United States Patent 10,766,935 (PLANT TRAITS CONFERRED BY ISOLATED POLYNUCLEOTIDES AND POLYPEPTIDES) - sequence listing, part 2

SEQ ID NO: 765 - DNA, 778 bp, Phaseolus vulgaris
tacccttgaaaccctagtgagaggagtgattagggtttttgtgtgcggcgactccagcgctctcctctgcagcattttccgtccaatcccttcaccatggctgaacaaaccgagaaggcgtttctgaaacaaccaaaagtgttcctcagttcaaagaaaactggtaaggggaagagacctggcaaagggggtaaccgtttttggaaatccattggtcttagttttaagactcccagggaagccatcgaaggaacctatattgataagaagtgccccttcactggcaatgtctctattcgtggccgtatcctagcaggaacatgtcacagtgctaagatgaataggactattgttgttaggaggaattatctccattttattaagaagtaccagaggtatgagaagaggcactccaatattcctgctcatatatcaccttgtttccgtgtgaaggaaggtgatcatgtcattattggacaatgcaggccactctccaagacagtgaggttcaatgtcttgaaagtgattcctgcaggatcttctagcggtgcaaagaaagcatttactggaatctgagctttgatttccagttttatgattttgttatactctgctgcctttgatcactagttttttactttttaagcaatgtagactcatcatgttttcagtctatttattttagtgttattttgggattgaagttggggaaattgtgttcagactcgaaatcaaggtttttgtcctaattaatgtgaaacatttatttttggtaaaa

SEQ ID NO: 766 - DNA, 754 bp, Phaseolus vulgaris
agtgagagaagtgactagggtttgtaggtgcggcaactccaacactctcctctgcagcattctccgagaaatcaaatacctttagcatggctgaacaaaccgagaaggcgtttctgaagcaaccaaaagtgttcctcagctcgaagaaaactggcaaggggaagagacctggtaaaggtggaaaccgtttttggaaatccattggtcttggatttaagactcccagggatgctatcgaaggaacatacattgacaagaagtgccccttcactggcaatgtctctattcgtggccgtatcctagcaggaacatgtcacagtgctaagatgaataggactattgttgttaggaggaattatctccattttattaagaagtaccagaggtatgagaagaggcactccaatattcctgctcatatatcaccttgtttccgtgtgaaggaaggtgatcatgtcattattggtcaatgcaggccactctccaagacagtgaggttcaatgtcttgaaagtgattcctgcaggatcttctagcggtgcaaagaaagcattcactggaatgtgagctttgatttccagtagtcttgtgattttgttatacgttgtggcctatgataactagttttttacttttcaaacaatgtagactcttccttttttcagtctatttatttagtgtttttttgtattgtgtttagactgaaaatcaaagtttttgccctaattaatgtgaaacaattatttttggtagaa

SEQ ID NO: 767 - DNA, 850 bp, Phaseolus vulgaris
aaggcagcgttttccctggaaacagccgtgagagaagtgactaaggtttgtaggtgcggcaactccagcactctcctctgcagcattctccgtctaatcaaatccctttagcatggctgaacaaaccgagaaggcgtttctgaagcaaccaaaagtgttcctcagctcgaagaaaactggcaaggggaagagacctggtaaaggtggaaaccgtttttggaaatccattggtcttggatttaagactcccagggatgccatcgaaggaacatacattgacaagaagtgccccttcactggcaatgtctctattcgtggccgtatcctagcaggaacatgtcacagtgctaagatgaataggactattgttgttaggaggaattatctccattttattaagaagtaccagaggtatgagaagaggcactccaatattcctgctcatatatcaccttgtttccgtgtgaaggaaggtgatcatgtcattattggtcaatgcaggccactctccaagacagtgaggttcaatgtcttgaaagtgattcctgcaggatcttctagcggtgcaaagaaagcatttactggaatgtgagctttgatttccagtagtcttatgattttgttatacgttgtggcctatgataactagttttttacttttcaaacaatgtaaactcatcttgttttcagtctatttattttagtgtttttttgtattctgtttagactgaaaatcaaaggttttgccctaattaatgtgaaacaattatttttggtagaatgcctttgtcattggaaactaaattgagagcatcagttctaggtcttaaatgtagtattggaaaccaaa

SEQ ID NO: 768 - DNA, 861 bp, Manihot esculenta
tcgtcatttgcttcctgcttcctagttcctatcatcagccaatactcgaccatggcggaacagacggagaaagcatttttgaagcaacccaagattttcctaagctctaagaaatctggaaaaggaaagaggcctggtaaaggtggaaaccgtttctggaaaagcattggattgggttttaagacacccagagaggccattgaaggaacttatattgataagaaatgcccttttactggcactgtttctatcagaggccgtatccttgccggcacttgccacagtgcaaaaatgaacagaaccattattgttcggaggaattatcttcacttcatcaagaaataccagaggtatgagaaacggcactcaaatatcccagcacacatatccccttgtttccgtgtcaaagaaggagatcatgttatcattggccagtgcaggccattgtcaaagaccgtgaggtttaatgttctgaaggtcattccagcagggtcttctactggtgcaaagaaggctttcacagccatttgagaggcatcattttatgttaccttataatgctggagacagctatcaaaaacttatatgagagaatagtggctgtttcatgatcatttagatgaattccatgaaagagcttagtccttgtttcctctagatttgttctagtcctttatattgttggaaatgagactgattgatgctaaatgtatgttgacgcaattttgagtgcattttttcgacttttttgttgtgggtgatgaattgtattcggttcttctcgagtgtttacatctttttagtattctaaccctttatttggattggaaaaaatgtagagaaaaaaggaaatttgggatt

SEQ ID NO: 769 - DNA, 811 bp, Manihot esculenta
ggctgggactagggtttggtctgcttagttagctttctttgcgacttcaacatccacgaatctcctctatcgctagccatggccgagcagaccgagaaggcatttctgaagcagcccaaggtattcctgagctcgaagaagtcaggaaaaggaaagagacctggaaagggaggtaatcgattttggaagagcattggattgggctttaagacacccagagaggcaattgaagggacttacattgataagaaatgcccattcactggtactgtttctatcagaggccgcatacttgctggtacttgccacagtgcaaagatgatgaggaccatcattgttagacggaattaccttcatttcattaaaaaataccagagatatgagaagcgtcactccaatattccagcacacatttccccatgcttccgtgtgaaagagggtgatcatgttatcattggccaatgcaggcctttatctaagacagtgaggttcaatgttttaaaagtaatcccagctggttcttctggtggtgggaagaaagcattcacagccatctgagtttcccaagttttagagatgtttcaattagttcctgtgagggaagattagttgagatttgagttaagacgttagacagtcttgtttcaattttgtacttgggttttaaatttttgaatgacaatataagttttctgggaatgatgttaattggtgtattattcatgcattattgttattgttttttcgaattgcgctgcaaataccaatctgttgattttaattctgagtgatatgctagcagttcattcat

SEQ ID NO: 770 - DNA, 840 bp, Catharanthus roseus
cccctttcaatttctcctggttcttcagctcataagttcacattctccgattaggttgttcattcagaccttgtgaccagcggacacaatcatggccgaacagacggagaaagctttcctaaagcagcccaaggtgttcctgagttcgaagaaggcagcgaagggaaagagaccaggaaagggaggaaatcgctactggaaaagcataggcttaggattcaagactccacgtgaggctattgaaggtacatatattgacaagaaatgcccattcactggcaatgtctcaatcagaggccgtatcattgctggcacttgccacagtgctaagatggtcagaacaataatcgttcgaagaaactatcttcactttgtcaagaagtaccagagatatgagaagcgccactccaacattccggctcacatttctccatgcttccgtgtgaaagagggagatcacattaccattggccagtgcaggccgttatcaaagactgttaggttcaatgtccttaaggtgattccagcggggtcctcctctggtgttgccaagaaagcttttacagggatgtgagtgagtgagtgtttgttttagtttctagaaaattattgccagacttacatacttcaatttgagtataaacttcaattttgattttaccgtgatggcttaaattttgcaatctgaaagtctatttattttggtttctcacgttgtttaagtttgagatgacttacatatttcttggaactgcccaaggtaagttccatttgtctgatcattttatattctactctcatgattggtttgtgtattattcaaaaatggatctattacgg

SEQ ID NO: 771 - DNA, 638 bp, Centaurea maculosa
tggcggaacagaccgagaaggcgtttctgaagcaacccaaggtgtttttatgctcgaaaaagagcgggaaagggaagaggcctgggaaaggtggaaacagattctggaagagtgttggtcttggttttaagacaccaagagaagctattgaaggaacttacatcgacaagaagtgccctttcactggtgatgtctcgatcagagggcgtatccttgctggtacatgccacagtgccaagatggtcaggaccatcattgctcgtaggaactacctccatttcgtcaagaaatatcaaagatacgagaagaggcattccaacattccagctcacatttctccgtgcttccgtgtgaaggaaggtgatcacgtgattgttggacagtgcagaccattgtcaaagacggtgaggttcaatgtgttgaaggttattccggctggatcttctggtggtggaaagaaggcctttaccggcttttagaatggttatgattatctttttcttgaatgagtgaaatgtggttgggtttaatgcttgtagttttcgtttattttttattatgagatgattgacgacaatccaagtcttgatttgatacattattatcattgctttagaaattagtaacttcgatcaaaa

SEQ ID NO: 772 - DNA, 684 bp, Chrysanthemum coronarium
aatggctgaacagactgagaaggcttttttgaagcaacccaaggtctttctttgttcaaagaagagtgggaaaggaaagaggcctggaaagggaggaaacagattctggaaaagtgttggtcttggcttcaagaccccaagagaggctattgagggaacatacatcgacaagaagtgcccattcactggtgatgtctccatcagaggacgtattcttgctggtacatgccacagtgccaagatggtgaggaccattattgttcgcagggactaccttcactatgtcaagaaatatcaaaggtacgagaagaggcattcaaacattcctgctcacatttctccttgtttccgtgtgaaagaaggggaccatgttactgttggacagtgcagacctttgtccaagaccgtgaggttcaacgtgttgaaggtgattccagctggatcttctggtggtggaaagaaggctttctcaggcatttaaagaaaggacttgtgcttgtttagcatgctaggttatgcaaaaacaatttattttgatttgctgattttgaagtgaaatgtggttcgagtatgaccttgttggtttaatgtttctgtagacggttgtttgctctagttttattatttatgttttgatggttacaaatcctttattattatcgcttaaatacatttggtttgtgt

SEQ ID NO: 773 - DNA, 704 bp, Chrysanthemum coronarium
ctattctctttgtgcctccgtttgtagttgcagcagctcttgttcttcaccaacaacaaaccacaatggctgaacagactgagaaggcgtttttgaagcaacccaaggtctttctttgctcaaagaagagtgggaaaggaaagaggccaggaaagggaggaaacagattctggaaaagtattggtcttggcttcaagaccccaagagaggctattgaaggaacttacatcgacaagaagtgcccattcactggtgatgtctccatcagaggacgtattcttgctggtacctgccacagtgccaagatggtgaggaccattattgttcgcagggactacctccactatgtcaagaaatatcaaaggtacgagaagaggcattcaaacattccagctcacatttctccatgtttccgtgtgaaagaaggggaccatgttaccgttggacagtgcagacctttgtccaagaccgtgaggttcaatgtgttgaaggtgattccagctggatcttctggtggtggaaagaaggcctttacaggcatataagaggcttgtgcttgtttagcatgttaggttatgcaaaaacaatttaatttgatttgctgattttgaagtgaaatgtggtttgagtacgaccttggtttaatgtttctgtagacgattgtttgctctagtcttatgttttacttttgatggttacaatta

SEQ ID NO: 774 - DNA, 757 bp, Chrysanthemum coronarium
attcttcgcttgtttcattctctttgtgcctccgtttatagttgcagcagcagctcttgttcttcaccaacaacaaacaacaatggctgaacagactgagaaggcttttttgaagcaacccaaggtctttctttgctcaaagaagagtgggaaagggaagaggccaggaaagggaggaaacagattctggaaaagtattggtcttggcttcaagaccccaagagaggctattgaaggaacttacatcgacaagaagtgcccattcactggtgatgtctccatcagaggacgtattcttgctggtacctgccacagtgccaagatggtgaggactattattgttcgcagggactacctccactatgtcaagaaatatcaaaggtacgagaagaggcattcaaacattccagctcacatttctccatgtttccgtgtgaaagaaggggaccatgttaccgttggacagtgcagacctttgtccaagaccgtgaggttcaatgtgttgaaggtgattccagctggatcttctggtggtggaaagaaggcctttacaggcatataagaggcttgtgcttgtttagcatgttaggttatgcaaaaacaatttaatttgatttgctgattttgaagtgaaatgtggtttgagtacgaccttggtttaatgtttctgtagacgattgtttgctctagtcttatgttttacttttgatggttacaactatggtattattgttgctgaagaattaaattctgattt

SEQ ID NO: 775 - DNA, 775 bp, Chrysanthemum coronarium
cttccgatcttaccacttcatcttcctacatttatccgccgtcaaaccttcaaatcaacaatggcagaacagaccgagaaggcttttttgaagcaacccaaagtgttcctctgttcgaagaagagtggaaaggggaagagaccagggaaaggtggaaacaggttctggaagagtattggtttgggcttcaagaccccaagagaggctattgaaggaacttacattgacaagaagtgcccattcactggtgatgtttccatcagaggtcgtattcttgctggtacatgccacagcgctaagatggtgaggactattatcgttcgaagggactatctccattatgtcaagaagtaccaaagatatgagaagagacactccaacatccctgctcacatctcaccatgtttccgtgtgaaggagggtgaccatgtcactgttgggcagtgcagaccattgtcaaagacagtgaggttcaacgtcttgaaggtgattccagcaggatcatcagggggtgggaagaaagcctttactggcatttaagtatactagtgcttcaactctttttgcttaattatgtaaaagttttctagaaccaaatttgactgatatcgttccatctacattaatatgctgttgtttctggtttttgccaacacttttgagagttattttaaggaattttgatattgggtatttgttctctatctacattggtgtacttgctcgtaaaaatagggtgtcgtgttggcttaacctaaaaatgtcttgtgtgccc

SEQ ID NO: 776 - DNA, 758 bp, Trifolium pratense
tcaaacttgagagagtgagagagggttttcgacgagtgcggctaaaattagggtttctcattttcctctgcaaaactctcgaatttcatcaccatggctgaacaaactgagaaggcttttctgaagcaacctaaagtgtttctaagctcgaagaaatctggaaagggaaagaggcctggaaaaggtggaaatcgcttttggaaatccgttggtcttggatttaagactcccagagatgccattgaaggagcctacattgacaagaagtgccctttcactggcaatgtttccatcaggggccgtattttagctggaacttgtcacagtgctaagatgaacaggactattattgttagaaggaattatcttcactttattaagaagtatcagagatatgagaagaggcattccaacattcctgctcatgtatcaccttgcttccgtgttaaggaaggagaccatgtaattatcggccaatgcaggcctctctccaagaccgtgaggttcaacgtcttgaaagtgatcccagctggttcatcgagtggtgctggaaagaaggcatttactggaatttgagatgtgttgaaagtaattcttatttctgtatgctgacttatataaagaccagttcaattttgttttgcttttgaatttcaagctctatcatttgataaaagttgaaagattttcctttgattattggttattaaatattaggagcattttatattgaatttttgcttcaaacagggattatc

SEQ ID NO: 777 - DNA, 877 bp, Coffea canephora
cggccggggggatcgcaaaccatatcccaagcttggtttctgcagctgacagcggtttctactgctagggttttagggtgtagctctcagccgcagtcatggccgaacagacggagaaggctttcttgaagcagccaaaggtgttcctttcctcgaagaagactggaaaggggaagaggccaggaaagggtggaaatcgctattggaagagcattggccttggcttcaagactcctcgtgaagctattgaaggtacatacattgacaagaagtgcccattcactggcagtgtttctattagaggccgcataattgctggaacttgccacagtgccaagatggataagacaattattgtcagacgcaactacctgcattttgtgaagaagtatcagagatatgagaagagacactcgaacattccagctcatatatctccatgcttccgtgtgaaagagggtgaccatgtcataattggccagtgcaggccactgtcaaaaactgtgaggtttaatgtgctgaaggtggttccagcaggcgcctccgggggtggaaagaaggcatttacagggctttgagtttagtgctttccatctcatgttaaagttcttgagagatgttgtcaagacttggtgttattagttaaaacttgtgtattaatttgcctctttaaggcttaaatttttgatactcccatggtgcagtttttggatttctagtcttggttagtaatcgtcagtcttattcataaaaatggtattggaatgatttttctttaaatggcatgagaacaatcggcaactggcttgataaggtctagaccttcgaggctatggtgcatgatgattttgcagataacctagaatggttatttgct

SEQ ID NO: 778 - DNA, 721 bp, Gossypium hirsutum
ctttgcccgcagcacatccgcgccacactctccaggaagctcatcaaccatggcggaacagaccgagaaagcatttttgaagcagcccaaagtgtttttaagctctaagaaaactggtaaagggaagagaccaggaaagggagggaaccgcttctggaagagcattggtttgggattcaagacccctcgtgaagctattgaaggaacttacatcgataagaaatgccctttcactggccctgtttcagtcaggggccgcatcttagctggtacttgccatagtgccaagatgatgaggacaatcattgttcgacggaactatcttcattatatcaagaaataccaaaggtacgagaagaggcattcaaacattcctgctcacatttctccatgcttccgtgtgaaggaaggggatcatgtcattattggtcaatgcaggccattgtcaaagactgtgaggttcaatgttttgaaagtgattcctgctgggtcttccggtggtgggaagaaagctttcactggaatgtaagggcgtgagtgttattttaaatatatatatgtgatagtttggggtttttaaaaacctatgaagaaggcactaagattttgatgaactaactacacatggaattttcaatatatttccaattattattattattgtaatgatcttgaagtatatggtatttgttattggttggaaggtttagcgttgtttcct

SEQ ID NO: 779 - DNA, 800 bp, Vigna unguiculata
ggagtgttgaagctcttattctccgcggctgcacgcttctgcagtttgaaacagagccctagtcatggctgaacagacagagaaggcttttctgaagcaaccgaaggtgtttctatgctctaagaaaggtgggaagggaaagaggccagggaaaggtgggaatcgtttttggaagtcaattggacttggattcaagactcccagagatgccattgaagggacctacattgacaagaagtgccctttcacgggcaatgtttccatccggggtcgtatcttagctggtacatgtcacagcgctaagatgacaaggaccatcattgttaggaggaactatcttcattttattaagaaataccagagatatgaaaagcgtcattcaaatattcctgcacatatatctccttgtttccgcgttaaagaaggagatcacgttattataggccaatgcaggccaatatcaaagacagtgaggttcaatgtgttgaaagtaattccagctggatcctctagcggtgcaaagaaggcatttactggaatgtgagatttccattttgtctatattaagtagtagaaacaccttgcggagaaatactgttcaaattcttcaaggttgagttaaatcgagtcaaattttgtgatcttttcaaagcttcttgagttaagtgattgtatgttaaggtttttgatgcacattatgattcttaaacaatagttacgattgtttctgtttctcagattatgtttacacatcttgtcttcacttatttttctactttagaatccaaacaagccataat

SEQ ID NO: 780 - DNA, 644 bp, Cyamopsis tetragonoloba
cacgaggcctaaccatggcggaacaaacagagaaggcttttctgaagcaaccaaaagtgtttctatgctcgaagaaatctgggaagggaaagaggcctggaaaaggtggaaatcgcttttggaaatccattgggcttggatttaagactcccagagaagccattgatggaacctatattgacaagaagtgccccttcactggcaatgtttccatcaggggtcgtatcctagctggaacttgtcacagtgctaagatgacaaggacaatcattgttaggaggaattatcttcatttcattaagaagtatcagagatatgagaagcgccattcaaatattcctgcacatatatcaccctgtttccgtgtgaaggaaggagatcacgttattattggacaatgcaggccaatctcaaagactgtgaggttcaatgtgttgaaagttatcccagctggatcttctagtggtgcgaagaaggcatttactggaatgtaaggaaggttatctaccagttagcaggagcttttgtttcaattacttgtaggtcatgactcaaagatctattcaattttggacatctttgaatactttgttttgaactgagtggttaaattaaaggattttggcgttatttttcctgaaaaa

SEQ ID NO: 781 - DNA, 606 bp, Echinacea purpurea
ctccattgttttctctttgtgcctccacctgtgcaaagctcggatcttttcaacaatggctgaacagacggagaaggcgtttttgaagcaacccaaggtgttcttatgttcgaagaagagtgggaaagggaagaggcctgggaaaggtggaaacaggttttggaagagtattgggcttggattcaagacacctagagaggctattgatggaacttacattgacaagaaatgccctttcacgggtgatgtctccattagaggtcgtattttagctggtacgtgccatagtgctaagatggtgaggactatcatcgttcgaagggactatcttcattatgtgaagaagtatcagagatacgaaaagaggcactcaaacattcctgctcacatttcaccatgctttcgtgtaaaagaaggcgaccatgttaccattgggcaatgcagaccgttatcgaagacagtgaggttcaatgtgttgaaggtgattccggcaggatcttcgagcggtggaaagaaagcgtttacgggcatataggcggctactagagtgctgtagtctttttgcttgattttgtacaagattttgagatgaaaactggagttatg

SEQ ID NO: 782 - DNA, 688 bp, Echinochloa colona
acacgacgactatctacgccgtgcgccgcttcgccgtcagtctcttcgagcatcaaccatggcggagcagactgagaaggctttcctcaagcagcctaaggtgttcctctgcccgaagaaggtcaccaagggaacaagcccggcaagggggcaacaggttctggagagcattggccttggcttcaagactcccagggaagccattgaaggaacctacattgataagaaatgcccattcactggcactgtgtcaattagaggccgcatcattgctggaacatgccacagtgctaaaatgaacaggactatcattgttcgcaggaactaccttcacttcgtcaagaaataccagagatacgagaagaggcactctaacatccccgcccacatttccccttgcttccgtgtgaaggaaggagatcacgtgatcattggccagtgcaggccactgtccaagactgtgaggttcaatgtgctgaaggtgatcccggctgggtcaaagagtggtgcagtgaagaaggcattcactgctgcctgaagaatgcctctaatattctgaaagctatagaccgtgagattttgatgtcactttctgtattcctattccatctgtactaggggtttgactgagaaaatattgtgcgaaattaaagtcaaagagcactgaattcagcaatattgttgagac

SEQ ID NO: 783 - DNA, 659 bp, Euphorbia peplus
cacaacccgcagccatggccgagcagacagagaaggctttcttgaagcagcccaaggtgttcttagcgtcgaagaagacgggcaaagggaaaagacctgggaaaggagggaaccgtttctggaaaagcatcggtttagggtttaagactccccgagaagctattgatggaacatatattgataagaaatgtccatttactggcactgtctcgatcagaggtcgcatccttgctggcacttgtcacagtgcaaagatgaacaggacaattatcgttaggcggaattacctccattttatcaaaaaataccagaggtatgagaagcgtcattccaatatcccagcacatgtgtccccatgcttccgtgtgaaggagggagaccatgttattattggacaatgcaggcctttgtctaagactgtgaggttcaacgtcttaaaagtgataccagctggttcgtctggtggtgtgaagaaagcattcacagccatttaagttatgcaggggtgtcattgaatttgattagtctttgtgaggatagttatatggattttgagctggctgtcttgcccaattagacaaatttattttggtgttgaatgttgaatttttgtactatcaaatattaatgtccttcgaaagttaaaagttttgtgctca

SEQ ID NO: 784 - DNA, 693 bp, Euphorbia peplus
tactctgctcctcagctgccgccgatttaccgccgatccagcacaatccgcagccatggccgagcagacagagaaggctttcttgaagcagcccaaggtcttcttatcgtccaagactactggaaagggtaagagacccgggaaaggaggcaaccggttctggaaaagcgtcgggttagggtttaagactcctcgagaagctattgaaggaacatacattgataagaaatgtccatttaccggtagtgtctcgatcagaggccgcatccttgctggtacttgccacagtgcgaaaatgaacaggacaatcattgttagacggaattacctccattttatcaaaaagtatcagaggtacgagaagaggcactccaacattcctgcacacgtgtcaccatgcttccgtgtgaaggagggagaccatgttattattggccaatgcaggcctttgtctaagactgtgaggttcaacgttttaaaagtgatcccagctggttcatctggtggtgtgaagaaagcgttcacagccatttgagttgtatgcaggggtatcttgaatttgattagtttttatggggatagttatatgagttttgaactgtttttgcccaattagacaatttcattttggtgttgaatgttcaatttttgtactattgaaatattaatgtccttggaaagttttaaaagttt

SEQ ID NO: 785 - DNA, 768 bp, Fagopyrum esculentum
atagtgtgagtttcagtcgctttatccttctctcgcgcctccgacgaaactgtaaacccacttccgaaggatccagccatggcggagcagaccgagaaggcatttttaaagcagcctaaggttttcctgtcttcgaagaaatcgggcaagggaaagagacctggtaaaggtggaaacaggttctggaagagcataggtttgggattcaagacaccgagagaagctatcgaaggaacttacatcgacaagaaatgccccttcactggaaccgtgtcagtcaggggccgcatccttgctggtacttgccacagtgctaagatgatgaggactattattgtccgtaggaactatcttcactgggttaagaaataccaaagatatgagaagaggcactccaatatccccgctcacatatctccctgcttccgtgtcaaagaaggtgaccatgttatcattgggcaatgcaggcccttatccaagacggtgaggttcaatgtgttaaaggtgattcctgctggctctgcggctggtgggaagaaggcatttacgggcatgtgattttcttgctggttggtggtggtagtacgaagttttagcgggttgttgacggaaattttgggtgttttcaagttgcatgtctgttttgaacctttttcctaaatcaatcagaaccctgtgctcctttatacagtttgtttttatagttttgcaaagtagaaaccaattggaaatgctaatgtttcttgcgtttaaggtctgttgcttatc

SEQ ID NO: 786 - DNA, 728 bp, Fagopyrum esculentum
ctgctgcgagtactagggttttggtgtgcggaggatcgtggtttcatttgctcaaacaccaaaccctaataatggcggaacagaccgagaaggcctttctcaagcagtcgaaagttttcctcagctcgaagaagagtgggaaaggaaagagacctggaaagggaggtaacaggttttggaagagcattggtcttggtttcaagacacctagagaggccattgaaggtacatacattgacaagaaatgtcctttcaccggcaccgtttctatccgaggccgtatcctaactggaacttgccacagtgccaagatgaacaggacaatcattgtgcgccgtaattatcttcactttgtaaagaagtatcaaaggtacgaaaagaggcattccaacattccagctcatgtctccccgtgcttccgtgtgaaggagggagatcacattatcatcggccaatgcaggccgttgtccaaaacagtgagattcaatgtgttgaaagttattcctgctggctcgtcatctggtgcgggaaagaaggcttttactgggatgtgaagccctctaaaggattttgcctttctacaacctaaattgattgatggtactgaagaggaacaatcaagaggccaagacgtttccaaatattgcatttttaaaaccttgaaaatcttacccagcatttttgtagcattgacttcaactatattctattttgttattgagatttat

SEQ ID NO: 787 - DNA, 761 bp, Fagopyrum esculentum
ccgattatagagcctctctcgcctcctgcaaatttgtgaaagccatcgtctacaagagatccagccatggctgaacagactgagaaagcatttcttaagcagcccaaggttttcctgtcttcgaagaaaactggtaaggggaaaagacctggtaaaggaggaaacaggttctggaagagcattggtttgggatttaagactcccagagaagccattgaaggtacttacattgacaagaaatgtcccttcactggaaccgtgtctgtcaggggccgcatccttgctggcacttgccatagcgctaagatgatgaggaccattattgttcggaggaattaccttcactgggtgaagaaatatcaaagatacgagaagaggcactccaatattcctgctcacatatctccttgcttccgtgtcaaagaaggagatcacgttatcattggccaatgcaggcctttgtccaagaccgtgagattcaatgttttgaaagtgattcctgctggctctgctgccggtggcaagaaggcatttacaggcatgtaattgtaatcttctcacttgattttcttgggtgcacacttgaatgttctaactagggagttatgaagctttagcagattgtagacggattatgattttgttcttctatgtcattgtttggagtgtttttgccattttgatattaaacagaatccttttgttctcctcatatctttctcctgcccattgtgcacggctgtcgtctttgatacttgccg

SEQ ID NO: 788 - DNA, 749 bp, Fagopyrum esculentum
ggacgcaagaacatctatctattatcttccctgcgcctccgacattaactgtgaacctaagaatccagccatggcggaacagacggagaaggcttttttgaagcagcctaaggtttttctaagttcgaagaaaacaggcaaagggaagaggcctggtaaaggtggaaacagattctggaagagcattggattaggattcaaaactcccagagaagcaattgaaggaacttacattgataagaaatgcccatttactggaactgtgtcagtcagaggccgcattctcgctggtacttgccacagtgctaagatgatgaggacaattattgtccgtaggaactaccttcattgggtgaagaaataccaaagatacgagaagaggcactcgaacatccctgctcacatatctccgtgcttccgtgttaaagaaggagatcatgttatcattggacaatgcaggcccttgtccaagactgttaggttcaatgtattgaaagtgatccctgctgggtccgctgctggtggcaagaaggcattcaccggcatgtaattttcgcacccattttcttactagtagactcgaatattactgtggagtatcgagttttagttgtttgtagacgaaaattttggttcatttcactttttcaagtgtttgtttcccttgaagaacacatatcgttcagctcctatatacttgcactccgatgtttcttcacacgtgttaaatgtgttttgagtcgtctaac

SEQ ID NO: 789 - DNA, 934 bp, Fagopyrum esculentum
gcggaggatcgttgattcatttgctcaaacaccaaaccctaataatggcagaacagaccgagaaggcgtttctcaagcagccaaaggttttcctcagctcgaagaagagtgggaagggaaagagacctggaaagggaggtaacaggttttggaagagcattggtcttggattcaagacacctagagatgccattgaaggtacatacattgacaagaaatgtcccttcaccggcacagtttcaatcagaggccgtatcctaaccggaacatgccacagtgccaagatgaacagaacaatcattgtgcgccgtaactatcttcactttgtgaagaagtatcaaaggtacgagaagaggcattccaacattccagctcatgtctccccgtgcttccgtgtgaaggagggagaccacactatcataggccaatgcaggccgttgtcaaaaacagtgagattcaatgtgttgaaagttatccctgctggctcatcatctggtgcaggaaagaaggcttttaccgggatgtgaagccctttcaaaaggtttttgcctttctacaacctaaattgattgatggcactgaagagggacaatcaagagaccaagacatttccaaatattgcatttttaataccttgaaaatcttacccagcatttttgtagcatcgactatgttctattttgttattgagatttatcagtatgatctagccttgcccaatgttttgctggatgaatgttttaagtttatatatgatccagcatcaaagaattgtatctttctccctgcctagcttaactattctgatccgtagtctgtgggcctgtaggagcctggatagttggatgagcatgcttgttgatgcattcagaatttcgacattggagaagtttaagagatgataactgcatcttaaatcaaaatgatgcatcga

SEQ ID NO: 790 - DNA, 837 bp, Fagopyrum esculentum
gggtttttagccgaatatagagcctttctcgcctcctgcaaatttgtgaaagccatcgtcttcaagagatccagccatggctgaacagactgagaaggcgtttcttaagcagcccaaggttttcctgtcttcaaagaaaactggtaaggggaagagacctggtaaaggaggaaacaggttctggaagagcattggtttgggatttaagactcccagagaagccattgaaggtacttacattgacaagaaatgtcccttcactggaaccgtatctgtcaggggccgcatccttgctggtacttgccatagcgctaagatgatgaggaccattatcgtcaggaggaattaccttcattgggtgaagaaatatcaaagatacgaaaagaggcattccaatattcctgctcacatatctccttgcttccgtgtcaaagaaggagatcacgtcattatcggacaatgcaggcctttgtccaagaccgtgagattcaatgttttgaaagtgattcccgctggctctgctgctggtggcaagaaggcatttacaggcatgtaatcttctcacttgatcttcttcggcgcacacttgaatgttttaactagggagttatgaagctttagcagattgtagacggatattatgattttcttgttctatgtcgttgtttggagtgttttttgctatactgatatcaaaccgagtccttttgttacccttatctctttctcctgtccattgtgttcggcttttcgtcttttgaaacttgcatatggaagtccaggattgacaaacatcattagggtctccgcctttgcctgaatgagcacaatgaatag

SEQ ID NO: 791 - DNA, 651 bp, Flaveria ramosissima
tgcctccgccactgagaagctcggatctcttcaacaatggctgaacagactgagaaggcgtttttgaagcaacccaaggtgttcttatgttcaaagaaaagtggaaaggggaagaggcctgggaagggtggaaacagattctggaagagtattggacttgggtttaagacaccaagagaagccattgaaggaacttacattgacaagaaatgcccttttactggtgatgtctccatcagaggccgtattcttgctggtacgtgccacagtgctaaaatggttaggaccattattgttcgccgggactaccttcactatgtgaagaagtatcagcgttatgagaagcgccattcgaacatcccagcacacatttctccatgtttccgcgttaaggaaggtgatcatgtcaccattggtctgtgcagaccattatccaagacagtgaggttcaatgtgttgaaggtgattccagctggatcttcaagtggcgggaagaaagcatttacaggcatataagacgctatatcgtcttgttaggctttgcaaaaaacagttcaatttgctctaattttgaagtaaaatgtgttttgattatgtaccttgttaaatgttctcctagacaaattatgtgctttaaaatcaaattttgtt

SEQ ID NO: 792 - DNA, 968 bp, Linum usitatissimum
gaaactagggtttaaggttaagagcatcgatttctcattctgcgcccatcgccttcttcatttttgccgctttcctcccactgctagctgttcagagaaaacaagcttttgattagccatggcggaacagaccgagaaggcatttctgaagcaacccaaggttttccttagctctaagaaaaccggcaagggaaagagacctggaaagggaggcaaccgattctggaagagcatcgggttgggtttcaagactcccagagaagcaactgaaggaacctacattgacaagaaatgccccttcactggaaccgtttctatcagaggccgtatcttggctggaacatgccacagtgccaaaatgatgagaactatcattgttagacgtaactatcttcattttgtgaagaaataccagaggtatgagaagagacactcaaatatcccagctcatgtttcaccatgcttccgtgtgaaggagggagaccatgttatcattggacaatgcaggcctctgtcaaagacggtgagattcaatgtgctgaaagttattcctgctggatcttctggtggtggaaagaaggccttcactgggatgtaaggtgttcttttttgtgttgaggtgatgatgatggatgaagtgttgtgggttattttggctattgtaagaggagtattcttgaaattaaaccgcctagttttgggcaattacatggaaacgaatagatgcttcctatcttgtctctgcataattttgtttttaatctgcttgtgcgggttgttggaaacacaagtgcacaatagtaattgtctttttttgtccatttcgtcgatcaatttctggttcttgcagctgttagatgttgtgtgtttgatatagccatgtactcatgttgctgctacacctttggtttgtttgttcgactttggctttgttctacagcaaggaagaatggatagcaaaaattgcc

SEQ ID NO: 793 - DNA, 912 bp, Linum usitatissimum
cttcttcagttttgccgctttcctcccgctgctagctcttcagagaaaacaagcttttgattagccatggcagaacagaccgagaaggcatttctgaagcaacccaaggttttccttagctctaagaaaaccggcaagggaaagagacctggaaagggaggcaaccgattctggaagagcatcgggttgggtttcaagactcccagagaagcaactgaaggaacctacattgacaagaaatgccctttcactggcaccgtttctatcagaggccgtatcttggctggaacatgccacagtgccaaaatgatgagaactatcattgttcgacgtaactatcttcattttgtgaagaaataccagaggtatgagaagagacactcaaatatcccagctcatgtttcaccatgcttccgtgtgaaggaaggagaccatgttattattggacaatgcaggcctctgtcaaagacggtgagatttaacgtgctgaaagtgattccagctggatcttctggtggtggaaagaaggccttcactgggatgtaaggtgttcttttttgtgctaaggtgatgatgatggatgaactgttgtggtggttattttggctactgtaagaggagtagtcttgaaattaaaccacctagttttgggcaattacatggaaacgattagatgcttgctatcttgtctctgcattattatttttaatctgcttatgcgagttgttggaaacacaagtacacaacaggatttgtctgttttttgttcattttgtcgatcaatttctggttcttgcagctgttagatgttatgtgtttgatatagccatgtactcatgttgctgctacagcctttgtttgttcgtttgttcggctttgttctaaagaaggaagaatgaataggaagaattg

SEQ ID NO: 794 - DNA, 745 bp, Linum usitatissimum
agttcgcgttattctaccagccttctgcatcttgcctcttctcccgctgttacaagcgttctctcaatcatggcggaacagaccgagaaggcatttctgaagcaacccaaggttttcctgagctcgaagaaaacgggcaagggaaagaggcctggaaagggaggcaaccgtttctggaagagcattgggttgggcttcaagactcccagagaagccattgaaggaacttatattgataagaaatgccccttcaccggcactgtctccattaggggccgtatcttggctggaacatgccacagtgctaagatgatgaggtcaattattgtccgtcgtaactatctccattatgtgaagaaataccaaaggtacgagaagagacactcgaacatcccagctcatgtctccccatgcttccgtgtgaaggaaggagatcacgttatcattgggcagtgcaggcctctttttaagacggtgagattcaatgttttgaaagttatcccagctggatcttctggcggtggaaagaaggcctttactgggatgtagagtgttacttgctgttcttttctgtctgtgttagggtttgatcaaacgaaacgctggacgatctttatagtctaatttttgacaattacaaacgctggacatacttgttcaacaacgtaatgccaattttgttttattggatatcctctaatgattatctgagttggtcttgttgaaacaaatcatttgggttttc

SEQ ID NO: 795 - DNA, 820 bp, Fraxinus spp
cggccgggggttgcgcgctagggtcttacgcctccttcttagtttctgaatacacaccagcacacactctagaactactcaaccatggcggaacagactgagaaggcgttcttgaaacagcccaaggtgtttctttgctcgaagaagactgggaagggaaagaggccaggaaagggaggaaaccgatacttcaaaagcgttgggctagggttcaagactcctcgcgaggctattgaaggcacatatatagacaagaaatgccccttcactggtgatgtgtccatcagagggcgtattcttgctgggacatgccacagtgccaagatgatgagaacaatcattgtccgtcgtaactacttgcattgggttaagaagtaccggagatatgaaaagaggcactcaaacattccagcacatatatctccatgcttccgtgtgagagagggtgaccatgttactattggccagtgcaggcctttatcaaaaacggttagattcaatgttcttaaggtgataccagctggatcgtctggtcttggcaagaaggcatttacaggaatgtgagtttggtgatttggctttttgttgttagttctaaagagtttttaaggatgatttaagactgttttacttctcccagttggtcgattgtcactcctgacttgcccatgggcttaattttcttacgttccaattcatatattctctattagtcagctttggaatttaatccatacaatttatattatgctcttattaattggattttctataatttatgctcccttctttatgggcattgtagataatatcttttata

SEQ ID NO: 796 - DNA, 652 bp, Fraxinus spp
tagggtcttacgcctccttcttagtttctgaatacataccagcacacactctagaactactcaaccatggcggagcagactgagaaggcgttcttgaaacagcccaaggtgtttctttgctcgaagaagactgggaagggaaagaggccaggaaagggaggaaaccgatacttcaaaagcgttgggctagggttcaagactcctcgcgaggctattgaaggcacatatatagacaagaaatgccccttcactggtgatgtgtccatcagagggcgtattcttgctgggacatgccacagtgccaagatgatgagaacaatcattgtccgtcgtaactacttgcattgggttaagaagtaccggagatatgaaaagaggcactcaaacattccagcacacatatctccatgcttccgtgtgagagagggtgactatgttattattggccagtgcaggcctttatcaaaaacggttagattcaatgttcttaaggtgataccagctggttcatctggtcttggcaagaaggcatttacaggaatgtgagtttggtgatttggatgtttttttgttagtgctaaagagtttttaaggatgatttaagactgttttacttcttccagttggtcgattgtcactcttgacttgccca

SEQ ID NO: 797 - DNA, 750 bp, Fraxinus spp
acgcgcaagggtttttcgcctcgtcagtttctgaatacacacaagcacacactctagcactactcgaccatggcggaacagacagagaaggcgttcttgaaacagcccaaggttttcctttgctcgaagaagacaggaaagggaaagaggccaggaaagggaggcaaccgatactggaaaagcgttgggctaggattcaagactcctcgtgaggctattgaaggcacatatatcgacaagaaatgtcccttcacaggcgatgtgtccatcagaggccgtattcttgctgggacatgccacagtgccaagatgatgagaacaatcattgttcgtcgtaactacttgcattgggtcaagaagtacaggagatacgaaaagaggcattcaaacattccggcacacatatctccatgcttccgtgtgagagagggcgaccacgttactgttggccagtgcaggcctttatcaaaaacggttagattcaatgttcttaaggtgataccagctggttcgtctggtcttggcaagaaagcatttacagggatgtgagtttggtgatttgaaatttttgttaggactttaaaagtcttggaagtatggttcaagactgttttacttctttcagttggtcgattgtcattactgaggctttgacttttctgagttgccaatttatataatctctagttgtcagttttcaaaattggatctgtgagttgaattttttctattctatgctgcctcttatac

SEQ ID NO: 798 - DNA, 731 bp, Zingiber officinale
tcgtgccgcttcttcttccgtatctgcggcacttggtctcctcgtacgcccgccatcatggcggagcagactgagaagccctttcttaagcagccgaaagtgtttcttagctcaaagaaatctggaaaggggaaaaaaccaggtaagggtggcaacagattttggaagaacattgggcttgggttcaagactccgagggaagccattgaagggacttatattgataagaagtgcccattcactggaaccgtgtcaattagaggccgcattttggctggtacgtgccatagtgcaaaaatgaacagaaccattattgtcaggagaaattatcttcactatgtgaagaaatatcaaagatatgagaagaggcattcaaacatcccagcacatatttctccctgtttccgagtgaaggagggtgaccatgttatcattgggcagtgcagacccttgtctaagacagtaaggttcaatgtgctgaaagtcattccagctggatcgactggtggcggtggcaagaaggcctttgtggctgcttgagagggctgtatttggagatgaaaagactgcccccggtgaaaagatttgtgttgtcgacctttaaaatgttcaagattgcctctagttttatgttaatttcattgtagaactggtttgtttcagaggtcttgcaggaatatttgaatcgttgtcattttaatatgcattctcaagttgagtagttgtctagc

SEQ ID NO: 799 - DNA, 730 bp, Gossypium raimondii
tcctctctttaccagttttcttagactttgcccgcagcacatccgcgccacactctccaggaagctcatcaaccatggcggaacagaccgagaaagcatttttgaagcagcccaaagtgtttttaagctctaagaaaactggtaaagggaagagaccaggaaagggagggaaccgcttctggaagagcattggtttgggattcaagacccctcgtgaagctattgaaggaacttacatcgataagaaatgccctttcactggccctgtttcagtcaggggccgcatcttagctggtacttgccatagtgccaagatgatgaggacaatcattgttcgacggaactatcttcattatatcaagaaataccaaaggtacgagaagaggcattcaaacattcctgctcacatttctccatgcttccgtgtgaaggaaggggatcatgtcattattggtcaatgcaggccattgtcaaagactgtgaggttcaatgttttgaaagtgattcctgctgggtcttccggtggtgggaaaaaagctttcactggaatgtaagggcgtgagtgttatttaaaaaaaaaaaaaatgttttggggttttagaaacctatgaagaaggcactaagattttgatgaactgactacacatggaattttcaatatatttccaattattattattattgtaatgatcttgaagtatatggtatttgttattggttggaaggttta

SEQ ID NO: 800 - DNA, 920 bp, Gossypium raimondii
acagcaagcgaatctctttcatttgcccgcactagcagcagcagcgccacactcttcacagtgctgatcaaccatggcggagcagaccgagaaggcatttctaaagcaacccaaagtgtttttaagctccaagaaatctgggaaagggaagagaccaggaaagggaggaaaccgcttctggaagagcattggtttgggcttcaaaacccctcgtgaagccactgaaggaatctacatcgacaagaaatgcccattcaccggcactgtttccatcaggggtcgcattttagccggtacttgccatagtgccaagatgataaggacaatcattgttcgacggaattaccttcattatatcaagaaataccaaaggtacgagaagagacattcaaatatccctgcacatatttctccatgcttccgtgtgaaggaaggagatcatgtcattatcgggcaatgcaggccgttgtcaaagactgtgaggttcaatgttttgaaagtgattcctgctggatcttctggtggagggaagaaagctttcactggaatgtgaggtgtaagtgttttcaatcaggagaagacattaaaatccctgaactgcctctagatatgaagaacctgggactattagatgtttttatgtttttgtttttcctttcctattacttgttatgtttggatttgtctagttatgacaactggaattttgaaggtatcccctattctagtatgatcctgttctctgaagaatcactctgatcacttacttagattatgtatgaaatttctggtgttctctattcacaaatgaagacattctgtaaattggcgaggggcatccattgtgcaaatgtgtggtgaaagtatcacaaaaccccctgtactatactttggattgcatgttagcccgtctactaaaa

SEQ ID NO: 801 - DNA, 724 bp, Vitis vinifera
ggtttctgcatctgaacaactctgctccttcgcctcttctcaccgctgcattctcttcagcgctctcaatcatggcggaacagaccgagaaggcatttctgaagcaacccaaagtgtttttatgctcgaagaaatctgcgaaggggaagaggcctgggaagggtggaaaccggttctggaagagcattggcttagggtttaagacaccccgagacgctattgaaggtacttatattgataagaaatgccccttcactggcactgtttctattaggggccgcatcttagctggcacttgccatagtgccaagatgatgaggaccataattgttcgaaggaactaccttcactatgtgaagaaataccaaagatatgagaagaggcactcaaacattcctgctcacacatcgccatgcttccgtgtgaaggaaggagatcatgttattattggccagtgcaggccactatcaaagacagtaaggttcaacgttttgaaagtgattcctgctggatcttctggtggaggtgggaagaaggcttttactgcaatgtgaagtttggcttctagttgtcagtgtcaagggtaaacatcatggagcttgagagggttggttatatgagagtagacctttgcaatcttgaacagcttcaagattgaaatattttgatggattctttttcttttttccttaaattaaatgttggagtttttgaagatgcccaa

SEQ ID NO: 802 - DNA, 684 bp, Glycyrrhiza uralensis
ggtctctcgactctctccacaaagctgagcttagggtttagtgtgcggctaccacattcccatcaccctcctctgtaaagctccgttcaccatggctgaacaaactgagaaggcttttctgaagcaacctaaagtgtttctaagctcgaagaaatctgggaagggaaagaggcctggtaaaggtggaaatcgcttttggaagtccattgggcttggatttaagactcccagggacgctatcgaaggaacctatattgataagaagtgtcccttcactggcaatgtttccatccgtggccgtatcttagctggaacttgtcacagtgctaagatgaataggactattattgttaggaggaactatcttcactttattaagaagtatcagagatacgagaagcggcactccaacattgccgcacacatatcaccatgtttccgtgtgaaggaaggagatcacgttattattggccaatgcaggccactctcaaagacagtgaggttcaatgtgttgaaagtgatcccagccggatcttctagtggtgcgaagaaggcttttactggaatctgagattttattgagtttttattgaaggacaatgttgccttgttagttactagtttgtaattctgatttatgtaaagtgacaaatataaagatcgtatcaattttggattgctttt

SEQ ID NO: 803 - DNA, 722 bp, Lotus japonicus
ggtttttagggtttctgagtgcagcttctcaacaccctcatcctccgaactcgccgcaagctcccttcaccatggccgaacaaactgagaaggcttttctcaagcaacctaaggtgtttctgagctcgaagaaatctgggaagggtaagaggcctggaaagggtggaaatcgcttctggaaatccattgggcttggattcaagactcccagagatgccattgaaggaacctatattgacaagaagtgccccttcactggaaatgtttccatccgtggtcgtatcttagctggaacttgtcacagtgctaagatgacaaggactattattgtcaggaggaattatcttcactttattaagaagtatcagagatatgagaagaggcattcaaacatccccgctcatatttcaccttgcttccgtgtgaaggaaggagatcatgttatcattggccaatgcaggccaatctcaaagaccgtgaggttcaacgtgttgaaggtgattccagctggatcttcaagtggggtgaagaaggcatttactggagtgtgagatttggttcagttgttttgaaggacaattttctttattagtaattttgatttctgcaagatgacatttataaaaatatgatcaattttggattgcttgaggttttgttctgtgattggtttaatgttatcagtattttggtatatgttatggttcttgggttcgagtagc

SEQ ID NO: 804 - DNA, 646 bp, Medicago truncatula
agtgagagggttttcgagtgcggcgaaacaaacaaacatacatttctcccaaacttcaccatggcggaacaaactgagaaggcttttctgaagcaacctaaagtgtttctatgctcgaagaagagtggcaagggaaagagacctggaaaaggtggaaaccggttctttaaatccgttggtcttggatttaagactcccagagaagccattgacggaacctacattgacaagaagtgccctttcactggcaatgtttccatccggggccgtattttagctggaacttgtcacagtgctaagatgaataggactattgttgttaggaggaattatcttcacttcatcaagaaatatcagagatatgagaagaggcactcaaacattcctgcccatgtatcaccctgctttcgtgttaaggaaggagatcatgttattattggccaatgcaggcctctctccaagaccgtgaggttcaacgtcttgaaagtgatcccagctggttcatcaagtggtgctggaaagaaggcatttactggaatgtgagatgtgttgaaagtaattctggtttctgtatggtgactaatatgaagacctgttcaattttgttttacttttgaagttaaattccgtcattggatacaagttg

SEQ ID NO: 805 - DNA, 862 bp, Cucumis melo
aatcaagactccttcggccgcctgagcaaaccacaaatcctcctctcttcacaatccctaatcatggcggaacagaccgagaaggcctttttgaagcaacctaaagtgtttctctgctctaaaaagactgcaaaagggaagagacctggaaagggcgggaaccgtttctggaagagtattggattaggattcaagaccccaagagatgccattgaagggacttatattgataagaaatgccccttcgctggaactgtctccatcaggggacgtattttagctggaacatgtcacagcgctaagatggttaggaccattattgtaaggcggaactacctacattatgttaagaagtatcagaggtatgagaaaaggcactcaaacattccggcccacatatctccttgctttcgtgtgaaggaaggtgatcatgttattattggccaatgcaggccattgtcgaagacagttaggttcaatgtgttgaaggtcattccggctggatcctcgagtcgtggaaagaaggcttttgctgggatttaaattatgatgtaggggtttccgctttcaatacaaaaagaaaaacaagcaagaaagaacttttgagagttgtagtaggccaatatttgatggaagaggggttttgaaagacttagcagcagtctggattttgatatgaatatggactgtttttttattgtgttctatttgttctgatttcttgtctaatttggggtattgaaagtaccaacttctcctggatctctattaggtaattctaatacatgtcagttttatattatgagattgtctttccactgcttgttttcagcatttcatttttatttttctttcttacctt

SEQ ID NO: 806 - DNA, 812 bp, Olea europaea
agtataaaatcttttggcttccgtcttcccttctatctgctgttgtgcgctagggtttttcgcctcttttatcagtttctgaatacacacaagcacacactctaggactacttgaccatggcggagcagaccgagaaggcgttcttgaaacagcccaaggttttcctttgctcgaagaagacgggaaagggaaagaggccaggaaagggtggcaaccgatactggaaaagcattgggctaggattcaagactcctcgtgatgctattgaaggttcatatatcgacaagaaatgtcccttcacaggcgatgtgtccatcagaggccgtattcttgctggtacatgccacagtgccaagatgatgagaacaatcatcgttcgtcgtaactacttgcattgggttaagaagtaccagagatatgaaaagaggcattcaaacattccagcacacatatcgccatgcttccgtgtgagagagggcgaccacgttattattggccagtgcaggcctttatcaaaaacggttagattcaatgttctgaaggtgataccagctggttcgtctggtctcggcaagaaggcatttacagggatgtgagtttggtgatttgaattttgtctcttaagactgttttacttctttgagttgttcgattgtcactactgaggttttgaattttctaagttgccaatttatatattctctagttgtcagtttttagaattgaatctctgtaagttggattttttctattctgtgtctgtccttcttatatctttagttggtttacgtggaatgtcgtacttctgtcg

SEQ ID NO: 807 - DNA, 773 bp, Orobanche aegyptiaca
tccttcactctacacgcgcacacacgctccgcaggacgcagccatggctgaacagactgagaaggcgtttctgaaacagcctaaggtcttcctttgctcgaagaaaactgggaagggtaaagctcctgggaaaggtggaaaccgctactttaagagcgttggattgggctttaaaacaccgcgcgaagcgatcgaaggtacatacattgacaagaaatgcccgttcactggcaacgtatccatcaggggccgtatcattgctggaacttgccacagtgcaaagatgatgaggactatcatcgtgaggcggaactaccttcattgggtcaagaagtaccaaagatacgagaagaggcattcaaatatcgctgcacacatatccccatgcttccgtgttaaggagggtgaccatgtcatcattggccaatgcaggccattgtcaaaaaccgtgcggtttaatgttcttaaggtaattccggcgggttcttcaggtctcgggaagaaggcttttgcagggatgtgagttcggcaatcctcgttttgtgttttttaaatgatgtgatgtttcagttggatgtattaccatcgactctacctggattgttgaagttcttcagttttgtgatatcttccattttagatgtttatcttatttaatcggaattttatctattaagagtttaatgatgcctgatgggtcattagtgatctattgatgtttttgtcattttagtatcttagtgttattggttatgaaccaaaaaaaaaaaaaa

SEQ ID NO: 808 - DNA, 789 bp, Carica papaya
cacgagggttttctttcttaccagttctgaattcaatcttcatatctaatcatggcggaacagactgagaaggcgttcctgaagcagccgaaggttttccttgcctcgaagaagtcagggaaaggaaagaggccaggaaaaggaggcaaccggttctggaagagcattggtttgggattcaagacaccaagagaggcaattgaaggcgcttatattgacaaaaagtgccctttcactggcactgtttccatcaggggtcgcattctagctggtacttgccacagtgcaaagatgggaaggaccatcactgtccgacgcaactatcttcattttgttaagaaataccagagatatgagaagaggcattctaatattccagcgcatatatcaccatgcttccgtgttaaggagggggatcatgttattattggccagtgcaggcctttgtcgaagacagtcaggtttaatgtgttgaaagtgatacctgcggggtcatctagtgggggtaagaaggcatttactgggatgtgaactttagatcttttattccagaaacctttgaatattgctaaaagttcttacgaaatgttatttaatttttcctcttcataatgaatagtttcttttcatggaatgtttttgtatttggaaaaatttgccactttgttcttcaatggttacaagtgctttgttcagtgctttgtatctttagtatactttctacttctcttgtcatgctactgttgctataggcgaaatgttgactctattatatagtgctttgtttaa

SEQ ID NO: 809 - DNA, 754 bp, Arachis hypogaea
gtgctgttctttgctgctgttcgttctctctgctgcttgcaccacgcaccttccaggattcaccaatggcggaacagacggagaaggctttcttgaagcaacccaaggttttcctctgctcgaagaaatcagggaaagggaagaggcctggaaaaggaggcaacaggttctggaaaagcattggtttaggttttaagactcccagagaggctattcaagggacttacattgacaagaaatgcccattcactggcactgtgtccatccgaggtcgcattcttgcaggtacttgccacagtgccaagatgaccaggactatcatcgttcgtcgcaactatcttcatttcattaagaaataccaaaggtacgagaagaggcactcaaatatcgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccaatcccatttcccagattagatttaggaactcgcctgtgtgatttcctaaattcgtttaggagggatttatatttgtatgcttttgatttgattttttattccagtctcttttttttcccaccctaacagctgtgttatcagttttgacttttgatgtttaaaatatacaattagtcctttagtttctggcaaaa

SEQ ID NO: 810 - DNA, 798 bp, Arachis hypogaea
gtggtatcaacgcagagtacggggggagggttttgcgtgctccgtgctgttctttgctgctgttcgttctctctgctgcttgcaccacgcaccttccaggattcaccaatggcggaacagacggagaaggctttcttgaagcaacccaaggttttcctctgctcgaagaaatcagggaaagggaagaggcctggaaaaggaggcaacaggttctggaaaagcattggtttaggttttaagactcccagagaggctattcaagggacttacattgacaagaaatgcccattcactggcactgtgtccatccgaggtcgcattcttgcaggtacttgccacagtgccaagatgaccaggactatcatcgttcgtcgcaactatcttcatttcattaagaaataccaaaggtacgagaagaggcactcaaatattgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccgatcccatttcccagatattagatttaggaactcgcgtgtgtgatttcctaaattcgtttaggagggatttatatttgtatgcttttgatttgatattttattccagtctcttttttttttcccaccctcacagctgtgttttcagttttgacttttgatgtttgaaatacaattagtcctttagtttctggcaaa

SEQ ID NO: 811 - DNA, 818 bp, Lippia dulcis
ctgctgctgctcctgcgcctccgttgcttctcatcactctcacacacatttcacccatggcggaacagacggagaaggcatttttgaagcagcccaaggtcttcctttgctctaagaagtctgggaagggcaaggcgcctggaaagggagggaaccgctactttaagagcattgggttaggattcaagacacctcgcgatgctattgaaggcacatacatcgacaaaaaatgcccattcaccggcagtgtatccatcagaggccgtatcattgctgggacctgccatagtgcgaagatggtgagaactattattgttaggcgtaactacctgcactgggtcaagaaataccaaagatatgagaagaggcattcaaatattcctgcgcacatatccccatgcttccgtgtgaaggagggtgaccatgtcatcatcggccagtgcaggcccttgtcaaaaactgtgaggtttaatgtacttaaggttattccagctggttcttccggtcgtgggaagaaggcttttacagggatgtgaattgcgtaatctgaattttcatgttaaagagaggtggttgaatgactgttttagacaattctctttcagttagaacttttagttttgactctgccatggtggcttaaatttttgtattttgtgaatttatgttctccagcatccttttctgatatttatgaaatttagagtaaatcttcaaggattttatatgcttttttaactattgtggaacttgctatgaaagatatgttggtcacattctgtagatttattttaccttttcatttatgaatttgaatt

SEQ ID NO: 812 - DNA, 880 bp, Platanus occidentalis
ttttcttgtcgtgcagactccacgcctcttcttctctgaaaagctgtagatcatggcggaacagaccgagaaggcatttttgaagcagccgaaggtgtttttatgctcgaagaaatctgggaagggaaagaggcctgggaagggcggaaaccgattctggaaaagcgttggtttggggtttaagactcccagggatgctaccgaaggaacatatattgataagaaatgtcccttcactggcaacgtttccatcaggggccgtattctggcaggcacctgccacagtgctaagatgatgagaacaatcattgttcgtcgcaactaccttcactatgtgaagaaataccagagatatgagaagaggcactccaatattcctgcccacgtatctccatgcttccgtgtgaaggagggggaccatgtgatcattggccagtgcagaccattgtccaagacagtgaggttcaatgtgttgaaggtcattccagctggatcctctggtggggggaagaaggctttcacagcaatgtaaggtgtctccagatttcacctatactgtgggtgtcctggattttttgtgttttaagatcaagttgtaggagaacaaacagccatgggccatttccatgcattcatgtgtctttaaattttagttttttgacattttcggtattttgtttatgttgatacaagacaaggtagcattaatttttccagttttgaactccattttattatcagtttttggtttgcaagagtacatacatttttttttctcggccccattgttaattggagcttccagaggatagaagacgatgaaatcatatcttctggtttggttttgtaggttcttgaatggtaacaatcaggattgcaa

SEQ ID NO: 813 - DNA, 909 bp, Populus trichocarpa
tagggatcccattatagccgctagggttttctttcttgttctcttcgcagcgccaacagcagcagtagcgccagcagcagcagacatctctcaacaaccaccgccatggctgagcagacggagaaggcatttttaaagcagcctaaggttttccttagctcgaagaaaactggaaagggaaagaggcctggtaagggaggaaacaggttctggaaaagcattgggttgggtttcaagacacccagagatgccattgaaggaacttacattgataagaaatgcccattcactgggacagtttctatcagaggacgtatcttgtctggtacttgccatagtgcaaaaatgaacaggaccattatcgtgaggaggaactaccttcactgggtcaaaaaataccagagatatgagaagaggcactcaaacatcccagcacacatctccccatgcttccgtgtcagagaaggagactatgtcatcattggtcaatgcaggccattatcaaagacagtgaggttcaatgtgttgaaggtaattccagcaggatcttctggtggtgcaaagaaagtttttacaggcatgtaagaggtttgattctcaaatgatgtgatgctgccagagattcatatacctataggcgatcttggatgttttatcagccttcagattaaatgaacggatccttttgttttccttgtatcctagattttggtctgtttctgttactatcaaggatgatctagattgaaattttgaggatattaattgctttattttgctgggtgttatgttatttctgattttcgtcagtaatattcatcctttccaaatctctcccaccaagagttttctcctgtctggaacaagttttttatggctccttttcctatctgcaattgtattgcctca

SEQ ID NO: 814 - DNA, 614 bp, Salvia sclarea
agggtttttgctgctaccgccctccacacacacacgcacacacacactttgatagcgcgcagccatggcggaacagaccgagaaggcttttttgaagcagcctaaggtgtttctttgctcgaagaagacagggaagggtaaggccccaggaaagggtgggaaccgctactttaagagcattgggctcggattcaaaacaccccgcgaggcttctgaaggcacatacattgacaagaagtgccccttcactggtgatgtatccatcagaggtcgtatccttgctggaacttgccacagtgctaagatgatgagaacaatcatcgtgagacggaactacctgcactgggtgaagaagtaccaaaggtatgagaagaggcattccaacatccctgcacacatttccccatgcttccgtgtgagggaaggtgaccatgtcatcatcggtcaatgcaggccattgtccaaaaccgtgaggtttaatgttcttaaggtgattccggctggttcttctggtcttgggaagaaggcttttacggggatgtgagttaggcgatatgaagtttgctcttagttgttaaaactgtttttgaaaggatggattttgaatttctatt

SEQ ID NO: 815 - DNA, 800 bp, Senecio madagascariensis
cgaggtacgcgggggccttgttgagttatatttgtgtgtgcctccatccgccactgttttaaaaaaagctcggattttttcaacaatggctgaacagactgaaaaggcgtttttgaagcaaccaaaggtctttctatgttctaagaaaagtggaaaaggaaagagacctggaaagggtggaaacagattctggaagagtatcggtcttggtttcaagactcccagagaggctattgaaggaacttacatcgacaagaagtgccctttcactggtgatgtttctatcagaggccgtattcttgctggtacatgccacagtgccaagatggttaggaccattatcgttcgtagggactacctccattatgttaagaaatatcaacgttatgagaagaggcactccaacattccagctcacatttctccatgtttccgtgtgaaagaaggcgaccacgtcactgttggacaatgcagacctttgtccaagactgtgaggttcaacgtattgaaggtaattccagctggatcttctggcggtggaaagaaggcgtttacaggattttaagtaagatagttcgacgtactgaaggggatgccagctggatcttctgatggcgaaagaaagcgtttataggctttgaagaaagtatgtctgtaggtttttttttttaagcaaaaacaattcaatttgatttgctccatgttgaagtgaattgttggttttgttgcgtacttggtttgctctagtttcttatggctttactttttatggttatgaatatcgaattatttaaaattac

SEQ ID NO: 816 - DNA, 726 bp, Sesamum indicum
gttttggctgccgctcttccctcaccatctttcaacacgcatacgcacacagtagcacgcagcaatggcggaacagactgagaaggcgttcttgaagcagcctaaggtgttcctttgctccaagaaatcggggaagggtaaggctcctggaaagggagggaaccggtactggaagagcattgggttaggattcaaaacaccacgcgaggccattgaaggcacatacatcgacaagaaatgcccattcactgggagtgtgtccattagaggccgtatccttgccgggacctgccacagtgcaaagatgatgaggacgatcgtagttaggcggaactacctgcattgggtgaagaaataccagagatatgagaagaggcattcaaatattcctgcacatatatccccatgcttccgtgtgaaggaaggtgaccatgtcatcattggccagtgcaggcccttgtcaaaaactgtgaggtttaatgttcttaaggtgataccagctggttcttctggtcgtggaaagaaggcttttacagggatgtgagttaggcaatctgaatttcatgttaaatgttaagggtttatcgaaggatggcttttagacttttgcttttcagttggaactattaccattaactttgccttgatggcttaaatttttgtgttttgtgaacttatactctttattagcctttctgttgatacttctcaaaaagagtatggggc

SEQ ID NO: 817 - DNA, 825 bp, Glycine max
gagcggccgcctgcaggaaagagagaagttattagggtttttgagtgcggcggtccaaacactcttctctgcagcttttgcctacaactcccttcaccatggctgaacaaaccgagaaagcttttctgaagcaaccaaaagtgtttctcagcacaaagaagactgggaagggaaagagacctggaaaaggtgggaaccgcttttggaagtccattgggcttggatttaagactcccagggaagccatcgaaggaacctatattgacaagaagtgccccttcactggcaatgtttccatccgtggccgtatcttggctggaacatgtcacagtgctaagatgaacaggactattattgttagaaggaattatctccattttatcaagaagtaccagaggtacgagaagaggcactcaaatattcctgctcatatatcacctgccttccgtgtgaaggaaggggatcacgttattattggtcaatgcaggcctctctctaagacagtgaggttcaatgtcttgaaagtgatcccagctggatcttctagtggtgcaaagaaggcttttactggaatgtgagcttcgatttccagtttttattgaagaaaaatgttaccttgttatttagtagatctgatttcttttctggaaggtgacatattaaaaccttatcaattttggattttctttgaggtttcgttcgggctttatgtttaggattttgttatacattatgtttttcgaatactatttgccttttaatttttgaaactatgcagactcttcatttgctttaccagtaatatatttagtttactcgggtttc

SEQ ID NO: 818 - DNA, 722 bp, Euphorbia esula
gctgctccatctttgtgtgctcttcgcttctcatcacaacccgcagccatggccgagcagacagagaaggctttcttgaagcagcccaaggtgttcttagcgtcgaagaagacgggcaaagggaaaagacctgggaaaggagggaaccgtttctggaaaagcatcggtttagggtttaagactccccgagaagctattgatggaacatatattgataagaaatgtccatttactggcactgtctcgatcagaggtcgcatccttgctggcacttgtcacagtgcaaagatgaacaggacaattatcgttaggcggaattacctccattttatcaaaaaataccagaggtatgagaagcgtcattccaatatcccagcacatgtgtccccatgcttccgtgtgaaggagggagaccatgttattattggccaatgcaggcctttgtctaagactgtgaggttcaacgtcttaaaagtgataccagctggttcgtctggtggtgtgaagaaagcattcacagccatttaagttatgcaggggtgtcattgaatttgattagtctttgtgaggatagttatatggattttgagctggctgtcttgcccaattagacaaatttattttggtgttgaatgttgaatttttgtactatcaaatattaatgtccttcgaaagttaaaagttttgtgctcaattattgcatacgtacttctggttttact

SEQ ID NO: 819 - DNA, 726 bp, Helianthus annuus
tccacaggtgaaagaaaagctcggatctcttcaacaatggcggaacagacggagaaggcgtttttgaagcaacctaaggtgtttttatgctcgaagaagagtggaaaagggaagaggcctgggaaaggtggaaacagattctggaagaatattggtcttggatttaagacacctagagaggctattgaaggaacttacatcgacaagaaatgccctttcactggtgatgtatccattagaggacgtattcttgctggtacatgccacagtgcaaaaatggttaggaccattattgttcgccgggactacctccattatgtcaagaagtatcaaaggtacgagaagaggcactcgaacattccagcacacatttctccatgttttcgtgtgaaagaaggtgaccatgtcaccattggacagtgcagaccactgtccaagaccgtgaggttcaacgtgttgaaggtgatcccagctggatctgccagtggagggaagaaggcgtttacaggcatataagaaaagcttatctttcctgttttgttaggttttgcaaaaacagtaaacattgatttgcagattttgaattgaaatgtggtttggttatgttgaagatttatgtagactctagtcttcttttacctaagacatgataatttaccattttgtgttatgcaacatgtgttggtgaactgagtttgtctcttttctttgaaaaggttttatttt

SEQ ID NO: 820 - DNA, 815 bp, Trigonella foenum-graecum
ttaaaattagggtttctgaaaatctgagagggttttttcagtgcggctaaacaaacacaaccttcttcttctcctctgcgaaattcccaaattccaccatggctgaacaaaccgagaaggcttttctgaagcaacctaaagtgtttctatgctcgaagaaaagtggaaaggggaagagacctggaaaaggtggaaaccgcttctggaaatccgttggtcttggatttaagactccaagagaagccactgaaggaacctacattgacaagaagtgcccttttactggcaatgtttccatccggggccgtattttagctggaacttgtcacagtgctaagatgaataggactattattgttaggaggaattaccttcactttattaagaagtatcagaggtatgagaagaggcattcaaacattcctgctcatgtatcaccttgcttccgtgttaaggaaggagatcatgttattattggccaatgcaggcctctctccaagacagtgaggtttaacgtcttgaaagtgatcccagctggatcatccggtggtgttgggaagaaggcatttactggcatgtgagatgctttgaaagttattctgatttctgtatggtgaccaatataaagacctgttcaattttgttttgctttttaagttaaattctgtcttttgttaaaaattgaaggattttgattttgattttgattatggatacatagcagtagcatttatattgaatattggctttaaacaagaattatcttgcttctagaaggttgaaaaagacatctcaatttctgataagaaatcaat

SEQ ID NO: 821 - DNA, 870 bp, Trigonella foenum-graecum
gagtacggtgcggctacacttcctctgcaactcaaaccaccatggctgaacaaactgagaaggcttttctcaagcaacccaaagtgtttctatgttcgaagaaatctgggaagggaaagaggcctggaaaaggtggaaatcgcttctggaaatcagttggtcttggattcaagactcccagagaagccactgaaggaacctatattgacaagaagtgtccattcaccggtaatgtttccatccggggtcgtatcttagctggaacttgccacagtgctaaaatgaataggactataattgtcaggaggaattaccttcactttattaagaagtatcaaaggtatgagaaaaggcattcaaacattccagctcacgtatcaccttgcttccgtgttaaggaaggagatcatgtcattattggccaatgcaggccactctccaagacagtgaggttcaacgtgttgaaagtgatcccagctggatcatctggtggtgtaggaaagaaggcctttactggaatgtgagatttgaatgactttcgtagcatagagatcttatcatctgtgatgaaagtaattctgatttctgtatggtgtagttccagatcaaattatgggatggtttgcttttgaagttatgtacttttcgttattatggtttttttatcgggacatgatgttatgatggttattaaatactagttgcaattattttgaattttagcttctgaatggaatttcttacttatagagaagggtataatacaaaatctcaattctttataagaaatcaatgtgaagtattgagacaagtagatgttatgcaacatagaacaccattttacaatcttgaaagtgaacggaagcttac

SEQ ID NO: 822 - DNA, 633 bp, Utricularia gibba
cggcggagcagacggagaaagcgtttttgaagcagccgaaggtttttctttgttcgaagaagtcagggaagggtaaggcaccgggcaagggtggaaatcgcttctggaaaagcattggattaggctttaagacgcccagggaggctattgaaggaacatacatagacaagaaatgccccttcacaggcaccatctcaatccgaggtcgcatccttgctggtacatgccacagtgccaagatgacacgaaccattattgttcgtaggaactatctgcactgggtcaagaagtaccagaggtatgagaagaggcactccaacataccagcccacgtctccccgtgcttccgcgtcaaggagggtgatcatgtcatcattggccagtgcaggccgttgtcgaaaacggtgagattcaatgttctgaaggtgatacccgccggttcatccggacagggaaagaaggcctttacagggatgtgagttcagctaatctgtttcaagatcttccagcttcttcctcaagttgctcctttgcccatttttatccagaagttcttgttggaattctatcttcgctgaaacaactcccaactttgatgagatatcgtgtcgcgctactgtcatttcctattta

SEQ ID NO: 823 - DNA, 613 bp, Utricularia gibba
agccgcgggaactcttctagctgctttctacaatggcggaacagactgagaaagcgttcttgaagcagccgaaggtttttcttagttcgaagaagtcagggaagggtaaggcaccgggaaagggtgggaatcgcttctggaaaagcattggattaggcttcaagacgccccgggaggctattgaaggcacgtacatcgacaagaaatgtcccttcacaggcacaatatccatccgaggccgtatccttgctggtacgtgccacagtgccaagatgacaagaaccattatcgtccgaaggaattacctgcattgggttaagaagtaccagaggtatgagaagaggcactctaacataccagcccacgtctccccatgtttccgtgtcaaggaaggtgaccatgtcatcattggccaatgcaggccgttatcgaaaactgtgagattcaatgttctgaaggtgattccagctggttcatccggacaggggaagaaggccttcaccgggatgtgagtttagtattctgttttttgatgaacactgtacctgtttccagatcccccagttttccccttctcgtgttcattactgatcctgaaatactcgtttgaatt

SEQ ID NO: 824 - DNA, 760 bp, Vicia sativa
gctctaccaaaaatctgagccagaaggtattcaactccgtgcggcttccccaacaatctcttccgcaattccaccatggctgaacagactgagaaggcttatctgaagcaacccaaggtgtttttatgctcaaagaaatctggcaagggtaagaggcccggaaaaggtggaaatcgcttctggaaatccattgggctcggattcaagacccccaaagaagccatcgagggagcctacattgacaagaagtgtccattcactggcaatgtttccatccgtggtcgtatcatagctggaacttgtcacagtgcaaaaatgaataggactattattgtcaggaggaattatcttcacttcattaagaagtatcagaggtatgagaagaggcattcaaacatcccagctcatgtgtcacctgccttccgtgttaaggaaggtgatcatgtcattatcggtcaatgcaggcctctctccaagacagtgaggttcaatgttttgaaagtgatcccagctggatcatccagtggtgcaaagaaggcatttggtggaatatgagatttcgttggccctcgtagtatagagatcttatcatctatgttgaaagtaattccgatttctgtatggtgaagttcttaacaattttgataattttggtttgcttttaaagttctgtactctgatttgataagatggtttaattatgtttatttttccagacatatgttattatggttattcaatactagttgcaatttttttg

SEQ ID NO: 825 - DNA, 796 bp, Juglans hindsii x Juglans regia
tgtcttggccgccgatccccctcgcccccgactggtcattacagcttgagagctcccctaatcatggctgagcagaccgagaaggcatttcttaagcaaccgaaagtgtttttatgctcgaagaagtctgggaaggggaagagacctggtaagggcgggaaccgtttctggaagagcgttggtctcggtttcaagactcccagagaagctattgaaggaacctacattgataagaaatgccccttcactggcaatgtttctatcagaggtcgtatcttagctggcacttgtcatagtgccaagatgatgaggacaattattgttcggaggaattatcttcattttgtcaagaagtaccaaagatatgaaaagaggcactcaaacattgctgcgcacatatccccgtgcttccgtgtgaaggaaggagattatgtcactattggccagtgcaggccattgtcaaagacagtgagattcaatgttttaaaagtcattcctgctggatcttctggtggtgggaagaaggcttttactggaatttgatgttgttttccgtcttaaattgctcatcatggttttgatggagctagtcatccactagaagacttttgaagtttagaaaagcatcttgatggggtgaacctggacttctaaatgctttgtgccttttgtttttcaacatgattttgacctcttttttagtactgttttagttgtggtattctaaatacactatggttcttcgagtggaatccaccttttagatcttagttgccatgtatttcttgcattagac

SEQ ID NO: 826 - DNA, 1221 bp, Cocos nucifera
ttacaactcaagctcaaacttgaatacggctcaattgacattcaaatcaaatcaattttgaatattatcttatttttattaaatttaggatattaaacctcatacggcttggctcaaatttcaaatccaagtatttttaacggaatcaagctcaaatccctagctgcatggctcacttggttcaattgctgtcagcatgtgatattgaatggtattgccttgtaccggtaccctgcatgcagtcatatcttttaaaccatgcaacagccctggaaagacatgcaatttcataggtaagactggtattcagcggaaatccagcgaaaaaggagttcacttctgtttaaacagcattagtttcttcattcagaaagcaaaactgagaactagctttggagagttcttaaagcgaccaacgggataactcctggtcaaatggcatttagttcattcaaagagctcaattcaaaactgaacctactccaaccaactgcaacatgtaagaacacaatgttaaaaacttcagattgcagtgaaggccttcttcccactaccaccttttgatccagctggaatgacttttagaacattgaacctcacagtcttggacaatggcctgcactggccaatgataacatgatctccttccttcacacggaagcatggggatacgtgtgctgcaatatttgaatgcctcttctcatacctctgatacttcttcacgtagtggaggtaatttctacggacgataatggttctgttcatcttggcactatggcatgtgccagctaaaatgcggcccctaatagaaacactaccagtgaatgggcatttcttgtcaatgtatgttccttcaatagcttccctaggagtcttgaatccaagaccaatgttcttccagaagcggttcccacccttaccaggtctcttccccttgctagatttcttcgagcaaaggaaaacctttggctgcttaaggaaagccttctcagtctgttccgccatgattgaacgaagcagaagtaccggaaaagggtcagggggagggggatggagacggcggaggaaaacggcgggatgaaagaagagaccggatagaccctacttttatacagtacaggttttgggtttgggttagggttttcggccatcaagcccaagagccccagtaaccggctggcggtggaatgagaagggcctatccggtctcttctttcatcc

SEQ ID NO: 827 - DNA, 630 bp, Flaveria ramosissima
caaagctcctaatttgtgatcaacaatggctgaacaaaccgagaaggcgttttgaagcaaccgaaggtgttcctctgctcgaagaaaagcggcaagggaaagaggcctgggaagggtggaaacagattctggaagagtattggtctcggatttaagacgcctagagaggctattgaaggaacatacattgacaagaaatgcccttttactggtgatgtatccattagaggccgtattttagctggtacttgccatagtgctaagatggtgaggactattatcgtacgaagggactatcttcattatgtgaagaagtaccaaaggtatgaaaagagacactcgaacatccctgctcatatctcgccatgttttcgtgtgaaagaaggtgaccatgttatcattgggcaatgcagaccattatcaaagacggtgagattcaatgttttgaaggtcattccagcaggatctgcaactggtggtaagaaagcatttacaggcatatagagtaacattagcgttggaactcttttgcttgatcgtgtaaaagcttttgagaacaaatcggagttgtgtcgtttcattgacagttgttgttctgttgttttcagtgtactttgaaacacttgatag

SEQ ID NO: 828 - DNA, 712 bp, Arachis hypogaea
agaagtgagtacagattagggtttctgagtgcggctctcattctgcgactctgcaactttcgccgttaaccccttcacgcgtcacaatggctgaacaaaccgagaaggcttttctcaagcaacctaaagtgtttctatgctcgaagaaaagtgggagggaaagaggcccggaaagggtggaaaccgtttctggaaatccattggccttggatttaagactcccagggatgccattgaaggaacctatattgacaagaaatgcccctttacggaactgtttccatccgtggccgaatcttagctggaacttgtcacagtgctaagatgaataggactatcattgttaggaggaattatcttcattttatcaagaagtatcagagatacgagaaaagacattcgaatattcctgcacatatatcaccctgcttccgtgtgaaggaaggagatcatgttattattggccaatgcaggccactttcaaagacggtgaggttcaatgtgttgaaagtgatcccagctggatcttcaagtggtgcaaagaaggcatttgctggaatttgagatttgattcagttttttgttgaaggataatgttatcttattagttagtaaaactgattcctggaagattatcatataaagatatgatcaattttggatttcctttaagattatgtttgtgaatgaccaagtgttatccttttaaatt

SEQ ID NO: 829 - DNA, 804 bp, Lotus japonicus
agggttttggcttctctgctctgcgcgttccgcagctcattctctgtaatcagcttgcaccaatcaatcaccttcactctccatcaatggcggaacagacggagaaggctttcttgaagcagcccaaggtttttctctgttcgaagaaatctgggaaggggaagaggcctggcaaaggagggaataggttctggaagagtattggtttgggattcaagactcccagagatgcaattgaagggtcttacattgataagaaatgcccattcaccggcaatgtttctgtccgtggacgcattcttgccggcacctgccatagtgcaaaaatgaccaggactatcattgttcgtcgtaactatcttcattttatcaagaaatatcaaaggcaagtgtatgagaagaggcactcaaacattccagcacatatatctccatgcttccgtgtgaaggagggtgatcatgttattattgggcagtgcaggccattgtcaaagacagtgagatttaatgtgttgaaagtgattcctgctggttcatctggagctgttaagaaagctttcacaggagtatgagcatttccattcgtcctcatccaccaatatcctgttagaggatttagacttgacaattcctgatatgcgacttctcttttaatgtgttctgaaggaattagattttgtatgctatttaatcttcttattgctgttctctgtattatcttccagtgatattgttccatttatctttgtgtctccttatgttgttccattgatgctgctgcattctttatagctttccaaaaga

SEQ ID NO: 830 - DNA, 689 bp, Oryza sativa
ccgccgcatcgccgctgcagcctccttcccccttcgccgccgtacaccctccagccagccatggcggagcagactgagagagctttcctgaagcagcccaaggtcttcctttgcccaaagaaatctggcaaagggaagaagcctggcaagggaggtaaccgcttctggaagaatattggccttggcttcaagacaccccgggaagcaattgaagggacctacatcgataagaaatgcccattcactggaactgtttctatcagaggtagaattattgctggaacatgccacagtgccaagatgaataggacaatcatcgtacgcagaaactacctccattttgtgaagaaatatcagcgatatgaaaagaggcactccaacattccagctcacatttctccatgcttccgtgttaaggaaggtgaccatgtcatcattggccagtgcaggcctttatcaaaaactgtgaggttcaacgttattaaagtcatcccagctggttccacaggtggtgggaagaaagcattcattgcagcttgagcttatcgaaaatgcctaatcaatcactagttaaatatacaagtgttcacttagaattcttctagcttgctgttttgaccttctgtctaggtccctggagcatttgccactcatctgaaatgtatccgtgcaagttttgtttagatctc

SEQ ID NO: 831 - DNA, 926 bp, Rosmarinus officinalis
cactttgatagcgcgcagccatggcggaacagaccgagaaggctttcttgaagcagcccaaggtgtttctttgctcgaagaagacagggaagggtaaggcccccggaaagggtgggaaccgctactttaagagcattggactcggattcaaaacaccgcgcgaggctactgaaggcacatacattgacaagaagtgccccttcactggtgatgtatccatcagagggcgtatccttgctggaacttgccacagtgcaaagatgatgagaaccatcattgtgagacggaactacctgcactgggtgaagaagtaccaaaggtatgagaagaggcattccaacatcccagcacacatttccccatgcttccgtgtgagggaaggcgaccatgtcactattggtcaatgcaggccattgtccaaaactgtgaggtttaatgttcttaaggtgattccagctggttcttctggtctcgggaagaaagcttttacggggatgtgagttaggcaatatgaagtttactgctggtagttaaaaatgtttttgaaaggttgtattttgaatttctattgtttcatttggaactgttattatcgaccttgctttgaaagctcaaaatcttgatattttacgaatgtctatctagtgccatttttgtgacagttctaagattgagcttcgtttctcaccagtggtgtcgtattcactactgttgattttatgcttataatttaagtctctatatacatatatgggtctcagactggctttattggaaaaaatgtgatttttgttagtgcataagttgatgatgttagtaagcggtgtcgcatcgactctttccagtgtttgatggtgatttccaaattgtaagctgtgattttgtcaattattatggttaagattgcgatagcgtaagttgtgaat

SEQ ID NO: 832 - DNA, 896 bp, Rosmarinus officinalis
ctcagctgctgcggactagggttttttgctgctaccgccctcctctacccacacgctcgcgcacacacacatacactttgatagcgcgcagccatggcggaacagaccgagaaggctttcttgaagcagcccaaggtgtttctttgctcgaagaagacagggaagggtaaggccccaggaaagggtgggaaccgctactttaagagcattggactcggattcaaaacaccgcgcgaggcttctgaaggcacatacattgataagaagtgccccttcactggtgatgtatccatcagagggcgtatcctagctggaacttgccacagtgcaaagatgatgagaaccatcattgtgagaaggaactacctgcactgggtgaagaagtaccaaaggtatgagaagaggcattccaacatcccagcacacatttccccatgcttccgtgtgagggaaggtgaccatgttaccattggccaatgcagaccattgtccaaaactgtgaggtttaatgttcttaaggtgattccagctggttcttctggcctcgggaagaaggcttttacggggatgtgagttaggcaatatgaagtttactgctggtagttaaaaatgtttttgaaaggttgtattttgaatttctattgtttcatttggaactgttttcatcgaccttgctttgaaagctcaaaatcttgatattttacgaatgtctatctagtgccatttttgtgacagttctaagattgagcttcgtttctcaccagtggtgtcgtattcactactgttgattttatgcttataatttaagtctctatatacatatatgggtctcagactggctttattggaaaaaatgtgatttttgttagtgcataagttgatgatgttagtaagcg

SEQ ID NO: 833 - DNA, 802 bp, Rosmarinus officinalis
tttttgctgctaccgccctcctctacccacacgcgcgcacacacacgtacactttgatagcgcgcagccatggcggaacagaccgagaaggctttcttgaagcagcccaaggtgtttctttgctcgaagaagacagggaagggtaaggcccccggaaagggtgggaaccgatactttaagagcattggactcggattcaaaacaccgcgcgaggcttctgaaggcacatacattgataagaaatgccccttcactggtgatgtatccatcagagggcgtatcctagctggaacttgccacagtgcaaagatgatgagaaccatcattgtgagaaggaactacctgcactgggtgaagaagtaccaaaggtatgagaagaggcattccaacatcccagcacacatttccccatgcttccgtgtgagggaaggtgaccatgttaccattggccaatgcagaccattgtccaaaactgtgaggtttaatgttcttaaggtgattccagctggttcttctggcctcgggaagaaggcttttacggggatgtgagttaggcaatatgaagtttgctgttggttgttaaaactgtttctgaaaggatgtattttgaatttctattgtttctgttggaactgttattatcgaccttgctttgacagctcaaaatctcgatattttacggctagtgccatttttgtgacggttctcagatttagcttgatttctacatataatctccaatgctgtagtgtttactattgactatattatgtttataatttagttcgtcttaattggaata

SEQ ID NO: 834 - DNA, 592 bp, Glycine max
gtttctggatgctgctagtttctgtctgaaagctattctccaccgtagccgcaagcttcgccgtttgaaacagtgcctcaaccatggcagaacaaacagagaaggcttttctgaagcaaccaaaagtgtttctatgctctaagaaaggtgggaagggaaagaggcctgggaaaggtgggaatcgcttttggaagtcaattgggcttggattcaagactcccagagatgccattgaaggaacatatattgacaagaagtgccccttcactggcaatgtttccattcggggtcgtatcctagccggtacttgtcacagtgctaagatgacaaggaccattattgtaaggaggaattatcttcattttattaagaaataccagagatatgaaaagcgacattccaatattcctgcacatacatcaccttgtttccgtgttaaagaaggagatcatgttattattggccaatgcaggccaatctcgaagacagtgaggttcaatgttttaaaagtgattccagctggatcctctagcggagcaaagaaggcatttactggaatgtgaaatttgaattgtgtcagttttcattgaag

SEQ ID NO: 835 - DNA, 672 bp, Glycine max
gaaactattatccacagtagctaagcctgcaagcttcgccgtttgaaacagtgcctcaaccatggcagaacaaacagagaaggcttttctgaagcaaccaaaagtgtttctatgctctaagaaaggtgggaagggaaagaggcctgggaaaggtgggaatcgcttttggaagtcaattgggcttggattcaagactcccagagatgccattgaaggaacctatattgacaagaagtgccccttcactggcaatgtttccattcggggtcgtatcctagccggtacttgtcacagtgctaagatgacaaggaccattattgtgaggaggaattatcttcattttattaagaaataccagagatatgaaaagcggcattcaaatattccttcacacatatcaccttgtttccgtgttaaggaaggagatcatgttattattggccaatgcaggccaatctcaaagacagtgaggttcaatgtgttgaaagtgatccccgctggatcctctagcggtgcaaagaaggcttttactggaatgtgagatttgaattttcagttctcattgaagggtagtgttaccttacaaagttagtagaagcctctgttcaaatacatcaaggttgagttaaagattgaatcaattttttgatatcttgtaatgctttgagtggt

SEQ ID NO: 836 - DNA, 643 bp, Ambrosia trifida
ttcgtcttctctgcacctgtctccgccgccacaaagcttctagtttctgatcaacaatggccgaacaaaccgagaaggcgttcttgaagcaaccgaaagtgttcctctgctcgaagaaaagcgggaaaggaaagagacctggaaagggtgggaacagattctggaagagtattggtcttggattcaagactcctagagaggctattgaaggaacatacattgacaagaaatgcccttttactggtgatgtatccattagaggccgtattttggctggcacttgccacagtgcaaagatggtgaggactattattgtacgaagggactatcttcattttgtgaagaagtaccaaaggtatgaaaagaggcactcaaacattcccgctcacatctcaccatgctttcgtgtgaaagaaggtgaccatgttaccgttggccagtgcagaccattatcgaagactgtgaggttcaatgtgttgaaggtgattccagcaggatcttcaagtgctggaaagaaagcctttacaggcatatagacggctacttgagtactcgactctttttgcttgattttgtaaaagtttttgagaagaaaactggagttatgtggttttattgacgttattattctgttgttttcagt

SEQ ID NO: 837 - DNA, 907 bp, Aquilegia formosa
ctcgatttagggtttatagcagcagcacagtgttcatcttcttcccctccccttttccctttaatcatctaaaacctctcgaacaacatggcagaacagactgagaaggcttttttgaagcaacccaaggtgtttttatgctcgaagaaatctgggaaagggaagagacctggaaaaggtggaaaccgcttctttaagagcattggattgggatttaagactccaagagaagcgatcgaagggacatatattgacaagaaatgcccatttactggcgatgtttctgtgaggggtcgtattctggctggtacttgtcacagtgccaagatggttaggaccatcattgttcgccgaaactaccttcattatgttaagaaatatcagaggtatgagaagaggcactctaacatcccagcacacgtatcaccatgctttcgtgtcaaggagggagatcatgttatcattgggcaatgcaggccattgtcaaaaactgtgaggttcaatgtattgaaggttattccagctggatcttctggtggatctgggaaaaaagctttcctaggcgtctaggtgtcttttcaaagttttgcatgacaattgttagtctcttagtccgaggattttgttaaaactgaaagtattttatttgcgcttttaaactgcagagtatgttaagctatatttatgttctcaacttgtgctattgcagttgtagttgtgtttgtcaactacaacatgtgaaaggaacagttcgttgatatttttcagttagtttactcgtggatttgtatgcacttgtgcatgtagtaaatgtgtgatctgtaatgctagtctggtaagctctggactgcaattggtatcttgtctatcaaacggtcaaaccccttcagtgtcacttgtgcatatt

SEQ ID NO: 838 - DNA, 1083 bp, Aristolochia fimbriata
tggttgtaagtctagggttttcgatctacctggccgaggtttctctcgccgcaggtccactctcggcatcatggcggaacagacggagaaagcgttcctgaagcagcccaaagtgtttctaagctcgaagaaatcagggaagggaaagaggcctggaaaaggtggcaaccgtttctggaaaagtataggtctaggtttcaaaacaccaagagaagcaattgaagggacatatattgataagaagtgcccttttactggcactgtttctgtcaggggtcgcatccttgcaggaacttgtcacagtgcaaagatgatgaggaccattatagttaggaggaactatctacactgggtcaagaagtaccagaggtatgagaagagacactctaatatacctgcccatatatctccatgctttcgtgttaaagagggagaccatattatcattgggcaatgcaggcccctgtccaagacggtgagattcaatgtgttgaaggttattccagcaggatcctctactggtggtggcaaaaaggctttcacaggaatgtgagggttgtcgtcgatcaaatatgatcttgatgttgagattagatgaaattttgaagttttggatccagatctagctgagtgtcaattttgtatcaacttattattacgtgttctagtacaaaatttaccctttattactgctatcactaaaaaggcagcgctacctcttctcgtgctaagttgtaggcagctgtggctaaggatgcatttaaccaactttccaagttcgggtatttcatttgttggtagtcttggtcgggaagatatgataatggtcaattgaaagctagagatggctgctgatcgcaggcttgaggctgtgcagctggtttgtatcgtctccgacacttctacacagggactgcggtggtcggatgtatttatgatgggcactgcagaaatttgggtcacaacttaggttgtcactgtgaaaatgttctgaagaagtacatttctctattcgctcaaacagaatgtgcgtgtaaaatgataagtagggttaagccctgtcatatatagagttgaagcctg

SEQ ID NO: 839 - DNA, 987 bp, Hordeum vulgare
cccgccgccaactcctgtcagcgcctcgcctcctcgcacccgcatccccgcgctccgccgccgccgccgccgccgcctccgagccgctcgaagcccacctcgtagccatggcggagcagactgagaagtctttcctcaagcagccaaaggttttcctcagcaccaagaaggctgacaaggcaaagaggcccggcaaggctggcaaccgcttctggaagagtgttggccttggtttcaagaccccaagggaagcgatcgaaggtacctacattgacaagaagtgcccattcactggaactgttgccatcaggggcagaatcatagctggaacctgccacagcgccaagatgaacaggacgatcatcgtgcgcaggaactaccttcactttgtgaagaagtatcagaggtatgagaagaggcactccaacatcccagctcacatctccccctgcttccgtgtcaaggaaggcgaccatgtcatcattggccagtgcaggcccctgtcgaaaactgtgagattcaatgtcctgaaggtcgttccagctggaaccaccggaggcgggaagaaggctttcatcgctgcttaagcccagactctgattcatgagtagttcatagtcagaagcttttcgctcttaaaacgtaccggcctgctgtttcaagatttgattcccgtgttttttgtcaaaccgaagaatgtcgtgatctgaacatgttttgtggaatctatctatcattaatagtttcgcttaaatttgtactgtctgttgttttttggtgaagccctggggactttgtttgcctagatgtggtattatttttactttagctcatgccattagaaggtactatatgacatgtctcgtacgttggccctcaaatacaagtggctgcagaagttgtaggtgagaaagctctactacctcatatgcacccaattcggcgctgcttccagacctcttcttgaaaacctaactgttgattctt

SEQ ID NO: 840 - DNA, 823 bp, Phaseolus vulgaris
ttttcccttgaaatgaaaccctagtttgaggagtgtttagggcttttgtgtgcggcgattccagcgttctcctctgcagcatttttcgtcaaatccctcaccatggctgaacaaaccgagaaggcgtttctgaaacaaccaaaagtgttcctcagctcaaagaaaactggtaaggggaagagacctggcaaaggaggtaaccgtttttggaaatccattggtcttagttttaagactcccagagatgcaatcgaaggaacctatattgataagaagtgccccttcactggcaatgtctctattcgtggccgtatcctagcaggaacatgtcacagtgctaagatgaataggaccattgttgttaggaggaattatctccattttattaagaagtaccagaggtatgagaagaggcactccaatattcctgctcatatatcaccttgtttccgtgtgaaggaaggtgatcatgtcattattggacaatgcaggccactctccaagacagtgaggttcaatgtcttgaaagtgattcctgctggatcttctagcggtgcgaagaaagcatttactggaatgtgagatttgatttccagttttatgattttgttttactctgtggcctttgatcactagtttttttactttttaaacaatgtagactcaattgtgttttcagtctatttattttagtgttttttgtattgtgtttagactgaaaatcaaagtttttgtcctaattaatttgaaacaattattttttgtagaatgcctttgtcattgagaacatcagttataggttttaaatgtagtattggaaacc

SEQ ID NO: 841 - DNA, 740 bp, Brachypodium distachyon
cccgccgccatctcttcttaagccttcggctccccgcttctgtatctcccacccgcgccgccgccgccgcttcttcgccgctcgactcccacaggcagccatggcggagcagactgagaaggctttccttaagcagcccaaggtgttcctcagcacgaagaaagctgacaaggccaagaggccaggcaaggcaggcaaccgcttctggaagagtgttggccttggtttcaagaccccaagggaagcgatcgaaggtacctacattgacaagaaatgcccattcaccggtactgttgctatcaggggcagaattattgctggaacatgccacagtgctaagatgaacaggacaatcattgttcgcagggactacctccactttgtgaagaaataccagaggtatgagaagaggcattccaacattccagctcacatctccccatgcttccgtattagggagggcgaccatgtcatcattggccagtgcaggcccctgtcgaaaaccgtgagattcaacgtcctgaaggtgattccagctggatccactggtgggaagaaggcattcgttgctgcttaagtgcagactctgattcatgagtagtttcatagtcagaagtgtttcgcttgaaagttctaccagggtggcgttttgacattttatttggatattttctgccaaaatgtagactcgttgtctaaacatgttttctggaatctatctacctatcaagagtttttgc

SEQ ID NO: 842 - DNA, 769 bp, Chelidonium majus
gacctcacaccctctttatatcttttgcttcccttcttcccccaactcgtgcgcctccgagcttcttcaatcatggctgagcagacggagaaggcttttttgaagcaacccaaggtgtttctatgctcgaagaaatccggaaagggcaagagacccggcaagggtggaaaccgtttctacaagagcatcggattgggatttaaaacccccagagaagctatcgaaggaacttacattgacaagaaatgccccttcactggcaatgtttctatcaggggccgtatcattgctggcacctgtcacagtgcaaagatggtgcgaactatcattgtgcgacggaactaccttcactatgtgaagaaatatcaaagatatgagaagaggcattccaacataccagctcatatttccccctgttttcgtgtgaaggagggagaccatgtaaccattggtcaatgcaggcctttgtcgaagacggtgaggtttaatgtcttgaaggtcatccctgctggatcctctggtggaggtggcaaaaaggctttcgtggccatgtaaggttgttcatcatggtttttcagacccagtgctatgtcatgaatattatgctttaagatcagctatagttgagagtggacctcagtcgtcattttagttttatgatttgttttttgaatctgttatcacagcaattttgcatgtgaggccgaattttgtttatttagttgaagtattactagacgagatagtgtttctgtgttgattaatgaag

SEQ ID NO: 843 - DNA, 1041 bp, Cicer arietinum
aaaccttataagcccaattacaagagcaaaacgctgaataaaatctgagtccgagacaaagtgaaactagggcttctgaattctcacataacgagcggctactctcacagcctctgcaaaattcccaacctcactccaccatggctgaacagactgagaaggcttttctgaagcaacctaaagtgtttctatgctctaagaaatctgggaagggaaagaggcctggaaaaggtggaaaccgcttctggaaatctattggtcttgggtttaagactcccagagaagcaaccgaaggaacctacattgacaagaagtgtccattcactggaaatgtttccatccgaggtcgtatcttagctggcacttgtcatagtgctaaaatgaatcgtacaattattgttaggaggaattatcttcatttcatcaagaagtatcagagatatgagaaaagacactcaaacattcccgctcatgtatcaccttgcttccgtgttaaagaaggagatcatgttactattggccaatgcaggcccctctccaagacagtgaggttcaatgtgttgaaggtgatcccagctggttcatccagtggtgttgccaagaaggcttttaccggaatttgagatttgaattacttttgagccaagggatctgatcatctctactgaatgtagttctgatttctttatgttgactagtataaagatttgaacaattttggtttgtttttcaagttctgttttgttattggatgatcgttcaagtttttgttatttgttatgtttattagttactagttgcaattgtttgtaagtttggcttctaaaaagaattctcacttttcaaacgataatttattaaggatgagtatgtcttgttaatcagtctttctaatcaaactctggcaccatatttatcattggtttttttgaatcaatttttttgctgtgttttttacctcacgttctaaattgaaaacttcaatgtagagtaatactgtataatattgtactaatgttattatccagcacctttttttaa

SEQ ID NO: 844 - DNA, 899 bp, Cicer arietinum
tgagtccgaaatgaaagtgaaactagggtttctgatttctcataagagtcttttccagtgcggcttttcccacagcctctgcaaaattcccaacctcactccaccatggctgaacagaccgagaaggcttttctgaagcaacctaaagtgtttctatgctcaaagaaatctggaaagggtaagaggcctggaaaaggtggaaaccgcttctggaaatctattggtcttgggtttaagactcccagagaagcaacggaaggaacctacattgacaagaagtgtccattcactggaaatgtttccatccgaggtcgtatcttagctggcacttgtcatagtgctaaaatgaatcgcactattattgttaggaggaattatcttcatttcatcaagaagtatcagagatatgagaaaagacactcaaacattcccgctcatgtatcaccttgcttccgtgttaaagaaggagatcatgttactattggccaatgcaggccactctccaagacagtgaggttcaacgtgttgaaggtgatcccagctggttcatccagcggtgttgccaagaaggcttttaccggaatttgagatttgactttcgattgagccaagacatctgattatatctattgaatgtagttctgattttctttatgttgactagtataaagatctgaacaattttgttttgccggcgaagttctgttttattattggataatcgttgaagtttttgttattcattattgttattagatatactccatgcaattgtttttaactttgggttctaaaaggaattatctcacttttcaaggttaaagtaatttattatggatgagtctttgttgttaattattaactttctaatcaaacacggcatatttatcattgatttt

SEQ ID NO: 845 - DNA, 905 bp, Trifolium pratense
agataggtaggtttcaggtgcttgcggctacactctcctcctctgcaactaactctccaccatggctgaacaaactgagaaggcttttctcaagcaacctaaagtgtttttaagttctaagaaatctggtaagggaaagaggcctggtaaaggcggaaaccgcttttggaaatccattggtcttggatttaagactcctagggatgccattgaaggagcctacattgacaagaagtgcccatttactggcaatgtttccatcaggggtcgtatcttagccggaacttgtcacagtgctaaaatgaataggactattattgttaggaggaattaccttcactttattaagaagtatcagaggtatgagaagaggcattcaaacattcctgctcatgtatcaccttgcttccgtgttaaggaaggagaccatgttattatcggccaatgcaggccactctccaagacagtgaggttcaacgtgttgaaagtgataccagctggatcatctagtggtgcaggaaagaaggcttttactggaatttgagatctgatcgactttcgtagtatagagatcttatcatctgtgtgaaaagcaattctgatttctgtatggtgaagttctgatcaattttggtttgcttttaaagttatgtactgtgatcggatataagattatgttatttgggttttctctcggacatgatgtttttatggttattaaatactagttgcaattattttgaattttggattgtgaaagcaattttctcacttctttatatatgaaatcaatgtctagtaatctgagataaaagcagatgtgatccaacattgatatcagtttacaaactggaaattagaagtgaagcctacacatacatatacctgctttcagtttcttttct

SEQ ID NO: 846 - DNA, 693 bp, Trifolium pratense
aggtaggtttcaggtgcttgcggctacactctcctcctctgcaactaactctccaccatggctgaacaaaccgagaaggcttttctcaagcaacctaaagtgtttttaagttctaaaaaatctggtaagggaaagaggcctggtaaaggcggaaaccgcttttggaaatccattggtcttggatttaagactcccagggatgccattgaaggagcctacattgacaagaagtgtccatttaccggcaatgtttccatcaggggtcgtatcttagccggaacttgtcacagtgctaaaatgaataggactattattgttaggaggaattaccttcactttattaagaagtatcagaggtatgagaagaggcattcaaacattcctgctcatgtatcaccttgcttccgtgttaaggaaggagaccatgtcattatcggccagtgcaggccactctccaaaacagtgaggttcaacgtgttgaaagtgatcccagctggatcttctagtggtgcaggaaagaaggcctttactggaatttgagatatgatcgactttcgtagtatagagatcttatcatctgtgtcaaaagtaattctcatttctgtatggtgaagttctgatcaattttggtttgcttttaaagttatttactgtgatcggatataagattatgttatttgggttttctctcgg

SEQ ID NO: 847 - DNA, 943 bp, Cryptomeria japonica
agaaggtagggttcggcgagttcatttgttttgagcagggttgaagcaggggtaggtttagggtttctctcagcaaccatggccgaacagaccgagaaagcctttctgaagcagccaaaggtttttttatgttcgaagaaatctggtaagggaaagcggcctgggaaaggcgggaataggttttggaaaaatgttggtctgggatttaaaacacccaaggaagccatacaagggacatacattgacaagaaatgcccattcacgggcaatgtatcaattagaggccgtatattgacgggtacgtgccacagtgcaaaaatgaacagaacaatcattgttcgccgtaattatcttcacttcgtcaagaagtatcaaaggtatgagaagaggcactcaaacattcccgcacacatttcaccctgcttccgtgtaaaggaaggagaccatgttataattgggcagtgcagacctttgtccaagactgttagattcaatgttctgaaggtgatacctgcgggcagtagcagtgggacagcaaagaaaggatttgctgcaatctgattatacctatattaagactatggcatacattatgattttgttaagtagtcctaagaaaggccttatgacaatcttttgcggagaggaatatttgattctagtttgttcaatattttttcttgtttaatgtaatccctaacattgttgagtgtagggaagaaatacaatgttgattgtttttatgttctgtgcttgggtacaatttctagcgttctgtagctgcatgttgtgtgaatgcagataattcgttgtgttttaagaataattttcaagcaaggtcagcttacagaaaagagaaatgctttggctctatataagcaaagttaaaactataaagattcatattagatctgtgcctgcaaaatgtgtgggaagtgttagt

SEQ ID NO: 848 - DNA, 826 bp, Cucumis sativus
gctgcctctagggtttttacttagtatcagactctgcggcttaggcttctatcggatcttcgaaaccctaacaatggcggaacagacggagaaggcttttctgaagcagcccaaggtgttccttagctcgaagaaatcgggcaaaggaaagaggccaggaaaaggaggtaatcgtttctggaagagcattggtttgggcttcaagactcccagagatgcaattgaaggaacctacattgataagaagtgtccattcactggcactgtttctatcagggggcgtatacttgctggtacctgccacagtgctaagatggtcagaactatcattgttagacgtaattatcttcactatgtgaagaaatatcaaaggtatgaaaagagacactctaacatcccagcacacatagctccttgctttagggttaaagagggagaccatgtcatcattggccagtgcaggcccttgtcaaagaccgtgaggtttaatgtattgaaagtgattcctgctggatcatccgcaggtggaaagaaggctttcgcagggatttaagtccagaattttcaggtcccatatttgtttatgttaaggggataatatgttagcatgagcttttcttcagctagatgatcttttcactttatttattaactgaatatttcattattgtgatactactgcaattttgattcccttgagttttgctttatccatcagtatcagtaccttctctgttcttggtttatcaaatattattttctgcttacggtaatccataagtttgattcccttgagttttgatttattcctcttttccccccaccc

SEQ ID NO: 849 - DNA, 774 bp, Solanum melongena
caaattagggtttgtctgcggagcgtctctcatcgttcacttcatctcccttcgtaaccctcaatcatggcggagcagacggagaaggcgtttttgaagcagccaggtgtttttctaagctctaagaagaccgggaagggaaagaggccaggaaagggaggtaatcgatactttaagagtattggtttaggattcaagactcctcgtgaggctattgaaggtacatacattgacaagaagtgtccattcactggcaatgtttctatccgaggtcgtatccttgctggtacatgccacagtgctaaaatgaacagaaccatcattgttcgacgcaattacctacattatgtcaagaagtaccagagatatgagaagaggcactccaatattccagctcacatatcaccatgcttccgtgtgaaggagggagatcatgttattattggacagtgcaggcctttatccaaaactgtgaggttcaacgttttgaaggtgattccagccggttctggtgctggtgggaaaaaagcttttaccggaatgtgagcttgagtgcttcaaacctttttgtttacatctatgaatgatgtcaaggcttttctgcttttgctgaattctagtatttatttatattgagattcaaattttgaaacttaatgctagcaacaaagttttctttcctattaagcctgtgtactactctcatcttgtaagagatttcgtaattggaccttccttttttccccatagaaaagatgtttggtggtcgactta

SEQ ID NO: 850 - DNA, 681 bp, Euphorbia peplus
attcactctgcagctgcctcttccattttctttctccctcagcagaatcatcaactatggcggaacaaacggagaaagcttttttgaagcaaccgaaggttttcctaagctcgaagaaaactggaaagggtaagaggcctggtaaaggtggaaatcgtttctggaaaagcgttggattgggtttcaagactccaagagaagcaattgaaggaacatttattgataagaaatgcccattcactggcactgtttccattaggggccgtatcttggctggtacttgccacagtgcaaaaatgactaggaccattatagttcggaggaattaccttcactttatcaagaaatatcagcggtatgaaaagcgtcatgcaaatatcccagctcatgtatccccatgctttcgtgtgaaagaaggcgatcatgttatcatcgggcagtgcaggccgctttcaaagacggtgagattcaatgtgcttcgggtcattccagctgggtcttctggtggtgtaaagaaggcttttacagctgtgtaagacaggatgatgatgatgatgaagcatttgtggggattttctctgttttatggcatttagagaagtatgaactgagtctcagattttaaactttgttctagtttttgttatacctttagactgcacatctctaaatatatgttga

SEQ ID NO: 851 - DNA, 875 bp, Fagopyrum esculentum
tttcagtcgctttatccttccttcgcgcctccgacgaaactgtaaaaccacttccgaaggatccagccatggcggagcagaccgagaaggcatttttaaagcagcctaaggttttcctgtcttcgaagaaatcgggtaagggaaagcgacctggtaaaggtggaaacagattctggaagagcataggtttgggattcaagacaccgagagaagccaccgaaggaacttacattgacaagaaatgccctttcactggaaccgtgtcagtcaggggccgcatccttgctggtacatgccacagtgctaagatgatgaggactattattgtccgtaggaactaccttcactgggttaagaaataccaaagatatgagaagaggcactccaacatccccgctcacatatctccctgcttccgtgtcaaagaaggagatcatgttatcattggacaatgcaggccgctatccaagacggtgagattcaacgtgttgaaggtgattcctgctggctctgcagctggtgggaagaaggcattcacgggcatgtgattttcttgctggttggtggtagtatgaagtgttaggggtgttttcaatttgcatgtctgttttgaacctttttcctaaatcaatcagaaccctgttgttctttatacaatttgtttttatagtttggccaattagaaaccaattggaaatgcttatgaatcttgcgtttaaggtctgttgcttatctaatttggactgtcttgaccgtttgctgtaagtttggttattttctactaggtcatattttcttagatgttgccatggatttggttaacaatgttgaaaagatgatatttagaattttaaacacgttcatcattgatatga

SEQ ID NO: 852 - DNA, 617 bp, Flaveria ramosissima
cgaacagactgagaaggcgtttttgaagcaacccaaggtgttcttatgttcaaagaaaagtggaaaggggaagaggcctgggaagggtggaaacagattctggaagagtattggacttgggtttaagacaccaagagaagccattgaaggaacttacattgacaagaaatgcccttttactggtgatgtctccatcagaggtcgtattcttgctggtacgtgccacagtgctaaaatggttaggaccattattgttcgccgggactaccttcactatgtgaagaagtatcagcgttatgagaagcgtcattcgaacatcccagcacacatttctccatgtttccgcgttaaggaaggtgatcatgtcaccattggtcagtgcagaccattatccaagacggtgaggttcaacgtgttgaaggtgattccagctggatcttcaagcggcgggaagaaagcatttacaggcatataagaagctttatcttcttgatcttgttaggctttgcaaaaaacagttcaatttgctctaattttgaagtaaaatgtgttttgattatgtaccttgttaaatgttttcttaagacaaattatgtgctctaaaatcaaattttgtt

SEQ ID NO: 853 - DNA, 740 bp, Linum usitatissimum
gagttctcgttattctaccagccttgtgcatcttgccgcttctcccgctgttacaagcgttctctcaatcatggcggaacagacggagaaggcatttctgaagcaaccaaaggttttccttagctcgaagaaaacgggcaagggaaagaggcctggaaagggaggcaaccgtttctggaagagcattgggttgggcttcaagactcccagagaagccattgagggaactttcattgataagaaatgccccttcaccggcactgtctccattaggggccgtatcttggctggaacatgccacagtgctaagatgatgaggtcaatcattgtccgtcgtaactatctccattttgtgaagaaataccaaaggtacgagaagagacactcgaacatcccagctcatgtctccccatgcttccgtgtgaaggaaggagatcacgttatcattgggcagtgcaggcctctttcaaagacggtgagattcaatgttctgaaagtgatcccagctggatcttctggtgggggaaagaaggcctttactgggatgtagggtgtttacttgctgttttgtttctgtctgtgttagggtttgatgaaatgaaacgtattctggacaacctttatagtctagtttttgacaattacagatgcttccctgagaacatttgttcaacaacgtaatggcaattttgttttattggatatcctttcatgattatcacagttaactaatttgcatg

SEQ ID NO: 854 - DNA, 699 bp, Fraxinus spp
tacgcctccttctcagtttctgaatacacaccagcacacactctagaactactcaaccatggcggaacagactgagaaggcgttcttgaaacaacccaaggtgtttctttgctcgaagaaaacggggaagggaaagaggccaggaaagggaggcaaccgatacttcaaaagcgttgggctagggttcaagactcctcgtgaggctattgaaggcacatatatagacaagaaatgtcccttcactggtgatgtatccatcagaggccgtattctttctgggacatgccacagtgccaagatgatgagaacaatcattgtccgtcgtaactacttgcattgggttaagaagtaccggagatatgaaaagaggcactcaaacattccagcacatatatctccatgcttccgtgtgagagagggtgaccatgttactattggccagtgcaggcctttatcaaaaacggttagattcaatgttcttaaggtgataccagccggttcgtctggtcttggcaagaaggcatttacaggaatgtgagtttggtgatttggctttttgttgttagttctaaagagtttttaaggatgatttaagactgttttacttctcccagttggtcgattgtcactcctgacttgcccatgagctttggaatttaatccatacaatttatattatgctcttaataatttggatac

SEQ ID NO: 855 - DNA, 957 bp, Fraxinus spp
acgttagggtttgtctctgccgatattttccccgcttgcgttttgacctccgaactctttacagctcaaccatggctgaacagactgagaaggcgttcttgaagcagcctaaggtcttcctttgctcgaagaagacagggaagggaaagaggccaggaaaaggaggaaatcgatactggaagagcattgggcttgggttcaagactccacgtgaggctgttgaaggtacctatatcgacaagaaatgtcctttcactggcgatgtttccatcaggggccgtattcttgctgggacatgccacagtgccaagatgatgagaacaataattgttcgtcgcaactacctgcattgggtcaagaagtaccagagatatgagaagaggcattcaaacattccagcacacatatctccatgcttccgcgtgaaagaaggagatcatgttacaattggccagtgcaggccattatcgaaaactgtgagattcaatgttttgaaggtgatcccagctggttcttccggtcttgggaagaaggcatttacaggaatgtgagactagtgttctgaatttcttggttcaaaagtgtttggaagggccgtctgagactgtttcttgttgaaaatatggtgatattgcttgcggcgagaaattgatatattttgtattttaccaattgctagattatattctcctattacccagttatgaaatttctcaattttcttgagcaattttaatagtttgggatctctatcttttgcctccaactccaataattttttttgtagtttcataatagttgaatcaactcttttaaatgttcaattgttgattggttgggtgtcaactataggaaatacatttctttccattggttttggtagctaagccaaaatgtgaaatcagcaatctgcaatctgctcagaaacgaaattgatgctgaacggccaattgaatt

SEQ ID NO: 856 - DNA, 1881 bp, Panax ginseng
gactaggaatgctgctgtgggcttgttgaactgtgcctcaccgaggaataaccgaaggtcacggaggcgattcgagcaagaaattcgtgaagagagagatttaggtttcttggaagaaatgggtaagcctaaaaaaaggcgaaatggtggccggtccaagaaggagaaaccaacttcgggaacttcaattccgtctccaggaaatgatggcgattcttgtaatctggatagaattgggcagctgataactgatctgataatgtggaatgatgttgcaaaatcgagccattggtttggttttggatcacttggttttgtatcttcttgttttgcaagtggagttagctttagcattttctcgatgatatctcgattgggccttttggttttgggagttgcattcttctcaaattcaatctgtcaaagggataacactgaaattaagcgtgactttaaacttacggaagacgacatagtgaaagcaactagagttgtacttccagctgcaaatcttgcaatttgtaaaacaagagagttattttcaggggatccatccacgaccctcaaagtagctccatttttacttctaggagctgagtatggacatctcataaccctgtggaggctctgtgcacttggattctttataagctttactggtccaaaactgtactccttttactctgttcaaataaacgaaagagttgcatacctgagacgtagggtgttggaagcatggggagtttgctcccacaaaaagattgttgctgcatcagcagccacagccttctggaatctgacttccttcaaaacacgcatttttgcagcattcatatctctggttttagctcgataccatagacaatattcagaaccaaaagaggaagaaaaggaaacagaagaaacccaacaagagcaagagcagcaactggcattggttttggtggcaaatggatgacagagacacaataaatattcagtttcgattaggctctgtatctctctgactattgcacgtataaatgaatatgatcttaatttaccgttgcatgaatatatttttcatgcatatatgaaagcagtggtatcaacgcagagtacatggggttggtgcacaatacaatagagagcgtctgccgacccttcatttttcacctccttcctcaactctccaaaaccctcaatcatggcggaacagaccgagaaggccttcttgaagcagcccaaggtgtttctttgctcgaagaagtcagggaagggaaagagacctggaaaaggaggaaatcgtttccacaagagcattggattagggttcaagactcccagagaggctattgaagggacttacattgacaagaaatgcccatttactggagatgtttcgatcaggggccgtattcttgctggtacttgccatagtgcaaagatgatgaggactatcattgttcgccgcaactacttgcactatgtcaagaaataccagaggtatgagaaaaggcattcaaacattccagctcacgtatccccttgcttccgtgtgaaagagggagaccatgtaattgttggccagtgcaggccattgtcaaagacagtgagattcaatgtgttgaaggtgatcccagctgggtcttctggtggtggtggaaagaaggcttttactggcatttgagtttgagttttctggtcggtgttataatatttggggaggactgttgtttttactactttggctaggtaggacttacccttttgactttgaaccttgaatgttcaaatttttgtatgcgatgaattagtgttccataaaacctggtttcaaatttctcatttccagtcttattaatatataatagttgaatttcaaaaaaaaaaaaaaaaaaa

SEQ ID NO: 857 - DNA, 806 bp, Panax ginseng
gtctcagaagcagtggtatcaacgcagagtacatggggccgccgcagtttctgttatagagagcgtctgccgacccttcatttttcacctccttcctcaactctccaaaaccctcaatcatggcggaacagaccgagaaggccttcttgaagcagcccaaggtgtttctttgctcgaagaagtcagggaagggaaagagacctggaaaaggaggaaatcgtttccacaagagcattggattagggttcaagactcccagagaggctattgaggggacttacattgacaagaaatgcccatttactggagatgtttcgatcaggggccgtattcttgctggtacttgccatagtgccaagatgatgaggactatcattgttcgccgcaactacctgcactatgtcaagaaataccagaggtatgagaaaaggcattcaaacattccagctcacgtatccccttgcttccgtgtgaaagagggagaccatgtaattgttggccagtgtaggccattgtcaaagacagtgagattcaatgtgttgaaagtgatcccagctgggtcttctggtggtggtggaaagaaggcttttaccggcatttgagtttgagttttgtggtcagtgttataatatttggggaggactgttgtttttactactttggctaggtaggactttcccttttgactttgaaccttgaatgttcaaatttttgtatgcgatcaattagtgttccataaaacctggtttcaaatttctcatttccagtcttgttaatatataatagttgaatttcattaataaaaa

SEQ ID NO: 858 - DNA, 709 bp, Panax ginseng
aagcagtggtatcaacgcagagtacatggggactccctggtgcacaatacaatagagagcgtctgccgacccttcatttttcacctccttcctcaactctccaaaccctcaatcatggcggaacagaccgagaaggccttcttgaagcagcccaaagtgtttctttgctcgaagaagtcagggaagggaaagagacctggaaaaggaggaaatcgtttccacaagagcattggattagggttcaagactcccagagaggctattgaagggacttacattgacaagaaatgcccatttactggagatgtttcgatcaggggccgtattcttgctggtacttgccatagtgcaaagatgatgaggactatcattgttcgccgcaactacttgcactatgtcaagaaataccagaggtatgagaaaaggcattcaaacattccagctcacgtatccccttgcttccgtgtgaaagagggagaccatgtaattgttggccagtgcaggccattgtcaaagacagtgagattcaatgtgttgaaggtgatcccagctgggtcttctggtggtggtggaaagaaggcttttactggcatttgagtttgagttttctggtcggtgttataatatttggggaggactgttgtttttactactttggctaggtaggactttccccttttgactttgaaccttgaatgttcaaattttt

SEQ ID NO: 859 - DNA, 743 bp, Vitis vinifera
ggtttttgcggagcctcctctggtttcttcgtcctctcgagtctcccacagcccctgagccatggcggaacagacggaaaaggcgttcttgaagcagcccaaggtgtttctatgctcaaagaagggcggaaagggaaagaggcctggaaagggtggaaatcgattctggaagagcattggattgggatttaagacacccagagatgcaattgaaggaacatacattgacaagaaatgtccgttcactggaggtgtttctatcaggggccgtattcttgctggtacttgccacagtgcgaagatgatgaggaccatcattgttcgacgcaactatcttcattatgtcaagaaataccagagatatgagaagaggcactcaaatataccagcacatatatccccatgcttccgtgtcaaagagggtgatcatgttattattggccagtgcaggccattgtcgaagacagtaagatttaatgtgttgaaggtaattcctgctggatcttctggtggaggtgggaagaaagcttttgtggcgatgtgagttcagtgttccagttttccagttagtgtcatagctgaggtacaatgtcgctagatcaagtttattttgtgccagaggaaactttctccattttatttgtcttgaatattttgatttttgtacaacagattggttttacgtgctgagttttatttgccaagagttgcttaaattttatcaccataagcttgagatagta

SEQ ID NO: 860 - DNA, 671 bp, Guizotia abyssinica
gagggtttacttctctattgtgctccatcatttctgtgcctccgccgttgaaaagctcggatctctgcaacaatggctgaacagacggagaaggcgtttttgaaacaacctaaggtgtttctatgttcgaagaagagtgggaaggggaagaggcctgggaagggtggaaacagattctggaagagtattggccttggatttaagacacctagagaggctattgaaggaacttacatcgacaagaaatgccctttcactggtgatgtgtccattagagggcgtattcttgctggtacatgccacagtgcaaagatggttaggaccataattgttcgccgggactacctccactatgtcaaaaagtatcagcggtatgagaagaggcactcgaacattccagcacacatttctccatgctttcgtgtgaaagaaggcgaccatgtcaccgttggacagtgcagacctttgtccaagacggtgaggtttaacgtgttgaaggcgattcccgctggatcttcgggtggtgggaagaaagcgtttacaggcatataagaagcttctgttttttttgttgtcaggttttgcaaaacagttcatttgatctgctgattttgaagtaaaatgtgttttggttatgtttaatgtttatgtagactctagatttcttttaa

SEQ ID NO: 861 - DNA, 771 bp, Carpinus betulus
tcgcctccttcgcgtcgtcggcttctatcgctcttcacaaactctaatcatggcggaacagacggagaaggcattcctgaagcagcccaacgtgttcctctgctcgaagaagtcggggaaagggaagaggccaggaaaaggagggaacaggttctggaagagcgtcgggttggggttcaagactcccagagaggctattgatgggacatatattgataagaaatgcccattcaccggaaatgtttccatcaggggtcgtatcatttctggtacttgtcacagcgccaagatggtaaggaccatcattgttcgccgcaattaccttcattttgttaagaaataccaaagatatgaaaagagacattcgaacataccagcacacatatccccatgcttccgtgtgaaagagggagactatgttatcattggccagtgcaggcctttgtcaaagacggtgaggtttaacgttttgaaggtgattccagctgggtcttctgcaggtggtaagaaggcatttactggaatgtgagtttcagtgttaagttttcaacgagaatgagttagattgagctactccctccagacgagacttttttgtcctttttattttccttaaaatattaaatctttgtatgacctgtttatgtttattttcaactggagttcgtgaatttttgcttttgccaatcctttctttatgggttccttttgaaattgtttctatgatgtggttatgtttgcccaagaaccgtgtgagtgaatgtaatttgg

SEQ ID NO: 862 - DNA, 781 bp, Liriodendron tulipifera
agctcagaaaccctaactagggcttttcttttccctgaccaaaggacttcctcccttccccctgtgaactctagggtttctctctctctctctctctctctctctcatatcatggcggaacagacggagaaggcgttcttaaagcagccgaaggtttttctaagctcgaagaaaccagggaaggggaagaggcctgggaagggtggaaaccgttactggaagagcatcggattgggattcaagactcccagggacgctatcgaagggacatacattgataagaaatgtccctttactggtaccgtttccatcaggggccgtatcctagctgggacctgccatagtgccaagatgatgagaaccatcattgttcgacggaactaccttcactatgtgaagaaatatcagagatatgaaaagcggcactcgaacattccagcgcatatatctccatgcttccgagttaaggagggggatcatgttatcatcggccagtgtaggcccttgtccaagacggtgagattcaatgtgttgaaagtggttccagcaggatcttcaggcggtggcggtaagaaggctttcgccgcaatataagcccacctttcgttttaattcagttagataccatggactttttctttgttttttgttgtaggccaagcatttagaattttggtctgctgattggccatcagaactgtggtgatgttatcttataggcttctttttgggaccattttttttctcctaatgattatatgatgctagagttatggaccgc

SEQ ID NO: 863 - DNA, 785 bp, Cucumis melo
gtgccttgcctatcccctgttgcgtgtctcagcttcgtatcagactctgcggcttaggcttctatcggatcttcgaaaccctaacaatggcggaacagacggagaaggctttcctgaagcagcccaaggtgttccttagctcgaagaaatcgggcaaaggaaagaggccaggaaaaggaggaaatcggttctggaagagcattggtttggggttcaaaactcctagagatgcaattgaaggaacctacattgataagaagtgtccattcactggcactgtttctattagggggcgtattcttgctggtacctgccacagtgctaagatggtcagaactatcattgttagacgtaattatcttcactatgtgaagaaatatcaaaggtacgaaaagagacactctaacatcccagcacacatagctccttgctttagagttaaagagggagaccatgtcatcattggccagtgcaggcccttgtcaaagaccgtgaggtttaatgtattgaaagtgattcctgctggatcatccacaggtggaaagaaggctttcgcagggatttaagtccagaattttcaggtcccatatttgtttatgttaaggggatgatatgttagcatgagcttttcttcagctagatgttcttttcactttatttattaactgtatttcattatcgtgatactattgcaattttgattcccttgagttttgctttatccatcagtatcagtaccttctctgttcttggtttctccaatagtattttcttcttacgtccaa

SEQ ID NO: 864 - DNA, 983 bp, Nicotiana benthamiana
ggctagggtatcagtagtataaattataaaggctttagtagctcacaattcaatccaatctccgcctagggtttttgctgccgagccactcccctcgttccagttaagctttcagctccttcaactccacagccatggccgaacagacggagaaggcgttcttgaagcagccaggtgtttttcttagctcgaagaagacagggaaggggaagagaccagggaagggaggtaaccgctacttcaagagcattggtctagggttcaagactcctcgcgaggctattgaaggtacgtacattgacaagaaatgtccatttactggaaatgtttcaatcagaggtcgtatccttgctggtacatgccatagtgccaagatgaacagaaccatcattgttcgtcggaactacctgcattacgttaagaagtaccaaagatatgagaagaggcattccaatatcccagctcacatatcaccttgcttccgtgtgaaagagggagatcatgttatcattggacagtgcaggcctttgtccaagactgtgaggtttaatgtgttaaaggtgattccagctggttctgctggtggtggcaagaaagcatttacaggaatgtgagcaggtgtttcttgagtttactgtcacttctagagtatgaaagtaattatgcttgagactgagaagaggagtgacgttgagacttctctactaaaagctgtttgcgtttgcctttgaaggcttaaattttgtatggatacttgctacctatcattagtataaggagttcagatttcagtttttttgttaccattgttatttccaatcaaatgttcttcctgattgccccaccagctaaatgtctgtttgttaagatctttaggtacttctgttaggagattataccctttttgcgtctctggttgttgctatactctggtgtggttattgtgtgagcgactctgtggattttgtgccatatggttactt

SEQ ID NO: 865 - DNA, 817 bp, Elaeis guineensis
ccctactttccccttacccgttcgttggtccttcgtcgcgtctcctacgcccgtccctctctctctctctctctctctgtgggtcctcctcctccgttcaacaatggcggagcagactgagagggcattccttaagcagccaaaggttttcctttgctcaaagaaatctggtaagggaaagagacccggtaagggtgggaaccgcttctggaagaacattggtcttggattcaagactcctagggaagctattgaaggaacatacattgataagaagtgcccattcactggcaatgtatccattaggggtcgcatattagctggcacatgccatagtgccaagatgaacagaactatcattgtccgtagaaattacctccactatgtgaggaagtatcagaggtatgagaagaggcattccaatattgcagcacacatatccccatgcttccgtgtgaaggaaggagaccatgttatcattggccagtgcaggccattgtccaagactgtgaggttcaatgttctgaaagtcattccagctggatcaaaagggggtgggaagaaggcctttgctgcagtctgaagtttttaacatcattttcttacagattgcgtttcgttaacgtagattcaattttgagttgagctctttgaatgaactaatgccatttgaacatctcttttctttctttaaaaactcactctaaagctagttgtgtgtttcccattccggatgatgaaactaatactgtttgaacagtaaactttttggatttccacccagtataaattctacttatgaagtgatataagcaag

SEQ ID NO: 866 - DNA, 852 bp, Arachis hypogaea
agggttttgcgtgctccgtgctgttcgctgctgctgctgctcattctctctgctgcttgcaccacgcaccttctaggattcaccaatggcggaacagacggagaaggctttcttgaagcaacccaaggttttcctctgctcgaagaaatcagggaaagggaagaggcctggaaaaggaggcaacaggttctggaaaggcattggtttagggtttaagactcccagagaggctattcaagggacttacattgacaagaaatgcccattcactggcactgtgtccatccgaggtcgcattcttgccggtacttgccacagtgccaagatgaccaggactatcatcgttcgtcgcaactatcttcatttcattaagaaataccaaaggtacgagaagaggcactcaaatattgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccgatcccatttcccagatattagatttaggaactcgcgtgtgtgatttcctaaattcgtttaggagggatttatatttgtatgcttttgatttgatattttattccagtctctttttttttcccaccctcacagctgtgttttcagttttgacttttgatgtttgaaatacaattagtcctttagtttctggcaaaaaaaaaggaaaaaaaacaaaagtactctgcgttgataccactgcttctgagactgccaaggcacacaggggataggcc

SEQ ID NO: 867 - DNA, 719 bp, Arachis hypogaea
agggttttgcgtgctccgtgctgttcgctgctgctgctgctcattctctctgctgcttgcaccacgcaccttctaggattcaccaatggcggaacagacggagaaggctttcttgaagcaacccaaggttttcctctgctcgaagaaatcagggaaagggaagaggcctggaaaaggaggcaacaggttctggaaaggcattggtttagggtttaagactcccagagaggctattcaagggacttacattgacaagaaatgcccattcactggcactgtgtccatccgaggtcgcattcttgccggtacttgccacagtgccaagatgaccaggactatcatcgttcgtcgcaactatcttcatttcattaagaaataccaaaggtacgagaagaggcactcaaatattgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccgatcccatttcccagatattagatttaggaactcgcgtgtgtgatttcctaaattcgtttaggagggatttatatttgtatgcttttgatttgatattttattccagtctcttttttttcccaccctcacagctgtgttt

SEQ ID NO: 868 - DNA, 636 bp, Capsicum annuum
cagcaattcatcactctttcagctcaattcaacaatggcggagcaaacggagaaggcatttttgaagcagcctggtgtttttctgagctcaaaaaagacagggaaaggtaagaggccaggaaaaggagggaatcgatactttaagagtattggtttaggcttcaaaactccccgtgaagctattgaaggtacatatattgacaagaaatgcccattcactggcaatgtttctatcagaggtcgtatccttgctggtacatgccacagtgctaagatgaacagaaccatcattgttcgacgcaactatctacattatgttaagaagtaccagagatatgagaagaggcactcgaacattccagctcacatatcgccatgcttccgtgtgaaagagggagatcatgttattattggacagtgcaggcctttgtccaaaaccgtgaggttcaatgtgttgaaggtgattccagctggttctgctggtggtgggaaaaaagcttttaccggaatgtgagcagagtgcttataggaatgatgtcaagacttttctgcttttgctgaattgttgtcttcattgatatttctttgagcttcaaattttgaacttaaatgctagcaacaagttttctttcctat

SEQ ID NO: 869 - DNA, 927 bp, Lippia dulcis
tcaatcaaaaactgccgccacttctttccttcttccttcagctttcgattcctcatctgcactctattgccggcaaccatggcggaacagacggagaaggcgtttttgaagcagccgaaggtgttcctttgctcgaagaagtcgggtaagggaaaggctccgggaaagggaggcaaccgctactttaagagcattggattagggttcaaaacacctcgcgacgccattgaaggcacatacattgacaagaaatgccccttcactggcagtgtatccattagaggccgcattcttgcaggaacctgccacagtgctaagatggtcagaacaatcattgtccgaaggaactacttgcattgggtgaagaagtaccaaagatacgaaaagaggcactcaaatattccagcacatatatccccttgcttccgtgtgaaagagggtgaccatgttatcatcgggcaatgcaggcctttgtcaaaaactgtgaggtttaatgttcttaaggtgataccagctggttcctcaggtcgtgggaagaaggctttcacggggatgtgaatgtgatccgaataatctaaacttcttctcgattgttatataggttagtgggagatgatagtcgtttcagttttaagaatcaaccctcacttgaggggttcaatatttcaagtttttcttgcttatgattaaactgtagctgagatttcttgacatcccgtttggcattttgttcgaacaagagttgaattatgtggtatatctgtcgaacctatgtttctgagtccagtttttatcttgtttgttagtgtaatgagtgtttcagaaggatcatgtcctttacagttaacacaaatgagaaataagaaacttgcccaattaggcccgtttgtatatggacaaattttatcaactaatgggattttaaga

SEQ ID NO: 870 - DNA, 830 bp, Lippia dulcis
ggagctctctttttagggttttatcgcagccgctgcttcctccatttttcacgagcacacacgcacaaccagccatggcggaacagactgagaaggccttcttgaagcagcccaaggttttcctttgctcgaagaagtcggggaaggggaaggcgccagggaaaggaggcaaccgctactttaagagcattgggttaggtttcaagacaccccgcgatgcaattgaaggaacatacattgacaagaaatgtcccttcactggtaatgtgtccatcaggggccgcatcatcgctggaacctgccacagtgcaaagatggtgagaactatcattgttcgccgtaattatcttcactgggtgaagaaataccaaagatatgagaagaggcactcaaatatcccagcccacatatccccttgcttccgtgtgaaagagggcgaccacgtcatcattggacagtgcagatccctgtccaaaactgtgaggtttaatgttcttaaggttataccagccggttcttctgggcgcgggaagaaggccttcacagggatgtgatctcagcatacctaaaatcttttcgttatgttatagaggagaaagatgagtttagactttttcctttggaagtattgattattgttggcatgaaagctgaaatttttgtactctaccaattttttgtttactatgagctgtttttgagatttcttgaagttcgcaatcagtttctgtgaaaatccaaatgcttgctgttcatgcttcagtttttcgtcaaaaactcatcatattttcacatgaatgatcccacttctaaagctgggtggaaaaaag

SEQ ID NO: 871 - DNA, 898 bp, Populus trichocarpa
atttatttaacaaaaaattattactacatatcagcgagcaaaatagggtttaaagcttgctcatttcagcaagaggctctctctcttttgtatcttttgcctcctgctgtttcaggtccttgtagagaacacaaacagctgtaaatcatggctgagcagactgaaaaggcatttttgaaacaacccaaagtgtttctcagttcaaagaaatctgggaaaggaaagaggcctggaaaaggtggaaacagattctggaagagtattggattgagtttcaagactcccagagaagccactgaaggaacttatattgataaaaaatgccccttcaccggcactgtttctattcgaggtcgtatcttagctggaacttgtcatagtgccaagatggtgaggacaattattgttcggcggaactatcttcactgggtcaagaaataccaaagatatgagaagaggcattcaaatattccagcacacgtatccccatgcttccgtgtgagggaaggcgatcatgtcatcatcggacaatgcaggccactgtccaagactgttagatttaatgtattgaaagtgattccagctggttctgctgctggtgggaagaaggccttcacaggaatgtgaggttgaacttccattttttttgttcatgctggtgttacagccatattggtttagggttatatcttatgtaagaggcaactcctggagttttgaacagcatagtttgacagcaaatggacaatgagattcttttttttcccctcattttcatgtttttaattaaatgatgattgtcgaagataccactgctactgtttatcaatagcattggaatttgttgcttcatccgcacgagttattgagtaaatcgaagattttagcaaggtgcata

SEQ ID NO: 872 - DNA, 754 bp, Pseudoroegneria spicata
ctcctctcatcgcctcgcctcctcgcacccgcatctccgcgctccgccgccgccgccgcctccgagccgctcgaagcccacctcgcagccatggcggagcagaccgagaagtccttcctcaagcagccaaaggttttcctcagcacgaagaaagctgacaaggctaagaggcctggcaaggctggcaaccgcttctggaagagcgttggcctaggtttcaagaccccaagggaagcgatcgaaggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaaccgtgagattcaatgtcctgaaggtcgttccagctggaaccaccggaggcgggaagaaggctttcatcgctgcttaagcccagattctgatttatgagttagttcatagtcagaggtttatcgcacttgaaacttaccaggctgctgctgttttgcgatttgattcccttgttttctgtcaaaccaaagaatgtctgtcatctgaacatgtcttgtggaatctatctatcattaatagttttgcttaaattagtactatca

SEQ ID NO: 873 - DNA, 914 bp, Oryza sativa
ttccgccgcccgccgccgcatcgccgctgcagcctccttcccccttcgccgccgtacaccctccagccagccatggcggagcagactgagagagctttcctgaagcagcccaaggtcttcctttgcccaaagaaatctggcaaagggaagaagcctggcaagggaggtaaccgcttctggaagaatattggccttggcttcaagacaccccgggaagcaattgaagggacctacatcgataagaaatgcccattcactggaactgtttctatcagaggtagaattattgctggaacatgccacagtgccaagatgaataggacaatcatcgtacgcagaaactacctccattttgtgaagaaatatcagcgatatgaaaagaggcactccaacattccagctcacatttctccatgcttccgtgttaaggaaggagaccatgtcatcattggccagtgcaggcctttatcaaaaactgtgaggttcaacgttattaaagtcatcccagctggttccacaggtggtgggaagaaagcattcattgcagcttgagcttatcgaaaatgcctaatcaatcactagttaaatatacaagtgttcacttagaattcttctagcttgctgttttgaccttctgtctaggtccctggagcatttgccactcatctgaaatgtatccgtgcaagttttgtttagatctctggtcatgcaaattgtggttgctgttgccctgtcgttgggccatgttccttctttgaagcaatagcatcaacagcctgtttgtttcagtcttatgatggtgatgtgcgttatcgttgttttttttaagctggaaattgttcaccatgtcactgacatttcaaaagatgtctatttcacatgaactaaaagatcttgtgatgtttgctattgtg

SEQ ID NO: 874 - DNA, 635 bp, Senecio madagascariensis
cctccctccgccactgatcggatttcttcaacaatggctgaacagactgaaaaggcgtttctgaagcaaccaaaggtctttctatgttcaaagaagagtggaaaaggaaaaaggcctggaaaaggtggaaacagattctggaagagtattggtcttggtttcaagactcctagagaggctattgaaggaagttacatcgataagaaatgccctttcactggggacgtttctatcagaggccgtattcttgctggtacatgccacagtgctaagatggttagaaccattatcgttcgtagagactacctccattatgtcagcaaatatcaacgttatgagaagaggcactccaacattccagctcacatttctccatgtttccgtgtcaaagaaggcgatcatgtcactgttggacaatgcagacctttgtccaagacggtcaggttcaacgtattgaaggtcattccagctggatcttctggtgctggaaagaaggcgtttacaggattttaagtaagatagttcaacagctggattttctcgtggcgaaagtatgtctctaggttttttctttttagcaaagacaattcaatttgatttgctcgtgttgaagtacgtacttggtttgctctagt

SEQ ID NO: 875 - DNA, 723 bp, Sesamum indicum
cctgaacaaaggatctcgatttccagttctcttttgaaagaaaatcgttacaatcaaaagaactagaacaactgccgccactttcctgcatcttcacattctcatctgagctccattgccggcgaccatggccgaacagacggagaaggcgttcttgaagcagccgaaggtgttcctttgctcgaagaagtcggggaagggtaaagctccaggaaagggaggcaaccgctactggaagagcatcggattggggttcaaaacaccccgcgaggccgttgaaggcacatacattgacaagaaatgcccattcactggcaatgtctccatcagaggccgtatccttgctgggacctgtcacagtgctaagatgatgagaactatcattgttcgacgaaactacttgcattgggtaaagaagtaccaaagatacgaaaagaggcattcaaatattccagcacacatttccccttgcttccgtgtgaaagagggcgaccatgttatcatcggtcaatgcaggcccttgtccaaaacggtgaggtttaatgttctcaaagtgatcccagccggctcgtcaagccgtggaaagaaggcatttacggggatgtgagtgataataggctatctgaactctaatcttcttggcatatgttgaataggttattggtagattatttctagacttttatttgattcatttgagagtgctctcacttagcttgagcc

SEQ ID NO: 876 - DNA, 772 bp, Glycine max
agggtttctggatgctgctagtttctgtctgaaagctattctccaccgtagccgcaagcttcgccgtttgaaacagtgcctcaaccatggcagaacaaacagagaaggcttttctgaagcaaccaaaagtgtttctatgctctaagaaaggtgggaagggaaagaggcctgggaaaggtgggaatcgcttttggaagtcaattgggcttggattcaagactcccagagatgccattgaaggaacatatattgacaagaagtgccccttcactggcaatgtttccattcggggtcgtatcctagccggtacttgtcacagtgctaagatgacaaggaccattattgtaaggaggaattatcttcattttattaagaaataccagagatatgaaaagcgacattccaatattcctgcacatacatcaccttgtttccgtgttaaagaaggagatcatgttattattggccaatgcaggccaatctcgaagacagtgaggttcaatgttttaaaagtgattccagctggatcctctagcggagcaaagaaggcatttactggaatgtgaaatttgaattgtgtcagttttcattgaagggtagggttagtttgcgagttagtagaagcttttgttcaaatgcctcagggttgttagttaatgatcaaattaatttttgatatctttcaaggctttgccttgatttgagtggttgtgtgttatggattttaatatagattatggttcttaaatagtagttgcatttatttttatgc

SEQ ID NO: 877 - DNA, 1110 bp, Glycine max
agggtttctggatgcggcttctttctgtctgaaactattatccacagtagctaagcctgcaagcttcgccgtttgaaacagtgcctcaaccatggcagaacaaacagagaaggcttttctgaagcaaccaaaagtgtttctatgctctaagaaaggtgggaagggaaagaggcctgggaaaggtgggaatcgcttttggaagtcaattgggcttggattcaagactcccagagatgccattgaaggaacctatattgacaagaagtgccccttcactggcaatgtttccattcggggtcgtatcctagccggtacttgtcacagtgctaagatgacaaggaccattattgtgaggaggaattatcttcattttattaagaaataccagagatatgaaaagcggcattcaaatattccttcacacatatcaccttgtttccgtgttaaggaaggagatcatgttattattggccaatgcaggccaatctcaaagacagtgaggttcaatgtgttgaaagtgatccccgctggatcctctagcggtgcaaagaaggcttttactggaatgtgagatttgaattttcagttctcattgaagggtagtgttaccttacaaagttagtagaagcctctgttcaaatacatcaaggttgagttaaagattgaatcaattttttgatatcttgtaatgctttgagtggttatatgttacagactttaattgttgaatagtagttgcagttatttctgttttcaggtcatgcttactcttatcttcttgtctccattctctttatttatttttttccttcatcgttggattttttgctacaataaaatgctcaatgggattatctcaagtttgttggggctagtacacttaactcttcggttgaggaggattttgtgataagtttctccataacaaacctcccttatgttgtgaatgggaaggtttctgtgaaaggttcctgggtcgggtgaaattttgttcaagaatttgtttctagactttggcaccgtacacaacttatttggactgttattcgatattgaactttaagtagggatgaagtggcaattgtggagacaaagggatgtgaaacagaa

SEQ ID NO: 878 - DNA, 730 bp, Euphorbia esula
attcactctgcagctgcctcttccattttctttctccctcagcagaatcatcaactatggcggaacaaacggagaaagcttttttgaagcaaccgaaggttttcctaagctcgaagaaaactggaaagggtaagaggcctggtaaaggtggaaatcgtttctggaaaagcgttggattgggtttcaagactccaagagaagcaattgaaggaacatttattgataagaaatgcccattcactggcactgtttccattaggggccgtatcttggctggtacttgccacagtgcaaaaatgaccaggaccattatagttcggaggaattaccttcactttatcaagaaatatcagaggtatgaaaagcgccatgcaaatatccctgctcatgtatccccatgcttccgtgtgaaagaaggggaccatgttatcattggccagtgcaggccgctttcaaagacggtgagattcaatgtgctacgtgtcattccagctgggtcttccggtggggtaaagaaggcttttacagcagtgtaaaggctgatgatgatgaaagcatttgtggcaattttctgctgtttttatggcgtttatcagcagtatgaactgagtctcagattttaaactttgttctagtttttgttatacctttagactgcacatctctaaatatatgtcgacatattttggaagatgtttattgctttattttagagttgcctttgtttttt

SEQ ID NO: 879 - DNA, 1192 bp, Fragaria vesca
cacctcctctccgctcttgatccttgttcgcgcggccagtagtctccacagaacaacagctcaaacatggcggaacagacggagaaggctttcctcaaacagcccaaggttttcctcagctccaagaagactggtaagggcaagaggcctggaaagggaggcaatcgcttctggaagagcgttgggctcggctttaagactcccagagatgctattgaaggaacatacattgacaagaagtgcccttttactggcaatgtctccatcaggggtcgcattctggctggtacctgccacagtgcaaagatgtccaggactatcattgtgcggcgcaattacctccactacataaagaagtatcaaaggtatgagaagaggcattcaaacattcctgcccatgtttcaccatgcttccgtgtgaaggagggagatcatgtcatcattgggcagtgcaggccattgtcaaagacagtgaggtttaatgtcttgaaggtcattccagctgggtcttcttctgcctttgggaagaaggcattcactggagcataagatagcatttctggcagtttatgcaactaccttaggttgagttatcttttggaacatctgttttttgccaatttaatttgcgccttttatgtaatttgaatgttaaggttatcttcagaactataattttgaatcccaaaatactgtgttttctgcggaaaatttgttagaatgccatagtctgattatgtatgagcaaaagagttgtcattgcgctggagtcaaatcccactggctgtgcctgttttcagttttcacattcttttcttgtggaatgtgaactgatctgtgtgatggttaatcaaatgatgtagtcaaaactgttggagataggcttatgttgaagaatggtttcaatgttcccatcaaacaggaagacacgcttacgatttcttgcttgagcaactgaatggagaatccagttttgaattctatgcatgcaatcagtgtctaagttcaacatgaaccattgagctccaattatttcatttttgttgtcacttgattaaccaagtgagccgttcctgcactcaaggtggtggccggttcgattttgtcatggattggagatttggagtgtagaggtcattatatccgtcactacatgtttgattgtactatttaggcttccattgtgaacgta

SEQ ID NO: 880 - DNA, 873 bp, Fragaria vesca
actagcactagggtttccgcacatctttcatctcaaagctttgcagcctctctctctcactcttttcgcgcgccgtcgtcatcgtcctcaaccagagagacctcaaagatggcggagcagacggagaaggctttcctgaagcagcccaaggtgttcctcagctccaagaagactgggaagggaaagaggcccggaaagggaggcaatcgcttctggaagagcgttggtttgggattcaagactccaagagatgccattgaaggaacatacattgataagaagtgccctttcactggcaatgtctccatcaggggtcgcattctggctggtacctgtcacagtgcaaagatgtcaaggactatcattgttcggcgcaattacctccactacataaaaaaataccagaggtatgagaagaggcattcaaacatcccagcccatgtttccccatgcttccgtgtgaaggagggagatcatgtcatcattgggcagtgcaggccattgtcaaaaacagtaaggtttaatgttctgaaggttattcctgctgggtcttcttctgcctttgggaagaaggcattcactggagcataagatggcattttgggcagcctcctagtgttatttatgcaattacaatagattgagtttcttttggaacatctttcgtttgccaatttatttgcacctttatgtaatctgaatgttaatgttttccttaggaccatcgaaattttggatcgtattatcaaatactgtcttatgtcgatggatgttatactgccattttcttatattcatggctctttatgaaagcagacgtaatttcccctaggttttcattcaaaactgtcgaattgggatttctcattattc

SEQ ID NO: 881 - DNA, 673 bp, Helianthus annuus
tcttctctgcaactataaccgccgctgcaaagcttctaatttcagatcaacaatggcagaacaaaccgagaaggcgtttttgaagcaaccgaaggtgttcctatgctcgaagaagagcgggaaaggaaagagacctggaaaggggggaaataggttttggaagaatattggtctcggatttaagactcctagagaggctattgaaggaacatatattgacaagaaatgccctttcactggtgatgtatccatcagaggccgtattttggcgggtacttgccacagtgctaagatggtgaggactattatcgtacgaagggactatcttcattatgtgaagaagtaccaaaggtatgaaaaaaggcactcaaacatccctgctcacatctcaccatgctttcgtgtgaaagaaggcgaccatgttactgttgggcaatgcagaccgttgtcgaagacagtgaggttcaatgtcttgaaggtgattccagcagggtccgcaagtggtggaaagaaagcattcacaggcatatagagtgctcaccttcttgcttgattatgcaaaagtttttgagaagaaaacaggagttttgtggtttttcatgacattattttgctgttgtttaagtttatcttgacactcccaatagttattttttatgaaattttcatctgg

SEQ ID NO: 882 - DNA, 856 bp, Helianthus annuus
gtgcctccacaggtgaaagaaaagctcggatctcttcaacaatggcggaacagacggagaaggcgtttttgaagcaacctaaggtgtttttatgctcgaagaagagtgggaaagggaagaggcctgggaaaggtggaaacagattctggaagaatattggtcttggatttaagacacctagagaggccattgaaggaacttacatcgacaagaaatgccctttcaccggtgatgtatctattagaggacgtattcttgctggtacatgccacagtgcaaaaatggttaggaccattattgttcgccgggactacctccattatgtcaagaagtatcaaaggtacgagaagaggcactcgaacattccagcacacatttctccatgttttcgtgtgaaagaaggtgaccatgtcaccgttggacagtgcagaccactgtccaagaccgtgaggttcaacgtgttgaaggtgatcccagctggatctgccagtggagggaagaaggcgtttacaggcatataagaaaagcttatctttcctgttttgttaggttttgcaaaaagagtgaactttgatttgcagattttgaattgaaatgtggtttggttgtgttgaagatttatgtagactctagtcttcttttacctaagacatgataatttaccatttcgtgttatgcaacatgtgttggtgaattgagtttgtttcgtttctttgaagaggttttatttttctagatgtgttttggtttagggcttctttgacttgagtttttacatgcttggtatgtttatgcataatggcatgaaactcaagtgggtttgaattgtatacaaatagtagggctacgaaatttt

SEQ ID NO: 883 - DNA, 647 bp, Helianthus annuus
cctccgtcactgctcggatctcttcaacaatggcggaacagactgagaaggcgtttttaaagcaacccaaggtctttttatgttccaagaaaagtggaaaggggaagaggcctgggaaaggtggaaacagattctggaagaatattggtcttggcttcaagactccaagagaagctattgaaggaacttacatcgacaagaagtgccctttcactggtgatgtctccattagaggacgtattcttgctggtacatgccacagtgcgaaaatggttaggaccattattgttcgtcgggactacctccattatgtgaagaagtatcagcgttatgagaaacgccattcaaacatcccagcacacatttcgccatgtttccgagtgaaagaaggtgaccatgtcaccgttggacagtgcagaccattatccaagacagtgaggttcaacgtgttgaaggtgattccagctggatcttctagcggtgggaagaaagcgtttacaggcatatgacaagcttgatcctcttctttagcttcttgttaggctttgcaaaagcaatttaatttgatttgctatgattttgaagtatgtaatgtgattgtgaaccttatttaatgtttctataaacaaaatatttttttcaaaaaa

SEQ ID NO: 884 - DNA, 667 bp, Helianthus annuus
gtaaccgccgctgcaaagcttctaatttcagatcaacaatggcagaacaaaccgagaaggcgtttttgaagcaaccgaaggtgttcctatgctcgaagaagagcgggaaaggaaagagacctggaaaggggggaaacaggttttggaagaatattggcctcggatttaagactcctagagaggctattgaaggaacatatattgacaagaaatgccctttcactggtgatgtatccatcagaggccgtattttggcgggtacttgccacagtgctaagatggtgaggactattatcgtacgaagggactatcttcattacgtgaagaagtaccaaaggtatgaaaaaaggcactcaaacatccctgctcacatctcaccatgctttcgtgtgaaagaaggcgaccatgttactgttgggcaatgcagaccgttgtcgaagacagtgaggttcaatgtcttgaaggtgattccagcaggatccgcaagtggtggaaagaaagcattcacaggcatatagagtgctcaacttcttgcttgattatgcaaaagtttttgagaagaaaactggagttttgtgggttttcatgacattattttgctgttgtttaagtttatttcgacacttacaatagttattttttttatgaaattttcatctggtgtctt

SEQ ID NO: 885 - DNA, 697 bp, Helianthus annuus
atttgtgcctccacaggtgaaaaaaagctcggatctcttcacaatggcggaacagacagagaaggcgtttttgaagcaacctaaggtgtttttatgctcgaagaagagtgggaaagggaagaggcctgggaaaggtggaaacagattctggaagaatattggtcttggatttaagacacctagagaggctattgaaggaacttacatcgacaagaaatgccctttcaccggtgatgtatctattagaggacgtattcttgctggtacatgccacagtgcaaaaatggttaggaccattattgttcgacgggactacctccattatgtcaagaagtatcaaaggtacgagaagaggcactcgaacattccagcacacatttctccatgttttcgtgtgaaagaaggtgaccatgtcaccgttggacagtgcagaccattgtccaagaccgtgaggttcaacgtgttgaaggtgatcccagctggatctgccagtggagggaagaaggcatttacaggcatataagaaaagcttatctttcctgtcttgttaggttttgcaaaaacagtacactttgatttgcagattttgaagtgaaatgtggtttggttatgttgaagatttatgtagactctagtcttcctttacctaagacatgatgatttaccattttgtgctatgcaacatgtgttggtgaac

SEQ ID NO: 886 - DNA, 747 bp, Triphysaria pusilla
cacacattcatcgtcagtctactttctccattttcacattctcctctgcaatccattgccaaaaaccatggcggaacagacagagaaggcgttcttgaagcagcctaaggttttccttagctcgaagaaaacaggaaaggggaaggctccaggtaagggaggcaatcgctactggaagagcatcggattagggttcaaaacaccccgcgaggccattgaagccacttacattgacaagaaatgtccgttcactggcaatgtatccatcagaggccgtatcctagctggaacctgccacagtgctaaaatggtgagaacaatcattgttcgccgtaactacttgcattgggtcaagaagtaccaaagatatgaaaagaggcactcaaacattgctgcacacatatctccatgcttccgtgtgaaagagggcgaccatgttatcatcggccaatgcaggccgttgtcgaaaactgtgaggttcaatgttcttaaggtggtaccagccgggtcatcaggtcttggcaagaaggcctttactgggatgtgatttgaggtagtcaaactttttgttacgacgtttaaatagattatcgagatatgtgttctcgacttatgactcatttcagttttggactattactgtgaactttcattttgggtttgcacttttgagatttgatcaacagtctgatggatttctatatttcagtactttttttttagtttcaagtaaaccaaaaaaaaaaa

SEQ ID NO: 887 - DNA, 688 bp, Triphysaria pusilla
acattctcctctgcaatccattgccaacaaccatggcggaacagaccgagaaggcgttcttgaagcagcctaaggttttccttagctcgaagaaaacaggaaaggggaaggctccaggaaagggaggcaatcgctactggaagagcatcggattagggttcaaaacaccccgcgaggccattgaagccacttacattgacaagaaatgtccgttcactggcaatgtatccatcagaggccgtatcctagctggaacctgccacagtgctaaaatggtgagaacaatcattgttcgccgtaactacttgcattgggtcaagaagtaccaaagatatgaaaagaggcactcaaacattgctgcacacatatctccatgcttccgtgtgaaagagggcgaccatgttatcatcggccaatgcaggccgttgtcgaaaaccgtgaggttcaatgttcttaaggtggtaccagccgggtcatcaggtcttggcaagaaggcctttactgggatgtgatttgaggtagtcaaactttttgttacgacgtttaaatagattatcgagatatgtgtcattttggactattactgtgaactttcattttgtgtttgcacttttgagatttgatcaacagtctgatggatttctatatttcagtacttttttttagtttcaagtaaccttataagagc

SEQ ID NO: 888 - DNA, 862 bp, Tripterygium wilfordii
gagttttctctcagagaggcagcgactagcgagtgtagctcttatcaaaacttcgcctccataaccagcggaacagtcgctccttcactgacagctctcaatcatggccgagcagaccgagaaggcatttctgaagcagcccaaagttttcttgagttcaaagaaaactgggaaagggaagagacctggaaagggcgggaaccgcttctggaagagcattggcttgggtttcaagactccaagagaggccattgaaggaacctatattgataagaaatgccccttcactggtaccgtttctatcagaggccgtatcttggctggcacttgtcatagttccaagatgatgaggtcaatcattgtacgacgtaactatcttcattttgtgaagaagtaccaaaggtatgagaaaagacactctaacattcctgcacatgtatcgccatgcttccgtgtgagggaaggtgatcatgttatcattggccagtgcaggccattgtcaaaaaccgttagattcaatgtgttgaaggtgattcctgctggatcttctgctggtggaaagaaggcctttaccgggatgtaattttggctttttgcaatttcatggtagggtgctgtcacaagcatatggtgttaggttgtttgttgatttgattatgtaagggaaacctttgggaatttctcaatattcctacctttaaaaattcgtgtacttttttgctaccaaatgtttttctgtttcagttaattacttaaatcatggttttgacgatgcctagtagttgggatcggaatctttctgtctctgaggaatatatggcttttttttttttttaaaagtaaaagccatatattcctcaga

SEQ ID NO: 889 - DNA, 665 bp, Vicia sativa
caaacttccaggtgtgaaacaaacctcatcaaccaaccatggcggagcaaactgagaaggcttatttgaagcaacccaaagtgtttctatgctcgaaggtatctgggaaggggaagaggcccggtaaaggtgggaatcgattctggaagtctgttggacttggatttaagactcccagggatgccattgaaggaacctatattgacaagaagtgtccgttcaccggcaatgtctcaatccgtggtcgtattatagctggtacttgtcatagtgctaagatgaataggaccatcattgttaggagaaattatcttcatttcatcaagaagtatcagagatacgagaagcgtcattctaatatccctgcacatgtttcaccttgtttccgagtcaaggaaggagatcatgtcattattggccaatgcaggccactttcgaaaacagtcaggttcaatgtattgaaagttatcccagctggctcttctaatcttgcaaagaaggcttttacaggaatatgagtttgaaatttgtttaaatgctttgcattgatttgagtagttaatgtttaagattttgatataagttattgcttttgagtaagagttgcacttatttttggcataatgctagtgcttacttattaatatatttttaaaacttctttc

SEQ ID NO: 890 - DNA, 768 bp, Artemisia annua
tggtatcaacgcagtactccgacggggacgcttgttattatctcattctctttgtgtgcctccattgttagtttgcagcagctgggatcacttgttcttcatcaacaacaatggctgaacagactgagaaggcttttttgaagcaacccaaggtctttctttgttcaaagaagagtgggaaagggaagagaagggaggaaacagattctggaaaagtgttggtcttggcttcaagaccccaagagaggctattgaaggaacttacatcgacaagaagtgcccattcactggtgatgtctccatcagaggacgtattcttgctggtacttgccacagtgctaagatggtgaggaccattattgttcgcagggactacctccattatgtcaagaaatatcaaaggtacgagaagaggcattcaaacattccagctcacatttctccatgtttccgtgtgaaagaaggcgaccatgttaccgttggacagtgcagacctttgtccaagactgtgaggttcaatgtgttgaaggtgattccagctggatcttctggtggtggaaagaaggctttcacaggcatataagaggcttgtgcttgtttagcatgttaggtttatgcaaaaacaatttattttgatttgctgattttgaagtgaaatgtggtttgagtaagaccttggtttaatgtttctgtagacaattgtttgctctagtcttaatactcttgatggttatgattacggtattattgttgctaaaacgcactcgt

SEQ ID NO: 891 - DNA, 797 bp, Arachis hypogaea
gcagtggtatcaacgcagagtacgggggagggttttgcgtgctccgtgctgttctttgctgctgttcgttctctctgctgcttgcaccacgcaccttccaggattcaccaatggcggaacagacggagaaggctttcttgaagcaacccaaggttttcctctgctcgaagaaatcagggaaagggaagaggcctggaaaaggaggcaacaggttctggaaaagcattggtttaggtttaagactcccagagaggctattcaagggacttacattgacaagaaatgcccattcactggcactgtgtccatccgaggtcgcattcttgcaggtacttgccacagtgccaagatgaccaggactatcatcgttcgtcgcaactatcttcatttcattaagaaataccaaaggtacgagaagaggcactcaaatatcgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccaatcccatttcccagattagatttaggaactcgcctgtgtgatttcctaaattcgtttaggagggatttatatttgtatgcttttgatttgattttttattccagtctcttttttttcccaccctaacagctgtgttatcagttttgacttttgatgtttaaaatatacaattagtcctttagtttctggcaaa

SEQ ID NO: 892 - DNA, 943 bp, Ananas comosus
gtatgatgttcttacctgcatttattgggtctttgtacttctgaatcaaatttatagtctttaatctgtttttattctatttccttcatttacttgtaaactctgatggtcaattccctgttgcacaagaaacaagttctcctatttattaaatgttttgttcttctacgacccctcatctgatatgtccaattgtccgtgaagaacgtatttaggacttgcagtttttccataattcttatgcttgcattttcttttcttgcagacggagaaagctttcctcaagcagccaaaggttttcctttgctccaagaagtctgggaaggggaagaggcccggtaagggtgggaaccgcttctggaagagcattggcttgggatttaagacacccagggaagcaattgaaggtacatatattgacaagaaatgcccattcactgggactgtttccattagaggccgcattttagctggaacatgccatagcgccaagatgaacagaactattatcgttcgcagaaactacctccatttcgtgaagaagtatcaaaggtacgagaaaaggcattccaacattccggcacacatatccccctgcttccgtgtgaaggaaggcgatcacgtgattatcggtcaatgcaggccgttgtcgaagactgtgaggttcaatgtcttgaaagtcattcctgccggatcaacaggtggcggcgggaagaaggctttcaccgcagcttgaggcccgcgacgcagccagaatcgtttttctcattttgagttttagagttgattaagtctctgaattttcctttcagccataagactttgcagcttaaatcagatgtttttcactttgtgattttggagttaatcattggagtactttgcctttttgtagctgagattgcactttgttattctgctatataatatttcatttaggcca

SEQ ID NO: 893 - DNA, 726 bp, Secale cereale
gggggccaactcctctcagagtctcgcctcctcgcacccgcatctccgcgccgaccgccgcctccgagccgctcgaagcccacctcgaagccatggcggagcagaccgagaagtctttcctcaagcagccgaaggttttcctcagcaccaaaaaggctgataaggcaaagaggcccggcaaggctggcaaccgcttctggaagagtgttggccttggtttcaagaccccgaagagaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaactgtgagattcaatgtcctgaaggtcgttccagctggaaccaccggaggtgggaagaaggctttcatcgctgcttaagaccagactctgattcatgagtagttcatagtcagaactttttcgcacttgaaatctaccaggctgctgtttgagatttgattcccatgttttctgtcaaaccgaatgtcgtgatctgaacatgttttgtggaatctatctatcattaatagt

SEQ ID NO: 894 - DNA, 854 bp, Sarracenia psittacina
ctcgctatttaaaagcttctgttaagatccgccgactccactctctgactaggtcaaggtttcaccgagcttccagctctcgtcttgctcctcctacattctacaaagctctacagcccttaatcatggccgaacagacggagaaggcgttcttgaagcagccaaaggttttcctttgctcgaagaaagtcgggaagggaagaggcgggaaagggtgggaatcgatactggaagagcgttgggttgggcttcaagactcccagagatgcaattgaaggaacttatattgacaagaaatgtccattcactggaaatgtgtctatcaggggtcgtatacttgctggaacctgtcacagtgccaagatggtgagaacgatcattgttcgacgcaattatcttcattttgtcaagaaataccaaaggtatgagaagcggcattcaaatattccagctcacatatccccatgcttccgtgtgaaagagggagatcatgttattattgggcagtgcaggccactgtcgaagactgtgaggtttaatgtgttgaaagtgattcctgctggttcttcgggtggtgggaaaaaggcatttacagcaatttgaggtttggttgcccaattatctttagtagtgatatgatttaagtgggacaagggcattagagtgttctatttatatttgttgaactatttctatttaatttgctactggaagttttggatttttgtatgggagccaatttagggtttcagggaaacaagcatttgaatctttccaagtcttcttttgtctgctaattagtttattctatagattactcttcagttgttaggagagaagcatctggagtttat

SEQ ID NO: 895 - DNA, 1091 bp, Trifolium pratense
gagagagtgagagagggttttcgacgagtgcggctaaaattagggtttctcattttcctctgcaaaactctcgaattccatcaccatggctgaacaaactgagaaggcttttctgaagcaacctaaagtgtttctaagctcgaagaaatctggaaagggaaagaggcctggaaaaggtggaaatcgcttttggaaatccattggtcttggatttaagactcccagagatgccattgaaggagcctacattgacaagaagtgccctttcactggcaatgtttccatcaggggccgtattttagctggaacttgtcacagtgctggctaaaatgaataggactattattgttaggaggaattaccttcactttattaagaagtatcagaggtatgagaagaggcattcaaacattcctgctcatgtatcaccttgcttccgtgttaaggaaggagaccatgttattatcggccaatgcaggccactctccaagacagtgaggttcaacgtgttgaaagtgataccagctggatcatctagtggtgcaggaaagaaggcttttactggaatttgagatctgatcgactttcgtagtatagagatcttatcatctgtgtgaaaagcaattctgatttctgtatggtgaagttctgatcaattttggtttgcttttaaagttatgtactgtgatcggatataagattatgttatttgggttttctctcggacatgatgtttttatggttattaaatactagttgcaattattttgaattttggattgtgaaagcaattttctcacttctttatatatgaaatcaatgtctagtaatctgagataaaagcagatgtgatccaacattgatatcagtttacaaactggaaattagaagtgaagcctacacatacatatacctgctttcagtttcttttcttttttacgagaaagctatagcatccttgataaaggaggctaaatttcatttcaaactcaggtgtaaaaacctttcaattcaatgcctttttgtccaatttatgctttacgacacaaagcatcaataacaattcctgatgttccctactcaataaagtg

SEQ ID NO: 896 - DNA, 962 bp, Phalaenopsis aphrodite
aaaaaggttaacgtagaacaattagtatcaaaaaaaaaccatcaataccatcgcagagaaagagataagtttatatggtacctcaagtggaattttgtcaattttgattcctagaaccttggaatttgatgaactcttctattcttgccttgagctccacattgggcaccaacatctcttgagtcaaatgtgaccggttaaatggagctagtttctaagaaagcgtgtaccgcttcgccctgcgcttgcagtctacagttttcggttcttatctcgattagccatggcggagcagactgagagggccttcctcaagcaaccaaaagtgttcctaagctcaaaaaagtctgcaaagggtaataggcctgggaagggtgggaatcgattttggaagaatgttggtcttggcttcaagacacctagggaggccattgaagggacctacattgacaagaaatgcccatttactggcaccgtctctataagaggccgcatcttagcaggcacttgtcacagtgccaagatgaataggacaatcatcgttcgtcgggactaccttcactatgtgaagaaatatcagaggtacgagaagagacattctaatattgctgcacatatttcaccatgcttccgtgtgaaggaaggcgatcacgttataattgggcaatgcaggccattagcgaagactgttcggtttaatgtgctgaaggttatcccagctggctctaccggtggctccaagggaaagaaggccttcgctgctgtttgaggctgctgagtatttctcaaaggtcgctaagcagagttaagattatgctagttttgtgttcagattaaagtgcttgtttacagtactgttttgttaagaatttgttgggattttgtgtttttattgaacttggaagtgttgaaaacatttgagttattttcttgtattttttttcttataattggaatttatt

SEQ ID NO: 897 - DNA, 798 bp, Persea americana
tctatcgcccccctctctctctctctctccctctccatctcccagccccgttctcgcctgcgttggaggagctcttgttgttgatcatggcggagcagacggagaaggcgttcttgaagcaaccaaaggtgtttttatgctcaaagaagtctgggaaggggaagaggcctgggaagggcgggaaccgatactggaaaagcattggattgggtttcaaaacaccgagagaagcgatggaagggacatatattgataagaaatgcccctttactggtaatgtttctatcaggggccgcatcctatcgggtacctgtcacagtgccaaaatgaatagaaccatcattgtccgtcgggactaccttcactatgtgaagaaataccaaagatatgagaaaaggcactcaaatattccggcacatacatccccatgcttccgtgttaaggagggtgaccatgttatcattggccaatgcaggcccttgtcaaagacggtgaggttcaatgtgctgaaagtcattccagctggatcctctggagtgggggaagaaggctttcacagcaatttaatacctcttcttaactttgctggatttggtttatgaacaggattttagatttgttttaagctttactactagtgccgaaaattttgggtattcaaatagtgagacttcgtattcctttcctattcctgttatgtgcttccattaaaacaatatgtagttctctatacatcaacactggatgaattccatggacgctggagttttggacctcatgaattttgtcatgagttca

SEQ ID NO: 898 - DNA, 887 bp, Sarracenia psittacina
tccgctaggtcaagggtatctaccgagcttccagctctcgtcttgctcctcctacattctacaaagctctacagcccttaatcatggccgaacagacggagaaggcgtttttgaagcagccaaaggttttcctttgctcgaagaatcgggaagggagaggccgggaaagggtgggaatcgatactggaagagcgttgggttgggcttcaagactcccagagatgcaattgaaggaacttatattgacaagaaatgtccattcactggaaatgtgtctatcaggggtcgtatacttgctggaacctgtcacagtgccaagatggtgagaacgatcattgttcgacgcaattatcttcattttgtcaagaaataccaaaggtatgagaagcggcattctaatattccagctcacatatccccatgcttccgtgtgaaagagggagatcatgttattattgggcagtgcaggccactgtcgaagactgtgaggtttaatgtgttgaaagtgattcctgctggttcttcgggtggtgggaaaaaggcatttacagcaatttgaggtttggttgcccaattatctttagtcgtgatatgatttaagtgggacaagggcattagagtgttctatttatatttgttgaactatttctatttaattttctactggaagttttggatttttgtatgggagccaatttagggtttcagggaaacaagcatttgaatctttccaagtcttcttttgtctgctaattagtttattctatagattactcttcagttgttaggagagaagcatctggagtttatatttgaaacggaattgcttgtttgttcaaactccgaatatatatatatatatattctttcttgatattgttcatgac

SEQ ID NO: 899 - DNA, 684 bp, Utricularia gibba
ggcgggagcagacggagaaggcgttttgtaagcagccgaaggtttttcttctgctcgaagaagtcggggaagggtaaggccccaggtaagggtggcaatcgcttctggaagagcattggcttagggtttaagacaccccgagaggccatcgaagggacatacattgacaagaagtgtcccttcactggcactatctctatccgaggccgtatccttgctgggacgtgtcacagcgctaaaatgacaagaaccatcatcgtccggaggaactaccttcactgggtcaagaagtaccagagatatgagaagcggcattctaacataccagcccacgtctccccttgcttccgtgtgaaggagggcgaccatgttatcattggccagtgcaggccattatcgaagacagtgagattcaatgttctcaaggtgatacccgccggctcttcagggcaggggaagaaagccttcaccggtatgtgagttaaggcaacttccagtgatctgatcactcctgcggcttttcctggaagtacttctcctccccaaaacactgctctctcatattctgccgtgcgttgcttgggaaaggcatcccttttgtctagtcttgttatcaatagtgcatctgcaatggtgttggttatgaatgagatttttttgacgtgaagacggctctgctgtttg

SEQ ID NO: 900 - DNA, 810 bp, Amaranthus tuberculatus
ttttgttgcattagggttttgtgtgtgccgtaaatcgattcttgttgcacttgaaactttctcaaaccctaacaatggcggaacagaccgagaaggcatttttgaagcagccgaaagttttcctttcgtcgaagaaatcagggaaaggaaagagacctggaaaaggaggaaacagattctggaagagcattggtttgggattcaagactcctcgtgatgcaatcgaaggaacatacatcgacaagaaatgcccattcaccggaaatgtttctatcagagggcgtatccttgctggtacctgccacagtgctaagatgcaaagaaccatcattgttcggcgcaactaccttcactacatcaagaagtaccaaaggtacgagaagaggcactccaacatttctgctcacatttcaccttgtttccgtgtgaaggaaggcgaccatgtcatcattggtcagtgcaggcccctatcaaagacagtgagattcaatgtattgaaggttattccagctggatcagccgctggtggcaagaaggcattcactggcatgtaaaccagcttttggctctctttttggccaattacgatagcagtcgaaggaactttattcatgtattttcatatatgcttgtaggagtgcttctatgtctggtcttgatatttttctttttggtaaatcagttccttagttttgatattactgtctaattcaattcttctctagttcatgtttgcttgagcttttcattcggacccaaagggttaccctggaatcggttcatatgtttcatatggtctgtttttggaag

SEQ ID NO: 901 - DNA, 930 bp, Amaranthus tuberculatus
ctattcaatcaacattagggtttgtgtgtgccgaaaaactcctctttcccttcagagcctaagaagcctcttcaaaccctaacaatggcggaacagactgagaaggccttcttgaagcagccgaaagttttcctttcgtcgaagaaatcagggaaaggaaagagacctggaaaaggaggaaacagattctggaagagcattggtttgggattcaagactcctcgtgatgccattgaaggaacttacatcgacaagaaatgccccttcaccggcaatgtttctatcagaggtcgtatccttgctggtacttgccacagtgctaagatgcaaagaacaatcattgtccgtcgcaactatcttcactatatcaagaagtaccaaaggtatgagaagaggcactccaacatatctgcccacatttcaccttgtttccgtgtgaaagaaggcgaccatgtcatcattggccagtgcagacccctgtcaaaaacagtgagatttaatgtattgaaggtgattccagctgggtcagccgctggtggcaagaaggctttcactggcatgtaatcccgagtttggcttgaattctagttttggcaagttatgaaagcagtcaattaaaaccttttcatgtattttcatacatgcttgtaggagtatttctatgcttggtccttgagagttctttttgtcaattcgaatccttaattttgatattgctagcaaatctcatcaatacattcatctaatcatggttatctgcttacacctgttacttcgaccatagtatgcaagctagttttcaatgtgttgatttgtgtctagattggtagctcttaaaccaatcaaaataattgttgaggttcttggtgagtttatagcctaacagtttataatacatatacaaccgataagaatttagtcgtgggtagg

SEQ ID NO: 902 - DNA, 914 bp, Amaranthus tuberculatus
ctttattgcattagggttttgtgtgtgccgtaaatcgatttcctgttgctctcgaaactttctcaaaccctagcaatggcggaacagaccgagaaggcatttttgaaacagccgaaagttttcctttcgtcgaagaaatcagggaaaggaaagagacctggaaaaggaggaaacagattctggaagagcattggtttgggattcaagactcctcgtgatgcaatcgaaggaacatacatcgacaagaaatgcccattcaccggcaatgtttctatcagagggcgtatccttgctggtacctgccacagtgctaagatgcaaagaaccatcattgttcggcgcaactaccttcactacatcaagaagtaccaaaggtacgagaagaggcactcaaacatttccgctcacatttcaccttgtttccgtgtgaaggaaggcgaccatgtcatcattggacagtgcaggcccctatcaaagacagtgagatttaatgtattgaaggttatcccagctggatcagccgctggtggcaagaaggcattcactggcatgtaaaccagattttggctctctttttggcaatttacgatagcagtcggaggaactttattcatgtattttcatatatgcttgtaggagtgcttctatgtctggtcttgatatttttcttttcgtcaaatcagttccttaattttgatattgctgtttaattcgatatcgaaaattcttctctagttcatgtttgcttgagcttttcattcggacccaaacggttaccttggaatcggtttatattttacatatggtctgttatgggaagcaaagtaattatttgtggtgattggtttctccatctcaattctgagctgcctcaaaagatatgtattgactattgaatattgaatttagtatta

SEQ ID NO: 903 - DNA, 909 bp, Amaranthus tuberculatus
atgttgacgatgccggagcctatttcatcagtgctgtttgactggaaaaatgatagccctacactgttaactgctaatagtcaaggaactattaaggggctagtacttgctgcttaatctactcccaagtcagcagtctctattcactcccaagtcccaactagggttttttgctatcgcctcagaagccaaatcgaatcctaacaatggcggaacagaccgagaaagcttttttgaagcaaccgaaggttttcctttcgtcgaagaagtcggggaaaggaaagagaccgggaaaaggaggaaacaggttttggaaaagcattggcttgggattcaaaactcctcgtgatgcaattgaaggtacatacatagacaagaaatgcccctttactggtaatgtttctatcagaggtcgtatccttgctggtacctgccacagtgctaagatgcaaagaaccatcattgttcggcgcaactaccttcactatatcaaaaagtaccaaaggtatgagaagaggcactcaaatatttctgcccacatttcaccttgttttcgtgttaaggaaggtgaccatgtcatcatcggacagtgcaggcctctatcaaagacggtaagatttaacgtactgaaggttatcccagcagggtcagctgctggtggcaagaaggcatttactggcatgtaaccagattttgaccccaattctagttttggcaaattttaaaagtaatcagatgaaacttttttcatgtattttcattcaattgctttgtttttacagagacattcaaaatttttaaaaatatcctctaaatgcggaacagctaaggatacacgtaaaattttgatatattttatggtaatttaacgtatatctttgaatatatagtcgtgggaggcgaaggcac

SEQ ID NO: 904 - DNA, 691 bp, Amaranthus tuberculatus
aactttctcaaaccctaacaatggcggaacagaccgagaaggcatttttgaaacagccgaaagttttcctttcgtcgaagaaatcagggaaaggaaagagacctggaaaaggaggaaacagattctggaagagcattggtttgggattcaagactcctcgtgatgcaatcgaaggaacttacatcgacaagaaatgcccattcaccggcaatgtttctatcagagggcgtatccttgctggtacctgccacagtgctaagatgcaaagaaccatcattgttcggcgcaactaccttcactacatcaagaagtaccaaaggtatgagaagaggcactccaacatttccgctcacatttcaccttgtttccgtgtgaaggaaggcgaccatgtcatcatcggacagtgcaggcctctatcaaagacagtgagattcaatgtattgaaggttatcccagctggatcagcggctggtggtaagaaggccttcaccggcatgtaaaccagattttggctctcattttggcaaattataatagtagtcggaggaactttattcatgtattttcatatatgcttttaggagtgcttctatgtctgctcttgatatttttctttttgttaaatcagttgcttaattttgatattgctgtctaattcggtattgaaaattcttctctagttcatgtttgc

SEQ ID NO: 905 - DNA, 623 bp, Antirrhinum majus
caacaatggcggagcagactgagaaggctttcttaaagcagcctaaagtgttcctatgctcgaagaagacgggtaagggtaaagcgcctggaaagggaggtaaccgctactttaagagcattggattagggttcaaaacaccccgagaggctgttgaaggcacgtatattgacaagaaatgcccttttgttggaaatgtgtcgattagaggtcgtatcattgctgggacatgccacagtgcaaagatggtgagaaccatcattgttcgtcgtagttaccttcactggatcaagaagtaccaaagatatgagaagagacattcaaacattccagcacacatatctccatgctttcgtgtgaaagagggagatcatgtcatcattggccaatgcaggcctttgtcaaaaaccgtaaggtttaatgttcttaaagtggtaccagccggttcttctggtcgtgggaagaaggccttcacaggaatgtgagttcggcttttgcagagcttttagatttttctttctattggaacagttagctcgatttctcttgagagcttaagtttttgtatgtttcttttatgatgtactctctgataacaagtctttaatatttcttagatttaa

SEQ ID NO: 906 - DNA, 744 bp, Malus domestica
tccgcacagattagggttttgttgctcattcggtctctctgcttacggcgtcggcttccaccactctcctcgcaccagctccaaaatggcggaacagaccgagaaggctttcttgaagcagcccaaggttttcctcagctcaaagaagacagggaagggaaagaggcctggaaagggaggcaatcgcttctggaagagtgttgggttgggattcaagaccccccgagatgctatagaaggaacatacattgacaagaagtgccctttcactggcaacgtctccatcaggggtcgtattctctctggtacttgccacagtgccaagatgtcgaggaccattattgttcgccgcaactaccttcattatattaaaaaataccagagatacgagaaaaggcactcaaacattccggctcacgtttcaccttgcttccgtgtgaaagagggagattatgtcattattggccagtgcaggccattgtcaaagacagtgaggtttaatgtgttgaaggtgactccagccggttcatctggaactgggaagaaggcattcactggaatatgatattactgttctgagaagtatgttagttttacttttgtgcaagaagtgcatttagattgagctactcttgacagatgaactgttttttggcattttatttgcttttaaaatatttgatccgtgtacggtgaattaaggtttttgttgaaccattatcatgaattttgctacccctttta

SEQ ID NO: 907 - DNA, 784 bp, Malus domestica
agattagggtttttgctcattcggtaactctgtgcttaaggcgtcggcttcctccactctcctcgaaccagctcgaaaatggcggaacagaccgagaaggctttcttgaagcagcctaaggttttcctcagctcaaagaagacagggaagggaaagaggcctggaaagggaggcaatcgcttctggaagagtgttgggttgggattcaagaccccccgagatgctatcgaaggaacatacattgacaagaagtgcccattcactggcaacgtctccatcaggggtcgtattctctctggtacttgccacagtgccaagatgtcaaggactattatcgttcgtcgtaactacctgcattatattaaaaagtaccagagatacgagaaaaggcattctaacatcccagctcacgtttcaccttgcttccgtgtgaaagagggagattatgtcatcattgggcagtgcaggcctttgtcaaagacagtgaggtttaatgtgttgaaggtgactccagccggttcatctggaactgggaagaaggcattcactggaatatgattttgctgttttgggcagtatgttagtgttacttttgtgcaagaagtacatttagattgagctactcgtgacagatgaactgttttttggcattttatttgcttttaaaatattcatcattctaaggtgagtttatggtattcgttgaaccatatcctgaattttgctatccatattctcattttatattcatattgttgtgattgtgtgggtctgccaaattagt

SEQ ID NO: 908 - DNA, 605 bp, Arnica chamissonis
actgaaaagctcggatctcttcaatggctgaacagaccgagaaggcgtttttgaagcaaccgaaggtgtttctatgttcgaagaaaagtgggaaagggaagagacctgggaagggtggaaacagattctggaagagtattggtcttggctttaagacaccaagagaagctattgaaggaacttacatcgacaagaaatgccctttcactggtgatgtctccattagaggccgtattcttgctggcacatgccacagtgctaaaatggttaggactattatcgttcgtcgggactacctccattatgtgaaaaagtaccagcgttatgagaagcgtcattcgaacattccagcacacctttctccctgtttccgtgtgaaagaaggcgatcgtgtaaccgttggacagtgcagaccattatccaagacggtgaggttcaacgtgttgaaggtgattccggctggatcctctggcggtggaaaaaaagcgtttacaggcatataaactttgttagcctttgcaaaaacaattcaatttgatttgccaagattttgaagtaaaacgtgggttgcttacgaactttgtttaatgtttctcaagacatag

SEQ ID NO: 909 - DNA, 722 bp, Persea americana
ggccccatctttatctcgctctatatctcccgctgctgcagtatcctcttcgttggagtctttctcatcaatcatggcggagcagacggagaaggcgttcttgaagcagcccaaggtttttctatgttctaagaagtctggaaaggggaagaggcctgggaaaggcggaaaccgatactggaaaagcatcgggttgggattcaagactcccagggatgcaatcgaaggaacatatatagataaaaaatgccccttcactggcaatgtttccatccggggccgtatcctctctggtacttgccacagtgccaagatgaatagaaccatcattgtccgtagagactatcttcactacgtgaagaaataccagagatatgaaaagaggcactctaatattccagcacacatatccccttgcttccgtgcgaaggagggggaccatgttatcatcggccaatgcaggcccttgtcaaagactgtgaggttcaatgtgttgaaagtcattccagcaggatcttccggtggtggaaagaaggctttcactgcaatttaagtcctgtgtttttcaactatttcagattttaagttgatgcctagggttttagactcatttagagacttcattcctgttttgtgctttcagaaaacgtttctttctagttttctttaatgattgatactggttgagttggatattcaggagttttggaccatttgcattt

SEQ ID NO: 910 - DNA, 800 bp, Musa acuminata
aaattctcctcgttcccttccgccggcttttcgcccttgccccctgaaggccagctcgtcgatctccttcgctttctcggccatggcggaacagacggagaaggcattccttaagcagccaaaggtgttcctttgcccaaagaaacctggtaagggaaagagacctggtaagggcggcaacagattctggaagagtattgggcttgggttcaagactccaagagaggccattgaaggtacttacatcgataagaaatgcccattcactggcaatgtgtcaattaggggtcgtatcttagctggcacatgccatagtgccaagatgaaccgaaccattatcgtacgcagaaactatcttcactatgtgaaaaaatatcaaaggtatgagaagaggcactctaatatagcagcgcatatctcaccctgcttccgtgtcaaggaaggggaccatgttatcattggtcagtgcagaccattggcaaaaactgtgactttcaatgttttgaaagtcataccagctgggtcgacaggtggtggcaagaaggcattcgcagctgtgtaaggttgtgccaaggcttcaaagctgaggagttggaaactttaatccggaaaaggttgtcgtgcaaccagtttttagtaatttagccttattttgcactattttctgttcttataagttcaccatttgaatttttgtggcatcaagattatgttgttgaacagctagaaaattcgtctgacgaacatccaaagatgtgacactcatatttgcaagttctagttggttatcccttattttt

SEQ ID NO: 911 - DNA, 688 bp, Ocimum basilicum
tcagctgctgcctccgagctagggttttgccattcctcgcagattcacgaacacacgcagccatggcggagcagacggagaaggctttcttgaagcagcccaaggtattcctttgctcgaagaagtcaggtaagggtaaggcgcctggaaagggtgggaaccgctactttaagagcattggacttggcttcaaaacaccgcgtgaggcgtctgaaggtacatacattgacaagaagtgccccttcactggtgatgtttccatcagaggtcgtatcatcgctggaacttgccacagcgcaaagatggtgagaaccatcatcgtgagacgaaactacctccactgggtgaagaagtaccaaagatacgagaagaggcattccaacatcccagcacacatatccccgtgcttccgtgtgaaggagggagaccacgttataattggtcaatgcaggccattgtcgaaaactgtgaggtttaatgttcttaaggtgattcccgctggttctagtactggcaagaaggcttttgcagggatgtgagttatccagtatgaattttgcatttgatttttaaaacagtttttgtaaggatggattttagactgttgtttcagttggaaacgttatcaacttcacatatcagaatattggtattttggtaatgattacttagttttctttttgcggca

SEQ ID NO: 912 - DNA, 875 bp, Brachypodium distachyon
aacttcttgtttctgttgaagttcgttcatcacacctttggcgttagggttcgcctggtttgagccgtcaccgccccgccccagctctgcccttcgccgccggacacctcccggtctccaatggcggagcagactgagaaggctttcttgaagcagccaaaggtcttcctttgcccaaagaaatctgacaaggggaagagacctggcaaggcaggtaatcgcttctggaagaatgttggcctcggcttcaagacccccaaggaagcgattgaaggggcctacatcgacaagaagtgcccattcactggaactgtttctatcagaggcagaattattgctggaacatgccacagtgccaagatgaacaggactatcatcatctgcaggaactacctacactttgtgaagaagtatcagaggtacgagaagaggcactccaacattccagctcacatttatccttgcttccgggtcaaggaaggagaccatgtcatcattggtcagtgcaggcctttgtcaaaaactgtgaggttcaacatccttaaagtcattccagcgggatccacaggtggcactgggaagaaggcattcaccgctgcttgagcttaccgaaattgtctagtctagaagtagttatagataaaagttcattcttctgaacatgttcatgaaatctatccgtgcaagttttgtttagatatcactggtcatgcaaattgtggtagctgttgcccactggttggctggtcggatggtgtaccatatgcaccttatttgaagcaatggcatcagcagcttgttttcttatcttattttggtggatgtgctttctctttgcttatctcttgttgggggtcaagggaattaaatattca

SEQ ID NO: 913 - DNA, 698 bp, Centaurea maculosa
tctgattctccttcttcctcctgccgaatagcgctatcgcatctcttcaacaatggcggaacagactgagaaggcgtttctgaagcaaccaaaggtgtttttgtgctcgaaaaagagcgggaaaggaaagaggcctgggaagggtggaaacagattctggaagagtattggtcttggttttaagacaccaagagaagctattgaaggaacttacatcgacaagaagtgccctttcactggtgatgtctcgattagagggcgtatcctttccggtacatgccacagtgccaagatggtcaggaccatcattgctcgtagggactacctccatttcgtcaagaaatatcaaagatacgagaagaggcattccaacattccagctcacatttctccgtgctttcgtgtgaaggaaggtgatcatgtgattgttggacagtgcagaccattgtcaaagaccgtgaggttcaatgtgttgaaggttatcccagctggatcttctggcggtggaaagaaggcctttaccggcatataaattggtgactactaccattttcttgagtgagtgaaatgtggttcggtttaatgcttctagtttttgttaatttattattatgagatggttgacaacaatcgaagtcttgatttgatacattattattattattgctttagaatttagtaacttcaatcaaaagcct

SEQ ID NO: 914 - DNA, 739 bp, Cirsium arvense
aacagactgagaaggcgtttctaaagcaaccaaaggtgtttttgtgctcgaaaaagagcgggaaagggaagaggcctgggaaaggtggaaacagattctggaagagtgttggtcttggttttaagacaccaagagaagctattgaaggaacttacatcgacaagaagtgccctttcactggtgatgtctcgatcagagggcgtatccttgctggtacatgccacagtgccaagatggtcaggaccatcatcgctcgtaggaactacctccatttcgtcaagaaatatcaaagatacgagaagaggcattccaacattccagctcacatttctccgtgctttcgtgtgaaggaaggtgatcacgtgattgttggacagtgcagaccattgtcaaagacggtgaggttcaatgtgttgaaggttattccggctggatcttctggtggtggaaagaaggcctttaccggcttttagaatggttatgatcatctttttcttgaacgagtgaaatgtggttgggtttaatgcttctagttttcgtttatcttatattatgagatgattgacgacaatccaagtcttgatttgatacatcattatcattgttttagaaattagtaacttcgatcaaaagcctcccttctttcaatctttataaatcaaaacaagatcattaaccacagacaaaaaaagcattaccctccatgaaattaataatactttaacactttgagagcctg

SEQ ID NO: 915 - DNA, 782 bp, Cyclamen graecum
ctcagctgtgctctccgtctccgtcgcactcctcccgccaaaaccctcagccatggccgaacagacggagaaggcatttctcaagcagcacaaggtattcctttgctctaagaaatcagggaagggaaagagacctggaaagggaggaaatcgttactggaagagtattggcttgggtttcaagacacccagagatgctattgaagggacttatattgacaggaaatgtcctttcaccggagatgtgtccatcaggggtcgtataattgccggtacctgccacagtgcaaagatgatgagaactatcattgttcgacgcaactaccttcattatgtcaaaaagtaccagaggtatgagaagaggcattcaaatattccagctcacatttccccgtgcttccgtgtgaaggagggtgaccatgtagttatcggccagtgcaggccattgtccaagacggtgaggtttaacgtgttgaaggtggtcccagctggttcctctgctggtgggaagaaagcatttacagcaatatgagtttggtatcggaagttattttggtagtaaaatataaaagtatcgcggattttttctagttcattttttaaagcttaaatggaaaattgaacttcatttgatttggttagttctgaactgtatgagattgatttatgattttgcggaaatgagtttttcaagtttggatgcttttgatgtctgggatttttgccgccgttaaatctttttccttgataatgatcaaggcagtgatccctaaaaaaaaaaa

SEQ ID NO: 916 - DNA, 893 bp, Solanum melongena
actctctgctgcgcaaattagggttttctgctactcagcatttcttctctttcggttcagcctccttcataaccttcaatcatggcggagcagacggagaaagcgtttttgaaacagccaggggtttttctaagttctaagaagaccggaaagggaaagaggccaggaaaaggaggaaatcggtactttaagagtattggtttaggattcaagactcctcgcgaggctactgaaggtacatatattgacaagaaatgcccattcactggcaatgtttctatccgaggtcgtatccttgccggtacatgccacagtgctaagatgaacagaaccatcattgttcgacgcaattacctacattatgtgaagaagtaccaaagatatgagaagagacactcgaacattccagctcacatatcaccatgcttccgtgtgaaagagggagatcatgttattattggacagtgcaggcctttatccaaaaccgtgaggtttaacgtcttaaaggtgattccggctggttctggtgctggagggaagaaagcttttactggaatgtaattcttagtgcttccatttcaaattttgttatctctaggaattatgcctgttacttattccgctattgctggattgttttcttcatggattttccttttgagcttccaatgttaaaacttaaatgctagtaagtcttttattatccctatgtaagagttctggtgtttggacattattatacaaacaaaaacaagacactgttttttccttagaaacaagtaaagacattcaacaattttaaaaacctccggacgacatccctcgggactttatcataggatacattgtataatagttgaatcacttcgatgtgaattcaaattaattctagg

SEQ ID NO: 917 - DNA, 693 bp, Festuca arundinacea
ctctctgctcccgcatctccccgcgcgccgccgcctcctcgccgctcgaagcccgcagcgcagccatggcagagcagaccgagaagtctttcctcaagcagccgaaggtcttcctcagcacaaagaaggctgacaaggctaagaggccaggcaaggctggcaaccgcttctggaagagtgttggcctgggtttcaagaccccaagggaagcgatcgaaggtacctacattgacaagaagtgccccttcactggaactgttgccatcaggggcagaatcatcgctggaacatgccacagcgccaagatgaacaggaccatcattgtgcgcaggaactacctgcactacgtcaagaagtatcagaggtatgaaaagaggcactcaaacattccggctcacatctcaccgtgcttccgtatcaaggaaggcgaccatgtcatcattggccagtgcaggcccctgtctaaaaccgtgagattcaacgtgctgaaggtgattccagctggcaccaccggtggtgggaagaaggctttcatcgctgcttaagcctagactctgattcatgagtagttcatagtcagaagttttcgcacttaaaaagacctagcagtcatgtgttttggtatttgattccaaattttctgtcaaactgaagtctctcgacatatgaacgtgtctgtggaatctatctatc

SEQ ID NO: 918 - DNA, 633 bp, Gerbera hybrid cultivar
gcggagaaggcttttttgaagcaaccgaaagtgtttctatgctcgaagaaaagtggcaaggggaagaggcctggaaagggtggaaaccggttctggaagagtgtaggtcttggatttaagacgccaagagaagctatcgaaggaacttacattgacaagaaatgccctttcactggtgatgtgtccattagaggccgtattctcgcgggtacatgccacagtgctaagatggtgaggaccattatcgttcgaaggaactaccttcattatgtcaagaaataccaaagatatgagaagaggcactcgaacattcctgcccatatctcaccatgtttccgtgtgaaggaaggtgatcatgtcactattggacagtgcagacccttgtcaaagacagtgaggttcaacgtgttgaaggtgataccagccggctcttctggtggggggaagaaggcatttacaggcatataagtgctcaacctttttggcttcataatgtaaaagcttttgagagttattgtgaacttcgctatattgtttcatcgacattattatgctttttttttcaaatttatgcaatacttttgaggattatttaagaaattttcatctgggacttttaaaaaaaaaaaaaaa

SEQ ID NO: 919 - DNA, 789 bp, Ipomoea batatas
ggtcgacactagtggcatccaaacaattcggcacgagggtttttagctgccgatccaatttgctcttatcttcttgcgacacatcggcgtctacaatcatggcggagcagactgagaaggctttcttgaagcagccgggagtttttctcagctcgaagaaaacggggaagggtaagaggcccggtaagggaggtaatcgatactggaagagcattggactagggtttaagacacctcgcgaggctattgaagggacatacattgataaaaaatgccccttcactggtactgtttctatcagaggtcgtatccttgctgggacatgccatagtgctaagatgaatagaacgatcattgttcgtaggaactaccttcactttgtgaagaagtaccagaggtatgaaaaaagacactcaaacattgctgctcatgtatcaccttgcttccgtgtgaaagagggagatcacgttatcattggccaatgcaggccgttgtccaaaaccgtgaggttcaacgttttgaaggtgattcctgctggctctgctggtggcggaaagaaggcgtttactgggatatgattttgtggttttcctgttaccatcaaattattctgagttatgatattagactcctttctgttgaactcatactattcagtagccccaggtttacatttttgaatgctgagatgtagccgagtttttgaatcactcagttcagtttacattaagacttcatttgcacttggccttgttcttctaagtttgatttgtagaaatatctttgcat

SEQ ID NO: 920 - DNA, 708 bp, Ipomoea nil
ggccctgcctctagggtttttagctgccgatccaactcgctcctatcttcttgcgacacatcggcggctacaatcatggcggagcagactgagaaggctttcttgaagcagccgggagtttttctcagctcgaagaaaacagggaagggtaagaggcccggtaagggaggtaatcgattctggaagagcattggattagggtttaagacacctcgcgaggctactgaagggacatatattgataaaaaatgccccttcactggtactgtttctatcagaggtcgtatccttgctgggacatgccatagtgctaagatgaatagaacaatcattgttcgtaggaactaccttcactttgtgaagaagtaccagaggtatgaaaaaagacactcaaacattgctgctcacatatcaccttgcttccgtgtgaaagagggagattacgttatcattggccaatgcaggccattgtccaaaactgtgaggttcaacgttttgaaggtgattcctgctggctctgctggtggcggaaagaaggcgtttactggcatgtgattttgcggttttcttgttaacatcaaattattcgagttatgatattagactcttttttgttgaactcatactattcagtagccccatgtttacatttttgaatgctgagatgtagtcgagttcttgaatcactcagtaagtttacaaaaaaaa

SEQ ID NO: 921 - DNA, 681 bp, Ipomoea nil
gctgttgcatcgctctgggttttagttgccggctatccttctcctttcaccctcgaaatctttactggactcggtagcttcagaatggcagaacagaccgagaaggctttcttgaaacagcctggagtgtttctcagctcgaagaagactggaaaaggaaaacggcccgggaagggaggaaatcgcttctggaagagtgtagggctagggttcaagactccacgcgaggctattgaaggggcctatattgataagaagtgtccattcaccggcactgtttctattagaggtagaatccttgctgggacatgccacagtgcaaagatgacaagaactatcattgttcgccgcaactacctgcattttgtcaagaagtatcagagatatgagaagcgacactcaaacattgccgctcacatttctccatgcttccgagtgaaagagggagattatgttatcattggccagtgcaggccgctgtccaaaacagtgaggttcaacgtgttgaaggttattcctgcagggtcaggtggagggaaaaaggctttcactgggatgtaaacttgtttctttttgtagtattgttaaagtattagaagaatgcttggtatttagactatgcaaaactcagtcaaagtttctctctatgtacttgccatggaaggcttaaatttttgtgct

SEQ ID NO: 922 - DNA, 716 bp, Leymus cinereus x Leymus triticoides
gcacgaggctcagagcctcgcctcctcgctcccgcatctcctcgctccgccgccgccgctgcctccgagccgctcgaagcccacctcgcagccatggcggagcagaccgagaagtctttcctcaagcagccaaaggttttcctcagcacgaagaaagctgacaaggctaagaggcctggcaaggctggcaaccgcttctggaagagtgttggccttggtttcaagaccccaagggaagcgattgatggtacctacattgacaagaagtgcccattcactggaactgttgctatcaggggcagaatcatagctggaacctgccacagtgccaagatgaacaggaccatcattgttcgcaggaactacctccattttgtgaagaaatatcagaggtatgagaagaggcactccaacattccagctcacatctccccctgcttccgtgtcaaggaaggcgaccatgtcatcattggccagtgcaggcccctgtcgaaaaccgtgagattcaatgtcctgaaggtcgttccagctggaaccaccggaggcgggaagaaggctttcatcgctgcttaagcccagactctgattcatgagtagttcatagtcagaagttattcgcacttaaaacctaccacgctgctgttttgagatttgattcctgtgttttctgtcaaaccgaagaatgtcgtgatctgaacatgttttgtggaatctat

SEQ ID NO: 923 - DNA, 1062 bp, Pinus pinaster
agatcattgtttgcaattggaaaccgttcacggggtttcgaacataaagctggggtttcagatctcggcctacataaaagggtgtatcactttttgacatccgttcacggtcgctagggtttaacagctccggcctacataagcggttgtattctttctcattgttatgagatcgagggtttcaaagctccggcctacataaagcggtgtatctcttatcattgtttggagatcgagggtgcagtcttaagaacgtcctcgtttggattccaggcaggagcagctggggcgttgaagatacgaagtgagaagtcttgaattcctatagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattatgtcaagaaatatcagaggtatgagaagagacattcgaacataccagcccacatttcaccttgtttccgtgtcaaggaaggggatcatgttataattgggcaatgcaggcccttgtccaagactgtaaggtttaatgttctgaaggtgattccggcgggttctagcagtggttctgcaaagaaagccttcactgcaatatgaatccgtttttttttactctgtccaagcaaaccataaaatccattaaacgcaaaggagttggcatcaaatgcaagtgagaaacaattgaaaccagtacagtagtattattagaaactctttatatggaatattttatatcgggatgtgtgtttcaaatcggaaaattttgtagaaaaacaaatgtttgcgagtgatctctatttcaagtacacttttcatatctaatattgtccatgaattgtgttgcaa

SEQ ID NO: 924 - DNA, 985 bp, Pinus pinaster
ataaaagggtgtatcacttttgacatccgttcacggtcgctagggtttaacggctccggcctacataagcggttgtattctttctcattgttacgagatcgagggtttcaaagctccggcctacacaaagcggtgtatctcttatcattgtttggagatcgagggtgcagtcttaagaacgtcctcgtttggattccaggcaggagcagctggggcgttgaagatacgaagtgagaagtcttgaattcctgtagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattatgtcaagaaatatcagaggtatgagaagagacattcgaacataccagcccacatttcaccctgtttccgtgtcaaggaaggggatcatgttataattgggcaatgcaggcccttgtccaagactgtaaggtttaatgttctgaaggtgattcctgcgggttctagcagtggttctgcaaagaaagccttcactgcaatatgaatccgtttttttgactctgtccaagcaaaccttaaaatccattaaacgcaatggagttggcatcaaatgcaagtgagaaacaattgaaaccagtacattagtattattagaaactctttatatggaatattttatattgggatgtgtgtttcaaatcggaaatttttgtagaaaaaaatgtttgcaagcgatctctatttcaagtacacttttcatatcttctattgtccatgaattgtgttgcaa

SEQ ID NO: 925 - DNA, 1023 bp, Pinus pinaster
tcacggggtttcgaacataaagctggggtttcagatctcggcctacataaaagggtgtatcactttttgacatccgttcacggttgcaagggtttaacagctccggcctacagaagcggttgtattctttctcatgttatgagatcgagggtttcaaagctccggcctacacaaagcggtgtatctcttatcattgtttggagatcgagggtgcagtcttaagaacgtcctcgtttggattccaggcaggagcggctggggcgttgaagatacgaagtgagaagtcttgaattcctgtagccatggctgaacagactgagagagcttttctgaagcaaccaaaagtctttctcagttctaaaacgtctgggaaggggaaacgacctggaaaaggcggcaacaggttttggaagaatgtgggtcttggctttaagactcccaaagaagctattcaagggacctacatcgacaagaagtgcccattcactggtactgtttcaataagaggtcgtatattagctggaacgtgttacagtgctaaaatgacacggacaattattgtccgtagggactatctccattatgtcaagaaatatcagaggtatgagaagagacattcgaacataccagcccacatttcaccctgtttccgtgtcaaggaaggggatcatgttataattgggcaatgcaggcccttgtccaagactgtaaggtttaatgttctgaaggtgattcctgcgggttctagcagtggttctgcaaagaaagccttcactgcaatatgaatccgttttttttgactctgtccaagcaaaccttaaaatccattaaacgcaatggagttggcatcaaatgcaagtgagaaacaattgaaaccagtacattagtattattagaaactctttatatggaatattttatattgggatgtgtgtttcaaatcggaaattttgtagaaaaaaaatgtttgcaagcgatctctatttcaagtacacttttcatatcttctattgtccatgaatt

SEQ ID NO: 926 - DNA, 1041 bp, Pinus pinaster
agatcattgtttgcaattggaaaccgttcacggggtttcgaacatagagctggggtttcagatctcggcctacataaaagggtgcatcactttttgacatccgttcacggtcgctagggtttaacggctccggcctacataagcggttgtattctttctcattgttacgagatcgagggtttcaaagctccggcctacacaaagcggtgtatctcttatcattgtttggagatcgagggtgcagtcttaagaacgtcctcgtttggattccagaagaaattctcaggcaggagcagctggggcgttgaagatacgaagtgagaagtcttgaattcctgtagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattatgtcaagaaatatcagaggtatgagaagagacattcgaacataccagcccacatttcaccctgtttccgtgtcaaggaaggggatcatgttataattgggcaatgcaggcccttgtccaagactgtaaggtttaatgttctgaaggtgattcctgcgggttctagcagtggttctgcaaagaaagccttcactgcaatatgaatccgttttttttgactctgtccaacaaaccttaaaatccattaaacgcaatggagttggcatcaaatgcaagtgagaaacaattgaaaccagtacattagtattattagaaactctttatatggaatattttatattgggatgtgtgtttcaaatcggaaatttttgtagaaaaaaatgtttgcaagcgatctctatttcaagtacacttttca

SEQ ID NO: 927 - DNA, 865 bp, Tropaeolum majus
tctccgtactcagcggccgggggcgcttagattagggttagtagcttttcagtctccgttgtctcttgaatcgtgcgatctagttccgaatctaatcatggctgagcagacggagaaggcgtttttgaagcagccaaaagttttccttagctcaaagaaagcaggcaagggaaagagacctggaaaaggaggcaacagattctggaaaagcattggattgggttttaagacccccagagatgcaattgaaggtacttacattgataagaagtgccctttcactggcaatgtttctatcaggggtcgcatcctagctggtacatgccacagtgcaaagatgatgaggaccattgttgttcgacgtaactatcttcatttcgtcaagaaataccagagatacgagaagaggcactccaacactcctgcacatgtttctccatgctttcgtgttaaggagggtgatcatgttataattggccagtgcaggcctttgtctaagacagtaaggtttaatgtgttgaaagtgatacctgctggatcttctgcagctgggaagaaagcatttacagggatgtgagcaaaaaaatctaatcatgacatttgttctttttgttctcgtacgacaattgtttaccttgcttagaatttaatgtttgctcttagtagtgcacactacattttccatgttactactttttgagttattattatgaatttatatatttgttcaaatatgagtttgcttagagttatctctcatgacgatgagttttatgtgaaggttaaattatattagtgtggttgtataacggaggttcactcattttgtcagtgtttaagatggaacagaagttcattttgtttt

SEQ ID NO: 928 - DNA, 870 bp, Nicotiana benthamiana
tcactctgttgcactttagggttttgccgccgagcatctatcctcgtccagttcagtttgtagccctcaatcatggcggagcagacggagaaggcgtttctgaagcagccaggtgtttttctaagctcgaagaagacagggaaagggaaaaggccaggaaagggaggaaatcgctactttaagagtatcggtttagggttcaagactcctcgtgaggctgttgaaggtacttatattgacaagaaatgcccattcactggcaatgtttctatccgaggtcgtatccttgctggtacatgccacagtgctaagatgaacagaaccatcattgttcgacgcaactacttacattatgtcaagaagtaccagagatatgagaagaggcactcaaatattccagcgcacatctcaccatgcttccgtgtgaaagagggagatcatgttatcattggacagtgcaggcctttgtccaaaaccgtgaggttcaatgtcttaaaggtgattccagccggttctgctggtggaggaaaaaaggcttttaccgggatgtgagctttgtgcttccattttaactgttatttctagggatgatgtcaagacttttctgcttttactgaattttcgtcttcattgattttcctttgaacttcaaactttgaaacttaagctagcattttttaagcctatgtactacacttataagaggtttggtgattgaaccttatatttaaaggtgattgaattagcagtgttttcctactttttatcggttgagttgctaatttctgggccccatagatctttcttttgagcctagtctgctaaaaatagagatcgagtctgttgactcattgccacaacggagaactt

SEQ ID NO: 929 - DNA, 763 bp, Nicotiana benthamiana
atcattcttataaagagccgacggtttgctcagtgagtctcaactagggttttgttcatatcagctcagtcaacttcgcagcatatcacaacaatggctgaacagacggagaaggccttcttgaagcagcctggtgtctttcttagctcgaagaagacagggaaggggaagaggccaggaaagggtggcaatcgctactttaagagcgttggtttaggtttcaagactccccgtgaggctactgaaggtttttacattgataagaaatgtccattcactggcaatgtttctatcagaggtcgtatccttgctggtacatgccacagtgctaagatgaacagaactatcattgtccgacgcaactacctacattatgtcaaaaagtaccagaggtatgagaagaggcattctaatattccagctcatatatcaccatgcttccgtgtgaaagagggagaccatgttattattggacagtgcaggcctttgtccaaaactgtgaggttcaatgtgttaaaggtgattcctgctgggtcagctggtggggggaagaaagcatttacaggaatgtgagcttaggttatgagtttgttgttatttattgagcatcaaaaggcgatgatgttaacactaaatcttttgaaaaaggtgtattcatagacttgagtttttgtttggccaaacttactacattactatctacgagttgaaatttctgggtattcttggcttaatcacttgcatggagttctctatttcacta

SEQ ID NO: 930 - DNA, 755 bp, Nicotiana benthamiana
aatctccgcctagggttttagctgccgagccactcccccctcccctcgttccagttaagctttcagctctttcaactccacagccatggccgaacagacggagaaggcgtttttgaagcaaccaggtgtttttcttagctcgaagaagacagggaaggggaagagacctgggaagggaggtaaccgctacttcaagagcattggtctagggttcaagactcctcgtgaggctactgaaggtacgtacattgacaagaaatgtccatttactggaaatgtttcaatcagaggtcgtattcttgctggtacatgtcatagtgccaagatgaacagaaccatcattgttcgtcggaactacctgcattacgtcaagaagtaccagagatatgagaagaggcattcaaatatcccagctcacatatcaccgtgctttcgtgtgaaagagggagatcatgttatcattggacagtgcaggcctttgtccaagactgtgagatttaatgtgttaaaggtgattccagctggttctgctggtggtggcaagaaagcatttacaggaatgtgagcacaggtgtttcttgaggttattgtcgcttcttgcgtatgaaagtaattatgtttaagactgagaagaggagtgacgttaagacttctctactaaaagctgtttgcttttgcctttgaaggcttaaattttgtatggatacttgctacttatcattagtacaagaagttcagatttcagtttcttgtta

SEQ ID NO: 931 - DNA, 665 bp, Nicotiana benthamiana
cttacaatttccacttctctcactctctgttgcactttagggttttgccgccgtgcatctatcctcgtccagttcagcttgtagtcctcaatcatggcggagcagacggagaaggcgtttttgaagcagccaggtgtttttctaagctcgaagaagacagggaaagggaaaaggccaggaaagggaggcaatcgctactttaagagtatcggtctagggttcaaaactcctcgtgaggctgttgaaggtacatacattgacaagaaatgcccattcactggcaatgtttctatccgaggtcgtatccttgctggtacatgccacagtgctaagatgaacagaaccatcattgttcgacgcaactacttacattatgtcaagaagtaccagagatatgagaagaggcactcaaacattccagcgcacatctcaccatgcttccgtgtgaaagagggagatcatgttatcattggacagtgcaggcctttgtccaaaaccgtgaggttcaatgtcttaaaggtgattccagctggttctgctggtggaggaaaaaaggcttttaccgggatgtgagctttgtgcttccatttcaactgttatttctaggaatgatgtcaagacttttctgcttttactgaattgttgccttcattgattttcctttg

SEQ ID NO: 932 - DNA, 738 bp, Avena sativa
gccacctcctcttgaagcctcagctctctctgcttccgcatctccccgcgcgcgccgccgcctcgtcgccgctcgaagcccgcagcgcagccatggcggagcagaccgagaagtctttcctcaagcagccaaaggttttcctcagcacaaagaaggctgacaagtccaagaggccaggcaaggctggcaaccgcttctggaagagtgttggccttggtttcaagaccccaaaggaagcgatcgaaggtacctacattgacaagaagtgcccattcactggaactgttgccatcaggggcagaatcatcgctggaacatgccacagtgccaagatgaacaggaccatcatcgttcgcaggaactacctccactttgtcaagaagtaccagaggtatgagaagaggcactcaaacattccagctcacatctccccgtgcttccgtatcaaggaaggcgaccatgtcatcattggccagtgcaggcccctgtcaaaaactgtgagattcaatgtcctgaaggttattccagctggaactactggtggtgggaagaaagctttcatcgcagcctaaggctagattcatgagtagttcatagccgtttttcgcacttcaggtcctaccagctggtgttttggctctcgattctatattttctgtcaaactgaagtcttgtcatctgaacatgtttgtggaatctatctatcattaacagttttgcttaaattgtactgtgttg

SEQ ID NO: 933 - DNA, 781 bp, Avena sativa
ggcacattccgcagcggccgccacctcctctcgaaaccttagctctctcgtttcttccctcatctccccgcgcgccgccgccgcccgaagcccgcagcgcagccatggcggagcagactgagaagtctttcctcaagcagccaaaggttttcctcagcacaaagaaggctgacaagtccaagaggccaggcaaggctggcaaccgcttctggaagagtgttggccttggtttcaagaccccaaaggaagcgatcgaaggtacctacattgacaagaagtgcccattcactggaactgttgccatcaggggcagaatcatcgctggaacatgccacagtgccaagatgaacaggaccatcatcgttcgcaggaactacctccactttgtcaagaagtaccagaggtatgagaagaggcactcaaacattccagctcacatctccccatgcttccgtatcaaggaaggcgaccatgtcatcattggccagtgcaggcccctgtcgaaaactgtgagattcaatgtcctgaaggttattccagctggaactactggtggtgggaagaaagctttcatcgctgcctaaggctagattcatgagtagttcatagccgcttttcgcacttcaggacctaccgggctggtgttttggctcttgattccatattttctgtcaaactgaagtcttgtcatctgaacatgtttgtggaatctatctatcattaacagttttgcttaaattgtactgtgttgcttttgcggaaactagtgaatttgttcctc

SEQ ID NO: 934 - DNA, 816 bp, Allium cepa
atatttttcatcttcaaacagccgccgccttcacttgtacacgaatcttcgcaatggctgagcagactgagaaggctttcttgaagcaaccgaccgtcttcctctgctcaaagaaatctggcaaaggaaagaagccagggaaagcagggaatcgactttggcgcaatgttggccttggattcaagaccccaagagaagcaattgaaggaacttatatcgataagaaatgccctttcactggtcatgtctccattagaggtcgtatcattgcaggaacatgccacagtgcaaagatgaacagaactattattgtcagaagaaattatcttcattatgtgaaaaaatatcagaggtatgagaagaggcactcaaacataccagcacacgtttctccctgtttccgtgttaaggaaggtgaccatgtgatcataggccagtgcaggccactgtctaaaacagtgaggttcaatgtgttgagggttattccagctggatctacaggtggtggaaagaaggcttttgtagcagcttaagagttcattttaaagccaatgattgatgatatatgcatgtcttgtttagatgtttcttgatctgtttccctgttttgaggacgtagttatttttggttccgtggaaatgtttgtttattttgactaaattgcagaatttttatgagactaagcttatgttgttttctgctttggtttgtatcaagttggttgagattattgtgtttgatttttttcagccccgttaggaaagttttagatgttcctttttctaattggtactttcaaaatccaaaacacacac

SEQ ID NO: 935 - DNA, 767 bp, Allium cepa
atatttttcatcttcaaacagccgccgccttcacttgtacccgaatcttcgcaatggctgagcagactgagaaggctttcttgaagcaaccgaccgtcttcctctgctcaaagaaatctggcaaaggaaagaagccagggaaagcagggaatcgactttggcgcaatgttggccttggattcaagaccccaagagaagcaattgaaggaacttacatcgataagaaatgccctttcactggtcatgtctccattagaggtcgtatcattgcaggaacatgccacagtgcaaagatgaacagaactattattgtcagaagaaattatcttcattatgtgaaaaaatatcagaggtatgagaagaggcactcaaacataccagcacacgtttctccctgtttccgtgttaaggaaggtgaccatgtgatcattggccagtgcaggccactgtctaaaacagtgaggttcaatgtgttgagggttattccagctggatctacaggtggtggaaagaaggcttttgtagcagcttaagagttcattttaaagccaatgatagatgatatatgcatgtcttgtttagatgtttcttgatctgtttccctgttttgaggacgtagttatttttggttccgtggaaatgtttgtttatttcgactaaattgcagaatttttatgagactaagcttatgttgttttctgctttggtttgtatcaagttggttgaaattaagtatatggattagaaaatcacagagtttcgacaat

SEQ ID NO: 936 - DNA, 762 bp, Allium cepa
gctctctcatcctgcgtacttttcatcttcaaacagccgccgccttcacttgtacccgaatcttcgcaatggctgagcagactgagaaggctttcttgaagcaaccgaccgtcttcctctgctcaaagaaatctggcaaaggaaagaagccagggaaagcagggaatcgactttggcgcaatgttggccttggattcaagaccccaagagaagcaattgaaggaacttacattgataagaaatgccctttcactggtcatgtctccattagaggtcgtatcattgcaggaacatgccacagtgcaaagatgaacagaactattattgtcagaagaaattatcttcattatgtgaaaaaatatcagaggtatgagaagaggcactcaaacataccagcacatgtttctccctgtttccgtgttaaggaaggtgaccatgtgatcattggccagtgcaggccactgtctaaaacagtgaggttcaatgtgttgagggttattccagctggatctacaggtggtggaaagaaggcttttgtagcagcttaagttttcattttaaagccaatgatagatgatatttgcatgtcttgtttagatgtttctcgatctgtttccctgttttgaacgtagttatttttggtttcgtggaaatgtttgtttattttgattaaattgcagaatttttatgagactaagcttatgttgttttttgctttggtttatgttaagttggttgaaattattgtgttagattttttac

SEQ ID NO: 937 - DNA, 677 bp, Allium cepa
ctctcatcctgcgtacttttcatcttcgagcagccgccgccttcacttgcacccgaatctccgcaatggctgagcagactgagaaggctttcttgaagcaaccgaccgtcttcctctgctcaaagaaatctggcaaaggaaagaagccagggaaagcagggaatcgactttggcgcaatgttggccttggattcaagaccccaagagaagcaattgaaggaacttacattgataagaaatgccctttcactggtcatgtctccattagaggtcgtatcattgcaggaacatgccacagtgcaaagatgaacagaactattattgtcagaagaaattatcttcattatgtgaaaaaatatcagaggtatgagaagaggcactcaaacataccagcacacgtttctccctgtttccgtgttaaggaaggtgaccatgtgatcattggccagtgcaggccactgtctaaaacagtgaggttcaatgtgttgagggttattccagctggatctacaggtggtggaaagaaggcttttgtagcagcttaagagttcattttaaagccaatgatagatgatatatgcatgtcttgtttagatgtttcttgatctgtttccctgttttgaggacgtagttatttttggttccgtggaaatgtttgtttatttcgactaaattgc

SEQ ID NO: 938 - DNA, 773 bp, Allium cepa
tcatcctgcgtacttttcatcttcgagcagccgccgccttcacttgcacccgaatctccgcaatggctgagcagactgagaaggctttcttgaagcaaccaaccgtctttctgtgctccaaaaaaactggtaagggaaagaagccagggaaagcaggtaatcgactttggcgtaatgttggccttggattcaaaaccccaagagaagcaattgaaggaacttacatcgataagaagtgccctttcactggtcatgtctccattagaggtcgtataattgcaggaacatgccacagtgcaaagatgaacagaaccatcattgtcagaagaaactatcttcattatgtgaaaaaatatcagaggtatgagaagagacattcaaacatacctgcgcacgtatctccttgtttccgtgttaaggaaggggaccatgtgatcattggccagtgcaggccactgtcgaaaacagtgaggttcaatgtgttgagggttattccagctggatctacaggtggagggaagaaggcttttgttgcggcttaagttttcattttaaagccaatagataatatttgcatgtcttgttgaattgttttttgatctgcatctctgttttgaggacgtggttattgttggtttgttagagaagtttgtttattttgacttaattgcagaatttttatgagactaagcctatgtttgctttctaagtggagcatctttgtttattttgttcaccgtctatagcaccttaaaatgttctgtagacggtga

SEQ ID NO: 939 - DNA, 732 bp, Petunia hybrida
attcggccattattggccggggaattctccggctagggtttttgcagcagagcctctctctcctttttcttcatttcaggttttactactccacagccatggccgaacagacggagaaggctttcttgaagcagccaggtgtttttcttagctcgaagaagacagggaagggaaagagaccaggaaaaggaggcaaccgttacgtgaagagcattggtctaggttttaagactcctcgtgaggctactgaaggtacttacattgacaagaaatgtccattcactggcaatgtttctatcagaggtcgtatccttgctggtacatgccatagtgccaagatgaacaggaccatcattgttcgtcgtaactatctccattacgtcaagaagtatcagagatatgagaagaggcattcaaatatcccagctcatatatcaccttgcttccgtgtgaaagagggagatcatgttatcattgggcagtgcaggcctttgtccaagactgtgaggtttaatgtgttaaaggtgattccagctggttctgctggtggtggcaagaaagcatttacaggaatgtgagctggatgagtttattgtcacttctagagtatgattagtaattttgttttaagaatctgagagaaggaatgatatcaagacttctctactaaaagatgttttcttttgcctttgaaggcttacatttttgtatgttacgtgcttacttttcatc

SEQ ID NO: 940 - DNA, 1014 bp, Petunia hybrida
attcctctctactgcactttagggtttcgctgccgcctacgccgagcatctattcaaatcctcgtttaaaccttcaatcatggcggaacagacagagaaggcatttttgaagcagccaggtgtttttctcagttcgaagaagacgggaaaagggaaaaggccaggaaaaggaggaaatcgatacgttaagagtatcggtttagggtttaagactcctcgtgaagctactgaaggtacctatattgacaagaaatgtcccttcactggcaatgtttctatccgaggtcgtatccttgctggtacgtgccacagtgctaagatgaacagaactatcattgttcgacgtaattacctgcattatgtcaagaagtatcagagatatgagaagaggcactcgaacattccagcacacatatcaccatgcttccgtgtgaaagaaggagatcatgttattattggacagtgcaggcctttgtccaaaactgtgaggttcaatgtcttgaaggtgattccagctgggtctgctggtggaggaaagaaagctttcactggaatgtgagattgatgctgccattttaattgttacttctagggtatgagcaggaatgatgtcgagacttttctatatttactgaattgctgtcttcattaattttcctttgagcttttcaattgtgaaacttgttactagcaagttttttttctcctactataagcctactgtgtaccaatgtccaagagttttggtgtttgagttagcatagcttttctagtttactatcagttgagttactaatttccgggccctagcagtttagctctatgttttgagcctagtctgctgaaagaagagattagtctattggtacattaatagaagagattgacttcgattttctgtcccttctgaaccatcaagcttgagctaggtagaacagaggaccatccaaaaactttatgtaatatcatcggattctcagttttattacattacaagtgatgtaacggtacatt

SEQ ID NO: 941 - DNA, 1086 bp, Pinus taeda
gtcagctaactgttcaataaattttgttgtgtacacttgggtgctagcaaacgttgcttgcatgcataaacccatatacaaacttgctgcaaaatacaagtcaacttttatgacgcctcaatagaaaccctagagatatgaattagatttatcctaattaccaattagtgttttgacaacaaaggaggatcgaactagggtttatagggattaaataaccagggcttccattttcttcccttttgtttggaacttctcaggtaggagcgggagcggccgaggccttcaaatgcgaagttagaagtcttgaattcctacagccatggcagaacagactgagagagcttttctaaagcaaccaaaagtctttctcagttctaagaagtctgggaaggggaaacgtcctggaaaaggtggcaacaggttttggaagaatgtgggtcttggctttaagacccccaaagaagctattcaagggacctacattgacaagaagtgcccattcactggtactgtttcaataagaggtcgtatattagctggaacatgttacagtgctaaaatgacacggacaattattgtccgtagggactatctccattttgtcaagaaatatcagagatatgaaaagagacattcgaacataccagcccatatttcaccctgtttccgtgtcaaagaaggggatcatgttatcattgggcaatgcaggcccttgtccaagactgtaaggtttaatgttctgaaggtgattcctgcgggttctagcagtggttctgcaaagaaagccttcactgcaatatgaatccgttttttttccatgaagtgtgatagagtgggctttgacagagttgagggttactattttatcatttggtcaaattaattttgttagtttaatccttcttttggttactgtgttgaattttgaaaaagatgtacggcgcatgtttactctctgtagttgaaagtccaccgttcttggatacttttgttttggttttagcatccagtaaacctttgaatgcatattcttcgaatatatatattttttccaatagccaaatataaacgatgtcatattta

SEQ ID NO: 942 - DNA, 835 bp, Populus trichocarpa
ccactcatcctcatttagccgcctagggtttttcaacttgtactcctctctcagcaaagcagcagcagcacatcaacaaccacaaccatggctgagcagacggagaaggcatttttgaagcagcccagggttttcctgagctcgaagaagtctggaaaggggaagaggcctggtaagggaggaaataggttctggaaaagcattggattgggattcaaaacacccagagatgctattgaaggaacatacattgataagaaatgcccattcactggcactgtttctgtcagaggacgtatcttggccggtacttgccacagcgcaaaaatgaacagaaccattattgttaggaggaactaccttcactgggtcaaaaaataccagagatatgagaagaggcactcaaacatcccagctcacatctccccctgtttccggatcagagaaggagatcatgttaccattggtcaatgcaggccattgtccaagacagtgaggttcaatgtgttgaaggtcatcccagcaggatcttctggtggtgcaaagaaggcttttacagcaatgtaagaagctggcttctctaatgatgtgatggtgccggaatttaatagacctataggcgatgaccttcgctgttttatcagtctttagatttaattgaatgtatggatgctgttcttttctttactgttctcttctttatgatatcctagattttgttctgttactgttactatcgatggaagatccagatttgcaattttgaggatatttattgtttcgttctgataggtgttttatcatttgtgtttttcgtctgtaatatccatccttc

SEQ ID NO: 943 - DNA, 744 bp, Primula obconica
ttattttgagagctgctcactcttcacagactcttcaaccatggccgaacagactgaaaaagcgtttctgaagcagcccaaggtgtttctatgctcaaagaaatctagtaaaggaaagaggcctggaaagggtggtaacagattctggaagaatgttggattggggtttaaagttcctgtagaagccaagactggtacctatattgacaagaagtgtccgttcactggtgatgtctccatccgaggccgcatccttgctggaacttgccacagtgccaagatgatgagaactattatcgttcgaaggaattatcttcactatgtgaaaaaatatcaaaggtatgagaaaaggcactcaaacattgctgctcacatatctccgtgtttccgtgtgaaagaaggggaccatgtcattattggtcaatgcaggcctttgtcgaaaacagtgaggttcaatgtcttgaaagtgatccctgctggatcatccggtaccggaaagaaggcctttgctggcatctgaggggttggactttgccttttaattgctttgagagaagcaagagtacttgaaaaatgactcattaggcttgcagttatcctttgaattacttttcttttgttccggatcaattttgaaattatgtttgacccttttgtactttgaacttatttcaatgctgttcagcatcgattttgaatgttcccttcaaattcttatcgattctaatgaagtgcccttattat

SEQ ID NO: 944 - DNA, 741 bp, Prunus persica
tccgcatagattagggtttttgctcatcagtctcccttcacggcgtcggcttcaaccagtctccacaaagcagcttgaaaatggcggaacagaccgagaaggctttcttgaagcaacccaaggttttcctgagctcaaagaagacagggaaaggaaagaggccaggaaaaggaggcaatcggttctggaagagtgttgggttggggttcaagacacccagagacgctattgaaggaacttatattgataagaaatgccccttcaccggcaatgtctccatccggggtcgcgttctctctggtacttgccacagtgccaagatgtcgaggactataattgttcgacgtaattatcttcattatattaagaaataccaaagatatgagaagaggcattccaacattcctgctcatgtgtcaccatgcttccgtgtgaaggagggagattatgtcatcattggccaatgcaggccattgtcaaagacagtgaggtttaacgtgttgaaggtgactccggctggttcttctggagctggaaagaaggcattcactggaatatgagcttcttgttttgggcagtattggtagtgttacgtttgtgcaagaagtacatttagattgagctactgttgacagatgaactgttttttgccgttttattttgatccttaaatatttaatccatgtatggtgaattttaaggtttttcttcagttgaaccattatcttggagtttgatatc

SEQ ID NO: 945 - DNA, 682 bp, Rosa hybrid cultivar
accttttcgcgcgccgtcgtcgtcttcttcgtcttcaaccagactcccccagaaagctcaaagatggcggaacagacggagaaggctttcctgaaacagcccaaggtcttcctcagctccaagaagactggcaaggggaagaggccaggaaagggaggcaatcgcttctggaagagcgttgggttgggattcaagactcccagagatgccattgaaggaacatacattgataagaagtgccctttcactggcaatgtctccatcaggggtcgcattctggctggtacctgccacagtgcaaagatgtcgaggactatcattgttcggcgcaattacctccactacataaagaaatatcagagatatgagaagaggcactcaaacatcccagcccatgtttcaccatgcttccgtgtgaaggagggagatcatgtcatcattgggcagtgcaggccattgtcaaagacggttaggtttaatgttttgaaggtcattccagctggggcttctgctggtgggaagaaggcatttactggagcttagacagcattttgggtggtctcttagtgttatttatgcaactacattagattgagtttcttttggaacatctaaattttgccattttaatttgcaccttcatgtactctgaatgttaaggttttcttcagtaccataattc

SEQ ID NO: 946 - DNA, 721 bp, Secale cereale
cgctcgaagcccacctcgaagccatggcggagcagaccgagaagtctttcctcaagcagccgaaggttttcctcagcaccaaaaaggctgataaggcaaagaggcccggcaaggctggcaaccgcttctggaagagtgttggccttggtttcaagaccccaagagaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaaccgtgagattcaatgtcctgaaggtcgttccagctggaaccaccggaggcgggaagaaggctttcatcgctgcttaagcccagactctgattcatgagtagttcatagtcagaactttttcgcacttgaaatctaccaggctgctgtttgagatttgattcccatgttttctgtcaaaccgaatgtcgtgatctgaacatgttttgtggaatctatctatcattaatagtttcacttaaatttgtactgcatgattgtccttctgctcaattcctggtgaatttgtttgcccaga

SEQ ID NO: 947 - DNA, 822 bp, Secale cereale
gggggccgccaactcctctcagagtctcgcctcctcgcacccgcatctccgcgccgcgccgccgccgccgccgcctccgagccgctcgaagcccacctcgaagccatggcggagcagaccgagaagtctttcctcaagcagccgaaggttttcctcagcaccaaaaaggctgacaaggccaagaggcccggcaaggctggcaaccgcttctggaagagtgttggccttggtttcaagaccccaagggaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaaccgtgagattcaatgtcctgaaggtcgttccagctggaaccactggaggcgggaagaaggctttcattgcagcttaagaccaaactctgattcatgagtagttcatagtcagaactttttcgcacttgaaatctaccagtctgctgtttgagatttgattcccgtgttttctgtcaaaccgaatgtcgtgatctgaacatgttttgtggaatctatctatcattaatagtttcgcttaaatttgtactgcatgattgtccttctgctcaattcctggtgaatttgtttgcccagatgtgatatgatatttactc

SEQ ID NO: 948 - DNA, 846 bp, Secale cereale
gagtggtaagtcaaccgacaggagtacgactgggggccggccgaacctcctctcagagtctcgcctcctcgcacccgcatctccgcgccgcgccgccgccgccgccgcctccgagccgctcgaagcccacctcgtagccatggcggagcagaccgagaagtctttcctcaagcagccaaaggttttcctcagcaccaaaaaggctgacaaggccaagaggcccggcaaggctggcaaccgcttctggaagagtgttggccttggtttcaagaccccaagggaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaactgtgagattcaatgtcctgaaggtcgttccagctggaaccaccggaggtgggaagaaggctttcatcgctgcttaagcccagactctgattcatgagtagttcatagtcagaactttttcgcacttgaaatctaccaggctgctgtttgagatttgattcccatgttttctgtcaaaccgaatgtcgtgatctgaacatgttttgtggaatctatctatcattaatagattcgcttaaatttgtactgcatgattgtccttctgctcaattcctggtgagtttgtttgcccagatgtgatatg

SEQ ID NO: 949 - DNA, 928 bp, Secale cereale
ctccgagccgctcgaagcccacctcgaagccatggcggagcagaccgagaagtctttcctcaagcagccgaaggttttcctcagcaccaaaaaggctgacaaggccaagaggcccggcaaggctggcaaccgcttctggaagagtgttggccttggtttcaagaccccaagggaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaactgtgagattcaatgtcctgaaggtcgttccagctggaaccaccggaggtgggaagaaggctttcatcgctgcttaagcccagactctgattcatgagtagttcatagtcagaactttttcgcacttgaaatctaccaggctgctgtttgagatttgattcccatgttttctgtcaaaccgaatgtcgtgatctgaacatgttttgtggaatctatctatcattaatagtttcgcttaaatttgtactgcatgattgtccttctgctcaattcctggtgagtttgtttgcccagatgtgatatgatgtttactcaagctagtgttgcctcgtccctattgtttgttaacttctccagtcctttaagttttaatactaatagaagtagaaactaaatagacgtacggtattttgtaagtttatgtataatactaggtatgttgtttgtacgtaaacggaaaaaaaaaaactagaagactgacgaagacacaacgg

SEQ ID NO: 950 - DNA, 729 bp, Salvia sclarea
gactctcagctgctgcggactagggtttttgctgctaccgccctccacacacacaagcacacacacacttcgatagcgcgcagccatggcggaacagaccgagaaggcttttttgaagcagcctaaggtgtttctctgctcgaagaagacagggaagggaaagacgccaggaaagggagggaaccgctactttaagagcattgggcttggattcaaaaccccgcgcgaggcttctgaagccacatacattgacaagaagtgccccttcactggcaatgtttccatcagagggcgtatccttgctggaacttgccacagtgcaaagatggtgcgaactatcatcgtgagacggaactatcttcactgggtgaagaagtaccaaaggtatgagaagaggcactccaacatcccggcccacatttccccatgcttccgtgtgagggaaggcgaccatgtcatcattggtcaatgcaggccgttgtcgaaaacagtgaggtttaatgttcttaaggtgatcccagctggttcgtctggtctgggaaagaaggtctttacagggatgtgagttaggcaacgtgacgtttgctgctagttgttaaaactgttttggaaggatggattttgaatttctattgtttcagttggaactgttatcatcgacttctctttgacagttcaaaatcttgatattttactaatgtttatctagttccagttttgtgatagttt

SEQ ID NO: 951 - DNA, 665 bp, Helianthus annuus
cgggggctgctttccttatctgtgtccgccgctgcaaagctccaaatctcccctcaacaatggcagaacagacagaaaaggcttttttgaagcaacctaaggtgttcctctgctcgaagaagagcggtaaaggaaagaggcctggaaaaggtggaaacagattctggaagaatatcggtcttggatttaagactccacgagaggctattgaaggaacttacattgacaagaaatgccctttcactggtgatgtatccattagaggtcgtattttagctggtacatgccatagtgctaagatggtgaggaccatcatcgtacgaagggactatcttcattatgtcaagaagtatcagaggtacgaaaagaggcactcaaacattcctgctcacatctcaccatgtttccgtgtgaaagaaggtgaccacgtcactgttgggcaatgcagaccattgtcaaagactgtgaggttcaatgtgctgagggtgattccagcaggatctgcaagtgctgggaagaaagcatttacaggcatataaaagttcagcacttttgcttgataatgtagaagtttttgagaacaaaacgttgtttttattgagattattatgctgtttttgacttgtctttcttgatatttatcttaaaaaagttcatttgctttt

SEQ ID NO: 952 - DNA, 742 bp, Helianthus annuus
ttaaggccggggacctagggtttattgctgctttcctgcacctgtgttaccgccgctgcaaagctccaaatctcccctcaacaatggcagaacagacagaaaaggcttttttgaagcaacctaaggtgttcctctgctcgaagaagagcgggaaaggaaagaggcctggaaaaggtggaaacagattctggaagaatattggtcttggatttaagactccacgagaggctattgaaggaacttacatcgacaagaaatgccctttcactggtgatgtatccattagaggtcgtattttggctggtacatgccatagtgctaagatggtgaggaccatcatcgttcgaagagactatcttcattacgtcaagaagtatcagagatacgaaaagaggcactcaaacattcctgctcacatctcaccatgtttccgtgtgaaagaaggtgaccacgtcactgttgggcaatgcagaccattgtcaaagactgtgaggttcaatgtgctgagggtgattccagcaggatctgcaagtgctgggaagaaagcatttacaggcatataaacgttcagcacttttgcttgataatgtagaagtttttgaggacaaaacgttgttttattaagatgattatgctgtttttgacttgtcgtttttgatatttatcttaaaaaggttcatttgcttttcaaaaaaaaaaacccctatcaaattaaataacatgtcggtcgccttgggccaca

SEQ ID NO: 953 - DNA, 683 bp, Helianthus annuus
gctgctttccttcatctgtgtaccgccgctgcaaagctccaaatctcccctcaacaatggcagaacagacagaaaaggcttttttgaagcaacctaaggtgttcctctgctcgaagaagagcggtaaaggaaagaggcctggaaaaggtggaaacagattctggaagaatattggtcttggatttaagactccacgagaggctattgaaggaacttacattgacaagaaatgccctttcactggtgatgtatccattagaggtcgtattttagctggtacatgccatagtgctaagatggtcaggaccatcatcgttcgaagggactatcttcattatgtcaagaagtatcagagatacgagaagaggcactcaaacattcctgctcacatctcaccttgtttccgtgtgaaagaaggtgaccacgtcactgttgggcaatgcagaccattgtcaaagactgtgaggttcaatgtgctgagggtgattccagcaggatctgcaagtgctgggaagaaagcatttacaggcatataaacgttcagcacttttgcttgataatgtagaagtttttgagaacaaaacgttgttttattgagattattatgctgtttttgacttgtctttcttgatatttatcttaaaaaagttcatttgcttttgaactgaatgtcaggctacggc

SEQ ID NO: 954 - DNA, 643 bp, Helianthus annuus
ttattgctgctttccttcatctgtgtaccgccgctgcaaagctccaaatctcccctcaacaatggcagaacagacagaaaaggcttttttgaagcaacctaaggtgttcctctgctcgaagaagagcggtaaaggaaagaggcctggaaaaggtggaaacagattctggaagaatattggtcttggatttaagactccacgagaggctattgaaggaacttacattgacaagaaatgccctttcactggtgatgtatccattagaggtcgtattttagctggtacatgccatagtgctaagatggtcaggacgatcatcgttcgaagggactatcttcattatgtcaagaagtaccagagatacgagaagaggcactcaaacattcctgctcacatctcaccatgtttccgtgtgaaagaaggtgaccacgtcactgttgggcaatgcagaccattgtcaaagactgtgaggttcaatgtgctgagggtgattccagcaggatctgcaagtgctgggaagaaagcatttacaggcatataaacgttgagcacttttgcttgataatgtagaagtttttgaggacaaaacgttgtttgattatgctgtttttgacttgtcggttttgatatttatcttaaaaaa

SEQ ID NO: 955 - DNA, 601 bp, Helianthus annuus
ctgtgtaccgccgctgcaaagctccaaatctcccttcaacaatggcagaacagacagaaaaggcttttttgaagcaacctaaggtgttcctctgctcgaagaagagcggtaaaggaaagaggcctggaaaaggtggaaacagattctggaagaatattggtcttgggtttaagactccacgagaggctattgaaggaacttacatcgacaagaaatgccctttcactggtgatgtatccattagaggtcgtattttggctggtacatgccatagtgctaagatggtcaggaccatcatcgttcgaagggactatcttcattatgtcaagaagtatcagagatacgagaagaggcactcaaacattcctgctcacatctcaccatgtttccgtgtgaaagaaggtgaccacgtcactgttgggcaatgcagaccattgtcaaagactgtgaggttcaatgtgctgagggtgattccagcaggatctgcaagtgctgggaagaaagcatttacaggaatataaacgttcagcacttttgcttgattatgtagaagtttttgagaacaaaacgttgttttattaagatgattatgctgtttttg

SEQ ID NO: 956 - DNA, 676 bp, Eutrema parvulum
gagggttctctctcgacactgtagctacctcaacaatggcggagcagacggaaaaggcgtttctgaagcaaccaaaggtcttcttatgctcgaagaaatctggtaaaggcaagagacctggaaagggaggtaatcgtttctggaagaacattggtcttggtttcaagactcccagagaagctactgaaggtgcatacatagacaagaaatgtccctttactggcacggtttctattaggggccgtatcttggcgggcacttgtcacagtgccaaaatgcagaggacaatcattgtccggaggaactatcttcattttgttaagaagtatcaaaggtatgagaaaaggcattcgaacattcctgctcatgtctcaccgtgtttccgtgtcaaagaaggagatcacgtgatcatcggacaatgcagaccattgtcaaagacagtgaggttcaacgtcctaaaggtcattccagctgggagttctgctatagggaaaaaggcattcaccggaatgtagagaattcttaaggtgggatcaaggatttggacttgtttttttgggctttactctttatatgttatatcctctgttttcatttgtgttagttgcgacatgatgtttcaatactccatctccttaccagactcattatataagaatgattctctgttgctgat

SEQ ID NO: 957 - DNA, 776 bp, Nicotiana tabacum
cggggatctctgttgcactttagggttttgccgccgagcatctatcctcgtccagttcagcttgtagtcctcaatcatggcggagcagacggagaaggcgtttttgaagcagccaggtgtttttctaagctcgaagaagacagggaaagggaaaaggccaggaaagggaggcaatcgctactttaagagtatcggtctagggttcaagactcctcgtgaggctgttgaaggtacatatattgacaagaaatgcccattcactggcaatgtttctatccgaggtcgtatccttgctggtacatgccacagtgctaagatgaacagaaccatcattgttcgacgcaactacttacattatgtcaagaagtaccagagatatgagaagaggcactcaaacattccagcgcacatatcaccatgcttccgtgtgaaagagggagatcatgttatcattggacagtgcaggcctttgtccaaaaccgtgaggttcaatgtcttaaaggtgattccagctggttctgctggtggaggtaaaaaggcttttaccgggatgtgagctttgtgcttccattttaactgttacttctaggaatgatgtcaagacttttctgcttttactgaatggttgtcttcattgattttcctttgaacttcaaattttgaaacttaatgctagcaatttttttaagcctatgtactacacttataagaggtttggtgattgaaccttatatttaaaaaaaggatatttggttattgaattagcagtgtttttc

SEQ ID NO: 958 - DNA, 680 bp, Nicotiana tabacum
ggcgggataggttttgtcatatcagctcattcaacttcgcagcatatcacaacaatggctgaacagacggagaaggccttcttgaagcagcctggtgtctttcttagctcgaagaagacagggaaggggaagaggccaggaaagggtggcaatcgctactttaagagcattggtttaggtttcaagactccccgtgaggctattgaaggttcttacattgataagaaatgtccgttcactggcaatgtttctatcagaggtcgtatccttgctggtacatgccacagtgctaagatgaacagaactatcattgtccgacgtaactacctacattatgtcaagaagtaccagaggtatgagaagaggcattctaatattccagctcatatatcaccatgcttccgtgtgaaagagggagaccatgttattattggacagtgcaggcctttgtcgaaaactgtgaggttcaatgtgttaaaggtgattcctgctgggtcagctggtgggggaaagaaagcatttacaggaatgtgagcttagcttatgagtttgttgttatttatggagaatcaaaaggggatgctgttagcacttgtcttttgaaaaaggtgtattcatagacttgaatttttctttggctaaacttactccattagtatcgacgagttgaaatttctggg

SEQ ID NO: 959 - DNA, 1039 bp, Nicotiana tabacum
ggctagggtatcagtattcagtagtataaactataaaggctttagtagctcacaattcaatccaatctaatctccgcctagggtttttgctgccgagccactcccctcgttccagttaagctttcagctctttcaactccacagccatggccgaacagacggagaaggcgttcttgaagcagccaggtgtttttcttagctcgaagaagacagggaaggggaagagaccagggaagggaggtaaccgctacttcaagagcattggtctagggttcaagactcctcgtgaggctactgaaggtacgtacattgacaagaaatgtccatttactggaaatgtttcaatcagaggtcgtatccttgctggtacatgccatagtgccaagatgaacagaaccatcattgttcgtcggaactacctgcattatgtcaagaagtaccagagatatgagaagaggcattcaaatatcccagctcacatatcaccttgcttccgtgtgaaagagggagatcatgttatcattggacagtgcaggcctttgtccaagactgtgaggtttaatgtgttaaaggtgattccagctggttctgctggtggtggcaagaaagcatttacaggaatgtgagcaggtgtttcttgagtttattgtcgcttctagagtatgaaagtaattatgtttaagactgagaagaggagtgacgttaagacttctctactaaaagctgtttgcgtttgcctttgaaggcttaaattttgtatggatacttgctacttatcattagtataaggagttcagatttcagttttcttgttaccattcttatttccaatcaaatgttcttcctgattgccccacgagagaaatatctatttgttgagatctttaggtactactgttaggagattatcccctttttgcgtctctgtggttgttgctatactctggtgtggttattcgtgtgaacgactccgtggattttgtgccatatagtaacttcttgagcggccgcatgaggggtacctgtcctctccaaatga

SEQ ID NO: 960 - DNA, 795 bp, Nicotiana tabacum
gcggggatctctgttgcactttagggtttcgccgccgagcatctatcctcgtccagttcagcttgtagccctcagtcatggcggagcagacggagaaggcgtttctgaagcaggcaggtgtttttctaagctcgaagaagacagggaaagggaaaaggccaggaaagggaggcaatcgctactttaagagtatcggtttagggttcaagactcctcgtgaggctgttgaaggtacatatattgacaagaaatgcccattcactggcaatgtttctatccgaggtcgtatcattgctggtacatgccacagtgctaagatgaacagaaccatcattgttcgacgcaactacttacattatgtcaagaagtaccagagatatgagaagaggcactcaaacattccagcgcacatctcaccatgcttccgtgtgaaagagggagatcatgttatcattggacagtgcaggcctttgtccaaaaccgtgaggttcaatgtcttgaaggtgattccagctggttctgctggtggaggaaaaaaggcttttaccgggatgtgagctttgtgcttccattttaactgttatttctaggaatgatgtcaagacttttctgcttttactgaattgttgtcttcattgattttcctttgaacatcaaattttgaaacttaatgctagcaatttttttaaagcctatgtactactccacttataagaggtttggtgattgaaccttatattttaaaaaggatatttggtgattgaattagcagtgcttttctagtttttttgtcgg

SEQ ID NO: 961 - DNA, 604 bp, Triphysaria pusilla
ctcctctgcaatcttttgcccacaaccatggctgaacagactgagaaggctttcctgaagcagcctaaggttttcctaagctcgaagaaaacaggaaagggaaaggctccaggaaagggtggcaatcgctattggaagagcatcggattagggttcaaaacaccccgagaggccattgaagctacttacattgacaagaaatgtccatttactggcaatgtatcgatcagaggccgtatccttgctggaacttgccacagtgctaaaatggtgagaacaatcattgttcgacgtaactacttgcattgggtcaagaagtaccaaaggtatgaaaagaggcactcaaacattgcagcacacatatctccatgcttccgtgtgaaagaaggtgaccatgttatcattggacaatgcaggccgttgtcgaaaactgtgaggttcaatgttctgaaggtggtaccggctgggtcatcaggtcgtgggaagaaggcctttacttttatttgattcagaggtggtcgaacttttttgttacgatggttaagtagattattgagtttggttcatggacttgttcttgttccagttttggactattactgtt

SEQ ID NO: 962 - DNA, 611 bp, Triphysaria pusilla
acattctcctctgcaatcttttgcccacaaccatggctgaacagactgagaaggctttcctgaagcagcctaaggttttcctcagctcgaagaaaacaggaaaggggaaggctccaggaaaaggcggcaatcgctactggaagagcatcggattagggttcaaaacaccccgcgaggccattgaagccacttacattgacaagaaatgcccgttcactggcaatgtgtcgatcagaggccgtatcctagctggaacttgccacagtgctaaaatggtgagaacaatcattgttcgacgtaactacttgcattgggtcaagaagtaccagagatatgaaaagaggcactcaaacattgcagcacacatatctccatgcttccgtgtgaaagagggtgaccatgttatcattggacaatgcaggccgttgtcgaaaactgtgaggttcaatgttcttaaggtggtaccggctgggtcatcaggtcgtgggaagaaggcctttacttttatttgattcagaggtggtcgaacttttttgttacgatggttaagtggattattgtgatatggttcgtggacctttgacttgttccagttttggactattactgtt

SEQ ID NO: 963 - DNA, 758 bp, Triphysaria pusilla
tttttgctagtgctcctcctcttcactgcttttcatcacgctccgtagcacgcagcatggcggaacagacagagaaggcgttcttgaagcagcctaaggtgttcctaagctccaagaaaactggcaaggggaaagctcctggaaagggaggaaaccgctacttcaagagcattggtctgagttttaaaacacctcgtgaagcaattgaaggcacatacattgacaagaaatgcccattcactggtggtgtatctatcagaggccgcattcttgctggaacttgccacagtgcaaagatggtcagaactataattgttaggcggaactaccttcattgggtcaagaagtaccaaagatatgagaagaggcattcgaatattgctgcacacatatccccatgcttccgtgttaaggagggtgaccatgtcatcattggccagtgcaggcccttgtcaaaaaccgtgaggtttaatgtcctcaaggttgttccggctggttcttcgggtcttggaaagaaggcatttacaggggcgtgagatcaaaaatccaaatttcatgtttagtgttttgatggttttggacttctgctgtttcatttggatgtattaccattgacattgtcttaatttattaagtttttgagttttgcgaatttgtattctactatgccttttcaaatatttatatttctcgatattagagtgatatttatcattaagattttaatgatgcattttttaactaaaaaaaaaaaaaaa

SEQ ID NO: 964 - DNA, 706 bp, Triphysaria pusilla
tcctcctcctcttcactgcttttcatcacgctccgtagcacgcagcatggcggaacagacagagaaggcgttcttgaagcagcctaaggtgttcctaagctccaagaaaactggcaaggggaaagctcctggaaagggaggaaaccgctacttcaagagcattggtctgagttttaaaacacctcgtgaagcaattgaaggcacatacattgacaagaaatgcccattcactggtggtgtatctatcagaggccgcattcttgctggaacttgccacagtgcaaagatggtcagaactataattgttaggcggaactaccttcattgggtcaagaagtaccaaagatatgagaagaggcattcaaatattgctgcacacatatccccatgcttccgtgttaaggagggtgaccatgtcatcattggccagtgcaggcccttgtcaaaaaccgtgaggtttaatgtcctcaaggttgttccggctggttcttcgggtcttggaaagaaggcttttacaggggcgtgagatcgaaaatccaattttcatgtttagtgtttcatgtgttttggacctcagttgtttcatttggatgtattaccattgacattgccttaatttatcaagtttttgagttttgcgaatttgtattctactatgccttttcaaatatttctcgaaattagtgggatatttatcattaagatt

SEQ ID NO: 965 - DNA, 671 bp, Triphysaria pusilla
cacacattcaatctgccgccactttcaccattttcacattctcctctgcaatcttttgcccacaaccatggctgaacagactgagaaggctttcctgaagcagcctaaggttttcctcagctcgaagaaaacaggaaaggggaaggctccaggaaaaggcggcaatcgctactggaagagcatcggattagggttcaaaacaccccgcgaggccattgaagccacttacattgacaagaagtgcccattcaccggcaatgtgtcgatcagaggccgtatccttgctggaacttgccacagtgctaaaatggtgagaacaatcattgttcgccgtaactacttgcattgggtcaagaagtaccagagatatgaaaagaggcactcaaacattgcagcacacatatctccatgcttccgtgtgaaagagggtgaccatgttatcattggacaatgcaggccgttgtcgaaaactgtgaggttcaatgttcttaaggtggtaccggctgggtcatcaggtcgtgggaagaaggcctttacttttatttgattcagaggtggtcgaacttttttgttacgatggttaagtagattattgagtttggttcatggacttgttcttgttccagttttggactattactgtttcattgtgagtttgtactcttgattaa

SEQ ID NO: 966 - DNA, 609 bp, Triphysaria pusilla
acattctcctctgcaatcttttgcccacaaccatggctgaacagactgagaaggctttcctgaagcagcctaaggttttcctcagctcgaagaaaacaggaaagggaaaggctcctggaaagggtggcaatcgctactggaagagcatcggattagggttcaaaacaccccgagaggccattgaagccacttatattgacaagaaatgcccgttcaccggcaatgtgtcgatcagaggccgtatcctagctggaacttgccacagtgctaaaatggtgagaacaatcattgttcgccgtaactacttgcattgggtcaagaagtaccaaagatatgaaaagaggcactcaaacattgcagcacacatatctccatgcttccgtgtgaaagagggtgaccatgttatcattggccaatgcaggccgttgtcgaaaactgtgaggttcaatgttctgaaggtggtaccagctgggtcatcaggtcgtgggaagaaggcctttacttttatttgattcagaggtgggcgaacttttttgttacgatggttaagtagattattgagtttggttcatggacttgttcttgttccagttttggactattactgtt

SEQ ID NO: 967 - DNA, 794 bp, Juglans hindsii x Juglans regia
cgctagggtttaggattttcttcatcgcctcatctgcgtcgtcggcttctacgcttcctaaagtacccacaaaccctcaccatggcggaacagacggagaaggcgtttttgaagcagcccaaggtgttcctctgctcgaagaagtcggggaaagggaagaggcctgggaaaggaggcaaccgattttggaagagcatcgggctggggttcaagactccaagagaggctattgaaggtacatatatagataagaaatgcccattcactggggatgtttccatcaggggtcgcatccttgccggtacctgccatagtgccaaaatgatgaggaccatcattgttcggcggaattacctgcattttgttaagaaataccaaagatatgagaagaggcattcaaacattgcagcacatatatccccatgcttccgtgtgaaagagggagactatgtcaccattggccagtgcaggccattgtcaaagacagtaaggtttaacgtcttaaaggtgataccagctggttcttcaggaggcggtaagaaggcatttgctggaatctgagttctcccttgtgaaaggtctcagaagtatcagatttgaagagaatggtgttagatggagcttttccctcctgacgatacttcttttttattcttttgttggctcttcaaaatatgaaagtgttcatgacttgttttatgtttcctttcaattagttaccgagttttgccctgtcgattcaatttttcagtgagatccttctagctgtttctacgtgtggttttgttatgctc

SEQ ID NO: 968 - DNA, 820 bp, Citrullus lanatus
ataactctccgaagcaggtttagggtttcagtaatcgaactcctctccttcggccgcctgagcaaagaccagaacgcgtgctctcttcagaatccctaatcatggcggaacagaccgagaaggcgtttttgaagcaacccaaagtgtttctctgctctaaaaaggctgggaaagggaagagacctggaaagggtgggaaccgtttctggaagagtattggattaggattcaagacgccaagagaagccattgaaggaacatatattgataagaaatgccccttcactggaactgtctcggtcaggggacgtattttagctggaacttgtcatagtgctaagatggttaggaccataattgtcaggaggaactacttacattatgttaagaagtatcagaggtatgagaaaaggcatcctgctcacatatctccttgctttcgtgtgaaggagggagatcatgttattattggccaatgcaggccattgtcgaagacagtgaggttcaatgtgttgaaggtcattgctggatcctcaagtcgtgggaagaaggcttttgccggaatttaaattatgtaggtttccgcttttgatacaaaaaaacagcatgaaagaacttttgcgagttgtaggccatatttgatggatgcaaaaaggttttgatgacttggcagtctggattttgatatgaatatggactgttttattgtgttctatttgttttgatttcttggggttttgaaggcaccaacttttcctggatctctattaggtattctaatacatgtcagttttttattatgagatatttgttccaccgc

SEQ ID NO: 969 - DNA, 823 bp, Triticum aestivum
actcctctcagagccttgctcccgcttcccctcgacgcgccgccgccgccgcctccgagcccctcgacgcccacctcgcagccatggcggagcagaccgagaagtctttcctcaagcagccaaaggttttcctcagcacgaaaaaggccgacaaggcaaagaggccaggcaaggctggcaaccgcttctggaagagtgttggccttggtttcaagaccccaagggaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacatctccccctgcttccgtgtcaaggaaggcgaccatgtcatcattggccagtgcaggcccctgtcgaaaaccgtgagattcaatgtcctgaaggtcgttccagctggaaccaccggaggcgggaagaaggctttcatcgctgcttaagcccagactctgattcatgagtagttcatagtcagaacttttacgcacttgaaatctaccaggctgctgtttcgagatttgattcctgtgttatctgtcaaccgaaatgtcgtgatctgaacatgtcttgtggaatctatctatcattaatagtttcgctttaatttgtactgcctgattgtccttttgctcaattccttgtgaatttgtttgcccagatgtgatatgatatttactcaagcagtgtgttgccttgttcc

SEQ ID NO: 970 - DNA, 702 bp, Medicago truncatula
taaccacccactgcggcagattcaaggtgcaaacttgccttctgaaacaaagcttcatcaactgaaccaaccatggctgaacagactgagaaggcttttttgaagcaaaataaagtgtttttatgctcgaagatatctgggaaggggaagagacctggaaagggtggcaatcgttttcataaaactgttggccttggttttaagactcctagggaagccattgaaggaacctatattgacaagaagtgtcccttcactggtaatgtctcaatccgaggtcgtatcatatctggtacttgccatagtgctaagatgaataagaccattgttgttaggaggaattatcttcatttcattaagaaatatcagaggtatgagaagcgccattctaatattcctgcacacgtatcaccttgtttccgagtgaaggaaggggatcatgttattattggccaatgcaggccactttcgaagacagtgaggttcaatgtattgaaagtcatcccagctggatcttctagtggtgccggtgccaagaaggcatttacaggagtctgagtttggaatatttacagttgtaccttagtttcaaatgtttgactgttctgacttggtcatgatctcatcaaatttggatatgttttaatgctttgcattcattttagttaatgttaaatttttttattttgatatacattttgg

SEQ ID NO: 971 - DNA, 883 bp, Panicum virgatum
gagacaaccccgctccgatataagaagtgctccattacggccggggggccgccacctccttccgagtctcagctccgcaccccccgccgccgctcgacgcccgccgcgcagccatggcggaacagactgagaaggctttcctcaagcagcctaaggtgttcctcagcacaaagaaatctgccaaggataagaagccaggcaagggaggcagccgcttctggaagagcattggcctgggcttcaagacccccagggaagcaattgaagggacctacattgacaagaagtgcccattcactggaactgtttccatcagaggcaggattattgccggagcatgccatagtgcaaagatgaacagaaccatcattgttcgcaggaactacctccactttgttaagaaatatcagaggtacgagaagaggcactccaacattccggctcacatctccccatgcttccgtgtcaaggaaggtgaccatgtcatcattggccagtgcaggcccctctccaaaactgtgaggttcaacgtggtgaaagtcatcccagctggatccactgatggcagaggcgggaagaaggcgttcaccgcggcctgagctttagactatgttccaagagtagtctatagaatgatgtctttttgctaaaaatcctgctaggctggtgttttcgattatggtttggagattgttcgctgtctgaatggagtctcatcaccggaacatgttactctttatggaatcctctcgtgcaaagttttgttatgatctgtattgtttccccaatgctgctgtggcttctgcgcaatgcttttcccagcatatccgagtcattgttaaagaatttttttttttttgcaccgtgccagcaatatttgtgc

SEQ ID NO: 972 - DNA, 687 bp, Fraxinus spp
ttctgaacacacacaagcacacactctagcactactcgaccatggcggaacagacagagaaggcgttcttgaaacagcccaaggttttcctttgctcgaagaagacaggaaagggaaagaggccaggaaagggaggcaaccgatactggaaaagcgttgggctaggattcaagactcctcgcgaggctattgaaggcacatagtatcggacaagaatgtcccttcacaggcgatgtctccatcagaggccgtattcttgctgggacatgccacagtgccaagatgatgagaacaatcattgttcgtcgtaactacttacattgggttaagaagtaccggagatacgaaaagaggcattcaaacattccagcacacatatcccccatgcttccgtgtgagagagggcgaccacgttactattggccagtgcaggcctttatcaaaaacggttagattcaatgttcttaaggtgataccagctggttcgtctggtctcggcaagaaagcatttacagggatgtgagttttggtgatttgaaaatttttgtttaggactttaaaagtcttgaagtatggttcaagactgttttacttctttcagttggtcgattgtcactactgaggctttgaattttcgaagttgctaatttatatattctctagttgtcagtttttaaaattggatct

SEQ ID NO: 973 - DNA, 780 bp, Pinus pinaster
tcacggtcgctagggtttaacggctccggcctacataagcggttgtattctttctcattgttacgagatcgagggtttcaaagctccggcctacacaaagcggtgtatctcttatcattgtttggagatcgagggtgcagtcttaagaacgtcctcgtttggattccaggtccgtctgaaataccaggcaggagcagctggggcgttgaagatacgaagtgagaagtcttgaattcctgtagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattatgtcaagaaatatcagaggtatgagaagagacattcgaacataccagcccacatttcaccttgtttccgtgtcaaggaaggggatcatgttataattgggcaatgcaggcccttgtccaagactgtaaggtttaatgttctgaaggtgattccggcgggttctagcagtggttctgcaaagaagccttcactgcaatatgaattccgttttttttaccctgtccaagcaaaccataaaatccaattaaacgcaaa

SEQ ID NO: 974 - DNA, 718 bp, Papaver somniferum
gaccacccaccctccttatatctttcgcttcccttcttcccccaactcgttcgcctccgagcttcttcaatcatggctgagcagacggaaaaggcttttttgaagcaacccaaggtgtttctatgctcgaagaaatccggaaagggtaagagacccggcaagggtggaaaccgtttctacaagagcatcggactgggctttaaaaccccaagagaagctatcgaaggaacttacattgacaagaaatgccccttcactggcaatgtttctatcaggggccgtatcattgctggtacctgtcacagtgcaaagatggtgcgaactatcattgtgcgacggaactaccttcactatgtgaagaaatatcaaagatatgagaagaggcattccaacataccagctcatatatccccatgttttcgtgtgaaggagggtgaccatgtaaccattgtcaatgcaggcctttgtcgaagacggtgaggttaatgtcttgaaggtcattcctgctggatcctctggtggaggtggcaaaaaggcttttgtggctatgtaaggttgttcatcatggtttttcggacccagtgcaatgtcatgaatattatgctttaagatcagcaaaaatttagagccgaccgcagtcgtcattatagtttaatgatttgttttttgaatctgttatcactgcaattttgcatgtgaggccgaattttgtttattt

SEQ ID NO: 975 - DNA, 674 bp, Triphysaria pusilla
ctcctcctcttcactgcttttcatcacgccccgtagcacgcagcagcacggcggaacagacagagaaggcgttcttgaagcagcctaaggtgttcctaagctccaagaaaactggcaagggtaaagctcctggaaagggagggaaccgctacttcaagagcattggtctgagttttaaaacacctcgtgaagcaattgaaggcacatacattgacaagaaatgcccattcactggtggtgtatccatcagaggccgcattcttgctggaacttgccacagtgcaaagatggtcagaactataattgttaggcggaactaccttcattgggtcaagaagtaccaaagatatgagaagaggcattcgaatattgctgcacacatatccccatgcttccgtgttaaggagggtgaccatgtcatcattggccagtgcaggcccttgtcaaaaactgtgaggtttaatgtcctcaaggttgttccggctggttcttcgggtcttggaaagaaggcttttacaggggcatgagatcgaaaatccaattttcatgtccagtgtttcatgtgatttggacttctgctgtttcatttggatgtattaccattgacattgccttaatttatcaagtttttgagttttgtgaatttgtattctactatgcgttttcaaatattt

SEQ ID NO: 976 - DNA, 747 bp, Pinus taeda
gaaattccaggcaggagcggctggggcgttgaagatacgaagtgagaagtcttgaattcctgtagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattttgtcaagaaatatcagaggtatgagaagagacattcgaacataccagcccacatttcaccctgtttccgtgtcaaggaaggggatcatgttataattgggcaatgcaggcccttgtccaagactgtaaggtttaatgttctgaaggtgattcctgcgggttctagcagtggttctgcaaagaaagccttcactgcaatatgaatccgtttttttttgtactctgtccaagcaaaccataaaatccattaaacgcaatggagttggcatcaaatgcaagtgagaaacaattgaaaccagtacattagtattattagaaactctttatatggaatattttatattgggatgtgtgtttcaaatcggaaaattttgtagaaaaaaaaatgtttgcaagtgat

SEQ ID NO: 977 - DNA, 864 bp, Pinus taeda
tcgaactagggtttatagggataaataaccagggcttccattttcttcccttttgtttggaacttctcaggtaggagcgggagcggccgaggccttcaaatgcgaagttagaagtcttgaattcctacagccatggcagaacagactgagagagcttttctaaagcaaccaaaagtctttctcagttctaagacgtctgggaaggggaaacgtcctggaaaaggtggcaacaggttttggaagaatgtgggtcttggctttaagacccccaaagaagctattcaagggacctacatcgacaagaagtgcccattcactggtactgtttcaataagaggtcgtatattagctggaacatgttacagtgctaaaatgacacggacaattattgtccgtagggactatctccattttgtcaagaaatatcagagatatgaaaagagacattcgaacataccagcccatatttcaccctgtttccgtgtcaaagaaggggatcatgttatcattgggcaatgcaggcccttgtccaagactgtaaggtttaatgttctgaaggtgattcctgcgggttctagcagtggttctgcaaagaaagccttcactgcaatatgaatccgtttttttttccatgaagtgtgatagagtgggctttgacagagttgagggttactatttttatcatttggtcaaattaattttgttagtttaatccttcttttggttactgtgttgaattttgaaaaagatgtacggctcatgtttactctctgtagttgaaagtccaccgttcttggatacttttgttttggttttagcatccagtaaacctttgaatgcatattcttcgaatatatatatttt

SEQ ID NO: 978 - DNA, 720 bp, Antirrhinum majus
gctgccgagctttaaacttccgtcgcacacatacacacacacaagcacacaacaatggcggagcagactgagaaggcttttttgaagcagcctaaggttttcctttcctcgaagaagacgggcaagggtaaggctcctggaaagggaggtaaccgctacttcaagagcattggattagggttcaaaacgccccgagaggctgttgaaggcacatacattgacaagaaatgcccatttgttggagatgtgtccatcagaggtcgtatcattgctgggacatgccacagtgcaaagatggtgagaaccatcattgtacgtcgtagttaccttcactggatcaagaagtaccaaagatatgagaagaggcattcaaacatcccagcacatatctctccatgcttccgtgtgaaagagggagaccatgtcatcattggccagtgcaggcccttgtcaaagaccgtcaggtttaatgttcttaaagttgtcccagctggttcttctggtcgtgggaagaaggcttttaccggaatatgagcttgctagtctggattttagagttttaaggttgaacttttcaattgacttgctgtttaaatgattgtatttcacaattttatcctccattagcaagtccttttttgaacttcccaatgtcttgagtaatttttcattatgagatgtttcagttatgcttctaatatgatatttattactcctgcg

SEQ ID NO: 979 - DNA, 733 bp, Fagus grandifolia
ctggaccttggctgtcactcagttggattagggtttttcatcatcgcctcctttgcgtcgttagcttctaccactctcgacgaaccctaaccatggcggaacagacggagaaggctttcttgaagcagcccaaggttttcatctgctcgaagaagacagggaaagggaagaggccaggaaaaggtggtaacagattctggaagagcgtcgggttgggcatcaagactcccagagaggctattcaagggacatatattgacaagaaatgcccatttactggaaatgtttccatcaggggccgtcagcttaccggtacttgccatagtgccaagatggttaggaccatcattgttcgccgtgattaccttcattttgttaagaaatatcaaagatatgagaagaggcattcaaacattccagcacacatatccccttgcttccgtgtgaaagagggagaccatatcatcattggccagtgcaggccattgtcaaagacagtgaggtttaatgttttgaaggtggttccagctgggtcttccggaggtggtaagaaggcattcacaggaatgtgagtttcagtgtgcaacttttctcagtagtgtcacatttgaatgagaatgacattagattaagccactccttccagatgagacttttttgtccttttcttttactctttaaaatattaaatctttgtatgacctatttatgtttcctttcaattggagttcct

SEQ ID NO: 980 - DNA, 989 bp, Vaccinium corymbosum
tcctatttttacggttccgggttacttttctttgttcttttggttacttagtacgttactaagggtttctctctctcttctctgcacttccgtcttcctttaccgcagctctactcagtcaatcatggccgaacagacggagaaggcgttcttgaagcagccgaaggtgttccttagctcgaagaaaacagggaaggggaagagacctggaaagggagggaatcggtacttcaagaatgttggcttggggttcaaaactcccagagaggcaattgatggaacttatattgacaagaaatgtccattcactggaaatgtgtctatcaggggtcgcattatctctggaacctgtcacagtgccaagatgatgagaacaatcattgttcgccgtaactacctccattatgtcaagaaataccagaggtacgaaaagaggcattcaaacattcctgctcacatatcaccatgcttccgtgtgaaggagggagaccatgttactatcggccagtgcaggccattgtcaaagaccgtgaggtttaatgtgcttaaggttattccagctggttcttctggtggtggaaagaaggcgtttacggcaatgtgagttgtgatggagtaatatctttagtggtaatatagcgtaaggcagaccatggcattagattgtgttatgtcagttcgaatgaaccttttcatttgatttgctgttggaaattttgaatttttgtatgtggccggattttggtcttgagtaaacgagtttttgtttgtttccaactctgatcataaacttcattgtgttatggtcatgaaatttgcttgcgttgcctggtaattgatttttcttgtgctttctctattaattacgatgtccctgtagttgctctgagaatcgtctgagattgtgtgattcctgagcgaaacccgacaacattaaaatgattgtagctctgggaccgtctaagttttgaccctcttcgggccttggc

SEQ ID NO: 981 - DNA, 772 bp, Vaccinium corymbosum
cgtcttcctttaacgcagctctactcagtcaatcatggccgaacagacggagaaggcgttcttgaagcagccgaaggtgttccttagctcgaagaaaacagggaaggggaagagacctggaaagggagggaatcggtacttcaagaatgttggcttggggttcaaaactcccagagaggcaattgatggaacttatattgacaagaaatgtccattcactggaaatgtgtctatcaggggtcgcattatctctggaacctgtcacagtgccaagatgatgagaacaatcattgttcgccgtaactacctccattatgtcaagaaataccagaggtacgaaaagaggcattcaaacattcctgctcacatatcaccatgcttccgtgtgaaggagggagaccatgttactatcggccagtgcaggccattgtcaaagaccgtgaggtttaatgtgcttaaggttattccagctggttcttctggtggtggaaagaaggcgtttacggcaatgtgagttgtgatggagtaatatctttagtggtaatatagcgtaaggcagaccatggcattagattgtgttatgtcagtttgaaggaaccttttcatttgatttgctgttggaaattttgaatttttgtatgtggccggattttggtcttgagtaaacgagtttttgtttgtttcctactctgatcataaacttcattgtgttatggtcatgaaatttgtttgcgttgcctggtaattgatttttcttgtgctttctctaatt

SEQ ID NO: 982 - DNA, 874 bp, Vaccinium corymbosum
acttttagggttctcgttaggttatatataaaccttcttacctcgtggagctgctctcactctgcttggctgcgtctagggtttctctctatcttctctgcatttcctcctcccatcttcctttgccgcagctctactcagtcaatcatggccgaacagacggagaaggcgttcttgaagcagccgaaggtgttcctcagctcgaagaaaacagggaaggggaagagacctggaaagggagggaatcggtacttcaagaatgttggcttggggttcaaaactcccagagaggcaattgatggaacttatattgacaagaaatgtccattcactgggaatgtgtctatcaggggtcgtataatctctggaacctgccacagtgccaagatgatgagaacaatcattgttcgccgtaactacctccattatgtcaagaaataccagaggtacgaaaagaggcattcaaacattcctgctcacatatcaccatgcttccgtgtgaaggagggagaccatgttactatcggccagtgcaggccattgtcaaagaccgtgaggttcaatgtgcttaaggtgattccagctggttcttctggtggtggaaagaaggcatttacggcaatgtgagttttggtggagtaatatcgttagtggtaatatagcgtaaggcagacaatgacatttgattgtgttatgtcagttcgaaggaacctttttattttattctgttggaaattttgaatttttgtatgtggccggattttggtcttgagtaaacgagtttttgtttatttccaactctgatcttaaactttgttgtgttatggttgtgaaattcggttacgttgcctggtaattgattttaattgtgctt

SEQ ID NO: 983 - DNA, 542 bp, Bruguiera gymnorhiza
ggcgtgtttcgtgtctcggtttttggccgctactctcctgagaacacacagctattcatcatggccgagcagacagagaaggcttttttgaagcaacccaaagtgtttctttgctcgaaaaagtctgggaaggggaagaggcctggaaagggtggaaaccgctactggaagaacattggtcttggttttaagactcccagagaagccatcgagggaacatacattgataagaagtgccccttcactggaaatgtttcgattaggggtcgtattttagctggtgtttgccacagcgccaagatgaataggaccattattgttcggcggaattatcttcattttgtgaagaaataccaaagatatgagaaaaggcattcaaatattgctgcacacgtatccccatgcttccgtgtgaaggagggggatcatgttatcattgggcaatgcaggccactgtcaaagactgtgaggttcaatgtgttgaaagtgattcctgctggatcttctgctggtgggaagaaggcatttactgggatgtgaga

SEQ ID NO: 984 - DNA, 779 bp, Trifolium pratense
gcgaaactctcaacttccaccatggctgaacagactgagaaggcttatttgaagcaaccaaaagtgtttctaagctcgaagaaatctggaaagggaaagagacctggaaaaggtggaaatcgcttctggaaatccattggtctttcattcaagactcccagagatgccattgaaggaacctacattgacaagaagtgccccttcaccggcaatgtttccatcaggggccgtattttatctggaacctgtcacagtgctaagatgaacaggactattattgttagaaggaattatcttcactttattaagaagtatcagagatatgagaagaggcattctaacattcctgctcatgtatcaccttgcttccgtgttaaggaaggagaccatgtaatcattggccaatgcaggcctctctccaagactgtgaggttcaacgtcttgaaagtgatcccagctggatcatcgagtggtgctggaaagaaggcatttactggaatttaagatgtgttgaaagtaattctgatttctgtatgctgacttatatgaagaccagttcaattttgttttgtttttgaatttaagccctatcatcatttgataaaagttgaaggattttgattattggttatttaatagtagtagcattttatattgaatttttgcttcaaacagggattatcccgcctttattaggttagaaaagagatcaaaatttctgagggtattcagacagtgataacccattctgtatgtgtgttgtaccatcaacacacgta

SEQ ID NO: 985 - DNA, 780 bp, Trifolium pratense
actaaaattgtaaaacaccgaaataaaattagggtttcaccattttcatcaaacttcagagtgatagagaggcttttcgacgagtgcggctaaaactagggtttttcattttcctctgcgaaactctcaacttccaccatggctgaacagactgagaaggcttatttgaagcaaccaaaagtgtttctaagctcgaagaaatctggaaagggaaagagacctggaaaaggtggaaatcgcttctggaaatccattggtctttcattcaagactcccagagatgccattgaaggaacgtacattgacaagaagtgccccttcaccggcaatgtttccatcaggggccgtattttatctggaacctgtcacagtgctaagatgaacaggactattattgttcgaaggaattatcttcattttattaagaagtatcagagatatgagaagaggcattccaacattcctgctcatgtatcaccttgcttccgtgttaaggaaggagaccatgtaattatcggccaatgcaggcctctctccaagaccgtgaggttcaacgtcttgaaagtgatcccagctggttcatcgagtggtgctggaaagaaggcatttactggaatttgagttgtgttgaaagtaattccgatttctgtatgctgacttatataaagaccagttcaattttgttttgtttttgaatttaagccctatcatcatttgataaaagttgaaggattttgattattggttatttaatagtagtagcattttatattgaatttt

SEQ ID NO: 986 - DNA, 707 bp, Cyclamen graecum
tctccgcgtctagggtttctgctgatcttctctctcctccagagctcgctcaaccatggcggaacagacggagaaggcgttcttgaagcagcccaaggtcttcctcagctcaaagaaatcaagcaagggaaagaggccaggaaagggaggtaatcgttactggaagagcattggtttgggcttcaagacacccagagaggctattgaagggacttatattgataagaaatgtcctttcactggagatgtgtccatcaggggtcgtatacttaccggtacatgccacagtgcaaagatgaatagaagtatcattgttcgccgcgattaccttcattatgtcaaaaagtatcagaggtatgagaagaggcattcaaatattccagctcacatttccccgtgcttccgtgtgaaggagggtgaccatgtagttatcggccagtgcaggccattgtccaagacggtgaggtttaacgtgttgaaggtggtcccagctggttcctctgctggtgggaagaaagcatttacagcaatatgagtttggtatcggaagttattttggtagtaaaatataaaagtatcgcggattttttctagttcattttttaaagcttaaatggaaaattgaacttcatttgatttggttagttctgaactgtatgagattgatttatgattttgcggaaatgagtttttcaagtttggatgct

SEQ ID NO: 987 - DNA, 680 bp, Taraxacum officinale
atttgcactcttgcgaccgccgcttcggagctcgcaatccctaatcaacaatggcagaacagacggagaaggcttttttgaagcaacccaaagtgtttatctgctcgaagaaaagtgggaaaggtaagaggcctggaaagggtggaaacagattctttaagagtgtcggtcttggcttcaagacaccaagagaagccatcgaaggaacttacattgacaagaagtgtcctttcaccggtgatgtttccatcagaggccgtattttagctggaacatgccacagtgcaaagatggtgaggaccattattgttcgtagggactattttcactatgtcaagaaatacaaaagatatgagaaaaggcactcaaacactcctgcccacatttcaccatgttttcgtgtcaaggaaggtgaccgtgtcaccattggacagtgcagaccgttgtcaaagacagtgaggttcaatgtgttgaaggtggtcccagcaggatcttctggcggtggaaagaaagcatttaccggcttttgagaagagtatatgatgatgagtttttataaactattttttatttcgacttgcttttttatgtaagagattttgagttatatccttatgtagacgacactattattttattttggttctggtttatgagagtttttatgaaattattatttg

SEQ ID NO: 988 - DNA, 670 bp, Euonymus alatus
gtaatcctgttgtgtcctcggcgctgtatcttcaaccatggcggagcagacggagaaggcatttttgaagcagccgaaggtttttctaagctcgaagaaaactggtaaggggaaaaggccgggaaagggtggaaaccgcttctggaagaacattgggcttggttttaagacacccagagaagcaactgaaggtacatatattgataagaaatgtccattcactggcactgtatctatcaggggtcgtatcttggctggcacttgccacagtgccaaaatgaacaggaccattattgttcgaaggaactatcttcactttgttaagaaatatcaaaggtatgagaagaggcactccaatattcctgctcatgtttccccttgcttccgtgtgaaggaaggagaccatgttattattggccaatgcaggccactttcaaagacggtgaggttcaacgtcttgaaagtgattccagcaggaacgggtggcagtggaaagaaggcttttacagcaatttgaaggttttatttttgcaagtgatgtggttttactttttatatctgccaggattcgatttgagtctatgtatcagtattgctgcctgaattttgttttggttcttaacaccctaaattagctcccgcaggttttataattacgacatttgatcct

SEQ ID NO: 989 - DNA, 767 bp, Euonymus alatus
cttccagctagtgaagctttattaagccttagcctccataaccagagaacactcccgacttcatcgacggctctcaaacatggccgagcagacagagaaggcatttctgaagcagcccaaagttttcttgagttcaaagaaaactgggaaaggaaagagacccggaaagggcgggaaccgcttctggaagagcattggcttgggtttcaagaccccgagagaggcaatcgaaggaacctatattgataagaaatgcccattcactggtactgtgtcgatcaggggccgtatcttggctggcacttgccatagttccaagatgatgaggacaattgttgtacgacgaaactaccttcattttgtgaagaagtaccagaggtatgagaaaaggcactctaacattactgcacatgcatcgccatgcttccgtgtgagggaaggggatcatgtcatcattggccagtgcaggccattgtcaaaaacagttagattcaatgtgttgaaggtgattcctgctggagcttctgctggtgggaagaaggcctttacggggatgtgattttggctttgcaatttcatgatatggtgttgtcacaagcatattggttagggttgttcgttgatcttatcatgtaagggaaaccttaggaatttttcatcatttaggttttagaaattcctgtattttttttgataaatacctgtacttctgatgcctcgtgttcgtccctttcagttaattacctaaatcatggttttgaggatgt

SEQ ID NO: 990 - DNA, 744 bp, Euonymus alatus
tgtgatcctgttgtgtcttcggcgctgtatcttcaatcatggcggagcagacggagaaggcatttttgaagcagccgaaggtttttctaagctcgaagaaaactggcaaggggaaaaggccgggaaagggtggaaaccgcttctggaagaacattgggcttggttttaagacacccagagaagcaactgaaggtacatatattgataagaaatgtccattcactggcactgtatctatcaggggtcgtatcctggctggcacttgccacagtgccaaaatgaacaggaccattattgttcgaaggaactatcttcactttgttaagaaatatcaaaggtatgagaagaggcactccaatattcctgctcatgtttccccttgcttccgtgtgaaggaaggagaccatgttattattggccaatgcaggccactttcaaagacggtgaggttcaacgtcttgaaagtgattccagcaggaacgggtggcagtggaaagaaagcttttacagcaatttgaaggttttatttttgcaagtgatgtggttttactggttatatatctgccaggattcgatttgagtcttatgtatcagtattgctgcctgaattttgttttggttcttaacatcctaaattagctcccgcaggttttataattaagacatttgatcctttattttctcggattttttttccttgtctcaaaattgcactctcatctgctatgctattatatagtcgct

SEQ ID NO: 991 - DNA, 669 bp, Euphorbia peplus
aacggagaaagcatttttgaagcaaccaaaggttttcttgagctctaagaaatctggaaagggaaagaggcctggtaaaggtggaaaccgtttctggaaaagcattggattgggtttcaagaccccaagagaggcaattgaaggaacatatattgataagaaatgcccattcactggaactgtttccattagaggccgtatcttggctggtacttgtcacagtgcaaaaatgaataggactattattgtgcgcaggaattaccttcactttatcaagaagtatcagaggtatgaaaagcgtcactcaaatatcccagcacacatatccccatgcttccgtgtgaaggaaggagatcatgttatcattggccagtgcaggccattatcaaagacagtgaggttcaatgtgcttaaggtcattccagcagggtcttctggtggggcaaagaaggctttcacagcaatataagaaggattgatcttgaatgatgttatcatgcagaaggctctggtgaagctcatttgagatatcgttgctgttttatatggcatttagagaagtttaagcttgcattgattttagattttgtcctagtttcttttatacatttagactgctgaatgcaaagatatatgttgacatatttggaagatgttattgcttcattt

SEQ ID NO: 992 - DNA, 715 bp, Festuca arundinacea
agctctctctgctcccgcaccccccccctgcgcgccgccgccacctcgccgctcgaagcccgcagcgcagccatggcggagcagaccgagaagtctttcctcaagcagcccaaggttttcctcagcacaaagaaggctgacaaggctaagaggccgggcaaggctggcaaccgtttctggaagagtgttggccttggcttcaagaccccaagggaagcgatcgagggtacttacattgacaaaaagtgcccattcactggtactgttgccatcaggggcagaatcatcgctggaacatgccacagcgccaagatgaacaggaccatcattgtccgcaggaactacctccactttgtgaagaagtaccagaggtacgagaagaggcactcaaacatccctgctcacatctctccgtgtttccgtatcaaggaaggtgaccatgtcatcattggccagtgcaggcccctgtcgaaaactgtcagattcaatgtcctgaaggtcattccagctggaaccactggtggtgggaagaaggctttcatcgctgcctaagcttagactctgattcatgagtagttcatagtcagaagtttttcgcacttaaaaagacctaccaggctggtgttttggtatttgattccatattttctgtcagactgaagtctctcgtcataagaaagtgtttgtggaatctatctatcattaagagttttgc

SEQ ID NO: 993 - DNA, 829 bp, Festuca arundinacea
gctctctgctcccgcacccctctgcgcgccgccgccacctcgcagctcgaagcccgcagcgcagccatggcggagcagactgagaagtctttcctcaagcagccgaaggttttccttagcacaaagaaggctgacaaggctaagaggccaggcaaggctggcaaccgtttctggaagagtgttggccttggcttcaagaccccaagggaagcaatcgaaggcacctacattgacaaaaagtgcccattcactggtactgttgccatcaggggcagaatcatagctggaacatgccacagcgccaagatgaacaggaccatcattgtccgcaggaactacctccacttcgtgaagaagtaccagaggtatgagaagaggcactcaaacatccctgctcacatctcgccttgcttccgtatcaaggaaggtgaccatgtcatcattggccagtgcaggcccctgtccaaaactgtcagattcaatgtcctgaaggtcattccagctggaaccactggtggtgggaagaaggctttcatcgctgcctaagcttggactctgattcatgagtagttcatagtctgaagtttttcgcacttaaaaagacctaccaggctggtgttttggtatttgattccatattttctgtcagactgaagtctctcgtcatatgaacgtgtttgtggaatctatctatcattaatagttttgctcaaattgtaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 994 - DNA, 712 bp, Festuca arundinacea
gaagcctcagctctctctgctcccgcacctccccgcgcgccgccgccacctcgccgctcgactctcgcagcgcagccatggcggagcagactgagaagtctttcctcaagcagcccaaggttttcctcagcacaaagaaggctgacaaggctaagaggcccggcaaggctggcaaccggttctggaagagtgttggccttggcttcaagaccccaagggaagccatcgagggaacctatatcgacaaaaagtgcccattcactggtactgttgccatcaggggcagaatcatagctggaacatgccacagcgccaagatgaacaggaccatcattgtccgcaggaactacctccacttcgtgaagaagtaccagaggtatgagaagaggcactcaaacatccctgctcacatctccccgtgcttccgtatcaaggaaggcgaccatgtcatcattggccagtgcaggcctctgtccaagaccgtcagattcaacgtcctgaaggtcattccagctggaaccactggtggtgggaagaaggctttcatcgctgcctaagcttagactctgattcatgagtagttcatagtcagaagtttttcgcacttaaaaagacctaccaggctggtgttttggtatttgattccatattttctgtcggactgaagtctctcgtcatatgaacgtgtttgtggaatctatctatcattaag

SEQ ID NO: 995 - DNA, 747 bp, Carpinus betulus
ggcagagactcatctagttcaccttccttcgcagcttgagagcaccaaatcatggctgaacagactgagaaggcgtttctgaagcaaccaaatgtatttctatgctcgaagaagtctggcaagggaaagaggcctggcaagggcgggaaccggttctggaagagcgttggtctcggtttcaagacccccagagaagccattgacggaacctacattgataagaaatgcccctttactggcaatgtatctatcaggggtcgtatcttatctggcacttgccatagtgctaagatgataaggaccattattgttcgtcgtaattatcttcattttgtgaagaaataccaaagatatgaaaaaaggcactcaaacattcctgcacacatatccccatgcttccgcgtgaaggaaggagattatgtcactgtcggccaatgcaggccattgtcgaagactgtgaggttcaatgtgttgaaagtcattccagctggatcttctggtggtgggaagaaggcttttacaggattgtgaggtgatttccagttttcctcgaaggatataattgtcatggttttcagtgagctatagggaaccttttgaagttggcaacaacagcatggtgattgggtggacctggacactgttaaatgctctgctctttttctgcttgtttcaatataattatgacttctttaagtacttgtttaaattttggttttaataggattcaatctactcttctatatt

SEQ ID NO: 996 - DNA, 699 bp, Ipomoea batatas
cagcccccaaccatggcagagcagacggagaaggctttcttgaagcagccaggagtttttctcagctcgaagaagactggtaagggaaagcggcccggtaagggaggaaatcgttattggaagagcattggtctcgggttcaagacaccccgtgaggctactgaaggaacatatattgataagaaatgccccttcactggtaccgtttctatcagaggtcgtatccttgccggaacttgccacagtgcaaagatgaccaggaccattattgttcgtcgtaactaccttcactttgttaagaagtatcaaaggtatgagaagcgccactcaaatattgctgctcacatttcaccatgcttccgtgtcaaggaaggggatcacgtaatcattggacagtgcaggccattgtccaaaacggttcgattcaatgtgttgaaggtgatccccgctggttctgctggtggtgggaagaaggcattcaccggaatgtgaacgcgaattgaccctttttgttaaaaagtttgtgctagagatgtttttattgttttcgtgaacacttttatttcattggaatcttatctataatactacttgcaattgatttatgttcattgaatttacaaattgcttaactgaaattaatgttgactatgttgggagttttgtttgttggttgtgaagatttgttataaggatgag

SEQ ID NO: 997 - DNA, 912 bp, Lolium multiflorum
ggcccagaaagacggagggcattcggcaccggcgccccatcgttataagaaggcaccctagggtttgcgccccgccgccacctcctccaagaagcctcagctctcgctgctcccgcacctgcccgcgcgccgccgccacctcgccgctcgaagcccgcagcgcagccatggcggagcagaccgagaagtctttcctcaagcagcccaaggttttcctcagcacaaagaaggctgacaaggctaagaggcccggcaaggctggcaaccgtttctggaagagtgttggccttggcttcaagaccccaagggaagccatcgagggcacttacatcgacaaaaagtgcccattcacgggtactgttgccatcaggggcagaatcatagctggaacatgccacagcgccaagatgaacaggaccatcattgtccgcaggaactacctccactttgtgaagaagtaccagaggtatgaaaagaggcactcaaacatccctgctcacatctccccatgcttccgtatcaaggaaggcgaccatgtcatcattgggcagtgcaggcctctctccaagaccgtcagattcaacgtcctcaaggtcattccagctggaaccactggtggtgggaagaaggctttcatcgctgcctaagcttagactctgattcatgagtagttcatagtcagaagtttttcgcacttaaaaagacctaccaggctggtgttttggtatttgattccatattttctgtcagactgaagtctctcgtcatatgaacgtgtttgtggaatctatctatcattaagagttttgcttaaattgtaccatgtgttgtgttcttgttgattccggtgaaattgtttccctgctggcttgatgcttgctcaaattgactgctgttcagctatcagcggca

SEQ ID NO: 998 - DNA, 753 bp, Lupinus angustifolius
tgagtgcagctatcataagagaacattttcatatccttcgcaacattcgccattaactccttttcaccatggccgaacaaactgagaaggcttttctgaagcaaccaaaagtgtttctgagctcaaagaaatctgggaagggaaagaggcctggaaaaggtggcaatcgcttttggaaatccattggtcttggattcaagacccctagggaagccattgatggaacctacattgacaagaaatgccccttcactggcaatgtttccatccgaggccgtatcttatcaggaacttgtcacagtgctaagatgaataggactataattgtcaggaggaactatcttcatttcattaagaagtatcaaaggtatgagaagaggcattcaaatatccctgctcatgtttcaccttgcttccgtgtgaaggaaggagatcatgttattattggccaatgcagaccaatctcaaagacagtgcggttcaatgtgctgaaagtgatcccagctggatcttctggtggtgcaaagaaggcatttactggaatatgaactttgatattcagtttctgttgtgggacagtgatacctttttagttacaagatttgctttctgaatggaacaaattactgtattgatcaaattttggatatctttgaggttctgttctatgttatgtgtttcggttcatgaatactagtactagtagtgtttactctggcactaagttaactgttatatctgcatttctcgatt

SEQ ID NO: 999 - DNA, 799 bp, Lupinus angustifolius
agtttatgatccttcgaaattagggtttctcgctgcagctgaaacttcatcttctggtccataactcccattgagagaaccctaaccatggctgaacaaactgaaaaggcctttttgaaacaaccaaaagttttcctaagctctcataaatctgggaagggaaagaggcctgggaaaggtggaaatcgtttttggaagtcaattggacttggatttaagactcccagagatgccattgaaggaacatatattgacaagaagtgccccttcactggcaatgtttccatccggggacgtatcatagctggtacttgtcacagcgctaagatgacaaggactattattgtgaggaggaattatcttcattatattaagaagtatcagagatatgagaagaggcattcgaacattcctgctcatgtatcaccttgcttccgtgtgaaggaaggagatcatgtcattattggccaatgcagacccatctcaaagacagtgaggttcaatgtgttgaaagtgatcccagcaggatcctccactggtgcgaagaaggcgttcgccggactttgagattttagttcgattttagttctcatttctcattgaagagcaatgtaaccgtaagagatagtgatgtttcagatgtttcattgccattgcatgatctgatcatttttttaatttctttaaatgctttaatgtatgagctgttaaatacactacagattccatattcattatggtccttgaatagtagttgcttccatttttgacattctattgcagtcttgcagacacagac

SEQ ID NO: 1000 - DNA, 928 bp, Pinus pinaster
tttcgacatccgttcacggttgctagggtttaacagctccggcctacagaagcggttgtattctttctcattgttatgagatcgagggtttcaaagctccggcctacacaaagcggtgtatctcttatcattgtttggagatcgagggtgcagtctcaagaacgtcctcgtttggattccaggcaggagcggctggggcgttgaagatacgaagtgagaagtcttgagttcctgtagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaagaagctattcaagggacctacatcgacaagaagtgcccattcactggtactgtttcaataagaggtcgtatattagctggaacgtgttacagtgctaaaatgacacggacaattattgtccgtagggactatctccattttgtcaagaaatatcagaggtatgagaagagacattcgaacataccagcccacatttcaccctgtttccgtgtcaaggaaggggatcatgttataattgggcaatgcaggcccttgtccaagactgtaaggttcaatgttctgaaggtgattcctgcgggttctagcagtggttctgcaaagaaagccttcactgcaatatgaatcccttttttttgactctgtccaagcaaaccttaaaatccattaaacgcaatggagttggcatcaaatgctagtgagaaacaattggaaccagtacattagtattattagaaactcttcatatggaatattttatattgagatgtgtgtttcaaatcggaaattttgtagaaaaatgtttgcaagcgatctctatttcaagtaca

SEQ ID NO: 1001 - DNA, 714 bp, Tropaeolum majus
gccgggaattcggccatacggccgggggttttcgcttagggtttttatcttcatagcctccgttgcctacagatagcactagctaaagctccccactcggaacaatggctgaacagacggaaaaagcttttttgaagcagcccaaggttttccttagctccaagaaaacaggaaagggaaagaggcctggaaaaggaggcaacagattctggaagagcattgggttgggattcaagacacccagagatgcaattgaaggtacctacattgataagaagtgccccttcactggtaatgtttccatccggggtcgtattctcgctggtacttgccacagtgctaagatgatgaggaccattgttgtgcgtcgtaactatcttcattttgtgaagaaataccagagatacgagaagaggcactctaacacacctgcacatgtttctccatgcttccgtgtcaaggaaggagatcatgttattatcggacaatgcaggcctttgtcaaagactgtgaggttcaatgtgttgaaagtgataccagctggctcttctgttgctggcaagaaggcatttaccgggatgtgaacttaacttttgtagtgatgaagatgatatctttttgtctttagaatggtgacttttttttccttgttccgaatgtgatagtcacttgaaaattatgtctaaatttatttaatgatgaattttgtttact

SEQ ID NO: 1002 - DNA, 728 bp, Avena sativa
ggccactcctcttgaagcctcgctctcttttcttccgcgtctcccccccagcgccgccgccaccgagccgctcgaagtccgcagcaccgccgccgctcgaaccatggcggagcagactgagaagtctttcctcaagcagccaaaggttttcctcagcacaaagaaggctgacaaggctaagcggccaggaaaggctggcaaccgcttctggaagagtgttggccttggcttcaagaccccaagggaagcgattgaaggtacctacatagacaagaagtgccctttcactggaactgttgccatcaggggcagaatcatcgctggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaggcgaccatgtcatcattggccagtgcaggcccctgtcaaaaaccgtgagatttaacgtcctgaaggtcatcccagctggaaccactggcggtgggaagaaggctttcatcgctgcctaagcctagactctgattcatgagtagttcatagtccggaagtttttcacacttcaaagatcctatcaggctggtgttttgatattcgattccatgttttctgtcaaactgaagtctcttcatctgaacatgtttgtggaatctatct

SEQ ID NO: 1003 - DNA, 716 bp, Avena sativa
aagcctcgctctcttttcttccgcgtctcccccccagcgccgccgccaccgagccgctcgaagtccgcagcaccgccgccgctcgaaccatggcggagcagactgagaagtctttcctcaagcagccaaaggttttcctcagcacaaagaaggccgacaaggctaagcggccaggaaaggctggcaaccgcttctggaagagtgttggccttggcttcaagaccccaagggaggcgatcgaaggtacctacattgacaagaagtgccctttcactggaactgttgccatcaggggcagaatcattgccggaacatgccacagcgccaagatgaacaggaccatcattgtccgcaggaactacctccactttgtgaagaagtaccagaggtatgagaagaggcactccaacatccctgctcacatctccccgtgcttccgtatcaaggaaggcgaccatgtcatcattggccagtgcaggcccctgtcaaaaaccgtgagatttaatgtcctgaaggtcatcccagctggaaccactggcggtgggaagaaggctttcatcgctgcctaagcctagactcttattcatgagtagttcatagtccggaagttttccacacttcaaagatcctatcaggctggtgttttgatattcgattccatgttttctgtcaaactgaagtctcttcatctgaacatgtttgtggaatctatctat

SEQ ID NO: 1004 - DNA, 645 bp, Avena sativa
ccatggcggagcagactgagaagtctttcctcaagcagccaaaggttttcctcagcacaaagaaggctgacaaggctaagcggccaggaaaggctggcaaccgcttctggaagagtgttggccttggcttcaagaccccaagggaagcgattgaaggtacctacatagacaagaagtgccctttcactggaactgttgccatcaggggcagaatcatcgctggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaggcgaccatgtcatcattggccagtgcaggcccctgtcaaaaaccgtgagattcaacgtcctgaaggtcatcccagctggaaccactggcggtgggaagaaggctttcatcgctgcctaagcctagactctgattcatgagtagttcatagtcagaagttttttgcactcaaaagacctaccagacttgtgttttgatatttgattccatattttctgtcaaactgaagtctcttgtcatttgaacatgtttgtggaatctgtctattgctcagagttttgct

SEQ ID NO: 1005 - DNA, 711 bp, Avena sativa
ccaccgccacctaagccgctcgaagccacagcgacgccgccaccgccaccgagcagccccaaccatggcggagcagactgagaagtctttcctgaagcagccaaaggttttcctcagcacaaagaaggctgataaggctaagcggccaggaaaggctggcaaccgcttctggaagagtgttggccttggcttcaagaccccaagggaagcgattgaaggtacctacattgacaagaagtgccctttcactggaaccgttgccatcaggggcagaatcattgctggaacatgccacagcgccaagatgaacaggaccatcattgtccgcaggaactacctccactttgtgaagaagtatcagaggtatgagaagaggcactccaacatcccggctcacatctccccgtgcttccgtatcaaggaaggcgaccatgtcatcattggccagtgcaggcccctgtcaaaaaccgtgagatttaacgtcctgaaggtcatcccagctggaaccactggcggtgggaagaaggctttcatcgctgcctaagcctagactctgattcatgagtagttcatagtccggaagttttccacacttcaaagatcctatcaggctggtgttttgatattcgattccatgttttctgtcaaactgaagtctcttcatctgaacatgtttgtggaatctatctaccattaagagttttgcttaag

SEQ ID NO: 1006 - DNA, 737 bp, Avena sativa
tctctttgcttccgcgccgccgccgccaccgctacctagccgctcgaagcccacagcgacgccgccaccgccaccgagcagccccaaccatggcggagcagactgagaagtctttcctgaagcagccaaaggttttcctcagcacaaagaaggccgataaggccaagcggccaggaaaggctggcaaccgcttctggaagagtgttggccttggcttcaagaccccaagggaagcgattgaaggtacctacattgacaagaagtgccctttcactggaaccgttgccatcaggggcagaatcattgctggaacatgccacagcgccaagatgaacaggaccatcattgtccgcaggaactacctccactttgtgaagaagtatcagaggtatgagaagaggcactccaacatcccggctcacatctccccgtgcttccgtatcaaggaaggcgaccatgtcatcattggccagtgcaggcccctgtcaaaaactgtgagatttaacgtcctgaaggtcatcccagctggaaccactggcggtgggaagaaggctttcattgctgcctaagcctagactctgattcatgagtagttcatagtccggaagttttccacacttcaaagatcctatcaggctggtgttttgatattcgattccatgttttctgtcaaactgaagtctcttcatctgaacatgtttgtggaatctatctatcattaagagttttgcttaagt

SEQ ID NO: 1007 - DNA, 745 bp, Avena sativa
aagcctcgctctcttttcttccgcgtctcccccccagcgccgccgccaccgagccgctcgaagtccgcagcaccgccgccgctcgaaccatggcggagcagactgagaagtctttcctcaagcagccaaaggttttcctcagcacaaagaaggccgacaaggctaagcggccaggaaaggctggcaaccgcttctggaagagtgttggccttggcttcaagaccccaagggaagcgatcgaaggtacctacattgacaagaagtgccctttcactggaaccgttgccatcaggggcagaatcattgccggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaggcgaccatgtcatcattggccagtgcaggcccctgtcaaaaaccgtgagatttaatgtcctgaaggtcatcccagctggaaccactggcggtgggaagaaggctttcatcgctgcctaagcctaaactctgattcatgagtagttcatagtcagaagttttttgcactcaaaagacctaccagacttgtgttttgatatttgattccatattttctgtcaaactgaagtctcttcatctgaacatgtttgtggaatctatctatcattaacagttttgcttaaattgtactgtgt

SEQ ID NO: 1008 - DNA, 869 bp, Olea europaea
cgctgccgagatttctaacgcttgcgttttcacctccaaactctttacaactcaactatggcggaacagactgagaaggcatttttgaagcagcctaaggtcttcctttgctcgaagaagacagggaagggtaagaggccaggaaagggaggaaaccgatactggaagagcatcggccttgggtttaagactccacgtgaggcaactgaagctacctatatcgacaagaaatgcccttttactggcgatgtttcaatcaggggccgtattcttgctgggacgtgccacagtgccaagatgatgagaacaatcatcgttcgtcgcaactacctgcattgggtcaagaagtaccagagatatgaaaagaggcattcaaacattccagcacacgtctctccatgcttccgtgtgaaagaaggagatcatgtcataattggccagtgcaggccattgtcaaaaacggtgaggttcaatgttttgaaggtgatcccagctggttcttccagtctcgggaagaaggcatttacaggaatgtgagtctagggttctgaatttcttggttcaaaaaagtgtttggaaaggccgtctgagactgtcttgttgaaactatggtgatgttgacttgctgcaagagattgatatattttgtattttaccagatgctaaattatattctcctattagccagttttggaatttctcaattttcttgatcaattttagtagtttgggatctctattttcttatcaaaccctctttagccaccaactctagtaagttcttatttgtagtttcatgagaggtgaatcaactctcttaaattttcaatcgttgattggttgggtatcaaatataggagcttatttag

SEQ ID NO: 1009 - DNA, 763 bp, Pisum sativum
acccattgccgccgctgcaaacttcccggtgtgaaacaaaccctcatcaacaaccaaccatggcggagcaaactgagaaggcttatttgaagcaacccaaagtgtttctatgctcgaagatatctgggaaggggaagagacctggtaagggtggaaaccgattctggaaatctgttggacttggattcaagactcccagggatgccattgaaggaacttatattgacaagaagtgcccattcactggcaatgtctcgatccgtggtcgtatcatagctgggacctgtcatagtgcaaagatgaataggaccatcattgttaggagaaattatcttcacttcatcaagaagtatcagaggtacgagaagcgtcattctaatatccctgcgcatgtttcaccttgtttccgagtgaaggaaggagatcatgttactattggccagtgcaggccaatttcaaaaacagtcaggtttaatgtattgaaagttctcccagccggatcttctaatcttgcaaagaaggcatttacaggaatatgagtttagaattttcagtgagcataaaatattttaaggtcatgacattgttataatctgatcagaatttggatttatttaaatgctttgcattgatcctagtagttaacggtaacagattttgatatgactaacgctttttagtaagcgttccacttttttttggccgctattgatccctcaggtccctgtaataaagcttgtacacctcggccgcgaccacgcta

SEQ ID NO: 1010 - DNA, 648 bp, Lippia dulcis
cgtacacaccttgatagcgcgcagcaatggcggaacagaccgagaaggcatttttgaagcagcctaaggtgtttctctgctcaaagaagtcagggaagggtaaggctccaggaaagggaggaaaccgttacttcaagagcattggactcgggttcaaaacaccacgagaggcttctgaaggcacatacattgacaagaagtgcccgttcactggtaatgtatccatcagagggcgtatccttgccggaacttgccacagtgcaaagatggtgagaactatcatcgtgagacgtaactatctgcactgggtgaagaagtaccaaaggtacgagaagaggcattccaacattcccgcacacatttccccatgcttccgtgtgaaggaaggcgaccatgtcaccatcggtcaatgcaggccactgtccaaaaccgtgaggtttaatgttctcaaggttattccagcgggttcgtctgggctcggaaagaaggcttttaccgcgatgtgagttaggcgatatgaagtttgccatttagttgttaaaactgtttttgaaaggatggattttgaatttctattgtttaagttggaatattgtcatcgacctcgctttgatatctactaatgtttatcttgttccaaaaaagaaa

SEQ ID NO: 1011 - DNA, 930 bp, Pinus taeda
gaaggagggtactagggtttattgggattaaataaggaaggcttctatttactgaccttgtttcacaggcagaggcgggagcggccgcggcgggagtctcgattttctgcagccatggcagagcagactgagagagcttttctaaagcaaccaaaagtctttctcagttccaagacgtctgggaaggggaaacgacctggaaaaggtggcaacaggttttggaagaatgttggtcttggcttcaagacccccaaagaagctattcaagggacctacatcgacaagaagtgcccattcactggtactgtttcaataagaggtcgtatattagctggaacatgttacagtgctaaaatgacacggacaattattgtccgtagggactatctccattttgtcaagaaatatcagaggtatgagaagagacattcgaacataccagcccatatttcaccctgtttccgtgtcaaggaaggggatcatgttatcattgggcaatgcaggcccttgtccaagactgtaaggtttaatgttctgaaggtgattcctgcgggttctagcagtggttctgcaaagaaagccttcactgcaatatgaatccgttttttttctttgtacaagcaaaccatataatccgtcaaatgcaatagcgtaggctttgacagagttgagggttactattttatcatttgctcaaattaattttgttagtttaatccttcttttggttactgtattcaattttgaaaaagatgtacggataacgtttactgcttggtggttgaaagtccaccgttcttggatacttttgttttggttttagcatccagtaaacctttcaaagcatattcttggaatatttttttattccaatagccaaatatgaacgatgtcatatttagtttcgcttttaattatttctttaggagg

SEQ ID NO: 1012 - DNA, 1014 bp, Pinus taeda
aattcggcacgaggataaagctggggtttcagatctcggcctacctaaaagggtgtatcactttttgacgtccgttcacggttgctagggtttaacagctccggcctacataagcggttgtattctttctcattgttatgagatcaagggttccaaagctccggcctacataaagcggtgtatcttttaacattgtttggagatcgagggcgcagttttaagaacgtcctcgttcggattccaggcaggagcggctggggcgttgaagatacgaagtgagaagtcttgaattcctgcagccatggctgaacagactgagagagcttttctgaagcaaccaaaagtctttctcagttctaagacgtctgggaaggggaaacgacctggaaaaggtggcaacaggttttggaagaatgtgggtcttggctttaagacccccaaggaagctattcaagggacctacatcgacaagaagtgcccattcactggtactgtttcaataagaggtcgtatattagctggaacatgttacagtgctaaaatgacacggacaattattgtccgtagggactatctccattttgtcaagaaatatcagaggtatgagaagagacattcgaacataccagcccacatttcaccctgtttccgtgtcaaggaaggggatcatgttataattggccaatgcaggcccttgtccaagactgtaaggtttaatgttctgaaggtgattcctgcgggttctagcagtggttccgcaaagaaagccttcactgcaatatgaatccgtttttttttgttactctgtccaaggaaaccataaaatccataaaacgcaatagagttagcatcaaatgcaagtgagaaacagttgaaaccagtacattagtattattagaaactctttatatggaatattttatattgggatgtgtgtttcaaatcggaatttttttttgaaaaaaaaatgtttgcaagtgatctctatttcaagtacacttttcataaaaaaaa

SEQ ID NO: 1013 - DNA, 743 bp, Plantago ovata
gtgcaaaactctctctcgcagccgtcgcctcctccaagcagcgctgaagaagctacaccgcaaaaatggcagaacagactgagaaggctttcctgaagcagccgaaggttttcctttgctcgaagaagactggcaagggtaagaggccaggaaagggtggaaacagatacttcaagagcattggactcggcttcaagaccccaagggaagctattgaaggcacatacattgacaaaaagtgcccattcactggagatgtttctatccgaggccgtattctttcagggacatgccacagtgccaagatggtgaggacaatcattgtccgcagggattaccttcactgggtgaagaagtaccaaaggtatgagaagaggcattccaacaccccagcacatatttctccttgcttccgtgtcaaagaaggtgatcatgtcacaattggccagtgcaggcccttgtcaaagaccgtgaggttcaatgttcttaaagttgtacctgctggttcgtctggtcgtggtaagaaggccttcacaggaatgtagacatttcaggatgcttaattttgaaactattagtgtcttgccttgagggctttatattatgtattgtgacagtatactctggttgcccgtgttcttttttttattttagtttcaatggatagttcagattctagcattttgatttccttccggttattatcattcgtgattctgtcagtgtcagggcctttacatttt

SEQ ID NO: 1014 - DNA, 749 bp, Plantago ovata
tcaaagcagccgtcgccccccagcaggttaaagcagccgtcgccccccagcaggttgaagcagctacaacaaaacaacatggcagagcagaccgagaaggcttttctcaagcaacccaaggttttcctttgctcgaagaagtccggcaagggcaagaggccaggaaagggcggaaaccgctactttaagagcattgggctagggtttaagactccccgtgaggctattgaaggcacttatattgacaagaagtgcccattcactggtgatgtttctatcagaggccgtatcctttcagggacatgccacagtgccaagatggtaaggacgattattgtccgcagggattaccttcactgggtcaagaagtaccaaaggtatgagaagagacattccaacaccccagcccatatttctccttgcttccgtgtgaaagaaggcgatcatgtcaccattggccagtgcaggcctctttcaaagactgttaggtttaacgtccttaaagttgtaccagctggttcttccggtcgtggtaagaaggctttcacaggcatgtgaatgcttggaagccttgttttggcatgaatgctgttagacatttcggatatctttaatttggaagtgttttagtgacttgttggattggcaattatgtattttgaccttatactgcatttttggtttcaatgaagagttcaaatgcttaattaatctccttgtggttatttacagcccatgattttggttgt

SEQ ID NO: 1015 - DNA, 769 bp, Plantago ovata
atcaccaccctctctccaagccatccatcgtaggtcagaatcagattccgaaatctctctctctctcagccgtagtagccgtcgtctccaagcagaaaaatggcagagcagactgagaaggctttcctgaagcagcccaaggtgttcctatgctcgaagaagtctggcaagggtaagaggccaggaaagggaggaaaccgctactttaagagcattggactcggcttcaagactcctcgtgaagctattgaaggcacatacattgacaagaaatgcccgttcactggtgatgtttccatcagaggccgtatcctttctgggacatgccacagtgccaagatggtaaggacaatcattgttcgcagagattaccttcactgggtcaagaagtaccaaaggtatgagaagaggcattccaacaccccagcacatatatcaccctgcttccgtgtgaaggaaggcgatcatgtcacaattggccagtgcaggcccctttcaaagacggtgaggtttaatgttcttaaagtagtaccagccggttcatccggtcggggtaagaaggctttcacaggaatgtgaattattgaatatctggttttagtatgaatgctgagggatatttaagattttttactagaaaactgtttagcgacatgctttgagggcttgatagtattgcggctttaatactgcatttttggtttcaatgaagaggtcaaatgctgtggattagtctccttgtggttatttacagttcatgattcaccgc

SEQ ID NO: 1016 - DNA, 665 bp, Solanum tuberosum
gcatctctcgccgttcatttcatcttcctttgcaaccctcaatcatggcggagcagacggagaaggcatttttgaagcagccaggtgtttttctaagctctaagaaaactggtaagggaaagaggccaggaaagggaggcaatcgatactttaagagtatcggcttaggattcaaaactcctcgtgaggctaccgaaggtacatatattgacaagaaatgcccattcactggcaatgtttctatccgaggacgtatccttgctggtacatgccacagtgctaagatgaacagaaccatcattgttcgacgcaattacctacattatgtcaagaagtatcagagatacgagaagagacactccaatattccagctcacatatcaccatgcttccgtgtgaaagagggagatcatgttactattggacagtgcaggcctttatccaaaactgtgaggttcaatgtattgaaggtgattccagccggttctggtggtggcgggaaaaaagcttttaccggaatttgagtgtttcttttttaatgtttacatctaggaatgatgtcaaggcatttctgcttttgctgaattctcgtcttcattgatattcctttgagattcaaattttgaaacttaatgctagtagtaacaagcttttctttcctattg

SEQ ID NO: 1017 - DNA, 729 bp, Solanum tuberosum
ggttaccgataagctatcctcgttgagttctgcgtcttggtaatcctcagtcatggcggagcagacagagaaggcgtttttgaagcagccaggtgtttttctaagctctaagaagacggggaagggaaagaggccaggaaagggaggcaatcgatactttaagagtattggtttaggattcaagactcctcgtgaggctactgaaggtacatatattgacaagaaatgcccattcactggaaatgtttctatccgaggtcgtatccttgctggtacatgccacagtgctaagatgaacagaaccatcatcgttcgtcgcaattacctacattatgtcaagaagtatcagagatatgagaagaggcactcaaatatcccagctcacatatcaccatgcttccgtgtgaaagagggagatcatgttactattggacagtgcagacctttatccaaaaccgtgaggttcaatgtcttaaaggtgattccagctggttctggtggtggcgggaaaaaagcttttaccggaatgtgagcttggtgcttccattttaattgttacttctaggaatgatgtccatacttctatccctttacgggaatgttgtcttcgttgattttcctttgagcctcaagttttgaaacttaatgctagcagcaagttttttttttcctatggatctgtaggttctttgccacaatcaaaaacttcaataccattctcaatgttct

SEQ ID NO: 1018 - DNA, 630 bp, Solanum tuberosum
gcactcgataagccaccctcgttgagttctgcgtccttggtaatcctcagtcatggcggagcagacagagaaggcgtttttgaagcagccaggtgtttttctaagctctaagaagaccgggaagggaaagaggccaggaaagggaggaaatcgatacttcaagagtatcggtttaggattcaagactcctcgtgaggctactgaaggtacatacattgacaagaaatgtccattcactggcaatgtttctatccgaggtcgtatccttgctggtacatgccacagtgctaagatgaatagaaccatcattgttcgacgcaattatctacattatgtcaagaagtatcagagatacgagaagaggcactcaaatatcccagctcacatatcaccatgcttccgtgtgaaagagggagatcatgttactattggacagtgcaggcctttatccaaaaccgtgaggttcaatgtcttaaaagtgattccagctggttctggtggtggagggaaaaaagcttttaccgggatgtaatcttcattcctccatttcaaaatttgtgttttgtgtaggaatatgatgtcaaaacttttctgcttctactgagttatcttcaaattttgaaacttaat

SEQ ID NO: 1019 - DNA, 700 bp, Solanum tuberosum
ggggaaaattagggtttggcatctctcgccgtcagttgattttccttagtaacgatcaatcatggcggagcagacggagaaggcgtttttgaagcagccaggtgtgtttctaagctctaagaagaccgggaagggaaagaggccaggaaagggaggcaatcgatacttcaagagtatcggcttaggattcaagactcctcgtgaggctactgaaggtacgtatattgacaagaaatgcccattcactggcaatgtttctatccgaggtcgtatccttgctggtacatgccacagtgctaagatgaacagaaccatcatcgttcgacgcaattacctacattatgtcaagaagtatcagagatacgagaagaggcactccaatattccagctcacatatcaccgtgcttccgtgtgaaagagggagatcatgttactattggacagtgcaggcctttatccaaaaccgtgaggttcaatgtcttaaaggttattccagctggttctggtggtggcgggaaaaaagctttcaccgggatgtaatcttcgtgcctccatttcaaattttgtttcttgtaggaatattatgtcaagacttttctgcttttactgagttatcttcaaattttgaaacttaatgcttagtaagttatgtttaattaagcctctgaactagcttataaaatgttgtttgattgaacc

SEQ ID NO: 1020 - DNA, 702 bp, Rosa hybrid cultivar
accttttccgctgttgttgctccttgttcgcgcggcgtccacagaaagctcaaagatggcggaacagaccgagagggctttcctcaaacagcccaaggttttccttagctccaagaagactggcaagggaaagaggcctggaaagggaggcaatcgattctggaagagcgttggtctcggctttaagactcccagagatgctattgaaggaacatacattgataagaagtgccctttcactggcaatgtctccatcaggggtcgcattctggctggtacctgccatagtgcaaagatgtcgaggactatcattgttcggcgcaattacctccactacataaagaaataccaaagatatgagaagaggcactccaacattccagcccacgtttcaccatgcttccgtgtgaaggagggagatcatgtcatcattgggcagtgcaggccattgtcaaagacagtaaggtttaatgtattgaaggtcattcctgccggggcttctgccggtgggaagaaggcattcacgggagcataagataccatttcgggcagtctcttagtgttctttatgcaactacattagattgcgtttcttttgaaacatctgttttgccatttttagtttgcacctttgtgtactccggatgttaaggttttcttcagaaccataattttgaatcttactatcgaaatactgtgttt

SEQ ID NO: 1021 - DNA, 729 bp, Carthamus tinctorius
ggggtttgcttcttcttctctctctttcttctcgtgcctcccccgccattagcagaagctcggatctcttcaacaatggcggaacagacggagaaggcgtttttgaagcaacccaaggtgtttttatgctcgaagaaaagtgggaaagggaagaggcctgggaagggtggaaccagattctggaagagtgttggtcttggatttaagacaccaagagaagccattgaaggaacttacatcgacaagaagtgccctttcaccggtgatgtctccatcagaggccgtattcttgctggtacatgccacagtgccaagatggttgggacgatcatcgctcgtagggactacctccattttgtcaagaaatacaaaagatatgaaaagaggcattccaacattccagctcacatttctccctgcttccgtgtgaaagaaggcgatcacgtcattgttggacagtgcagaccattgtcaaagacagtgaggttcaatgtgttgaaggttatcccggctggatcttctggtggcgggaagaaggcgtttactggcatataaaaagcttagtttcatcttggtagattctgcgaaaacagtttgctgattttcgagggaaatgtggtttggtttaatgggttcttaagacgtaattttccgctctagttttcttttacttgacgatacgactatgagatattgtaggtttggcaattgaagttttgatttgttact

SEQ ID NO: 1022 - DNA, 633 bp, Salvia sclarea
ctaccagaccttggctgtcactcaggacgtctgagctctctcgtcgctagggttttatcaccgccgccgcttcccgcattttcagctcagcaccggagagagctacaatggccgagcagactgaaaaggcgtttctgaagcagcccaaggttttcctatgctcgaagaagactgggaagggtaagcggccagggaaaggaggtaaccgtttctttaagagcatcggattaggtttcaagacccctcgcgaggctactgaaggcacatacattgacaagaaatgcccattcactggtgatgtctccattagaggccgtattcttgctggaacgtgtcacagtgctaagatggtgagaactatcatcgtccgaaggaattaccttcattgggtgaagaaatatcaaagatacgagaagaggcattcaaataccccggctcacatttctccatgctttcgtgtgaaagaaggcgaccatgtcaccattggccagtgcagacccttgtcgaaaactgtgaggtttaacgtgcttaaggtgatcccggctggttcatctggtcttgggaagaaggcctttaccgcgatgtgagctatgaaattgcatatgtttcactatgttagtgcttttagaaaca

SEQ ID NO: 1023 - DNA, 1105 bp, Sequoia sempervirens
atttatataaaattcaagaatgccttcctaactgaaccctacacaattgcagaagttccttctatacgttagcatagggttttgtaactttgtaagttcgtttctcttattagggcgaggcataatagggttttgctagtagatttgttttttcggtgttgaagcagggtcagttcaagcttcctttcagttccgcagccatggcagaacagaccgagaaagcttttttgaagcaacccaaggtgttcctctgctcgaagaagtctggaaaagggaagcggccaggaaaaggaggaaataggttctggaagaatataggtctcggtttcaagacacccaaagaagctgttcaagggacatacattgacaagaaatgcccattcactggaaatgtgtcaattagaggtcgtattttgactggaacatgccacagtgcaaaaatgaaccgtacaatcattgttcgccgcaattatctccattttgtcaagaagtatcaaaggtatgagaagaggcattcaaacatacctgcacatatttcaccttgtttccgtgtgaaggaaggggatcatgttataattgggcagtgcagacctttgtccaagactgttagattcaatgtcttgaaggtgataccagcaggttctagcagtgggtcggcaaagaaaggctttgcagcaatctgaatatacctacattaaactatggcatactttatgattttgttaagtagcactatgaaaggctttatggcagtcttttgtggagagaaatatttgattctagtttgttcaatatgatcatttgtttaatttcaaatcatccttgtaatgggtgatttgtcttgtcattcctaacattattgattgtagggaagaatacaatttggattgttttttatgttctgtgcttgccactaatttctagtgttatgtggctgaatgttgtgtgaatgcagatgatccattatgttttaagagtaatactaattttcaagcaaggtcaagttacagagaagattaaggttctggctctatagaaccaaagtcaaaactaaaaggatgtatgttgggtctgtgcctgcaaaatgtgggaaatgttagtaagc

SEQ ID NO: 1024 - DNA, 679 bp, Sequoia sempervirens
catggccgaacagaccgagaaagcctttttgaagcagcccaaggtgttcctctgttcgaagaagtctgggaaagggaagcgaccaggaaaaggaggaaataggttctggaagaatataggtctcggttttaagacacccaaagaagctgttcaagggacatacattgacaagaaatgcccattcactggaaatgtgtcaatcagaggtcgtattttgactggaacatgccacagtgcaaaaatgaaccgtacaataattgttcgccgcaattatctccattttgtcaagaagtatcaaaggtatgagaagaggcactcaaacatacctgcacatatttcaccttgtttccgtgtgaaggaaggggatcatgttataattgggcaatgcagacctttgtccaagactgttagattcaatgtcttgaaggtgatacccgcgggttctagcagtgggtcagcaaagaaaggctttgcagcaatctgattatacccacttaaaactacaacatgctttatgattttgttaagtagcactaagaaaggctttttgacagtctttttgcggagagaaagatttgattctagtttgttcaatatttttcttgtttaatttcaaatcatctttgtaatgggtgatttatattgtcattcctaaacattgttgagtgtagggaagaat

SEQ ID NO: 1025 - DNA, 737 bp, Solanum phureja
actctccactgcaaattagggtttttgctacccagcatctctcgccgttcatttcatcttcctttgcaaccctcaatcatggcggagcagacggagaaggcatttttgaagcagccaggtgtttttctaagctctaagaagactggtaagggaaagaggccgggaaagggaggcaatcgatactttaagagtatcggcttaggattcaaaactcctcgtgaggctaccgaaggtacatatattgacaagaaatgcccattcactggcaatgtttctatccgaggtcgtatccttgctggtacatgccacagtgctaagatgaacagaaccatcattgttcgacgcaattacctacattatgtcaagaagtatcagagatatgagaagaggcactccaatattccagcacacatatcaccatgcttccgtgtgaaagagggagatcatgttactattggacagtgcaggcctttatccaaaactgtgaggttcaatgtattgaaggtgattccagccggttctggtggtggcgggaaaaaagcttttaccggaatttgagtgtttcctttttaatgtttacatctaggaatgatgtcaaggcatttctgcttttgctgaattctcgtcttcattgatattcctttgagattcaaattttgaaacttaatgctagtagtaacaagcttttctttcctattgagccactatgtgtacctgttcatcttatgagaggtttg

SEQ ID NO: 1026 - DNA, 728 bp, Solanum phureja
tgcaaattagggtttggcatctctcgccgtcagttgatcttcctcagtaactatcaatcatggcggagcagacggagaaggcgtttttgaagcagccaggggtgtttctaagctctaagaagaccgggaagggaaagaggccaggaaagggaggcaatcgatacttcaagagtatcggcttaggattcaagactcctcgtgaggctactgaaggtacatatattgacaagaaatgcccattcactggcaatgtttctatccgaggtcgtatccttgctggtacatgccacagtgctaagatgaacagaaccatcattgttcgacgtaattacctacattatgtcaagaagtatcagagatacgagaagaggcactccaatattccagctcacatatcaccgtgcttccgtgtgaaagagggagatcatgttactattggacagtgcaggcctttatccaaaaccgtgaggttcaatgtcttaaaggtgattccagctggttctggtggtggcgggaaaaaagctttcaccgggatgtaatatttgtgcctccatttcaaattttgtttcttgtaggaatattatgtcaaaacttttctgcttttactgagttgtcttcaaattttgaaacttaatgcttagtaagtttgttttattaagcctctgaactagcttataaaatgttgttttactgaaccttatacaaaaaggatgtttggtgattaaaat

SEQ ID NO: 1027 - DNA, 792 bp, Tabernaemontana elegans
agcttgagtagggtttctgcctccaaagagtaccaataagccattcccattcggtgatcatccgctgcaaccatggccgaacagacggagaaggctttcttgaagcagcccaaggtgttcctttgctcgaagaaatcaacgaagggaaagagaccaggaaagggaggaaatcgctactggaaaagcattggcttaggcttcaagacccctcgtgaggctcttgaaggtacatatattgataagaaatgcccattcactggttctgtttcaatcagaggtcgtattcttgctggaacttgtcacagtgctaagatggtaagaacaatcgttgttcgccgtaactacatgcaatttgtcaagaagtatcagagatatgagaagaggcattctaacattccagctcatatttctccatgcttccgcgtgaaagagggagatcacgttatcattggacagtgcaggcccttgtcaaagactgtgaggttcaatgtattgaaggtgattccagctgggtcctctgctggtggcaagaaggcttttacagggatgtgaggggatgtgttttgaatttgttttgaagtttctagagaaatggtgttagactttcctactattaattcaagactctttgtattgattttgccttgatggcttaaattttgcacttgacaagtttatcagctatagcgttaagttcttttggtttctgacgttagaagtttggaaggactctatatgttgcttaaaactaccaaggcaagcgccacagacattgatttatcctgttgaaaa

SEQ ID NO: 1028 - DNA, 1037 bp, Solanum lycopersicum
gctctccactgcatattagggttttcgctacagagtattcgtcgccgttcagtttatcttcatttgcaaaccctcaatcatggcggagcagacggagaaggcgtttttgaagcagccaggtgtttttctaagctctaagaagaccgggaagggaaagaggccaggaaagggaggcaatcgatactttaagagtatcggtttaggattcaagactcctcgtgaggctactgaaggtacatatattgacaagaaatgcccattcactggcaatgtttctatccgaggccgtatccttgctggtacatgccacagtgctaagatgaacaggaccatcattgttcgacgcaattacctacattatgtcaagaagtatcagagatatgagaagagacactccaatattccagctcacatatcaccatgcttccgtgtgaaagagggagatcatgttactattggccagtgcaggcctttatccaaaactgtgaggttcaatgtattgaaggtgattccagccggttctggtggtgttgggaaaaaagcttttaccggaatgtgaacttgattgtttctattttaatgtttacatctagaaatgatgtcaaggcatatttgcttttgctgaattctagtcttcatttatactcctttctgagattcaaattttgaaactttatgctagtagtaacaagcttttctttcctattgagatttgagcccatatatttactgttcatcttgtgataggtctggtgcttgaaccttctttaaaaaaaagtacttgtggtgattttagtctacaggtacatcgccatttgcatatactttagtaaagcagattttctttgttctaaaaaaagaaaccataagatgctacacttgtgcaactcttactatctatagaatgagtgcgtatatgctgaaacattgtgtaacgtaaacatttttttttgtgtctgtgtaatgaggacacaactagggtgaggggaattttacaaattggtaggtttctatgtttctttcgatccaagacttgc

SEQ ID NO: 1029 - DNA, 737 bp, Solanum lycopersicum
ctcctcctctgcaaattagggtttggcatctctcgccgtcagttgatcttccttagtaacaatcaatcatggcggaacagacggagaaggcgtttttgaagcagccaggtgtgtttctaagctctaagaagaccgggaagggaaagaggccaggtaagggaggcaatcgatacttcaagagtattggcttaggatttaagactcctcgtgaggctactgaaggtacgtatattgacaagaaatgcccattcactggtaatgtttctattcgaggtcgtatccttgctggtacatgccacagtgctaagatgaacagaaccatcattgttcgtcgcaattacctacattatgtcaagaagtatcagagatacgagaagaggcactccaatattccagctcacatatcaccgtgcttccgtgtgaaagagggagatcatgttactattggacagtgcaggcctttatccaaaaccgtgaggttcaatgtcttgaaggtgattccggctggttctggtggtggcgggaagaaagctttcactggaatgtaatgtgtttttccatttcaaattttgtttcttgtaggaatattatgtcaaaacgtttctacgttttactgagttgtttcttcaaattttgaacttaatgttagtaagttatgttttattaagcctctgaactagcttttaaaatgttgtttgattgaacttttatataaaaaggatattaggtgattaaaa

SEQ ID NO: 1030 - DNA, 582 bp, Triphysaria pusilla
acattctcctctgcaatcttttgcccaccaccatggctgaacagactgagaaggctttcctgaagcagcctaaggttttcctaagctcgaagaaaacaggaaaggggaaggctccaggaaagggcggcaatcgctattggaagagcatcggattagggttcaaaactccccgagaggccattgaagctacttacattgacaagaagtgcccattcaccggcaatgtgtcgatcagaggccgtatcctagctggaacttgccacagtgctaaaatggtgagaacaatcattgttcgacgtaactacttgcattgggtatccaagtaccagagatatgaaaagaggcactcaaacattgcagcacacatatctccatgcttccgtgtgaaagagggtgaccatgttatcattggacaatgcaggccgttgtcgaaaactgtgaggttcaatgttctaaaggtggtaccggctgggtcatcaggtcgtgggaagaaggcctttacttttatttgattcagaggtggtcgaacttttatgttacgatggttaagtagattattgagtttggttcatggacttgttc

SEQ ID NO: 1031 - DNA, 755 bp, Tripterygium wilfordii
ctcggcgctgtatcttcaaccatggcggagcagacggagaaggcatttttgaagcagccgaaggtgtttctatgctcgaagaaaactggcaaggggaaaaggccaggaaagggcggaaaccgcttctggaagaacattgggcttggttttaagacacccagagaagcaattgatggtacatatattgataagaaatgtccattcgctggcactgtatctatcaggggtcgtatcctggctggcacttgccacagtgcaaaaatgacaaggaccatcattgttcgaaggaactatcttcattttgttaagaaataccaaagatatgagaagaggcactccaatattcctgctcatgtttccccatgcttccgtgtgaaggaaggagaccatgttatcattggccaatgcaggccactgtcaaagacggtgaggttcaatgttttgaaagtgattccagcaggatcgggtggcagtgggaaaaaggcttttacggcaatttgaatagttttgtgatgttgtgttactggttatatctgtcaggatttgaatcgagtctatgttattggtgactaaattctgtttgggttcttacatcataaactagctttggcgagttttatattttataattaggacatttgatgctctattttcttgtccttttttcttgattcaaaactatgttcgcatcatttttgtggtgctatgctaatattgaacctggcttgtttgtttatctagtgtttgaattaatg

SEQ ID NO: 1032 - DNA, 768 bp, Tripterygium wilfordii
atcaagcttcgcctccataaccagagaacactcccgactccattgacagctctcaatcatggctgagcagaccgagaaggcatttctgaagcagcccaaagttttcttgagttcaaagaaaactgggaaaggaaagagacccggaaagggcgggaaccgcttctggaagagcattggcttgggtttcaagactccaagagaggccatcgaaggaacctatattgataagaaatgcccgttcactggtactgtttcgatcaggggccgtatcttggctggaacttgccacagtgccaagatgatgaggtcaattgttgtacgacggaactaccttcattttgtgaagaagtaccaaaggtatgagaaaaggcactccaacattcctgcacacgtgtcgccatgcttccgtgtgaaggaaggtgatcatgttatcattggccagtgcaggccattgtcaaaaacagttagattcaatgtgttgaaggtgatccccgctggatcttctgccagtgggaagaaggcctttgccgggatgtgattttggcttgcaatttcatggtagggtcctgtcacaagcatatgggttgggctgtttgttgattagattatgtaagggaaacctcaagaatttttcatcgtttagattttagaaattcgtgtacttttggatgcctcctgttctttccttttcagttaataacttaaatcatggttttgaggatgcctagtggttggatcagaatctgtttttgactaatatatggcttt

SEQ ID NO: 1033 - DNA, 789 bp, Valeriana officinalis
tcctctcttctcctcttctcgctctttctactcgcagttttccaccatggctgagcagacggagaaggcatttctcaagcaacctaaagtgtttttgagctcgaagaaatctggaaaaggaaagaggcctggtaaagctggaaaccggttctataagagcatcggtctcaactttaagactcccagagaagccattgaaggaacttacatcgataagaaatgtcccttcactggaaatgtttccattagaggccgtatcatcaagggaacttgtcacagtgcgaaaatggtgaggaccatcattgttcgaagaaactatcttcactacgtcaagaagtaccaaaggtatgagaagaggcactcaaacattcctgctcatgtgtcaccatgctttcgtgtcaaggaaggtgaccatattatcattggacaatgcaggcctttgtcgaagactgtgaggttcaatgtattgaaagtggtacctgctggatcttctggaggtgttggaaagaaggctttcgtcggcatttaagtttgtttttgttatctagtttctactatgcttaatattgtagtccacatttgtgttcaaacttgtttttggttatgaacttttagcctgttttgtttgaaaacctcaagttttgtttgatgaatcaagatacacagattgttgaatgttttttttagcttttcttgattgatgaggtataatattaagttttaatccatacctgatttgattatagaaacttaaaattttgatgttagaataattttagattatttatt

SEQ ID NO: 1034 - DNA, 660 bp, Valeriana officinalis
tctcctcttctctactcgttctctctacttacagttttccgccatggctgaacagacggagaaggcatttctcaagcaacctaaagtgtttttgagctcgaagaaatctggaaaaggaaagaggcctgggaaagctggaaaccggttctataagagcattggtcttaactttaagactcccagagaagccattgatggaacttacattgataagaaatgtcctttcactggcaatgtttccattagaggccgtatcatcaaaggaacttgtcacagtgcaaaaatggtgagaaccatcattgttcgaagaaactatcttcactacgtgaagaagtaccagaggtatgagaagaggcattcaaacattccagctcatgtatcgccatgctttcgtgtaaaggaaggtgatcatatcatcattggccaatgcagacctttatccaagactgtgaggttcaatgtattgaaagttgtacctgccggatcttctggtggtgttggaaagaaggcctttaccggcatttaaggttctttctttttttttcaaaatttgatattaactagacataatggctatttttgtagttgattatgtggttaaaattatttgattttgaatggtgattattaaagttgagtttattatcaatatatttgccc

SEQ ID NO: 1035 - DNA, 721 bp, Zostera marina
cagatgcatattatcaccatttcgttaagaacctgttctcttctcgtttttgtgtccaatcgaccatggcagatcagacggagaaggcttttctcaaacaacccaaggtgttcctaagctctaagaaatctggaaaggcaaggaagcctggtaagggcggaaacagattctggaagagcattggtctcggattcaagacccccaaatccgccattgagggacactacatcgataagaaatgtcctttcactggaactgtttctataaggggacgaatcataactggaacatgtcatagtgcgaagatgaacagaacaatcattgttagacgaaactatctacattttgtcaagaagtatcagagatatgagaaaaggcactcgaatatccctgcccacatatccccttgtttccgtgccaaggaaggcgaccacatcatcattggacagtgtagaccattgtcgaaaactgtgagatttaatgttttgaaggtgatcccagctggttcaactggtggtgggaagaaagctttcacagcaatatagaagagagtttttatggttagaatttggtatcttgacttttgacatattttttaaaatcaatttcggtaatgttgtttttagttattcacggcatccatactttgtttgttattatcgacctgaaccttagatcatgttttatttattattgaaatctcacacttgtttttctctgc

SEQ ID NO: 1036 - DNA, 974 bp, Elaeis guineensis
tctccccctcccctgggcccttttccggtccttctccttcgttcaatcatggcggaacagactgagagggctttccttaagcagccaaaggttttcctttgctcgaagaaatctggtaaggggaagagacctggtaagggtgggaaccgcttctggaagagtattggtcttggattcaagactcctagggaagctattgaaggtgcatacgttgacaagaaatgcccgttcactggtaatgtttctattaggggtcgcattttagctggcacatgccatagtgccaagatgaacagaaccattattgtccgtagaaattacctccactacgtgaagaagtatcagaggtatgagaagaggcattcaaatattgcagcacacatatccccatgcttccgtgtgaaggaaggagatcatgttatcattggccagtgcaggccattgtccaagactgtgaggttcaatgttctaaaagtcattccagctgggtcaaaaggtggcagtgggaagaaggctttcactgcaatccgaagtttctaacgttttgttcttacatattgcagtcagttggagtaggttcagttttgaattgagctctttgaatgaagtaatgccatttgaccaggagtaatcccgtttgtcgctttaagaactcttcaaagctagttctcagttttgctttctgaatgaagaaactaatgctgtttatgcagaagtcaactccgttttcgctggatttccactgaataccggtcttacctatgaaattgcatgagaaagtctttctagggctgttgcatggtttaaaagatatgactgcttgcagactattcaatattacgtgcaaacagctatcgtacaagttacagctattgtaatatcctaaattcgcgctcgatttgataaaaacaagaccatacccgatgttgatttgactcgaatatgaattaaaattcgaagttaaaaaaaaaaaa

SEQ ID NO: 1037 - DNA, 718 bp, Rosmarinus officinalis
cggccgggggctagcgaagagcacctttaccctacttctctgagttcgccgggcttcccgttaacggagcatcttcactctagttctctcggcagctgcagccactcagacggccatggcagaacaaactgagaaagcctttttgaagcaaccgaaagttttcctttgctccaagaagtcaggtaaagggaaacgacccggcaagggtggcaataggtattggaaaagtatcggtctcgggtttaagacgcctcgggatgctattgaaggtacttatattgacaagaagtgccctttcactggcaatgtttcaatccgagggcgtattcttactggtacttgccacagtgccaagatggtgcgaactatcattgttcgaaggaattatcttcattttgttaagaaatatcagcggtttgaaaagaggcactccaacattccagcccacgtttctccatgcttccgtgtgaaggagggagatcatgtgactattggtcagtgcaggccactctccaagactgtgcggttcaatgttttgaaggttgtaccagctggttcctccggcggaggcaagaaagctttcacagtgatgtaaagagttctgaatctcctttttaagtttctagagtcgggggttacggacttttttcctgagtattagttaaaaacagtattgattttggcgtgatggctcaaacgttgcagcaagtagccatag

SEQ ID NO: 1038 - DNA, 749 bp, Rosmarinus officinalis
actttcaatttctcctggttcttcagctcaaagttcacgctgaattctccaattagtaggggttctgcttccaagagttccaatctgccccattcgcatcccgtgaccagcagctgcaaccatggccgaacagacagagaaagcatttctgaagcagcccagggtatttctaagctcaaagaagagcggaaagggaaaacgacctggtaaaggaggtaatcgctactggaaaagcattggattgggatttaaaactcctcgtgaagctatcgaaggtacatatattgataagaaatgcccattcactggcaatgtttcgattagaggccgtatccttgccggaacatgccacagtgctaagatggtgcggacaatcgttgttcgaagaaactacctgcacttcgtcaagaagtatcagagatatgaaaagaggcattctaacattccagctcatatttctccctgcttccgcgtgaaagagggagatcatgtttacataggccagtgcaggcccctgtcgaagacagttaggttcaatgtactgaaggtgattccagctgggtcctccggtggtggcaagaaggctttcacattgatttaaggagtgtgtcttgagtttcttttaaagtatctagaaattgttgccagacttttgccttgatggcataaattttgcactcaattctatcagccctatcgcctagtattaatgtcttttggtttctcacatttgagtatgagatgactta

SEQ ID NO: 1039 - DNA, 808 bp, Amsonia hubrichtii
gtcaagcgttgtagtcttccaccgctccaggcttacactagggtttctgctctcgagagctccaatcagctgacattcacttacggtgaccagcagccgtaaccatggccgaacagacggagaaggctttcttgaagcagccaaaggtgtttctttgctcgaagaagacaagtaaaggaaaaagaccaggaaagggcggaaaccgctactttaagagcattggtttaggattcaagacccctcgtgaggctactgaagctacatacattgacaagaaatgcccattcactggctctgtttcaataaggggtcgtatcctggctggaacttgccacagtgctaaaatggtgagaacaatcattgttcgacggaactatctgcattttgttaagaagtatcagagatatgagaagaggcattctaacattccagctcacgtttctccatgcttccgtgtgaaagaaggggaccatgtgattattggccagtgcaggcccttgtcaaagaccgtcagatttaatgtccttaaggtgattccagctggttcctctgctggtggcaagaaggccttcacagggatgtgagggggggtgtctttgttttttaaagtttagatgtgttgaaaaatttctactatttagttgggactttgtattgattttgccttgatggcttaaattttgcactcagcaacaagtttatcagttacttattggtcgcttttgttttatgacatttgaagtatgaaatgaaatgacttgcaacctccaagctaagctgcctgaagttgatttattctattgaaaat

SEQ ID NO: 1040 - DNA, 727 bp, Arabidopsis lyrata
agggttttcttctccttccacaagcagttttaagggttcttctctctatctctctcgatattctcttaacaacctcaacaatggcggagcagacggagaaagcgttcttgaagcaaccaaaggtcttcttgagctcgaagaaatctggtaaaggaaagagacctggaaaaggaggtaatcgtttctggaagaacattggtcttggtttcaagactcccagagaagctactgaaggtgcatacattgacaagaaatgtccgtttactgggacggtttcgattagaggtcgtatcttagcaggtacttgtcacagtgcgaaaatgcagaggactatcattgttcggaggaactatcttcattttgttaagaagtatcagaggtatgagaaaaggcattcgaacattcccgctcatgtctcaccgtgtttccgtgtcaaagaaggagatcatgtgatcatcgggcaatgcagaccgctgtcaaagacggtaaggtttaacgtcctaaaggtcattccagctgggagttctgctatagggaaaaaagcattctctggaatgtagagacttgttaaagttgttgtgatcgatggacttgagaggattttggcttttcatgttacattctcaagaaaaacctcttttgcatttgtgtttgctgcaaacatttatgtttcaaaactttctctcttacaaataccattatataagaatgatcctcttatgtttgt

SEQ ID NO: 1041 - DNA, 694 bp, Arabidopsis lyrata
ttgagatttctctgtctctttcctttgcctctcgcattttcgacatccttttgccgcagagctccgtggagagcagcaatcagtagccatggctgagcagactgagaaagcttttcttaagcaacccaaagtcttcctaagctcgaagacatctgggaaaggaaagagacctggaaagggtggaaaccgtttctggaagaacattgggttgggtttcaagactcctcgtgaagccattgaaggagcttacattgacagtaaatgtccattcactggaactgtttctatcagaggtcgtatcttagctggtacttgccacagtgccaagatgcagagaaccatcattgttcgtaggaattaccttcactttgtgaagaagtatcaaagatatgagaagagacattccaatatccctgcccatgtctcaccgtgcttccgtgtcaaggagggtgaccatgtcatcattggccaatgcaggccgttgtccaagacagtcaggttcaatgtgttgaaggtgatcccagctggcgcatccgcctttggtaagaaggccttcactggagtgtaagggttttgagagaatctggagattttggtttgattttggaatgttttaatgttttgtttgatgatcccttttcttggagactttgattatcacagacgtaatacaaatctacgcacttttcgttga

SEQ ID NO: 1042 - DNA, 579 bp, Catharanthus roseus
gtcatatcggcgccggagccatccattatctgagcagccgcatcacagacactcaggcgaaatggcggaacagacggagaaagccttcttgaagcaaccaaaggttttcctttgctctaagaagaccggaaaaggaaagaggcctggaaaaggtggaaaccgctactggaagagtatcggtttagggtttaagacgcctagggatgctattgaaggtacttacattgacaagaagtgccctttcactggcaatgtttcaatccgagggcgtattcttactggtacttgccacagtgccaagatggtgcgaactataattgttcgaaggaattatcttcactttgtaaagaagtatcagaggtatgagaagaggcactctaatacgcctgctcatgtttctccatgcttccgtgtgaaggagggagatcatgtgactattggacagtgcaggccattgtccaagacagttagatttaatgtcttgaaggtgattccagctggctcatctggcactgggaaaaaggcattcactggaatgtgaggagttaaatttcctattcaagtttctagagggttttg

SEQ ID NO: 1043 - DNA, 925 bp, Cedrus atlantica
tttatattgtataccttttgttaaagaactttttaggcaggagtgggagcggctggggcgctgaagacacgaagttagacgtctcgaattcctgcagccatggcggaacagaccgagagagcatttctgaagcagcctaaggtctttctaagttctaagaagtctgggaagggtaaacgacctggaaaaggtgggaacaggttttggaagaatattggtcttggcttcaagacccccaaagaagctgttcaagggacctatatcgacaagaagtgcccattcactggcaacgtctcaataaggggtcgtatattagctggaacctgttatagtgctaaaatgaatcggacaattatagtccgtagggactatctccactttgtcaagaaatatcaaaggtatgagaagagacattcaaacataccagcccatatttcaccctgcttccgtgtgaaggaaggggatcatgttattattgggcaatgcaggcccttgtccaagactgtaaggtttaatgttcttaaagtgattcctgcgggttctagcagtggttctgcaaagaaagccttcactgcaatctgagcgcattttttggggtttgtccaagcaattttagcccaacaaatgcaatagataggatttgacagagatgatggttactatatcatcattgctcaacttatttttgtcgggttgatcctttattttttgttactacgttgaatgttgaaggatgtacggtgcacgctgtttttagtcttggtagttgaaagtaaaccgtttctggatatttgaaaaatttgttttggttttatcatccagcaaagctttgaaggtataacctttgagtaatttttttccgttgtccaaatgtgaatgacattatatatctagtttagtatttatgcgaaaggattttgctttt

SEQ ID NO: 1044 - DNA, 741 bp, Cichorium intybus
tcgtcacaagcgcaaagtcttttcatttagggtttattgccgattcactctcctgtgtccgccgcttcagagctcgcaatccatcctcaacaatggctgaacagaccgagaaggcgtttttgaagcaacccaaagtgtttctctgctcgaagaaaagtggaaaaggaaagaggcctggaaagggtggaaacagattctggaagagtgttggtcttggcttcaagacaccaagagaggctatcgaaggcacttacattgacaagaagtgtcccttcaccggtgatgtctccattagaggccgtattttaaccggtacatgcaacagtgccaagatggtgaggaccattattgttcgaagggactattttcactatatcaagaagtaccaaagatacgagaagaggcattccaacactcctgctcacatctcaccatgcttccgtgtgaaggaaggtgaccatgtcaccattggacagtgcagacctttgtcaaaaactgtgaggttcaatgtgttgaaggtgatcccagcaggatcttcaggtggtggtggaaagaaagcatttacaggattttaagtatttggagtgtttgactctttttgcttgattatgtaatagattttgagaacacaacttgagttttattgttctgtagacactattatgctgtttgtttctggtttatgccaacacttttgagagtttttaagaaattattatttgaggtttttgtcttattttc

SEQ ID NO: 1045 - DNA, 689 bp, Cleome spinosa
agtacgcgggggaagctctagtcgctgctcctctcgcatctttctcccaaatcctcaagcttcgcctgagagctatccgccatggctgagcagaccgagaaggctttcttgaagcaacccaaggttttcctatgctcgaagaaaaccgggaaggggaagaggcccggaaagggtggaaaccgcttctggaagaacattggtcttggattcaagacacctcgcgaagccattgaaggaacattcattgacaagaagtgccctttcacgggcactgtttcggtcagaggccgtatcttggccggcacttgccacagtgccaagatgcagagaaccatcattgtcaggaggaattaccttcacttcgtgagaaaataccagaggtatgagaagaggcactcgaacatccctgcccatgtctccccgagcttccgtgtcaaggaaggagatcacgtcatcatcggccaatgcaggccattgtcaaagacagtgaggttcaacgtgctgaaggtgatcccggcaggttcggctgctggtgggaagaaggccttcaccgggatgtaaaaggagtttgattttctgttttttttagcaagacaaagctactttgagtgtttttgctgcaccgattttgtttctctgggacttgattgagacgaaatctatcaactttcttcaggcagatttgagtt

SEQ ID NO: 1046 - DNA, 729 bp, Cleome spinosa
ttgttgtaagcttcagtcgctgcctctttcgcatctgtatctcccacattgcctcaagcttcacgtgagagcaaccagccatggccgagcagaccgagaaggctttcttgaagcaacccagggttttcctatgctcgaagaaaactgggaaggggaagaggcccggaaagggtggaaaccgcttctggaagaacgttggtcttggtttcaagacccctcgtgaagccattgaaggaacattcattgacaagaagtgcccgttcaccggacctgtttcagtcagaggccgcatattggccggtacttgccacagcgccaagatgcagagaaccattattgtacggaggaattaccttcactttgtgaggaaataccaaaggtacgagaagaggcactccaacattccggctcacgtctccccgtgcttccgtgtcaaggaaggcgaccacgtcatcattggccaatgcaggccgttgtcaaagacggttaggttcaacgtgctgaaggtgatcccagccggttcggccgccggtggaaagaaggcattcactgggatgtaagagtttgatcagtcagtagtttgcttttctggatagaaccgaactcaaaacgctgttttcaagtttgtgtaagacaaatcatttcgagtgttttgttgcgcacgattttgtctatttcgggtttttttttaatcaaggtttcagagcgttactctctctcttcctactg

SEQ ID NO: 1047 - DNA, 702 bp, Trifolium pratense
acacagtgctgcttgctgcaaccaacaatggcggaacaaactgagaaggctttttcgaagcaacagaaagtgtttttaagctcgaagaaatctggaaaggggaagagacctggaaagggtggtaatcgattctggaaatctgttggccttggttttaagcctccaagagatgccattgaaggaacctatattgacaagaagtgcccatacactggcaatgtctcaatccgaggtcgtattctagccggtacttgtcacagtgctaagatgaataggaccattattgttaaaagggattatcttcatttcgttaagaagtatcagagatatgagaagcgtcattctaatattcctgcacacatatcaccttgtttccgagtgaaggaaggagatcatgttattattggtcaatgcaggccactctcaaagacagttagattcaatgcattgaaagtgatcccagccggatctgctagtggtgcaaagaaggcgtttacaggaatttaagtttgaaattttcagttagcgttgaagacagttatatcttagtttcaaatattctaagatcatgatgtagtcatacttgatcaaatttggatgtgttttaatactttgcattgttttgagcagttaatcttaaagattttgatatacattttagcttttgaatattagttgcagcaattttttggcatagttgta

SEQ ID NO: 1048 - DNA, 691 bp, Cyclamen graecum
ctcctgctctgctctccgtcctggtcgcactcctcccgccaaaaccctcagccatggccgaacagacggagaaggcatttctcaagcagcacaaggtattcctttgctctaagaaatcagggaagggaaagagacctggaaagggaggaaatcgttactggaagagtattggcttgggtttcaagacgcccagagatgctattgaagggacttatattgacaggaaatgtcctttcaccggagatgtgtccatcaggggtcgtataattgctggtacctgccacagtgcaaagatgatgagaactatcattgttcgacgcaactaccttcattatgtcaaaaagtaccagaggtatgagaagaggcattcaaatataccggctcacatttccccctgtttccgtgtgaaggaaggagatcacgtcactattggccagtgcaggccattgtcaaagactgtgaggtttaacgtgttgaaggtgattccagctggttccgctgctggtgggaagaaagcttttgcagcaatctgagtttgttggctcaaatagtgctagtaatataatgtacggcaggttatgcctttcttagatgggactatttacttttccttttgagaattctgaacattgagactgatttatggttgtggtaacgagctttctaagtttcgttgtgttcaatgggtggg

SEQ ID NO: 1049 - DNA, 586 bp, Cyclamen graecum
tgatagctgccctctctctctataatcatggcagaacagactgagaaagcttttttgaagcagcacaaagtgtttctcagctcgaagaaatctgggaaaggcaagaggcctggaaaggggggtaacagatactggaagagcattggattgggattcaaaactcccagagaagccattgaagggacctatattgacaagaaatgccctttcactggcgatgtctccattcgaggccgtatcctcgctggaacttgccacagtgccaagatgatgaggacaattattgttcggaggaattatcttcactatgtgaagaaataccaaaggtatgagaagaggcactcgaacattgctgcacacttatctccatgtttccgtgtgaaagaaggggaccatgtcaccattggtcaatgcaggcctttgtcgaagacagtgaggttcaatgtcttgaaagtgatccctgcgggatcttctggtaccgggaagaaggcattcacagccatctaagtgttccgcctttcaattgctttgagaggaataagtacttgaatgaaacattagcttatcctattgaaatttattttac

SEQ ID NO: 1050 - DNA, 885 bp, Distylium racemosum
gggttttccaagctcgccgattcgggacggaggagcgttagggtttgggtcatttatcgtagccatggcggaacagacggagaaagcttttctgaagcagccgaaagtcttcctttgttcgaagaagtctggcaaagggaagaggcctggaaaggggggaacgaggttctggaagaacataggtctcggcttcaagacacctaaagaagccattcaaggtacttatattgataagaaatgtccgtttactggaaatgtgtcgatcagaggtcgcatattgactggaacatgttacagtgcaaaaatgaaccgtacaatcattgtgcgccgtaattatctccattttgtcaaaaaatatcagaggtatgagaagaggcattcgaacatacctgcacatatttcaccatgtttccgtgtgaaggaaggtgatcatgttataattgggcagtgcaggcctttgtccaagactgtaagatttaatgtcctgaaggtgattccagcaggttccagtggtggggctgctaagaaaggctttgcagcaatgtgaagatacatgcaaaaacttagagcaatcataaatttatcaaggagcacttagaatagatatctgcagaggttaagattggtttttagtgagtcatatgttgccttgttttaattttaatatcatcccatttgtgttgagtgatgtgcctcagtgcatatcaacaatctcaagtaaggtaatatgttactattgatttagcaaattttgaatttgaatccttgtgtattcttcttccatggttgaattttgtgggaggaacagacttcccctggtttctgggatgaaatttgaggactgccacttgatgcattttgcacagattataaattatgtccttg

SEQ ID NO: 1051 - DNA, 852 bp, Epimedium sagittatum
gttaggtccgggcccgtcccggtccggacccttcgtaaagtaaagagggtgtgtcgcgagggtcgcgtacggccggggagggttttgaaggcagcttgtcacactccatctctctcccgtcggctccatctgcttctcttgccaagcatttgctttgtcgaccatggctgaacagacggagaaggcttacttgaagcagcctaaggtgtttctatgctcaaagaaatccggcaagggaaagaggcctggaaaaggaggcaaccgtttctggaagagcgtcggtttgggcttcaagactcccagagatgctattgaaggaacatatattgataagaagtgcccttttactggtgatgtttcaatcagaggtcgtatcctagcaggcacatgtcacagtgctaagatggtgagaacaatcattgttcgacggaactaccttcattatgttaaaaagtatcagaggtatgagaagcgacactcaaatattcccgcacacgtttctccgtgttttcgtgtgaaagagggggaccatgtgaccattggccagtgcaggccattgtccaagactgtcaggttcaatgtattgaaggtcattcctgctggttcttcaggaggcggtggtaagaagggttttgccgccatgtgagaaatgtcttttttgttcaaaattttgagacacggtcgatgtgtgtttcttgtttcctttacatgcctataaatttcttgttatatttgatgtaggcaaatcagattgagctcctcgtagtttttaagatttaaaatttagtactttgtgagtgttgaattcagtaatttgcgagtgtgttctatattttagtagataagtaaata

SEQ ID NO: 1052 - DNA, 808 bp, Eschscholzia californica
ctatctcttcgtcaccatcaccattaatcatccgcaatggctgaacagacggagaaggcttttttgaagcaacccaaggtgtttctctgctctaagaagagtgggaagggaaagagaccaggaaagggaggaaatcgtttcttcaagagtatcggtctgggttttaaaacacccagagaagctattgaaggaacatacattgacaaaaaatgcccattcactggcaatgtttctattaggggtcgtatcctatcaggcacttgccatagcgcaaagatggtgagaaccatcattgtcaggaggaactaccttcactatgtgaagaaatatcaaaggtacgaaaagaggcactctaatatacccgcccacatatccccatgtttcagagtgaaggaaggcgaccatgttactgttggtcaatgcagacctttgtcgaagacagtgagattcaacgttttgaaggtcattcctgctggatcatctggtggtggtgggaagaaagcttttgttgcaatgtaagactatttgctcttcatggggtggatgccgtgagctcgcgtcattcatgtcttttcagactagatgagtagagaagagtactctggttgtagtattatttttaatctgttcactcaaatcttacaaggcttcatctcggcaagtggatttcttttgtttacatagttttgttcaggaccagattagacttgatagtttgatagctgtttcagttgctctggtcattgaagagcttgatttagttttaatgacttgattgctctgtttcattatatgctcctattacaat

SEQ ID NO: 1053 - DNA, 893 bp, Eucalyptus grandis
cgggcctggccttgtctatggatggattcaagacatggtccaggcccagctgcttgatgtatcggctcttcgctcgacatataaaaggcttccgcttcatcgttcccaccagcgaactagggtttcggctttcatcaaacctcgccgtcgcgctccttgcctccgcctgctcgatctcgcaagccctgaaaatggatgcccagacggagaaggcgtttctgaagcagccgaaggtgttcctctgctcgaagaagtcgggcaagggtaagaggcccggaaagggtgggaaccgttatcataagagcgttgggttgggattcaagacacccagagaggcaattgaaggtacctatattgacaagaaatgcccattcactgggaatgtttccataaggggccgtatacttgccggtacttgccacagtgccaagatgatgaggacgataattgtccgcagaaattaccttcattttgttaagaagtatcagaggtatgagaagaggcactcaaacattccggctcacatatctccatgtttccgtgtgaaggagggtgatcacgttactgttggccagtgcaggccgttgtcaaagaccgtgaggtttaatgtgttgaaggtgattcctgccggatcatcaggcggcggtgggaagaaggccttcactggaatgtaattgagtcaatttttacattttggttttacatgttgagagaagatactagatttgctctacttggaatttactattgttagctatcaaatttttgtatgaccttttctacctctttcttaattgtcgatttttggttcacttttggccgaacctacaaattttatgacatggtgaattcgtgtttgtctgatttgcttgttatgtggtgtttgctgtgat

SEQ ID NO: 1054 - DNA, 696 bp, Euonymus alatus
tcctgtcctgtcctcggcgctgtattttcaaccatggcggagcagacggagaaggcatttttgaagcagccgaaggtgtttctaagctcaaagaaaactggcaaagggagaaggcccggaaaagggggaaaccgcttctggaagaacattgggcttggttttaagacacccagagacgcaactgagggtacatatattgataagaaatgtccattcaccggcactgtatctatcaggggtcgtatcctggctggcacttgccacagtgcaaaaatgacgaggaccattattgttcgaaggaactatcttcactttgttaagaaataccaaagatatgagaagaggcactccaatattcctgctcatgtttccccttgcttccgtgtgaaggaaggagaccatgttattattggccaatgcaggccattgtcaaagactgttaggttcaacgtgttgaaagtgattccagcagggtcgggtggcagtggaaaaaaggcttttactgcaatttgaagggtttaattcaaatggagtctgtattagtattggtgcctaaattttgttatttacaattaggacatttgatcctttattttcttgtcctttttcattaattcaaaaaattgtgagttcatcattttgttgtgctatgctaatattgatcctggcttgctaatttttagtgttcgaattcct

SEQ ID NO: 1055 - DNA, 690 bp, Ipomoea nil
gacaacgcctaggcttttagctgctccatttcacttccacagcacctcggagcctccaaccatggcagagcagacggagaaggctttcttgaagcagccaggagtttttctcagctcgaagaagactggtaagggaaagcggcccggtaagggaggaaatcgttattggaagagcattggtctcgggttcaagacaccccgtgaggccactgaaggaacatatattgataagaaatgcccctttgctggtactgtttctatcagaggtcgtatccttgccggaacttgccacagtgcaaagatgacccgaaccattattgttcgtcgtaactaccttcactttgttaagaagtatcaaaggtatgagaagcgccactcaaatattgctgctcacgtttcaccatgcttccgtgtcaaggaaggggatcacgtaattattggacagtgcaggccattgtccaaaactgttcgattcaacgtgttgaaggtgatccctgctggttctgctagtggtgggaagaaggcattcaccggaatgtgaacgccgatgtgaccctttttgttaaaaagtttgtgttagagctgtttttattgttttcgttgaacacttttttttatttcattggaatcttatctataatactacttgcaattgattttgtgttcgttgaatttacaaattgcttaact

SEQ ID NO: 1056 - DNA, 580 bp, Jatropha curcas
attgctctctctctgtttctcgcgccccctctgccgtctcagcttcaaaagcttacccaagaaagagctctcaatcatggcggagcagactgagaaagcgtttctgaaacaacccaaagtatttctgagttcgaagaaatctggaaagggaaagaggcctggaaagggcggtaaccgcttctggaaaagcattggattgggttttaagactcctagagaagccattgaaggaacttatattgataagaaatgtcccttcactggaacggtgtctgtcaggggtcgtatcttagctggaacttgccacagtgccaagatgataagaacaattattgttcgccggaattaccttcactttatcaagaaataccaaaaatatgagaagagacattcaaatattccaacaaacatatctccatgcttccgtgtgaaagaaggagatcatgtaatcattgggcaatgcaggcctttgtctaaaactgtgagattcaatgtgcttaaggttattccagctggatcttctggtggtgggaagatggccttcactggcatgtgaactttgaaacccaaaatgtttttt

SEQ ID NO: 1057 - DNA, 827 bp, Actinidia deliciosa
ggttttctcatctcttccgcttgcatcttcttctgcaactctccacagctctcaatcatggccgaacagaccgagaaggcgttcttgaagcagcccaaggtgtttctcagctcgaagaaaacggggaagggaaagagacctggaaagggagggaatcggtactggaagagcattggattgggattcaagaccccccgagatgccattgaagggacctatatcgacaagaaatgtccgttcactggtgatgtgtctatcaggggtcgtatacttgctggaacctgccacagtgcgaagatgatgagaacaatcattgttcgacgcaactaccttcattatgtcaagaagtatcggaggtacgagaagaggcattcaaatattccagcccacatttccccgtgcttccgcatcaaggagggagaccacgttactattggccagtgcaggccattgtctaagacggtgaggtttaatgttctgaaagtgattccggctggttcttctggtggtgggaagaaggcatttactgcaatttgagttatgtgcctcagttttctttggtaggaatatgcaaggaggacaatggtattgccattttagttgctattcaaagtttttgtatgtgaccaatttatggttttgaggaaactagcttttgaattttttttgactcctattgcttggtaattgatcagcggtcaagtttgatcgttcctacatttccaagtcctgagatcctgagtgtggtctttatttggtatgaaatattttagcaagtcttgatataaacccccccagataacaaatttaattatagctctaattca

SEQ ID NO: 1058 - DNA, 809 bp, Liriodendron tulipifera
gtttccagaagctagggtttcgttgcactctctcgcctccgcctccgcctccgcctccgcctccgcctcctctcctctccttatcgaccatggccgaacagacggagaaggcgttcttgaagcaacccaaggtctttctaagctcaaagaaaactggaaagggaaagaggcctgggaagggagggaaccgctactggaaaagcattggtctgggattcaagacgcctagagatgcgattgaagggacatatatcgacaagaaatgccccttcactggatctgtttccattaggggtcgtatccttgcaggcacatgccatagtgccaagatgatgagaactatcattgtccgccgcaactaccttcactatgtgaagaaataccagagatacgaaaaaaggcactcgaacattccggcacatgtatccccttgtttccgtgtgaaggagggcgaccatgttatcattggccagtgcaggcccttgtcgaagacggtgaggttcaatgtgctgaaggtcattccagctggatcctctggtgggggcgggaagaaggcttttgcagcaatctaaggccattcttttaccttctttttttcccgattgagtagggtttctcggatttctagttttctttcaaaaattaagatgtctgtgtgtcaaatttgaattttgtgattctggatcagattgacgtttcagattatttctatagaggttggttagtgattcagttaaaaatgttagatggcctacttgtgttttggtttgctagttgattctgctgattgcgtggtctaaaaaaaaaaa

SEQ ID NO: 1059 - DNA, 1204 bp, Pinus pinaster
ctcgcgtgtcataaacacatgtacaaactggggaaaatgcaagtcaaacttttatgattaaagagtgcaaacccattcaaacaattcccaccaaaaaccctagagatatgaaatagatttattttaattgacaatgagggtttcgactaaaaagaggatcgaaggagggtactagggttattgggattaaataaggaaggcttctatttactgaccttgtttcacaagcaggggagggagcggcggcggcggcgggagtctcgattttcagcagccatggcagaacagactgagagagcttttctaaagcaaccaaaagtctttctcagttccaagacgtctgggaaggggaaacgacctggaaaaggtggcaacaggttttggaagaatgttggtcttggcttcaagacccccaaagaagctgttcaagggacctacatcgacaagaagtgcccattcactggtactgtttcaataagaggtcgtatattagccggaacatgttacagtgctaaaatgacacggacaattattgtccgtagggactatctccattttgtcaagaaatatcagaggtatgagaagagacattcgaacataccagcccatatttcaccctgtttccgtgtcaaggaaggggatcatgttatcattgggcaatgcaggcccttgtccaagactgtaaggtttaatgttctgaaggtgattcctgcgggttctagcagtggttctgcaaagaaagccttcactgcaatatgaatccgttttttttctttgtacaagcaaaccatataatccgtcaaatgcaatagcgtaggcgttgacagagttgagggttactattttatcatttgctcaaattaattttgttagtttaatccttcttttggttactgtattgaattttgaaaaatatgtacggataacgtttactccttggtggttgaaagtccacctttcttggatacttttgttttggttttagcatccagtaaacctttgaaagcatattcttggaatatttttttatttcaatagccacgatgtcatatttagtttggcttttaattatttctttaggaggtggcattcgtgtgcgttaagctgttgtcttggcaataataaatattgctatgaaatgatcacctaactttcccaacataactttgaatttataaaggtgcaatctagtaatatgtgatgg

SEQ ID NO: 1060 - DNA, 698 bp, Avena sativa
cgccgccgcagctaccgagcaactcgaaccatggcggagcagactgagaagtctttcctcaagcagccaaaggttttcctcagcacaaagaaggctgacaaggctaagcggccaggaaaggctggcaaccgcttctggaagagtgttggccttggcttcaagaccccaagggaagcgattgaaggtacctacatagacaagaagtgccctttcactggaactgttgccatcaggggcagaatcatcgctggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaagcgaccatgtcatcattggccagtgcaggcccctgtcgaaaaccgtgagattcaacgtcctgaaggtcatcccagctggaaccactggcggtgggaagaaggctttcatcgctgcctaaacctagactctgattcatgagtagttcatagtcagaagtttttcgcacttaaaagacctatcaggctggtgttttgatatttgattccatattttctgtcaaactgaagtctctcctcatcttaacatgtttgtggaatctatctgttgttaatagttttgcttaagttgtactgtgtgatgcttttg

SEQ ID NO: 1061 - DNA, 735 bp, Avena sativa
ggccgccactcctcttgaagcctcgctctcttttcttccgcgtcttccccccagcgccgccgccaccgagccgctcgaagtccgcagcaccgccgccgctcgaaccatggcggagcagactgagaagtctttcctgaagcagccaaaggttttcctcagcacaaagaaggcagacaaggccaagcggccaggaaaggctggcaaccgcttctggaagagtgttggccttggcttcaagaccccaagggaggcgatcgaaggtacctacattgacaagaagtgccctttcactggaaccgttgccatcaggggcagaatcattgctggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaagcgaccatgtcatcattggtcagtgcaggcccctgtcgaaaaccgtgagattcaacgtcctgaaggtcatcccagctggaaccactggcggtgggaagaaggctttcatcgctgcctaagcctagactctgattcatcagtagttcatagtcagaagtttttcgcacttaaaagacctatcaggctggtgttttgatatttgattccatattttctgtcaaactgaagtctcttgtcatttgaacatgttcgtggaatctgtctattg

SEQ ID NO: 1062 - DNA, 706 bp, Avena sativa
cgccaccaccgagccgctcgaagtccgcagcaccgccgccgctcgaaccatggcggagcagactgagaagtctttcctcaagcagccaaaggttttcctcagcacaaagaaggccgacaaggctaagcggccaggaaaggctggcaaccgcttctggaagagtgttggccttggcttcaagaccccaagggaggcgatcgaaggtacctacattgacaagaagtgccctttcactggaactgttgccatcaggggcagaatcatcgctggaacatgccacagcgccaagatgaacaggaccatcattgtccgcaggaactacctccactttgtgaagaagtaccagaggtatgagaagaggcactccaacatcccggctcacatctccccgtgcttccgtatcaaggaaagcgaccatgtcatcattggccagtgcaggcccctgtcgaaaaccgtgagattcaacgtcctgaaggtcatcccagctggaaccactggcggtgggaagaaggctttcatcgctgcctaaacctagactctgattcatgagtagttcatagtcagaagtttttcgcacttaaaagacctatcaggctggtgttttgatatttgattccatattttctgtcaaactgaagtctcgtcatcttaacatgtttgtggaatctatctattgttaatagttttgcttaagttgtactgtgtg

SEQ ID NO: 1063 - DNA, 859 bp, Olea europaea
agattttgaatacacacctgcacacactctagaactactacaccatggcggaacagactgagaaggcgttcttgaaacaacccaatgtgtttatttgctcgaagaagacggggaagggcaagaggccaggaaagggaggcaaccgatacttcaaaagcattgggctggggttcaagactcctcgtgaggctactgaaggcacatatatcgacaagaaatgtcccttcactggtgatgtgtccatcagaggccgtattcttgctgggacatgccacagtgccaagatgatgagaacaatcattgtccgtcggaactacttgcattgggttaagaagtaccagagatatgagaagaggcactcgaacattccggcacacttatctccatgcttccgtgtgaaagagggtgaccacgttattattggccagtgcaggcctttatcaaaaacagttagattcaatgttcttaaggtgataccagctggttcatctggtcttggcaagaaggcattcacaggaatgtaagtttggtgatttggattaaagagttttgaaggatggtttaagattgttttacttctttcatttggtcgattgtcactcctgacttgccccactggcttaatttcttttttaagttcccaatttgtatactctattagcaagcttttgaatttaatccatccaatttatgttaatctcttattaatttggatgttctctattttaattattttgctgtttttgttatattgtgattagtgcccgtgttcgattctggaagcattgttgatgtacatatactgtcagaaatgtttattatttattgcatttgtttttacgagtaatgcgactagcct

SEQ ID NO: 1064 - DNA, 749 bp, Papaver somniferum
tgattacagaccggagcatctgattaaggttttaatcatggcagaacagacggagaaggcttttcttaagcaacccaaggtatttatatgctcaaaagtatcaggaaagggcaagaggccagggaagggtggaaaccgtttctataagaacgttggattaggatttaagacacccagagaagcaattgaaggtacatatattgacaagaaatgtccatttactggcgatgtttctatcagaggccgtattctatctggtacctgtcacagtgccaagatggtgaggaccattgttgtccgccgtaattacctgcactatgtcaagaaataccagagatatgagaagaggcattctaacatacctgcacatatttccccatgcttccgtgtcaaggaaggagatcacgttattattggtcaatgcagaccattgtcgaagacagtgaggtttaacgtattgaaggtcatcccagcagggtcttcaactggtagtggaaagaaggcctttacagcaatgtgaggtgtttttttcgtacttttttgacaaatcgcgagtgttacctataggttataaggagctgattagctagatattatggtttagttatgtcaaaacagtatccagtaaaaagtatctgtttggcgatcacattcttttgatcatatttttattttataagagagttctgttcgtgctatccttcacaatatcgttgttattttcttatatcatgaagcattttgggaaa

SEQ ID NO: 1065 - DNA, 772 bp, Chenopodium quinoa
gctttcaagctgtattaatattagggtttctgtgagtgtgccgtaacgattttctctctcctcggaaagcttctgcaaaaccctaacaatggcggaacagacggagaaggcttttttgaagcagcctaaggtgttcctttcgtcgaacaagtctggtaaaggaaagagacctggaaagggaggtaacaggttctggaagagcattggtttgggattcaagactcctcgtgatgccatcgaaggaacatacatcgacaagaaatgcccatttacaggcaacgtttctatcagaggtcgtatccttgctggtacctgccacagtgccaagatgcagcgaaccataattgttcgtcgcaactatcttcattatatcaagaagtaccaaagatatgagaagaggcactccaacatccctgcccatgtttcaccttgttttcgtgtgagggaaggtgaccatgtgatcattggccagtgcaggcctatctccaagacagtgagatttaatgtcttgaaggtcatccccgctggtgcagcgactggtggcaagaaggctttcactggactgtaaaccaaattttgatcacattctactctttagaagttgagaaagcagtcagaagaaaccttgttcatgtattatcttatgctcgtagaagtgtttctatgattgattttagagtatgtttttatcaactcagttccttaaatctgattttgtcagctaatttgttttcacatgttttataaattattggcacccttttttgcttgg

SEQ ID NO: 1066 - DNA, 837 bp, Rhizophora mangle
ggtgcctcagttacctgccgctcctcttccgagaaagcacagcttttcatcatggccgagcagacagagaaggcatttttgaagcaaccgaaagtgtttctttgctcgaaaacgtctgggaaggggaagaggcctggaaagggtggaaaccgctactggaagagcattggtcttggttttaagactcctagagatgccagcgagggaacatacattgataagaagtgccccttcactggaaatgtttcgattaggggtcgaattttagctggtacttgccacagtgccaagatgaataggaccattattgttcggcggaattatcttcattttgtgaagaaataccaaagatatgagaaaaggcattcaaatattcctgcacacgtatcccaatgcttccgtgtgaaggagggggatcatgttatcatcgggcaatgcaggccactgtcaaagactgtgaggttcaatgtgttgaaagtgattcctgctggaacttctggtcgtgggaagaaggcatttactgggatatgagatctaatgtctggttttgttgggctggattattggcatgatgacttaagggatccggttatgtaactgaaaatttttgggagcttggaccagcatctagtttggcatttattgatgaatagaatttctttttcttccattcatactgttgatcagacaatgaagtcttaaagatgtgggtgctgttgctcttgacagaatttaagatgtaaacctttgggttctcatcgttttgcttgtgcaactgtgatgaacttggtcattggcaggttgtgtttctgtgatcagaccatggtttgtctgccg

SEQ ID NO: 1067 - DNA, 826 bp, Sciadopitys verticillata
ggtcactcgtagatagggtttggcagctcgtttcttctattcagggtcgaaggagggttagggtttcttacgtctcttgcagccatggcggaacagaccgagaaagcttttctgaagcagccgaaagtgttcctctgttcgaagaagtctggcaaaggaaagaggccaggaaagggaggaaataggttttggaagaatataggtctcgggttcaagacacctaaagaagctgttcaagggacttacattgacaagaaatgccctttcactggagatgtgtcgattagaggtcgtatattgactggaacatgctacagtgctaaaatgaaccgaacaatcattgttcggcgcaactatctccattttgtcaagaagtaccaaaggtatgagaagaggcattcgaacatacctgcgcatatttcaccctgtttccgtgtcaaggaaggtgatcatgttataattgggcagtgcaggcccttgtccaagaccgtaagattcaatgtcttgaaagtgattccggcaggttctagcagtgggagtgctaagaagggcttcgcagcaatataatggacgcatgcaaaaaattagggaatacttccgaattttattaagctgagacactggtttttagtttgttatatattgcctaatttacttaattgttttaatttcattttcattgtgtgttgagcaagcattcaatactctgcaacatacttatggcaatatgccattaataactttaacaaattttgaaattgaggcacactcatttttctattcctgggttttgtgggggaacagactccctacagttttctgtgat

SEQ ID NO: 1068 - DNA, 756 bp, Tragopogon dubius
ggggagggtttacttctgccttccatttttcattctgtgcctccgcaactgaaaggctcggatctcttcaacaatggccgaacagaccgagaaggcgtttttgaagcaacccaaggtttttctatgttcgaagaaaagcggaaaaggtaagaggcctggaaagggtggaaacagattctggaagagcattggactcggatttaagacaccacgagaagctatcgatggtacttacattgacaagaagtgccctttcactggtgatgtctccattagaggccgtattatttctggtacatgccacagtgccaaaatggtgaggaccataatcgttcgcagggactacttccattttgtcaagaaataccaaagatatgagaagaggcatagtaacattccagcccacatttctccttgtttccgtgtgagagaaggcgaccatatcactgttggccagtgcagaccgttgtcgaagactgtgaggttcaatgtgttgaaggtgactccagctggatctactggtggtggaaagaaggcatttacagggttttaagaagcttatcttcttttgcttcttaggttttgcaaagacagttgaatttggtatgctgattttgaagtgaaatttggttcatttacccgctttgtttaatgtttctgtagacataattgtttggtttaggttctatttacttttgatgttcacaaatatggtatgcttgtaacaattaaaaatactaaattttgatttgatac

SEQ ID NO: 1069 - DNA, 794 bp, Citrullus lanatus
gtctcaaagcattttcctcactctctgctgcctctagggtttttactttgcatcggactctgcggcttaggtttctatcggatcttcgaaaccctaacaatggcggaacagacggagaaggcttttctgaagcagcccaaggtgtttctttgctcgaagaaatcggggaaaggaaagaggccaggaaaaggaggaaatcggttttggaagagcattggtttgggattcaaaactccgagagatgcaattgaaggaacctatattgacaagaagtgtccattcaccggcactgtttctattagggggcgtatacttgctggtacctgccacagcgccaagatggtgagaaccatcattgtaagacgtaattatcttcattatgtgaagaaatatcaaaggtatgaaaagagacactctaacattccagcacatatagctccttgctttagggttaaagagggagaccatgttatcattggccagtgcaggccgttgtctaagactgtgaggtttaatgtattgaaagtgattcctgcggctttcacagggatttaagtccagaattttcaggtgtcccatatttgtctatgtcaaggggatgatatgttagcatgagcttttcttcagctagatgatcttttcactttatttattaaccgaatatttcattattgtgatactattgcaattttgattccctaagttttgctttattcatcagtaacagtaccttccttgttcttggtttatccaatcatattttctgcttatcgtaatcaatgatggtttccaac

SEQ ID NO: 1070 - DNA, 732 bp, Zostera marina
tttattatcattgtttctcctgccgccgccgccgctgctgttacctgttcttctcttctcgcttttgtatccagtcgaccatggcagatcagacagagaaggcttttctcaaacaacccaaggtgttcctaagctctaagaaatctggaaaggcaaggaagcccggtaagggaggaaatagattctggaaaagcattggtctcggattcaagactcccaaatccgccattgagggacactacatcgataagaaatgtcctttcaccggaactgtttctatcaggggacgaatcataactggaacctgtcatagtgcaaagatgaatagaacaatcgttgtgaggcgaaattatcttcattttgttaagaagtatcagagatatgagaaaaggcactctaatatccctgctcacatatccccttgtttccgggccaaggagggtgaccacatcatcattggacaatgtagaccattgtcgaaaactgtgagattcaatgttttgaaggtgatcccagctggttcaactggtgtagggaagaaagctttcacagcaatatagaagagagcttttttttgggttagaacttgttattttcacttttgacatgtttaaaaaaagtcaattcagtattgttgttttgagttattcactacatttattttgtttgttattttcttcctgaaccttagatcatgttttatttattattgaaatcttgcacttttttgtt

SEQ ID NO: 1071 - DNA, 738 bp, Festuca arundinacea
agtggtatcaacgcagagtacggggggctctttgaagcctcagctctctgcttccgcatctccccgcgcgccgccgccaccacctcgccgctcgaagaccgcagcgcagccatggcggagcagaccgagaagtctttcctcaagcagccgaagatcttcctcagcacaaagaaggctgacaaggctaagaggccaggcaaggctggcaaccgcttctggaagagtgttggccttggctttaagaccccaagggaagcgatcgaaggtacctacattgacaagaagtgccccttcactggaactgttgccatcaggggcagaatcatcgctggaacatgccacagcgccaagatgaacaggaccatcattgtgcgcaggaactacctccattacgtcaaaagtatcagaggtacgagaagaggcactcaaacattccggctcacatctccccttgcttccgtatcaaggaaggcgaccatgttatcattggccagtgcaggcccctgtctaaaaccgtgaggttcaacgtgctgaaggtgattccagctggcaccaccggtggtgggaagaaggctttcatcgctgcttaagcctagactctgattcatgagtagttcatagtcagaagttttcgcacttaaaaagacctagcagtcatgtgttttggtatttgattccatattttctgtcaaactgaagtctctcgacatatgaacgtgtttgtggaatctatctatc

SEQ ID NO: 1072 - DNA, 744 bp, Festuca arundinacea
agtggtatcaacgcagagtacggggggctcttcgaagcctcagctctctcagcttccgcatctccccgcgcgccgccgccacctcgccgctcgaagaccgcagcgcagccatggcggagcagaccgagaagtctttcctcaagcagccgaaggtcttcctcagcacaaagaaggctgacaaggctaagaggccaggcaaggctggcaaccgcttctggaagaatgttggccttggcttcaagaccccaagggaagcgatcgaaggtacttacattgacaagaagtgcccttcactggaactgttgccatcaggggcagaatcatcgctggaacatgccacagcgccaagatgaacaggaccatcattgtccgcaggaactatcttcactatgtgaagaaataccagaggtatgagaagaggcactcaaacattccggctcacatctccccatgcttccgtatcaaggaaggcgaccatgtcatcattggccagtgcaggcccctgtcgaaaactgtgagattcaacgttctgaaggttattccagcgggaacaactggcagtgggaagaaggctttcatcgctgcctgagcctagactctgattcatgagtagttcatagtcagaagtttttcgtactgaaaaaagacctaccaggccggtgttttggtatttgatcccatattttctgtcaaactgaagtctctgtcatatgaacgtgtttgtggaatctatctatcattaag

SEQ ID NO: 1073 - DNA, 749 bp, Secale cereale
cgcctccgagccgctcgaagcccacctcgtagccatggcggagcagaccgagaagtctttcctcaagcagccaaaggttttcctcagcaccaaaaaggctgacaaggccaagaggcccggcaaggctggcaaccgcttctggaagagtgttggccttggtttcaagaccccaagggaagcgatcgatggtacctacattgacaagaagtgcccattcactggaactgttgccatcaggggcagaatcatagctggaacctgccacagtgccaagatgaacaggaccatcattgttcgcaggaactaccttcattttgtgaagaagtatcagaggtatgagaagaggcactccaacatcccagctcacactctcccctcgcttccgtgtcaaggaaggcgaccatgtcatcattggccagtgcaggcccctgtcgaaaaccgtgagattcaatgtcctgaaggtcgttccagctggaaccactggaggcgggaagaaggctttcattgcagcttaagaccaaactctgattcatgagtagttcatagtcagaactttttcgcacttgaaatctaccagtctgctgtttgagatttgattcccgtgttttctgtcaaaccgaatgtcgtgatctgaacatgttttgtggaatctatctatcattaatagtttcgcttaaatttgtactgcatgattgtccttctgctcaattcctggtgaatttgtttgcccagatgtgatatgatattta

SEQ ID NO: 1074 - DNA, 905 bp, Sarracenia psittacina
gggtcagtacatgacacttatcttaactggctgctctaaatccctgcagcatttagggttttgccgagcctcttctgcatctcctcgtccttcatcttcttccgcaactctccatagccctcaatcatggcggagcagacggagaaagcgttcttgaagcagccgaaggtgttcctatgctcgaagaaatcaggaagggaaagaggccgggaagggagggaatcggtactggaagagcgttggcttggggttcaagactcccagagacgccattgatggaacctatattgacaagaaatgtccattcactggcaatgtttctatcaggggtcgaatacttgctggaacctgccacagtgccaagatggtgcgaaccatcattgttcgacgcaactaccttcattttgtcaagaaataccagaggtatgaaaagagacattcaaatattccagctcacatatccccttgcttccgtgtgaaagagggagaccatgttattattggccagtgcaggccattgtcaaagactgtgaggtttaatgtgttaaaagttattccagctggttcttctggtggtggtgggaagaaggcatttacggcaatataatgcgagtttagaggctcaattttttctccgagtgtgatatgatgttgggtggacaatagattgtgctacttcagttataagcttttcatttggtactttctttgaattttcatgtgaccaaattacgacgaatgagcttttttagttcttccaatttgtgcaattgaactttgggtattcatgctgtgaaattgttcctattcccaggtagtagtaagtggttcaccagcttgagattttactcaacatatatgcatttgtatggaattattaaatgtttcaagaaaagcatttggag

SEQ ID NO: 1075 - DNA, 646 bp, Echinochloa colona
gagaaggctttcctcaagcagcctaaggttttcctcagcacaaagaaatctggcaagggtaagaagccaggaaagggtggcaaccgcttctggaagagcattggccttggctttaagacccccagggaagccattgaaggtacctacattgacaagaagtgcccattcactggaactgtttctatcagaggcagaatcattgctggaacgtgccacagtgccaagatgaacagaaccattattgttcgcaggaactacctccactttgttaagaaataccagaggtatgagaagaggcactccaacattccagctcacatctccccatgcttccgtgtcaaggaaggggaccatgtcatcattggccagtgcaggcccctgtcaaaaactgtgaggttcaacgttgtgaaggtcattccagctggatccaccggtggtagcggcgggaagaaggccttcactgcggcctaagctttagactatgtcttatcagcagtctatagaatgatgtctttttgcttaaaatcgctgctagggtggtgttttggagattgttccctgtctgaatggagccccatcatctgaacatgttactctttatggaatcctgtcgtgcaaagttttgttatgatctgtattaggcggt

SEQ ID NO: 1076 - DNA, 892 bp, Pinus taeda
ttgtaacttctcaggtaggagcgggagcggccgaggccttcaaatgcgaagttagaagtcttgaattcctacagccatggcagaacagactgagagagcttttctaaagcaaccaaaagtctttctcagttctaagacgtctgggaaggggaaacgtcctggaaaaggtggcaacaggttttggaagaatgtgggtcttggctttaagacccccaaagaagctattcaagggacctacatcgacaagaagtgcccattcactggtactgtttcaataagaggtcgtatattagttggaacatgttacagtgctaaaatgacacggacaattattgtccgtagggactatctccattttgtcaagaaatatcagagatatgaaaagagacattcgaacataccagcccatatttcaccctgtttccgtgtcaaagaaggggatcatgttatcattgggcaatgcaggcccttgtccaagactgtaaggtttaatgttctgaaggtgattcctgcgggttctagcagtggttctacaaagaaagccttcattgcaatatgaatccgtttttttttttcttccattaagtttgatagagtgggcttcgacatagtcgagggttacttaccattttatcatttggtcaaattaattttgttagtttaatccttcttttggttactgtattgaattttgaaaaatatgtacggataacgtttactctttggtagttgaaagtccaccattattcgatacttttgttttggttttagcatccagtaaacctttgaaagcatattcttggaatacccatatatattccaatagccaagtatgacgatgtcatatttattttattatatatggcaaggagtttcgcttttaattatttct

SEQ ID NO: 1077 - DNA, 860 bp, Spinacia oleracea
gagcccaactcgatcgcattctttttaagctttgaagcatcgaaaactagggtttaagctctcctatccttcatcttctctcactctctcctacacggcgcctgggttgattctttcgaatctcgtcttgcaactactcaacaatggcggaacagactgagaaggctttcttgaagcagcctaaggtgtttttgagctcgaagaagactggaaagggaaagaggcctgggaaaggaggaaatcgtttctggaagagcattggtttgagctttaagactcccagagaagctattgaaggaacatacattgacaagaaatgtcccttcaccggttctgtttcaatcaggggacgtattttagctggtacttgccacagtgctaagatgcagagaactatcattgttcgcaggaactacctccattacatcaagaaataccaaaggtatgagaagagacactcaaacatccctgcacatgtgtcaccttgcttccgtgtcaaggaaggagaccatgttatcattggtcaatgcaggcctatctcaaagacagtgaggttcaatgtgttgaaggtgattccagctggagctgctgctggaggaaagaaggctttcgcaggactgtaaggtgttgtttggacagatattgtggtgtagctaggatctgttttggggcttgaaatttaatgatattttgcagacccttaaattttgatactcagtttttatgattactgaatactaactactccatgcttctttgttaaaaatcttgggaaatttagttcaaatatctttatattgtcaaatgttttgttttaggacctactgtacgttgttttgcaatattattactgcaatcac

SEQ ID NO: 1078 - DNA, 722 bp, Arabidopsis lyrata
atttcagtcatcgctgccgcactatcgtctcctacctcctttgccttgaagctttcacgcgggagctcaacatcagccatggcggaacagactgagaaagcttttcttaagcagcccaaggtcttccttagctcgaagaaatctggaaaagggaagcgacctgggaaaggtggaaaccgtttctggaagagcattggtttgggctttaagactcctcgtgaagccattgatggagcttacgttgacaagaaatgccccttcactggaactgtttccattagaggtcgtatcttagccggtacttgccacagtgccaaaatgcagaggaccattatcgtgcgaagggattaccttcactttgtgaagaagtatcagaggtatgagaagaggcattcgaacattcctgctcatgtatctccatgcttccgtgttaaggaaggagaccatatcatcattggccaatgcaggccattgtcgaagacagtgaggttcaatgtgttgaaggtgatacctgctgggtcttcttcttcttttggaaagaaggcattcactggaatgtaagcttaaactgttgctgttgatgttagtttatgtttctggatagagctgaattatgttttatggtgattttcttattgaatttttccagacatttaaattttgtttactttgctgaatcttcttcatcccaatctgtgatctctatttaagacctagagttt

SEQ ID NO: 1079 - DNA, 671 bp, Arabidopsis thaliana
gcctctcgcattttcttcatcctttttgcctcagagctccgtggagagcagcaatcagtagccatggctgagcagactgagaaagcttttcttaagcaacccaaggtcttccttagctcgaagatatctgggaaaggaaagagacctggtaaaggtggaaaccgtttctggaagaacattggtttgggtttcaagactcctcgtgaagccattgatggagcttacattgacagtaaatgtccattcactggaaccgtttctatcagaggacgtatcttagctggtacttgccacagtgccaagatgcagagaaccatcattgttcgtaggaattaccttcactttgtgaagaagtatcaacgatatgagaagagacattccaacatccctgcccatgtctcaccgtgtttccgtgtcaaggaaggtgaccatgtcatcattggccaatgcaggccgttgtcgaagacggttaggttcaatgtgctgaaggtgattccagcgggtgcatctgcctttggtaaaaaggccttcactggagtgtaagagttttgaaagtcatgggagattttggtttgattttgatttcggaatgttttaatgttttgtttaaagatcccttttgttggagactttgattatcacagacgaaatacaaatctacgcactttcgt

SEQ ID NO: 1080 - DNA, 559 bp, Arnica chamissonis
gaaaaggcttttctgaagcaaccgaaggtgtttctctgctcgaagaaaagtggcaaagggaagaggcctggaaaaggtggaaacaggttctggaagagtgttggtctcggatttaagacaccacgagaggctattgaaggaacttacattgacaagaaatgccctttcactggtgatgtatccattcgaggccgtattttagccgggacttgcaatagtgctaagatggttaggactattatcgttcgaagggactatcttcattatgtcaagaaatatcagagatacgaaaaaaggcactcgaacattcctgctcacatctccccatgcttccgtgtgaaggaaggcgaccgtgtgaccattgggcagtgcagaccattatcaaagacagttaggttcaatgtgctgaaggtgattcccgcgggatcttcaggcggtggcaagaaagcatttacaggcatataatcagtacatgccttggctcttttgcttgataatgtagaagtttttgagaacaaaacgttgctctattgagattattatgctgtttttgacttat

SEQ ID NO: 1081 - DNA, 595 bp, Brassica juncea
gctttagccgtctctgcctctcctgtcgtctacaagctttcacaaaacagcagccatggccgaacagactgagaaggcttttctaaagcaacctaaggtcttccttagctcgaagatatctggaaagggaaagcgacctggtaagggtggaaaccggttctcgaagaacatcggtttgggcttcaagactcctcgtgaagccatcgaaggaacttatattgacagaaaatgtcccttcaccggaactgtctccattagaggtcgtatcttagccggtacttgccacagtgccaagatgcagaggaccattatcgtgagaaggaactaccttcactttgtcaagaagtatcagaggtacgagaagaggcattcgaacatccctgctcatgtctcaccatgcttccgtgtcaaggaaggagaccatgtcatcatcggccaatgcaggccattgtccaagactgtgaggttcaatgtgttgaaggtgattccagctggtgcttctgctttcgcaaagaaggctttcactggaatgtaacaagggggcttttcatgttagtttatgtttttggatgctattcctcttttatctatggag

SEQ ID NO: 1082 - DNA, 694 bp, Brassica juncea
ggagagcagcggcagcaggagcagtagcaaccagtagccatggcggaacagactgagaaggcatttctgaagcaaccaaaggtattcctaagctcaaagaaatcagggaaaggaaagaggcctggaaaaggtggaaaccgtttctggaagaacattggtctgggtttcaagactccccgcgaagccattgacggacattacatcgacaagaaatgtccattcactggaactgtgtctgtaagaggtcgtatcttagctggtacttgccacagtgccaagatgcagagaaccatcattgttcgcagaaactatctccacttcgtcaagaagtatcaaagatacgagaagagacattccaacatcccagcccatgtctcaccctgcttccgtgtcaaagaaggtgaccatgtcatcattggccaatgcaggccattgtccaagactgtaaggttcaatgtgctgaaggtgatcccagcaggcgcatctgcctttgcaaagaaggccttcactggaatgtaatagtttcttgaaaccactgagagttttcttcgtttggtttttattttgcgaaatgtttttgtttgttgatcccttttgtgtgagacttggtttatccgcagactgaatagaaacaactacgtactactttcgtcagttctgttacttctctatttggtatctctagaagaaatca

SEQ ID NO: 1083 - DNA, 774 bp, Brassica juncea
agcagcagcagcaaccagtagccatggctgaacagacagagaaagcttttctgaagcaaccaaaggttttcctaagctccaagaaatctggtaaaggaaagagacctggcaaaggtggaaaccgtttctggaagaacattggtttgggtttcaagactccccgcgaagccattgatggaacttacattgacagaaagtgtccattcactggaactgtttctgtaagaggtcgtatcttagctggtacttgccatagtgccaagatgcagagaaccatcatcgttcgcaggaactacctccacttcgtcaagaagtatcaaaggtatgagaagagacactccaatattccagcccatgtctcaccctgcttccgtgtcaaagaaggtgatcatgtcatcattggccagtgcaggccattgtcaaagaccgtgaggttcaatgtgcttaaggtgatcccagcaggcgcatctgccttttcaaagaaggcattcactggaatgtaagggcttttgcaagttatggagattttactttgcttggttttgatgttgtaatgttttgttggaggctttgatatgccatagacttgatagaactctacctactttggttatctgaaattcctacgttcatctagtttgtctttcgtatctctagatatcaactacttttgtctacttgggtgaagactagagagtaaaagatagttcctttatttgtgttttcccttgaatgataatttaaaataaaagaactatcttttactctctagtc

SEQ ID NO: 1084 - DNA, 704 bp, Fagus grandifolia
ctggaccttggctgtcactcagttgagggttttgtagcagcaaactcttctattctacttgtcgcctcctttgcagcttgaattccttgagagcctccaatcatggctgaacagactgagaaggcatttctgaagcaaccgaaagtgtttatatgctcgaagaaaactgggaagggaaagaggcctggcaagggtggaaaccgtttctggaagagcattggcctcaatttcaagacccccaaagaagccatcaatggaacctacattgataagaaatgccccttcgctggcaatgtttccatcaggggccgtatcataactggctattgccatagtgctaagatggtgaggaccattattgttcgtagagactatcttcattttgtcaagaagtaccaaagatatgagaagaggcactcaaacattcctgcacacttatccccatgcttccgtgtgaaggaaggagatcatgtcgttatcggccaatgcaggccactgtcaaagactgtgaggttcaatgtgctgaaagttgttccggctggatcttctggtgggaagaaggcttttacaggaatgtgaggggattttcagttagtctggttatattaattttgtggtttatgtgagctagtcgtgtaaaagaagactcttgaagtagagaacagcatattgattgggtgaacctcgacttttaaatgctgcac

SEQ ID NO: 1085 - DNA, 704 bp, Beta vulgaris
gtaatattatctctctcctctaagagcttcaccaaaccctagcaaattagcaatggcggaacagactgagaaggcctttttgaagcagccaaagttgttcctttcttcgaagaagacagggaaaggaaagagaccaggaaaaggaggcaacagattctggaagagtattggattagggtttaagactcctcgtgatgccattgaaggaacatacattgacaagaaatgcccctttaccggctctgtttctatcagaggccgtattctagctggtacctgccacagtgctaagatgcaaagaaccatcattgttcgccgcaattacctgcactatatcaagaagtatcaaaggtatgagaaaaggcactctaacattccagcccacgtatcaccttgtttccgtgtgaaggagggtgaccatgtgatcattggccagtgcaggccgatttcaaagacagtgagattcaatgtattgaaggttatcccagctggagcagccactggtggcaagaaggccttcactggaatgtaaacctgattttggctccttcctacttctgagaatttataaaagcagtcagatgaaaccattttaatgtaattttcatatatgcttgtaggattgtttctatgattggtttttaggatttctttttgtcaactcagttgctaaattttgatactaccggcctactttcatttca

SEQ ID NO: 1086 - DNA, 691 bp, Cleome spinosa
tcggggccactcgctgcctttgtgtcgcatctctcgttcttctaagcctcaagcttcacccgagagcaaccagccatggccgagcagaccgagaaggctttcttgaagcaacccaaggttttcctatgctcgaagaaaaccgggaaggggaagagacccggaaagggtggaaaccgcttctggaaaaatgtcggcctaggtttcaagacccctcgtgaggccactgaaggaacattcattgacaagaagtgcccattcactggacctgtttcggttagaggccgtatcttggccggtacttgccacagcgccaagatgcagaggaccatcattgtccggaggaattaccttcactttgtgaggaaataccagaggtatgagaagaggcactccaacatccctgcccacgtctctccgtgcttccgtgtcaaggaaggagaccatgtcatcgtcggccaatgcaggccattgtcaaagacggttaggttcaatgtgctgaaggtgatcccggccggttcatctgctggtggaaagaaggcgtttaccgggatgtaagagttcggttcaagtagagtgctttggacagagctgaatgcaattcttcttctagtattgttttaagttttgtataagacaaccatttttttaattgttttgtctgcacccattttgttttaattcgtgaagttgg

SEQ ID NO: 1087 - DNA, 765 bp, Mesembryanthemum crystallinum
ctcctagttctacaggcatccgcacgagggtttttagagcacaagccgaaatctctccatctctctcttccctcaagctctcctccaaaccctaacaatggcggaacagactgagaaggcttttctgaagcagccaaaggttttcctttcctcgaagaagactggaaagggaaagaggcctggaaagggtggcaacaggttctttaagaacattggtttgggattcaagactccccgagaagccatcgaagggacttacattgacaagaaatgccctttcactggcaatgtctctatcagaggccgtatccttgctggtacgtgccacagcgcgaagatgcaaagaacaatcattgttcgtcgtaactaccttcattacatcaagaagtaccaaagatatgagaagaggcactccaatatagccgcacacgtttcacccgccttccgtgtgaaggaaggagatcatgtcatcattggccagtgcaggcccctgtcaaagactgtgaggtttaatgtcttgaaggttattccagcaggatcttcagctgccgctgggaaaaaggcttttaccggcatgtgaagtagcattctcactcatatcagtattctacttcttcaatagctgaaacagtcagatgatgcctttcatttttggttatatatgctcttagaggatgtttgtactggcagattagtatttatctttttggttggtcagatcctaattttggtatttgagagtaatgatgtttcaaactatcagtt

SEQ ID NO: 1088 - DNA, 761 bp, Ipomoea batatas
gccgggggttgtatcgctctggttttgagttgccggctacccttctccctttaccctcgaaacctttactggacttggtagcttcagaatggcagaacagaccgagaaggctttcttgaaacagcctggagtgtttctcagctcgaagaagactggaaaaggaaaacggcccgggaagggaggaaatcgctactggaagagtatcgggctagggttcaagactccacgtgaggctactgaaggggcctatattgataagaagtgtccattcaccggcactgtttctattagaggtagaatccttgctggcacatgccacagtgcaaagatgacaagaactatcattgttcgccgcaactacctccattttgtcaagaagtatcagagatatgagaagcgacactctaacattgctgctcacgcttctccatgcttccgagtgaaagagggagatcatgttatcattggccagtgcaggccgctgtccaaaacagtgaggttcaacgtgttgaaggttattcctgcagggtcaggtggagggaaaaaggccttcactgggatgtaaacttgtttctctgtagtattgttaaagtattagaagaatgcttggtatttagactatgcaaaactgtgagtcagttttctctatgtacttgccatggaaggcttaaatttttgtgctacttttttttgtttgttttatatactcaagtgttttcatgacactaagcttcagtaaaaattggttgaaatccttctct

SEQ ID NO: 1089 - DNA, 646 bp, Jatropha curcas
gccgaacagaaccgagaaagcatttttgaaacagcccaaggtgttcctgagctcaaagaagttagggaaaggaaagaggcctggaaagggaggcaatcggttttggaagagcattggcttaggtttcaagacacccagagaggcaattgaaggaacttatattgataagaagtgcccatttactggtactgtttctgtcagaggacgaatacttgctggaacttgccacagcgcaaagatgatgcggaccattattgtccgacgcaattatcttcattttatcaaaaaatatcagagatatgagaagcggcactctaatattccagcacacatttctccatgcttccgtgtgaaagaaggggaccatgttattattggtcaatgcagacctctgtctaagacagtgaggttcaatgttctaaaattgattccagctggttcatctggtggtggaaagaaggcattcacagggttgtgagtttcttagggcttagagttcttttgattagtttctgtgagggagaatgacttgagatttgagttgtcttacctaattagcaattgtttcaattttgggccccttggtgtttaaatctctgtatgaccatataattccgtggaaaatgtttgttctaaatgtgctctc

SEQ ID NO: 1090 - DNA, 760 bp, Tropaeolum majus
tactcagcggccgggggttcgcgattagggttttcttgattctggtggaactatattctcagtttactcgttccatctcaagtcttcaagcatggcggaacagacagagaaagctttcctgaagcagcctaaggtgtttcttagctctaagaaaaccgggaaagggaagcgacctggaaagggtggaaaccgtttctggaagaacattggtttgggttttaagactccaagagatgcgatcgaaggaacatacattgacaagaaatgcccattcactggtaatgtttccatcagaggccgcatcttggcaggcacttgtcacagttctaaaatgatgagaaccatcattgtccgaagaaattacctccattttgtgaagaaataccagaggtatgagaagagacactccaacaccccagcacatgtttccccatgcttccgtgtgaaggaaggcgatcatgttatcattgggcaatgcaggccgttgtcgaagaccgtgaggttcaacactttgaaggttattccagcaggatcatccgcagctgggaagaaggcatttacaggcatgtaaaagcttaggtcatgacagtttaacgccaatgaagttaaaagtttttaatgtctttataatttagatcttaaagaactccagtaagaaatctttgtcattacaattttggatacttgtcatttttgagttgctaaaacatatggatcaattgagtagattaatgtctttctcagtatttagaatttcgca

SEQ ID NO: 1091 - DNA, 813 bp, Primula obconica
ggccattacggcaaagctctgtgttttagggtttctgcgaatcgtccctttcactttctcactcctccgacctcagccatggccgaacagactgagaaggcttttctaaagcagcccaatgtcttcctttgctcaaagaaatcagggaagggaaagagaccgggaaagggaggaaatcgttacgtcaagaacattggattagggttcaaaactcccagagatgcttctgaaggcacttacattgacaagaaatgccctttcactggagatgtgtccatcaggggtcgtatacttgctggtacctgccacagtgcaaagatgatgagaactatcattgttcgacgtaactaccttcactatgttaaaaagtaccagaggtatgagaagaggcattcaaatattccagctcacatttccccctgttttcgtgtgaaggaaggagatcacgtcattattggccagtgcaggcctttgtcgaagacagtgaggtttaatgtgttgaaggttattccagctggttctgctgctggtggaaagaaagcatttgctgctgtttgagttttgtgctaatatttccgctagtagtgatatagtgtatggcgggttgcacttgtgcttatatttcgcttgacttagacggaacaattaaattcctttttatttttgaattctgaacattcaacattgtatgagattgattcatggttgtcatgatgagtttttgaagatttgaattcactgtttgggagtatggtatttgagtcattactttgtttttttttttttgcttcctggttgcattttgtggaaaat

SEQ ID NO: 1092 - DNA, 1344 bp, Chenopodium quinoa
ctttcaattataatgttctagaattcaaaaaaccctaagtttcttctctccttttctctcactttctcacctctgcggcgcctccattgcttcctctgaacctcatcttacaaccactcaatcatggcggaacagaccgagaaggcctttttgaagcagcctaaagtgtttctgagctcgaagaaaactggaaagggaaagcgacctgggaaaggaggaaacaggttctggaagagtattggtttgggtttcaagactcccagagaagctattgaaggagcttacattgacaagaaatgtcccttcaccggctctgtttcaatcaggggccgtattctagctggtacttgccacagtgctaagatgcagagaaccattattgttcgccgtaactaccttcattacatcaagaagtaccaaaggtacgagaagaggcattcaaacatccctgcacatgtgtcaccctgtttccgtgtcaaggaaggagaccatgttatcattggtcaatgcaggcctatctcaaagacagtgaggttcaatgtgttgaaggtgattccagctggagctgctgctggtggaaagaaggcttttgccggaatttaaggtgttttttttggatagatattgtgatgtagctaggatctatcacagggcttggaaattagtattgtttgcagacccttgaattttgatacttgaagcattttcatgattactgaatactatgtttcttttgttaaaatcatattgggaaattgtagtacaaacatctttatggtatcaaatgttttgtcttaggacctcccgcaagttttggcaatatagttgcaatgactccctttcaacttctccctcaccattttaagatgatggttcttttgggtttggattttaaatagctgaactctggaccccagttccccaaattgctgcatgttgggatttccttttcctttggtttggttgctacagtaatgttgtaatccttgcctgctgttgctgcatttgtgaatgaagttctacctttctgttctttgtgcacgagtttcggacttgaatgacatttagaaaaactctgcttacagaacttgcctgttgttacatttgtgttttaagtaccacctttctattctttgtgcacgagttctagacttgaacggtatgtagaagaactaagtttactaaacctgacctgaacctatttgttgttagcgtttggcttataaactagaactattgacaaaccagcagataaactagaactacaaatcaaccaaattttggagcagatgccttgacctaaatctcatttggtcaattcatctgacagctcaaatagctccg

SEQ ID NO: 1093 - DNA, 978 bp, Chenopodium quinoa
ctgctttcaagctgtattagtattagggtttctgtgagtgtgccgtaacgattttctctctcctcggaaagcttctgcaaaaccctaacaatggcggaacagacggagaaggcttttttgaagcagccgaaggtgttcctttcgtcgaacaagtctggcaaaggaaagagacctggaaagggaggtaacaggttctggaagagcattggtttgggattcaagactcctcgtgatgccatcgaaggaacatacatcgacaagaaatgcccatttacaggcaacgtttccatcagaggtcgtatccttgctggtacttgccacagtgccaagatgcagagaaccattattgttcgtcgcaactatcttcattatattaagaagtaccaaagatatgagaagaggcattccaacatccctgcccatgtttcaccttgttttcgtgtgagggaaggtgaccatgtgatcattggccagtgcaggcctatctccaagacagtgagatttaatgtcttgaaggtcatccctgctggtgcagctactggtggaaagaaggcttttgctggactgtaaaccaaattttgatcacattctactctttagaagttgagaaagcagtcagaagaaaccttgttcatgtattatcttatgctcgtagaagtgtttctatgattgattttagagtatgtgtttttatcaactcagttccttaaatctgattttgtcagctaatttgttttcacatggtttataaattattggcaccctttttgcttgagctttctcatcgtacttaaatttcagttgattggctaaactctggccgatagatctttagctggtataaggtgtatgaatattctactcgtgtctggtagttgttggttgacgcaacattcccaccttaaacaatttggttgcagttacattttgagacgttctgtcgatatatttttgggttgtattgttgtgagtttgtga

SEQ ID NO: 1094 - DNA, 767 bp, Raphanus sativus
gggcatctcttttacatctcattttgcctcaatccatcagtggagagcagcaggagcaggaggagcaactagtagccatggcggaacagactgagaaggcatttctaaagcagccaaaggtgttcctaagctcgaagaaatcagggaaaggaaagaggcctggcaaaggtggaaaccgtttctggaagaacattggtttgggtttcaagactccccgcgatgccattgaaggacattacattgacaagaaatgtccgttcactggaactgtttctgtgagaggacgtatcttagctggtacttgccacagtgccaagatgcagaggaccatcattgttcgcagaaactatctccactttgtcaagaagtatcaaagatacgagaagagacattccaacatccctgcgcatgtctcaccctgcttccgtgtcaaagaaggtgatcatgtcatcattggccaatgcaggccgttgtcaaagaccgtgaggttcaatgtgttgaaggtgatcccagccggcgcatctgcctttgcaaagaaggcattcactggaatgtaatagtttttgaagttatggagaagtttctttgtttcgtttttatgtttcagaatgttttgtttgttgatcaatccctcttgtgtgagacttggtttatccacagactgaatagaaacctacgtactactttcgtcatctgaagttactacattcgactgtgtctgtgacctctgtcttttggtatcgctagaagaaatcaagtactgtgtg

SEQ ID NO: 1095 - DNA, 680 bp, Raphanus sativus
acatctcattttgcctcaaatccatcggtggagagcagaagcagcaggaggagcaaccagtagccatggcggaacagactgagaaggcatttctaaagcaaccaaaggtgttcctaagctcgaagaaatcagggaaaggaaagaggcctggcaaaggtggaaaccgtttctggaagaacattggtttgggtttcaagactccccgcgatgccattgaaggacattacattgacaagaaatgtccgttcactggaactgtctctgtgagaggacgtatcttagctggtacttgccacagtgccaagatgcagagaaccatcattgttcgccgaaactatctccacttcgtcaagaagtatcaaagatacgagaagaggcattccaacatcccagcccatgtctcaccctgcttccgtgttaaagaaggcgatcatgtcatcattggccaatgcaggccgttgtcaaagaccgtgaggttcaatgtgttgaaggtgatcccagccggcgcatctgcctttgcaaagaaggcattcactggaatgtaatagtttttgaagttatggacaatttctctgtttcgtttttatgtttcagaatgttttgtttgttgatccttcttgtgtgagagacttggtttatccgcagactgaatagaaacctacgtactactttcttcatct

SEQ ID NO: 1096 - DNA, 664 bp, Raphanus sativus
tcaatcagcggagagcagcagcggcaggaggagcaaccagaagccatggcggaacagactgagaaggcatttctaaagcaaccaaaggtgttcctaagctcgaagaaatcagggaaaggaaagaggcctggcaaaggtggaaaccgtttctggaagaacattggtttgggtttcaagactccccgcgatgccattgaaggacattacattgacaagaaatgtccgttcactggaactgtgtctgtgagaggacgtattttagctggtacttgccacagtgccaagatgcagagaaccatcattgttcgcagaaactatctccacttcgtcaagaagtatcaaagatatgagaagaggcattccaacatccctgcccatgtctcaccctgcttccgtgtcaaagaaggcgatcatgtcatcattggccaatgcaggccgttgtcaaagaccgtgaggttcaatgtgctgaaggtgatcccagcaggcgcatctgcctttgcaaagaaggcattcactggaatgtaatagtttttgaagttatggagaaatttctttgtttcgtttttatgtttcagaatgttttgtttgttgatccttcttgtgtgagtgacttggtttatccgcagactgaatagaaacctacgtactactttcttcatttgaa

SEQ ID NO: 1097 - DNA, 750 bp, Rosa hybrid cultivar
atctttagggtttagagctttttctgccgccgcgcctgtgccgaagctcaccttcatctctccgatcccgataaatcaatcatggccgaacagaccgagagagcttttctgaagcagcccaaagtgttcttgagctcgaagaaaacaggcaagggtaagagacctggaaagggaggcaaccgatactggaagagcgtcgggctgggcttcaagactcccagggatgccattgaagggacttacattgataagaaatgcccattcactggaaatgtgtctatcaggggtcgtatcttagctggtacttgccacagtgctaagatgaataaaaccattattgttcgacggaattacctgcattatataaaaaaataccaaagatatgagaagaggcactctaacattgctgcacacgtgtctccatgcttccgtgtgaaagaaggggaccatgttatcatcgggcagtgcaggccattgtccaagactaagaggttcaatgtgctgaaggtgattcctgctggatcatctgctggtggcaaaaaggctttcactggaatttaagtctgattctcatggtagggtgatgttgtagatggtttagggtgaactgattatagacttgagaaggctattaattgtgctgcccgctttttcctcttaaaactttgatgtattctttagattttggagttttgaagatcctctggtatcaaactagcaatgttatctatttatctaagatcttattaa

SEQ ID NO: 1098 - DNA, 774 bp, Salvia sclarea
gactctcagctgctgcggactagggtttttgctgctaccgccctccacacacacacacgcacacacacactttgatagcacgcagccatggcggaacagaccgagaaggctttcttgaagcagcctaaggtgtttctttgctcgaagaagacagggaagggtaaggccccaggaaggggtggaagccgctactttaagagcattggactcggattcaagacaccgcgagaggcctctgaaggcacatacattgataagaagtgccccttcaccggtgatgtatccatccgagggcgtatccttgctggaacttgccgcagtgcaaaaatgatgagaaccatcattgagagacggaactatctgcactgggtgaagaagtaccaaaggtatgagaagaggcactccaacatcccagcgcacatttccccatgcttccgtgtgaaggaaggcgaccacgtcatcatcggtcaatgcaggccattgtcgaaaacagtgaggtttaatgttcttaaggtgattccagctggttcttctggtcagggaaagaaggcttttacagggatgtgagttaggcaacatgaagtttgctgctagttgttaaaactgttttggaaggatggattttgaatttctattgtttcagttggaactgttatcatcgacttctctttgacagttcaaaatcttgatattttcctaatgtttatctagttccatttttgtgatagttctcagattgagcttcagtgctgactacatatgatattaccaccc

SEQ ID NO: 1099 - DNA, 713 bp, Solanum phureja
tacgagcatctctcccgccttccgttgatcttcctttcaatcatggcggagcagacggagaaggcgtttttgaagcagccaggtgtgtttctaagctctaagaagaccgggaagggaaagagaccaggaaagggaggcaatcgatacttcaagagtatcggcttaggattcaagactcctcgtgaggctactgaaggtacgtatattgacaagaaatgcccattcactggcaatgtttcgatccgaggtcgtatccttgctggtacatgccacagtgctaagatgaacagaaccatcattgttcgacgtaattacctacattatgtcaagaattatttcagatatgagaagaggcactccaatattccagctcacatatcaccatgcttccgtgtgaaagagggagatcatgttactattgggcagtgcaggcctttatccaaaaccgtgaggttcaatgtcttaaaggtgattccagctggttctggtggtggcgggaaaaaagctttcaccgggatgtaatatttgtgcctccatttcaaattttgtttcttgtaggaatatgatgtcaagacttttttgccttttaccgagttattatcttcaaattttggaacttaatgctagtaagtttgtttattaagcctctgaactagcttatgtaatgttatttgattgaagaacctaatacaaaaaggatgtttggtgattta

SEQ ID NO: 1100 - DNA, 1174 bp, Picea glauca
aatgaaacaatcagaaaccccttttaagacaactcactagaaaccctagagatagcctatttatcaattagggtttcgactacaaaggaggattggaagaaaagttacaaagcgagggtactagggtttatagggattaaatagcagggcttctattttcttctcctttgttgaagaacttctcaggcaggagcgggagcggccggggcgttgaagatacgaaggtagaagttttgaattcctgcagccatggcggaacagaccgagagagcatttctaaagcaaccaaaagtctttctcagttctaagaagtctgggaaggggaaacgacctggaaaaggtggcaacaggttttttaagaatgttggccttggcttcaagacccccaaagaagcagttcaagggacctacattgacaagaagtgcccattcaccggtaatgtctcaataagaggtcgtatattagctggaacatgttacagtgctaaaatgacacggacaattattgtccgtagggactatctccattttgtcaagaaatatcagaggtatgagaagagacattcgaacataccagcccatatttcaccctgcttccgtgtcaaggaaggggatcatgttatcattgggcaatgcaggcccttgtccaagactgtaaggtttaatgttctgaaggtgattcctgcgggttctagcagtggttctgcaaagaaagccttcactgcaatatgaacctattttttctgaatttgtccaagcaaccatataatccatcaaatgcaacataataggcttttacggagatgatggtttactatttcatcatttctcaaattaattttgtcagtttaatcctttttctactatgttgaatgttgaaggatgtacggagcacgttgtttttagtcttggtagttgaaagtccaccgtttttgcatacttctgttttggttttagcatccagaaaacctttgaaggtataatccacggaatttatttttttccaatggccaaatatgaatgatgtcatatttagtttattatttatgctaaggggttttgcttttaattccttcattcttaataggtgacatttatgtgggttgactaaactgttgtctcagcgataatatatatttttatcaaaagaccaatatactttgaaacttttcca

SEQ ID NO: 1101 - DNA, 1258 bp, Picea glauca
tcaccaaacgcttcccaacgttgctttcatgcataaacccatacaaacttccgcaaaatgcaagtctacttttgtgaataaaaaagagtgcaaaccaatgaaacaatcagaaaccccttttaagacaactcactagaaaccctagagatagcctatttatcaattagggtttcgactacaaaggaggatcggaagaaaagttacaaagcgagggtactagggtttatagggattaaatagcagggcttctattttcttctcctttgttgaagaacttctcaggcaggagcgggagcggccggggcgttgaagatacgaagttagaagttttgaattcctgcagccatggcggaacagaccgagagagcatttctaaagcaaccaaaagtctttctcagttctaagaagtctgggaaggggaaacgacctggaaaaggtggcaacaggttttttaagaatgttggccttggcttcaagacccccaaagaagcagttcaagggacctacattgacaagaagtgcccattcaccggtaatgtctcaataagaggtcgtatattagctggaacatgttacagtgctaaaatgacacggacaattattgtccgtagggactatctccattttgtcaagaaatatcagaggtatgagaagagacattcgaacataccagcccatatttcaccctgcttccgtgtcaaggaaggggatcatgttatcattgggcaatgcaggcccttgtccaagactgtaaggtttaatgttctgaaggtgattcctgcgggttctagcagtggttctgcaaagaaagccttcactgcaatatgaacctattttttctgaatttgtccaagcaaccatataatccatcaaatgcaacataataggcttttacggagatgatggtttactatttcatcatttctcaaattaattttgtcagtttaatcctttttctactatgttgaatgttgaaggatgtacggagcacgttgtttttagtcttggtagttgaaagtccaccgtttttgcatacttctgttttggttttagcatccagaaaacctttgaaggtataatccacggaatttatttttttccaatgaccaaatatgaatgatgtcatatttagtttattatttatgctaaggggttttgcttttaattccttcattcttaataggtgacatttatgtgggttgactaaactgttgtctcagcgataatatatatttttatcaaaagaccaatatacttt

SEQ ID NO: 1102 - DNA, 1215 bp, Picea glauca
aaaagagtgcaaccaatgaacaatcagaaaccctttaagacaactcactagaacctagagatagcctatttatcaattagggtttcgactacaaaggaggattggaagaaaagttacaaagcgagggtactagggtttatagggattaaatagcagggcttctattttcttctcctttgttgaagaacttctcaggcaggagcgggagcggccggggcgttgaagatacgaaggtagaagttttgaattcctgcagccatggcggaacagaccgagagagcatttctaaagcaaccaaaagtctttctcagttctaagaagtctgggaaggggaaacgacctggaaaaggtggcaacaggttttttaagaatgttggccttggctttaagacccccaaagaagcagttcaagggacctacattgacaagaagtgcccattcaccggtaatgtctcaataagaggtcgtatattagctggaacatgttacagtgctaaaatgacacggacaattattgtccgtagggactatctccattttgtcaagaaatatcagaggtatgagaagagacattcgaacataccagcccatatttcaccctgcttccgtgtcaaggaaggggatcatgttatcattgggcaatgcaggcccttgtccaagactgtaaggtttaatgttctgaaggtgattcctgcgggttctagcagtggttctgcaaagaaagccttcactgcaatatgaacctattttttctgaatttgtccaagcaaaccatataatccatcaaatgcaacataataggcttttgcggagatgatggtttactatttcatcatttctcaaattaattttgtcagtttaatcctttttctactatgttgaatgttgaaggatgtacggagcacgttgtttttagtcttggtagttgaaagtccaccgtttttgcatacttctgttttggctttagcatctagaaaacctttgaaggtataatccacggaatttatttttttccaatgaccaaatatgaatgatgtcatatttagtttattatttatgctaagggttttgcttttaattccttcattcttaataggtgacatttatgtgggttgactaaactgttgtctcagcgataatatatatttttatcaaaagaccaatacacttgaaacttttccaacataactttgaatttaagaaagttgcctatgc

SEQ ID NO: 1103 - DNA, 655 bp, Thalictrum flavum
gagaaagcagcagcagcagtgttcatctacccattcccttttccctcaatcatctaaaacctttcaaacatggcagaacagactgagaaggcttttttgaagcaacccaaggtgtttttatgctcgaagaaatctgggaaggggaagaggcctggtaaaggtggaaaccgcttctttaagagcattggtttgggatttaagactccaagagaagccattgaagggacatacattgacaagaaatgcccatttactggcaatgtttctgtgaggggccgtattctgtctggtacctgtcacagtgccaagatggtgaggaccatcattgttcgaagaaactaccttcactttgttaagaaatatcaaaggtacgagaagaggcactctaacattccagcacatgtatcaccatgctttcgtgttaaggaaggagattatgttaccattgggcaatgcaggccattgtcaaaaacggtgaggtttaacgttttgaaggttattccagctggatcttctggtggatcggggaagaaggctttcctaggcgtttaggtttctttttatagttgtgcttgtcatgtgttagtctcgttgtctctggattgtgataagctttaaagtattttatttttgtcgttgaactgcattatgtaag

SEQ ID NO: 1104 - DNA, 686 bp, Thalictrum flavum
agggtttatagttgagaaagcagcagcagcagtgttcatctacccattcccttttccctcaatcatctaaaacctttcaaacatggcagaacagactgagaaggcttttttgaagcaacccaaggtgtttttatgttcgaagaagtctgggaagggtaagaggccaggaaaaggtggaaaccgcttctttaagagcattggtttgggatttaagactccaagagaagccattgaagggacatacattgacaagaaatgcccatttactggcaatgtttctgtgaggggccgtattctgtctggtacctgtcacagtgccaagatggtgaggaccatcattgttcgaagaaactaccttcactttgttaagaaatatcaaaggtatgaaaagaggcactctaacattccagcacacgtatcaccatgctttcgtgtcaaggaaggagattatgttaccattgggcaatgcaggccattgtcaaaaacggtgaggtttaacgttttgaaggttattccagctggatcttctggtggatctgggaagaaagctttcctaggtgtttaggcttcttttttatagttaagcatgtcatgtgttagtctctgtctgtggattgtgataaactttaaagtattttattgtgccttttgaactgcattatgttaagcaaaattttgtatctcaa

SEQ ID NO: 1105 - DNA, 723 bp, Eutrema halophilum
tttctcgaagcttaagccgtcgctgccgctctatcgtctcctacatcttcacttcaagctctaacgtgagagcaaaacagcagccatggcagaacagactgagaaggcatttctaaagcaacccaaggtcttccttagctcgaagaaatccggaaagggaaagagacctggaaagggtggaaaccgattctggaagaacattggtttgggatttaagactcctcgcgatgccattgaaggaacttacattgaccagaaatgtcccttcactggaattgtttcaatcagaggtcgtatcttagctggtacttgccacagtgccaaaatgcagaggaccattatcgtgcgaaggaactacctccactttgtgaagaagtatcagaggtatgagaagaggcattcgaacatcccagctcatgtctcaccgtgcttccgtgttaaggaaggtgaccatgtcatcatcggccaatgcaggcctttgtcgaagactgtgaggttcaatgtgttgaaggtgattccagctggtgcttctgcctttggaaagaaggctttcactggaatgtaaggaggggttttttgatgttagtttatgtttctggatagagctgaattctgttatttatggagatttttctattttaatgttttaatgcaccgattttgttttactttttgctgaaacttttcatcgcaatttgagaaatcgttatgtattagcctgag

SEQ ID NO: 1106 - DNA, 730 bp, Eutrema parvulum
tttctcgaagcttaagccgtcgctgccgctctatcgtctcctacatcttcacttcaagctctaacgtgagagcaaaacagcagccatggcagaacagactgagaaggcatttctaaagcaacccaaggtcttccttagctcgaagaaatccggaaagggaaagagacctggaaagggtggaaaccgattctggaagaacattggtttgggatttaagactcctcgcgatgccattgaaggaacttacattgaccagaaatgtcccttcactggaattgtttcaatcagaggtcgtatcttagctggtacttgccacagtgccaaaatgcagaggaccattatcgtgcggaggaactacctccactttgtgaagaagtatcagaggtatgagaagaggcattcgaacatcccagctcatgtctcaccgtgcttccgtgttaaggaaggtgaccatgtcatcatcggccaatgcaggcctttgtcgaagactgtgaggttcaatgtgttgaaggtgattccagctggtgcttctgcctttggaaagaaggctttcactggaatgtaaggaggggttttttgatgttagtttatgtttctggatagagctgaattctgttatttatggagatttttctatttttttaatgttttaatgcaccgattttgtttactttttgctgaaacttttcatcgcaatttgagaaatcgttttacaatatagcctgagttt

SEQ ID NO: 1107 - DNA, 733 bp, Eutrema parvulum
gcatctctttttacatcctttgcctcaaattcttcagcggagagcagcagcaacctaaccagtagctatggctgagcagactgagaaagcttttcttaagcaacccaaggtcttccttagctcgaagaaatccgggaaaggaaagagacctggaaaaggtggaaaccgtttctggaagaacattggtttgggtttcaagactcctcgtgacgccattgaaggaagttacattgacgggaaatgtccattcactggaactgtttctattagaggtcgtatcttagctggtacttgccacagtgccaagatgcagagaaccattatcgtccgcaggaactatctccattttgtgaagaagtatcaaagatatgagaagagacattctaatatccctgcccatgtctcaccgtgcttccgtgtcaaagaaggtgatcatgtcatcattggccaatgcaggcctttatctaagactgtgaggttcaatgtgctgaaggtgatccctgcaggcgcatctgcctttggaaagaaggcattcactggaatgtaagacttttcaagtttggagaattttcgtttgtttgattttgatttttgaatgttttgtttggtgatcccttttgttggagactttgattaccacagactaaatagagatctatgttctttcgtcatctgaaattactacattcaactgttttgtctttggtatctctagaaatcatctactttgtct

SEQ ID NO: 1108 - DNA, 764 bp, Eschscholzia californica
tacttctcttcgcatccaagcagttgcaatggctgaacagacggagaaagctttcctgaagcaacccaaggtgtttctttgctctaagaagagtggaaaggggaagagaccaggaaagggtggtaaccgcttctttaaaagcatcgggttgggattcaaaaccccaagagaagcaatcgaaggaacttacatcgataagaaatgtcccttcactggcacagtttctattaggggtcgtatcctcacaggtacttgccacagtgcaaagatggtgagaaccattattgtcaggaggaactatcttcactacgtgaagaaatatcaaagatatgagaagaggcattcaaacataccagcacatatatccccatgtttccgtgtgaaggaaggtgatcatgttacagtcggtcaatgcaggccgttgtcgaagacagtgaggttcaatgtttgaaggtcattccaggtggttcatctggtggtggcgggaagaaggctttcgttgccatgtaaaatgtttcttgcttggatttgcttccctggtaggaaaacttcgaacgtttgtgctttcagatcttatatagatgagcagacaatatggcttcatatattgcgatttcatgttctgatcttttttgtttgtttaaatctgtcatcactagttgggatattgttaaattttgatggaatgctaaattagataagattgtttactgtttattattattggttttgaagaagtagatcttgttttgtctgaaaaaaaa

SEQ ID NO: 1109 - DNA, 519 bp, Flaveria ramosissima
tgaacagacggagaaggcgttttgaagcaaccaaggtgttttatgttcgaagaagagtgggaaagggaagaggcctgggaagggtggaaacaggttctggaagagtattggtcttggcttcaagacaccaagagaggctattgaaggaacttacattgacaagaaatgccctttcactggtgatgtatctattagaggacgtattcttgctggcacatgccacagtgcaaaaatggttaggaccattattgttcgccgagactacctccattatgtcaaaaagtatcagcggtacgagaagaggcactcgaacattccagcacacatttctccatgctttcgtgtgaaagaaggtgatcatgtcaccattggacagtgcagaccattgtccaagacggtgaggttcaacgtgttgaaggtgattccagccggatcttccagtggggggaagaaggcgtttacaggcatttaaaaagcttatttctttatcttgttaggttttgcaaaaacacttcaatt

SEQ ID NO: 1110 - DNA, 621 bp, Avena sativa
ccatggcggagcagactgagaagtctttcctcaagcagccaaaggttttcctcagcacaaagaaggctgacaaggctaagcggccaggaaaggctggcaaccgcttctggaagagtgttggccttggcttcaagaccccaagggaagcgattgaaggtacctacatagacaagaagtgccctttcactggaactgttgccatcagggcagaatcatcgctggaacatgccacagcgaccaagatgaacaggaccatcattgtccgcaggaactacctccactttgtagaagaagtaccagaggtatgagaagaggcactccaacatcccggctcatatctccccgtgcttccgtatcaaggaaggtgaccatgtcatcattggccagtgcaggcccctgtcgaaaactgtgagattcaatgtcctgaaggtcattccagctggaactactggtggtgggaagaaagctttcatcgcagcctaagcctagattcatgagtagttcatagccagaagctttttgcactttaaggacctactgagctggtgttttggctcttgattccatattttctgtcaaactgaagtcttgtcatctgaacatgtttgtggaatctatcta

SEQ ID NO: 1111 - DNA, 1238 bp, Pseudotsuga menziesii
gtttaaatgtcacaggccatgtcgagagatcaattattaagatacatggtcgttgtagtatagttgtaagtattcccgcctgtcacgcgggtgacccgggctcgatccccggcaacggcgatatattttttttatatgccccatgcaaaccaaggtattctagcattaatttatgaatggaaggttcttctcccaattagggtttcgacttggcacgcccaacgcccaacgaccaattagggtttcgactacaaaggaggggctcttggtttcagttgttgtttggtttcagcaggagagggagcggccggggcacagaagatacgaatttagaattcttgaagtcctgcagccatggcagaacagactgagagagcatttctaaagcaaccaaaagtctttctcagttctaagaagtctgggaaggggaaacgacctggaaaagggggaaacaggttttggaagaatattggtcttggcttcaagacccccaaagaagcggttcaggggacttacatcgacaagaagtgcccattcactggtaatgtctcaataaggggtcgtatattagctggaacctgttacagtgctaaaatgaaccggacaattatagtccgtagggactatctccattttgtcaagaaatatcagaggtatgagaagagacattcgaacataccggcccatatttccccctgcttccgtatcaaggaaggggatcatgttatcattgggcaatgcaggcccttgtccaagactgttaggttcaatgttctgaaagtgattcctgcaggttcgagcagtggttctgcaaagaaagctttcactgcaatatgaacattgtttctgcatttgacctagcagccaattaatccttcaagtgcaatagagtaggcttggtcggcgatgatgattactatttcatcattgctcaacttaattttgtcagttttgatcctttttctttaccatgttgaatgttgaaggatggtacggagcaggatgttttagactttatagttggggaaggtccattgtattttgaatatttgaaaattgttttagtatccagcaaagcttttggaattattattttttcctatgtccgaatattaatggtgtctgtcatatttagtttatttatgagaagggtttatgcttttagtttcttctttctcagtcagtgacgatcatgtgggttgactgatgtgttgttttggctataataaatattgttt

SEQ ID NO: 1112 - DNA, 471 bp, Aquilegia formosa
acggagaaagcgttcttgaagcaaccaaaggtgtttatatgctccaagaaatccgggaaggggaagaggcctggaaagggtggaaaccgcttctttaagagcattggtttgggatttaagactccaagagaagccattgaagggacatatattgacaagaaatgcccatttactggcaatgtctctgtgaggggtcgtattctggctggtacttgtcacagtgccaagatggtgaggaccatcattgttcggcgaaactaccttcactatgtcaagaaataccaaagatatgagaagaggcactctaacatcccagcacacgtatcaccgtgctttcgtgtcaaggaaggagatcatgttatcattggtcaatgcaggccattgtccaaaacagtgaggttcaatgttttgaaagtgattcctgctggatcttctggtggatctgggaaaaaagctttcctaggtgtctag

SEQ ID NO: 1113 - DNA, 736 bp, Arabidopsis lyrata
atatgctaacaaagccgtgaagcgtgcgtcaggagatttcaaggtttagggtgtccgcaatttagccatggcggagcagacggagaaggcgtttcttaagcaaccaaaagttttcttaagctcaaagaaatctggtaaggaaaagaggcctggtaaaggaggtaatcgtttctggaagaacattggccttggtttcaaaactcctagagaggctattgaaggagcatacgttgacaagaaatgtccctttactggtacggtttcaatcagaggccgcatcttggcaggcacttgtcacagtgcaaagatgcagaggacgatcattgttcgtagggactatcttcactttgtgaagaagtatcaaagatatgagaaaagacactcaaacattcctgctcatgtttccccgtgcttccgtgtcaaagaaggagatcatgtgaccattgggcaatgcaggccactgtcaaagacggtgaggttcaacgtcttgaaggtcattccggctggaagctcttctattgggaagaaagcattcactggaatgtaaatgagattcagatctgttggaaaaaggtgctagctattctaagggcttagaatttttctactagagttatgacttgctttatttgatcaaaggaaaccggattttctctgtttcatttagtgattcaagtatcaagataagtctattttcgatgaaaagtgggattaggcttttgctatcttgatattt

SEQ ID NO: 1114 - DNA, 689 bp, Arabidopsis thaliana
tttcagtaatcgctgccgcactatcgtctcctacctcctttgcctacaagctttcacgcgggagctcaacatcagccatggcggaacagactgagaaagcttttcttaagcagcctaaggtcttccttagctcgaagaaatctggaaagggaaagagacctggaaaaggtggaaaccgtttctggaagaacattggtttgggcttcaagactcctcgtgaagccattgatggagcttacgttgacaagaaatgccccttcactggaactgtttccattagaggtcgtatcttagctggtacttgccatagtgccaaaatgcagaggaccattatcgtgcgaagggattaccttcactttgtgaagaagtatcagaggtatgagaagaggcattcaaacattccggctcatgtctcaccatgcttccgtgttaaggaaggagaccatatcatcattggccaatgcaggccattgtcgaagacagtgaggttcaatgtgttgaaggtgataccagctgggtcttcttcttcatttggaaagaaggcattcactggaatgtaagctgctgctgttgatgatgttagtttatgtttctggatagagctgaactattatgttttatggtgattttcttattgaatttttccagacattaaattttgttttactctgctgaatctttttcatccc

SEQ ID NO: 1115 - DNA, 766 bp, Brassica juncea
agcagcagcagcaggagcaggagcagcaaccagtagccatggcggaacagactgagaaggcatttctaaagcagccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaactgtctctgtgagaggacgtatcttagctggtacttgccacagtgccaagatgcagagaaccatcattgttcgccggaactatcttcacttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcgttttttatgtttcagaatgttttgtttgttgatcccttttttgtgagacttggtttgtaatactgcattctactgttctgtgacttctgtcttttgtcttttggtatctctagaagaaatcaagtactgtgtgtctgtgtctacttcttgattgatactagagcgtaaaagaaacaacccgagttggtatttagatagtatatgttgatga

SEQ ID NO: 1116 - DNA, 818 bp, Brassica juncea
cgagtttatcagtcgctctctttacctctttgcatccttttctgcatcttttcttcagcggagaacagcaaccagtagtcatggctgaacagactgagaaagctttcctcaagcaacccaaggtcttcctaagctcgaagaaatctgggaaaggaaagagacctggtaaaggtggaaaccgtttctggaagaacattggtttgggtttcaagactcctcgtgacgccattgatggaacttacattgacaggaaatgcccattcactggaactgtttcagtaagaggacgtatcttagctggtacttgccacagtgccaagatgcagcgaaccatcatcgttcgtaggaactatcttcatttcgtcaagaagtatcaaagatatgagaagagacattccaacatccctgcccatgtctcaccctgcttccgtgtcaaggaaggtgatcatgtcatcattggccaatgcaggccgttgtcaaagacggtgaggttcaatgtgctgaaggtgatcccagcaggcgcatctgcctttgcaaagaaggcattcactggaatgtaagagctttgaagttatggagatttaactttgcttggttttgatgttggaatgttttgtttggtgatctcctttttgttgtagtcccatagacttaatagacctactttgttttatctgaaattactacattcatctagtttgtctttggtatctctagacatcaactacttttgtctacttggtgaaaattgccactaaaaaagaatgcaactttcatatttatactcaaaagtagttggtatctctagacatcaacta

SEQ ID NO: 1117 - DNA, 682 bp, Brassica juncea
gaaagcttttagccgtcactgcctctcctatcgtctcctacatccttgcctcaagctttcacaaaacagcagccatggcagaacagactgagaaggcttttctcaagcaacctaaggtcttccttagctcgaagatatctggaaagggaaagcgacctggtaagggtggaaaccggttctcgaagaacatcggtttgggcttcaagactcctcgtgaagccattcaaggaacttacattgacagaaaatgtcctttcaccggaactgtctccattagaggtcgtatcttagccggtacttgccacagcgccaagatgcagaggaccatcatcgtgagaaggaactacctccactttgtcaagaagtatcagaggtacgagaagagacactcgaacatccctgctcatgtctcaccttgcttccgtgtcaaagaaggagaccatgtcatcatcggccaatgcaggcctttgtccaagactgtgaggttcaatgtgttgaaggtgataccagctggtgcttctgctttcgcaaagaaggctttcactggaatgtaacaagggggcttttcatgttagtttatgtttttggatgctattcctcttttatctatggagaatttgacatttgaattttcagatattaatgttttaatgcatcgattttgtttactttgctataccat

SEQ ID NO: 1118 - DNA, 1407 bp, Brassica oleracea
gtgacgattccattcatagggttttgatcgcgtcctttgaactccttttccatccattgaaactaaactacttacagatttgtagcattaaccatcttcttacttcctttagccacaatttatacttcaatgtgaagttatcttctgcgaggcggtgatatgcgggtataagaagatgtttctccaccgctgaggttagggtgaggccaggaatgtcaagcgatataaaatcgttcgtaaaaaaaatcgcaagcgagatggagggcggcagagaacgacggagtaagcggcagagagcaaccggagagcaactgattttgtttgagaagagaacatctcattttgcctcaatccatcagtggagagcaggagcaaccagtagccatggcggaacagactgagaaggcatttctaaagcagccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaactgtctctgtgagaggacgtatcttagctggtacttgccacagtgctaagatgcagagaacaatcattgttcgccggaactatctccacttcgtcaagaagtatcaaagatacgagaagaggcattccaacatccctgcccatgtctcaccctgcttccgtgttaaagaaggtgaccatgtcatcattggccaatgcaggcctttgtcaaagacggtgaggttcaatgtgctgaaggtgatcccagccggcgcatctgcctttgcgaagaaggcattcactggaatgtaatcgtttcgaagttatggagagtttctatgtttcagaatgttttgtttgttgatcccttttgtgtgagacttggtttgtccacagactgaatcctacgtactactttcgtcatctgaaaatactgcattctactgttctgtgacttctgtcttttgtcttttggtatctctagaagaaatcaagtacaaaaaaaagaaaaaaattgttcagaagcaacaaatgaatgtaatgtttccttccatctttccctctataacacaatcaatgttatagcttgctttgttgcttaacattttcattcatggttgctggctgactctatttcccggattgtggcaagcggaggaagtaacacagtctcttatgaagcccctgaggcagcggaaacatgatcaaatttgtaaaaaggaagaacaatatagcaacgtgtccaactttagtgaatgaaaatgtaatctccatggcaatgtcatcttcatgtactttgaatcttctctttggtttggtaaaagtgacgagtggtgtttttgttatcaaagctaa

SEQ ID NO: 1119 - DNA, 992 bp, Brassica oleracea
gtaactcaagatttaattaaggatgtgtgtggcatgttactagagcgagatagagggtggcagagaacgacggagtaagcggcagagagcaactgattttgtttgagaagagaacatctcattttgcctcaatccatcagtggagagcaggagcaaccagtagccatggcggaacagactgagaaggcatttctaaagcaaccaaaggtgttcctaagctcgaagaaatcagggaaaggaaagaggcctggtaaaggtggaaaccgtttctggaagaacattggtttgggtttcaagactcctcgtgacgccattgatggaacttacattgacaggaaatgtccattcactggaactgtttctgtaagaggacgtatcttagctggtacttgccacagtgccaagatgcagagaaccatcattgttcgccggaactatcttcacttcgtcaagaagtatcaaagatatgagaagagacattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcagaatgttttgtttgttgatcccttttttgtgagacttggtttgtccacagactgaatacaaacctgcgtactactttcttcatctgaaaatactgcattctactgttctgtgacttctgtcttttggtatctctagaagaaatcaagtacaaaaaaaaaagaaaagaactgttcagaagcaacaaatgaatcggaggaagtaacacaggctcttatgaagcccctgaggcagcggaaacatgatcaaagttgtaaaaaggaagaacaatatagcaatgtccccattttcagtgaatgaaaatgttatctc

SEQ ID NO: 1120 - DNA, 2134 bp, Brassica oleracea
aagattaatgttcgtgcatcaatgaatcaatgatatactaactttagaagaaaaaaacaaataatattttaatagaaaaacagtttcaaaaaaaaaaaacaaataaaataagaaagaaggcaagtcattttatgacaacgaggaacagaacatcactaccaaacaattccagctcagtttcttctctctcctctcattctctctcttaaatatcccaacttctggatcattcttgattctcttcagatatttttttgttctcttgtaatctttagttgttatacctgacgtcatatacgacatggccgaagaggaatctaagaaggtgacggagaacgttacaaccgtacctgaaccaactccaacagcgccagctccggtggataaaccccttgatgcggtggatgttgctccacaggagaagcctgtggctccaccaccagttcttccatctcctgcgccggtggaggagaagctagaggactccaaggctcttgttcccatcgttgcaaaagaagcaggggaagaaaagaaagaaggctcagttaatcgagatgctgtcctggctagagttgagacagagaagaggatgtcacttatcaaagcttgggaagaggctgagaagtgcaaagtggagaacaaagctgagaagaaactttcttcaattgggtcatgggagaacaacaagaaagcagctgttgaagctgagctcaagaaaatggaggaacaattggagaagaagaaggcagagtatgtggagctaatgaagaacaaaatagctcaaatccataaacaggcagaagagaagagggccatgatcgaagctagacgcggagaagaggttctcaaagccgaggaattagccgccaagtaccgtgctactggaactgctcccaaaaagctatttggatgcatgtgatatatcatttgtgaagatgtgaagctgcatctggtgttactgtaatgtttttatttgcattgtattatttaatgtggaaaacaaaccaaagaaagggtttcatttatacgtttgtagtttgcttaatgttggggtttaatattgcaacataggaagtcatgtatgggaaacgttacttatatattgatttggagtgcgtttgtatttctacagctttcatctgaaaggcttttcctttgaatttgtaccgtgcaataatgatatacagttttgcaaaatgtaacgtgctctagtttctagcccaaatatatatgggcttaagtcaaataaactactgacggcccattaaacaggaggcccaaataaaattagggttttgtcctgagctacactgccatctcttttacatctcatttcgcctcaatccagcaggagcagcaaccagtagccatggcggaacagactgagaaggcatttctaaagcagccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaactgtctctgtgagaggacgtatcttagctggtacttgccacagtgccaagatgcagagaaccatcattgttcgccggaactatctccacttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcgttttttatgtttcagaatgttttgtttgttgatccctttttgtgtgagacttggtttgtaatagaaacctacgtactactttcttcatctgaaaatactgcattctactgttctgtgacttctgtcttttggtatctctagaagaaatcaagtactgtgtgtctgtgtctacttcttgattgatactagagcgtaaaagaaacaacccgagttggtatttagatagtatatgttgatcaaatttttgg

SEQ ID NO: 1121 - DNA, 654 bp, Brassica oleracea
cgctgcctcgcctctcgcatctcttttacaacccttgcttcagcggagagcagcagcaaccagtagccatggctgaacagactgagaaggcttttcttaagcaaccaaaggttttcctaagctcgaagaaatctgggaaggggaagagacctggcaaaggtggaaaccgtttctggaagaacattggcttgagtttcaagactcctcgtgacgccattgacggaacttacattgataggaaatgtccattcactggaaccgtttctataaggggacgtatcttagctggtacttgccacagtgccaagatgcagagaaccatcattgttcgcaggaactatctccacttcgtcaagaagtatcaaaggtatgagaagagacactccaacatccctgcccacgtctcaccgtgcttccgtgtcaaagaaggtgatcatgtcatcattggccagtgcaggccgttgtcaaagacggtgaggttcaatgtgctgaaggtgatcccggcaggcgcatctgcctttgcaaagaaggcattcactggaatgtaagagctttgaagttatggagatttaactttgcttgttttgatgttggaatgttttgtttggtgatctccttttgttgtagtcccatagacttaatagacctactttg

SEQ ID NO: 1122 - DNA, 657 bp, Brassica oleracea
cgtcactgcctctcctatcgtctcctacatccttgcctcaagctttcacaaaacagcagccatggcagaacagactgagaaggcttttctcaagcaacctaaggtcttccttagctcgaagatatctggaaaaggaaagcgacctgggaagggtggtaaccggttctcgaagaacatcggtttgggcttcaagactcctcgtgaagccattcaaggaacttacattgacagaaaatgtcccttcaccggaactgtctccattagaggtcgtatcttagccggtacttgccacagcgccaagatgcagaggaccatcatcgtgagaaggaactacctccactttgtcaagaagtatcagaggtacgagaagagacactcgaacatccctgctcatgtctcaccatgcttccgtgtcaaagaaggagaccatgtcatcatcggccaatgcaggccattgtccaagactgtgaggttcaatgtgttgaaggtgataccagctggtgcttctgctttcgcaaagaaggctttcactggaatgtaacaagggggcttttcatgttagtttatgtttttggatgctattcctcttttatctatggagaatttgacatttgaattttcagatattaatgttttgatgctactcgattttgttta

SEQ ID NO: 1123 - DNA, 1192 bp, Brassica oleracea
ggtccttcggtaactcaagatttaattaaggatgtgtgtggcatgttactagagcgagatagagggtggcagagaacgacggagtaagcggcagagagcaaccggagagcaactgattttgtttgagaagagaacatctcattttgcctcaatccatcagtggagagcaggagcaaccagtagccatggcggaacagactgagaaggcatttctaaagcaaccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaactgtctctgtgagaggacgtatcttagctggtacttgccacagtgccaagatgcagagaaccatcattgttcgccggaactatctccacttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcagaatgttttgtttgttaatcccttttttgtgagacttggtttgtaatactgcattctactgttctgtgacttctgtcttttgtcttttggtatctctagaagaaatcaagtacaaaaaaaaagaaaagaactgttcagaagcaacaaatgaatgtaatgtttccttccctctttccctctataacacaatcaatgttatagcttgctttgttgcttaacattttcattcatggttgctggctgactctatttcccggattctggcaagcggaggaagtaacacaggctcttatgaagcccctaaggcagcggaaacatgatcaaagttgtaaaaaggaagaacaatatagcaatgtccccaattttagtgaatgaaaatgttatctccatggcaatgtcatcttcatgtactttgaatcttctctttggtttggtaaaagtgacgagtggtgtttttgttaccaaaactaattgtaatctccagctgttt

SEQ ID NO: 1124 - DNA, 832 bp, Brassica rapa
gatcttcgaaactagggttttgtctgaagcttcattgcctcgagtttatcagtcgctctctttacctctttgcatccttttctgcatcttttcttcagcggagaacagcaaccagtagccatggctgaacagactgagaaagctttcctcaagcaacccaaagtcttcctaagctcgaagaaatctgggaaaggaaagagacctggtaaaggtggaaaccgtttctggaagaacattggtttgggtttcaagactcctcgtgacgccattgatggaacttacattgacaggaaatgcccattcactggaactgtttcagtaagaggacgtatcttagctggtacttgccacagtgccaagatgcagagaaccatcatcgttcgcaggaactatctccatttcgtcaagaagtatcaaagatatgagaagagacattccaacatccctgcccatgtctcaccttgcttccgtgtcaaggaaggtgatcatgtcatcattggccaatgcaggccgttgtcaaagacggtgaggttcaatgtgctgaaggtgatcccagcaggtgcatctgcatttgcaaagaaggcattcactggaatgtaagagtttttttgaagctatggagggttttctttgtttggttttgatttttggaatgtgttgtttggtgtactggttctaaatgttttgtctttggtttggtacttatctctataagagtccattgcttagcttaatcttaaacaaggacagatattcaatgatttatcctaattgtttatgagttttgtatctaagtgatacatgttgatcaaatgaaaaacaagttggagga

SEQ ID NO: 1125 - DNA, 801 bp, Brassica rapa
actgcatctcttttacactcattttgcctcaatccatcatcagcggagagcagcagcagcaggagcaggagcaggagcagcaaccagtagccatggcggaacagactgagaaggcatttctaaagcagccaaaggttttcctaagctcgaagaaatcagggaaaggaaagaggcctggaaaaggtggtaaccgtttctggaagaacattggtttgggtttcaagactccccgcgacgccattgatggacattacattgacaagaaatgtccattcactggaactgtctctgtgagaggacgtatcttagctggtacttgccacagtgccaagatgcagagaaccatcattgttcgccggaactatcttcacttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcgttttttatgtttcagaatgttttgtttgttgatcccttttttgtgagacttggtttgtaatactgcattctactgttctgtgacttctgtcttttgtcttttggtatctctagaagaaatcaagtactgtgtgtctgtgtctacttcttgattgatactagagcgtaaaagaaacaacccgagttggtattt

SEQ ID NO: 1126 - DNA, 822 bp, Brassica rapa
ggcccaaacctaacgacaaagagatcttggggaactagggttttgtccggagagcttcattactttcagttcatcagtcgctgcctcgcctctcgcatctcttttacaacccttgcttcagcggagagcagcagcaaccagtagccatggctgaacagactgagaaggcttttcttaagcaaccaaaggttttcctaagctcgaagaaatctgggaaggggaagagacctggcaaaggtggaaaccgtttctggaagaacattggcttgagtttcaagactcctcgtgacgccattgacggaacttacattgataggaaatgtccattcactggaaccgtttctataaggggacgtatcttagctggtacttgccacagtgccaagatgcagagaaccatcattgttcgcaggaactatctccacttcgtcaagaagtatcaaaggtatgagaagagacactccaacatccctgcccacgtctcaccgtgcttccgtgtcaaagaaggtgatcatgtcatcattggccagtgcaggccattgtcaaagacggtgaggtttaatgtgctgaaggttatcccagcaggcgcgtctgcctttgcaaagaaggcattcactggaatgtaagagctttgaagtattgttactttggttttgattttggaatgtgttttgttggagtctttgattgccactgactttatagagatctacctaaaattactacattcatctgttttgtcttccgtttctccagaaaccaactatttatgtctacttgatcagaaaaaccttatgcagtagatcaaaatttgttatttat

SEQ ID NO: 1127 - DNA, 866 bp, Brassica rapa
atataaagactctttgtacactagggtttttctttcttaaagcttttagccgtcactgcctctcctatcgtctcctacatccttgcctcaagctttcacaaaacagcagccatggcagaacagactgagaaggcttttctcaagcaacctaaggtcttccttagctcgaagatatctggaaagggaaagcgacctggtaagggtggaaaccggttctcgaagaacatcggtttgggcttcaagactcctcgtgaagccattcaaggaacttacattgacagaaaatgtcccttcaccggaactgtctccattagaggtcgtatcttagccggtacttgccacagcgccaagatgcagaggaccatcatcgtgagaaggaactacctccactttgtcaagaagtatcagaggtacgagaagagacactcgaacatccctgctcatgtctcaccatgcttccgtgtcaaggaaggagaccatgtcatcatcggccaatgcaggcctttgtccaagactgtgaggttcaatgtgttgaaggtgataccagctggtgcttctgctttcgcaaagaaggctttcactggaatgtaacaagggggcttttcatgttagtttatgtttttggatgctattcctcttttatctatggagaatttgacatttgaattttcagatattaatgttttgatgctactcgattttgtttactttgctataccattttcaaccaaacttgagatctcgttttgaatatgtatttatttttctttatcagatccaaataccggttaaactgattggtccatccaaataccggtttgattccaaagatgttgcgacttttaggataaaataatatctttatt

SEQ ID NO: 1128 - DNA, 830 bp, Beta vulgaris
attaaaacttgcgtcgaaaactagggtttaagctgctccgtcccctctctttctctcttcctcggcgcctcctctatctcatcttacaaccactcaatcatggcggagcagactgagaaggcctttctgaagcagccaaaactgtttctgagctcgaagaaatctggaaaagggaagaggccaggaaaaggaggaaatcgtttctggaaaagcattggattgggattcaagactcctagagaagccattgaaggcgcatacattgacaagaaatgcccctttactggttctgtttcaatcaggggacgtattctagctggcacatgccacagtgctaaaatgcagagaaccatcattgtacgtcgtaactaccttcattacatcaagaagtaccaaaggtatgagaagaggcattcaaacatcgcggcacatgtatcaccctgcttccgtgtcaaggagggagaccatgtcatcattggtcaatgcaggcctctcgcaaagacagtgaggttcaacgtgttgaaggtgattcctgctggagctgctgctggtgggaagaaagctttcacaggaatttgaggtgttgttctttatagatatattgtcaggtagctaggatctatgtctttggaggcttagatatgggtgatgtttagcagaccctggaattttgatacttcaagagcatgttcaggattactgagtagttgagtactatatttttttttgttataatcatcagcggtaatagttgtagtaatttaaacattttcgcaatatcatgaatacgatggcatcctcgcatcttattcatgatattgcgaaaatgt

SEQ ID NO: 1129 - DNA, 698 bp, Brassica napus
gagcaggagcagcaaccagtagccatggcggaacagactgagaaggcatttctaaagcagccaaaggttttcctaagctcgaagaaatcagggaaaggaaagaggcctggaaaaggtggtaaccgtttctggaagaacattggtttgggtttcaagactccccgcgacgccattgatggacattacattgacaagaaatgtccattcactggaactgtctctgtgagaggacgtatcttagctggtacttgccacagtgccaagatgcagagaaccatcattgttcgccggaactatcttcacttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggcattcactggaatgtaataggttttttgaagttatggagagtttctatgtttcgttttttatgtttcagaatgttttgtttgttgatcccttttttgtgagacttggtttgtaatactgcattctactgttctgtgacttctgtcttttggtatctctagaagaaatcaagtactgtgtgtctgtgtctacttcttgattgatactagagc

SEQ ID NO: 1130 - DNA, 696 bp, Brassica napus
gcagcagcaaccagtagccatggcggaacagacggagaaggcatttctaaagcagccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaactgtctctgtgagaggacgtatcttagctggtacttgccacagtgctaagatgcagagaacaatcattgttcgccggaactatctccacttcgtcaagaagtatcaaagatacgagaagaggcattccaacatccctgcccatgtctcaccctgcttccgtgttaaagaaggtgaccatgtcatcattggccaatgcaggcctttgtcaaagacggtgaggttcaatgtgctgaaggtgatcccagccggcgcatctgcctttgcgaagaaggcattcactggaatgtaatcgtttcgaagttatggagagtcttcttttgtttggtttctgtatttcagaatatgttttgtttgttgatcccttttgtctgagacttggaatgtaatagaaacctacgtactactttcttcatctgaaattgctacattcgattactgtgtctttggtatctctagaagaaatcaactactgtgtgtcagtgtctc

SEQ ID NO: 1131 - DNA, 656 bp, Brassica napus
gagcagcagcaccaaccagtagccatggcggaacagacggagaaggcatttctaaagcagccaaaggttttcctaagctcgaagaaatcagggaaaggaaagaggcctggaaaaggtggaaaccgtttctggaagaacattggtttgggtttcaagactccccgcgacgccattgatggacattacattgacaagaaatgtccattcactggaaccgtctctgtgagaggacgtatcttagctggtacttgccacagtgccaagatgcagagaaccatcattgtccgcagaaactatctccatttcgtcaagaagtatcaaagatatgagaagaggcattccaacatccctgcccatgtctcaccctgcttccgtgtcaaagaaggtgaccatgtcatcattggccaatgcaggccattgtcaaagactgtgaggttcaatgtgctgaaggtgatcccagcaggtgcatctgcctttgccaagaaggcattcactggaatgtaataggttttttgaagttatggagagtttctatgtttcgtttttatgtttcagaatgttttgtttgttgatcccttttgtgtgagacttggtttgtccacagactgaatacaaacctgcgtactactttcttcatctgaaattactacattcta

SEQ ID NO: 1132 - DNA, 733 bp, Brassica napus
ggaagcttcattgcctcgagtttatcagtcgctctctttacctctttgcatccttttctgcatcttttcttcagcggagaacagcaaccagtagccatggctgaacagactgagaaagctttcctcaagcaacccaaagtcttcctaagctcgaagaaatctgggaaaggaaagagacctggtaaaggtggaaaccgtttctggaagaacattggtttgggtttcaagactcctcgtgacgccattgatggaacttacattgacaggaaatgcccattcactggaactgtttcagtaagaggacgtatcttagctggtacttgccacagtgccaagatgcagcgaaccatcatcgttcgtaggaactatctccatttcgtcaagaagtatcaaagatatgagaagagacattccaacatccctgcccatgtctcaccttgcttccgtgtcaaagaaggtgatcatgtcatcattggccaatgcaggccgttgtcaaagacggtgaggttcaatgtgctgaaggtgatcccagcaggtgcatctgcatttgcaaagaaggcattcactggaatgtaagagttttttgaagctatggagtgttcttctttgtttggttttgatttttggaatgtgttgtttggtgtactgattctctagaaatctacctactcttgtcatcttaaatgttttctttggtttggtacttatcccactatataaaagctactaattt

SEQ ID NO: 1133 - DNA, 865 bp, Brassica napus
ccctctgctatcaataatctgcctggctttcagtcctttcactctacactccttagtcaccacagagcattgcacacctgtgcggcggaatctaaggcatgacggcgcggattctgagtagcgttgggtggagacgcggtggttggaagagaggaaagatctctggagttggtgaggtttcgtagtcaaagccatgattgaaactgcctctcctatcgtctcgtcatccttgcctcaagctttcacaaaacagcagccatggcagaacagactgagaaggcttttctcaagcaacctaaggtcttccttagctcgaagatatctggaaaaggaaagcgacctgggaagggtggtaaccgattctcgaagaacatcggtttgggcttcaagactcctcgtgaagccatacaaggaacttacattgacagaaaatgtcccttcaccggaactgtctccattagaggtcgtatcttagctggtacttgccacagcgccaagatgcagaggaccatcatcgtaagaaggaactacctccactttgtcaagaagtatcagaggtacgagaagaggcactcgaacatccctgctcatgtctcaccatgcttccgtgtcaaagaaggagaccatgtcatcatcggccaatgcaggccattgtccaagactgtgaggttcaatgtgttgaaggtgataccagctggtgcttctgctttcgcaaagaaggctttcactggaatgtaacaagggggcttttcattttagtttatgtttttggatgctattcctcttatggagaatttaacatttgaattttcagatattaatgttttaatgcaccgattttgtttactttgctataccattttca

SEQ ID NO: 1134 - DNA, 721 bp, Brassica napus
ttcttaaagcttttagccgtcactgcctctcctatcgtctcctacatccttgcctcaagctttcacaaaacagcagccatggcagaacagactgagaaggcttttctcaagcaacctaaggtcttccttagctcgaagatatctggaaagggaaagcgacctggtaagggtggaaaccggttctcgaagaacatcggtttgggcttcaagactcctcgtgaagccattcaaggaacttacattgacagaaaatgtcccttcaccggaactgtctccattagaggtcgtatcttagccggtacttgccacagcgccaagatgcagaggaccatcatcgtgagaaggaactacctccactttgtcaagaagtaccagaggtacgagaagagacactcgaacatccctgctcatgtctcaccatgcttccgtgtcaaagaaggagaccatgtcatcatcggccaatgcaggcctttgtccaagactgtgaggttcaatgtgttgaaggtgataccagctggtgcttctgctttcgcaaagaaggctttcactggaatgtaacaagggggcttttcatgttagtttatgtttttggatgctattcctcttttatctatggagaatttgacatttgaattttcagatattaatgttttgatgctactcgattttgtttactttgctataccattttcaaccaaacttgagatctcgttttgaatat

SEQ ID NO: 1135 - DNA, 879 bp, Brassica napus
gagcttcattactttcagttcatcagtcgctccctcgcctctcgcatctcttttacaacccttgcttcagcggagagcagcagcaaccagtagccatggctgaacagactgagaaggcttttcttaagcaacccaaggttttcctaagctcgaagaaatctgggaaggggaagagacctggcaaaggtggaaaccgtttctggaagaacattggcttgagtttcaagactcctcgtgacgccattgacggaacttacattgataggaaatgtccattcactggaaccgtttctataaggggacgtatcttagctggtacttgccacagtgccaagatgcagagaaccatcattgttcgcaggaactatctccacttcgtcaagaagtatcaaaggtatgagaagagacactccaacatccctgcccacgtctcgccctgcttccgtgtcaaagaaggtgatcatgtcatcattggccagtgcaggccgttgtcaaagacggtgaggtttaatgtgctgaaggtgatcccagcaggcgcatctgcctttgcaaagaaggcattcactggaatgtaagagctttgaagttatggagatttaactttgcttggttttgatgttggaatgttttgtttggtgatctcctttttgttgtagtcccatagacttaatagacctactttgttttatctgaaattactacattcatctagtttgtctttggtatctctagacatcaactacttttgtctacttggtgaaaattgccacttaaaaagaatggcactttcataaaaaaaaaaaaaaaagggcggccgctctagagatccaagctacgtaccctgctgcgacgtcatactcttcttagggtcacctaatc

SEQ ID NO: 1136 - DNA, 769 bp, Brassica napus
actttcatttcatcagtcgctgcctcgcctctcgcatctcttttacagcccttgcttcagcggagagcagcagcaaccagtagccatggctgaacagactgagaaggcttttcttaagcaacccaaggttttcctaagctcgaagaaatctgggaaaggaaagagacctggcaaaggtggaaaccgtttctggaagaacattggcttgagtttcaagactcctcgtgacgccattgacggaacttacattgataggaaatgtccattcactggaaccgtttctataaggggacgtatcttagctggtacttgccactctgccaagatgcagcgaaccatcattgttcgcaggaactatctccacttcgtcaagaagtatcaaaggtatgagaagagacactccaacatccctgcccacgtctcaccctgcttccgtgtcaaagaaggtgatcatgtcatcattggccagtgcaggccgttgtcaaagacggtgaggttcaatgtgctgaaggtgatcccggcaggcgcatctgcctttgcaaagaaggcattcactggaatgtaagagctttgaagttatggagatttaactttgcttgttttgatgttggaatgttttgtttggtgatctccttttgttgtagtcccatagacttaatagacctactttggttatttgaaatttactacattcatctgttttatctttggtctctctagaactcatctactttgtcacgatgcgtgccactatagtaaatagacagtc

SEQ ID NO: 1137 - DNA, 1090 bp, Brassica napus
taaaaatatcagttggaaacaaattcttgaaaccatacaactccttgaactttttaatgacattaaatgctctaaatttacataaaagaaatccaccaaacaagaaaggaacatattcgcaaagaataaaataaaatcatacagcaattcacaatgaatcaaacaaaagcatcttccagtagagaaggagattgaaaattatacgttgtgggagttgtcgggcttggtgcgaggagacaagggcggagaggaggctgcggagatgattgcaccaggaggcggagcaggagctccatacacctggggatttgtatggatctcacgacggccacgagttttgccaagaaagtagcagccgaatccgagaagaaggcagaagaaaattagaggaagagatatgaccaccaccaaccccatcgatctagctgctgtcttctttttgattaatcttttttttttgtttcttcctctcctatcgtctcgtcatccttgcctcaagctttcacaaaacagcagccatggcagaacagactgagaaggcttttctcaagcaacctaaggtcttccttagctcgaagatatctggaaaaggaaagcgacctgggaagggtggtaaccgattctcgaagaacatcggtttgggcttcaagactcctcgtgaagccatacaaggaacttacattgacagaaaatgtcccttcaccggaactgtctccattagaggtcgtatcttagctggtacttgccacagcgccaagatgcagaggaccatcatcgtaagaaggaactacctccactttgtcaagaagtatcagaggtacgagaagaggcactcgaacatccctgctcatgtctcaccatgcttccgtgtcaaagaaggagaccatgtcatcatcggccaatgcaggccattgtccaagactgtgaggttcaatgtgttgaaggtgataccagctggtgcttctgctttcgcaaagaaggctttcactggaatgtaacaagggggcttttcattttagtttatgtttttggatgctattcctcttatggagaatttaacatttgaattttcagatattaatgttttaat

SEQ ID NO: 1138 - DNA, 695 bp, Castanea mollissima
tctgcgtcttcagcttccacaagtctatacgaaccatagccatggcggaacagacggagaaggctttcttgaagcagcccaaggttttcctctgcgcgaagaagactggcaaagggaagaggcctggaaaaggcgggaatagatactggaagaatgttgggttgggcatcaaaactcccagagaggctattgatgggacatacattgataagaaatgcccatttactggaaatgtttccatcaggggtcgtcagatttctggtacttgccacagtgccaagatgatcaggaccatcattgttcgtcgtgattaccttcattttgttaaaaaatatcaaagatatgagaagaggcactcaaacatcccagcacacatatctccatgctttcgtgtgaaagagggagaccacgtcaccattggccagtgcaggccattgtcaaagacagtgaggtttaatgttttgaaggttacttcagctggttcttcaggaggagctggtaagaaggcatttacaggaatgtgagcttcagtgtgtaacgtttttcagtagtattacatttgaatgaagatgatgttagtttaagccgagtccagatgagacttttttgtccgtttgtttttgtcattaacgtattaaatctttgtattggagttcctgaattttgccatgctataatcattctgagtatgggat

SEQ ID NO: 1139 - DNA, 758 bp, Cichorium intybus
cgcttgctagggtttacatctgcctccaatttttctctctttgcctctgccactgaaaagctcgatctctaccaacaatggctgaacagacggagaaggcttttttgaagcaacccaaggtgtttctaagttcaaagaaaagtgggaaaggtaagaggcctgggaagggtggaaacagattctggaagagtattggtcttggattcaagacgccaagagaagctattgaaggaacatacattgacaagaagtgtcctttcactggtgatgtctccattagaggacgtattcttactggtacatgcaacagtgccaagatggtgaggaccattattgttcgtagggactacttccattatgttaagaaataccaaagatatgagaagaggcactcgaacactccagctcacatttccccatgttttcgtgtgaaagaaggcgaccatgtcactgttggacagtgcagaccattgtcgaagactgtgaggttcaatgttattaaggtgattccagctggatctttgagtggtgggaagaaggcgtttacaggcttttaagaagtttatcttgttaggttctttaaacaacaatccaattagattttcagattttgaagtaaaatttggttcatttacagacttggtttaatgtttatgtaaacgtaattgtttgttttctcttgtctctccttacttttgatgttcgccaatatggtgtggttgtgacattaaaaattaaattctggttttgcagtagtc

SEQ ID NO: 1140 - DNA, 802 bp, Cichorium intybus
aagacgcgcttgctagggtttacatctgcctccaaattttctctctgtgcctccgccactgaaaagctcgatctctatcaacaatggctgaacagacggaaaaggcgtttttgaagcaacccaaggtgtttctaagttcaaagaaaagtgggaaaggtaagaggcctgggaagggcggaaacagattctggaagagtattggtcttggattcaagacgccaagagaagctattgaaggaacttacattgacaagaagtgtcctttcactggtgatgtctccattagaggacgtattcttactggtacatgcaacagtgccaagatggtgaggaccattattgttcgtagggactacttccattatgttaagaaataccaaagatatgagaagaggcactcgaacactccagctcacatttccccttgttttcgtgtgaaagaaggcgaccatgttactgttggacagtgcagaccattgtcgaagactgtgaggttcaatgttattaaggtgattccagctggatctttgagtggtgggaagaaggcgtttacaggcttttaagaagtttatcttccttatcttgttaggttctttaaacaacaatccaattagatttgcagattttgaagtgaaatttggttcatttacagacttggtttaatgtttatgtaaacgtaattgtttgttttctcttgtctctctttacttttgacgttcgccaatatggtgtggttgtgacattaaaaatcaaattttggttttgcagtagtctagttttggtttttagtgcacatgggacc

SEQ ID NO: 1141 - DNA, 1047 bp, Trifolium pratense
tacatgggagggtttgtttgttctgaatatccatccgagttagagaaggtaggtttcgagtgcttgcggctacactctcatcctctgcaactaactccacaaccatggctgaacaaactgagaaagcttatctcaagcaacgtaatgtgtttttaagttcgaagaaatctggtaagggtaagaggcctggaaaaggtggaaatcgcttttggaaagctattggtcttggattcaagactcccagagatgcaattgaaggaacctatattgacaagaagtgcccattcactggcaatgtttccatcaggggtcgtatcttatctggaacttgtcacagtgctaaaatgaataggactattgttgttaggaggaattaccttcactttattaagaagtaccagaggtatgagaagagacattcaaacattcctgctcatgtatcaccttgcttccgtgttaaggaaggagaccatgttattatcggccaatgcaggccactctccaagacagtgaggttcaacgtgttgaaagtgatcccagctggatcatctagtggtgcaggaaagaaggcttttactggaatatgagatttggtcgactttcgtagtatagagatcttatcatctgtgccgaaagtaattctgatttctgtatggtgaagttctgatcagttttggtttgcttttaaagttatgtactgtgatcggataagatttttcgttattatggttttttctcagacatgatgttattatggttattaaatactagttgcaattattttgaattttggcctgtgaaagaaattttctcacttatttatataaagcaatgtctagtaaatctgagacaaaagcagatgtgatccaacattgatatcagtttacaaactcgaaattagaaggcaagtctacacatacctgcatttcggtttcttttcttttctatgacagtgcttatattcaactttcacaactaccatggcagagaaagaaaagttaaagtcctgcataatttcactatgttgctttttctacattatacaca

SEQ ID NO: 1142 - DNA, 736 bp, Taraxacum officinale
gggtggctcctccgattatttgtgcctctgccactgaagagctcggatctctacgaacaatggctgaacagacggagaaggcgtttttgaagcaacctaaggtgttcatctgttcgaagaaaagcgggaaaggaaagaggcctgggaagggcggaaacagattctggaagagtgttggtctcggattcaagacaccaagagaggccattgaaggaacttacattgacaagaagtgcccattcaccggcgatgtctccattagaggccgtattctttctggtacctgcaacagcgcgaagatggtgaggaccattatcgttcgtagggactacttccattttgtgaagaaataccaaagatacgagaagaggcactctaacactccagctcacgtttctccttgtttccgtgtgaaagaaggtgaccgagttaccatcggacagtgcaggccattgtcaaagactgtgaggtttaatgtcttgaaggtcactccagctggatcttcaggtactggaaagaaggcctttacaggcatgtaacaaccttagaatggaatttcatttgcttgtttggtttctgtgacaactttatgtttcattacatgtatttgcttgctttttacttttcatgtttgcaattatgggagtttttgatcaaataggtgttattaaaataggtgtagtttgacaagtatttaccgaaagaggtgtctttgaattttgacttgtttatcatt

SEQ ID NO: 1143 - DNA, 690 bp, Taraxacum officinale
tgtgccctctgccactgaaaagctcggatctctacgaacaatggctgaacagacggagaaggcgtttttgaagcaacctaaggtgttcatctgttcgaagaaaagcgggaaaggaaagaggcctgggaagggcggaaacagattctggaagagtgttggtcttggattcaagacaccaagagaggccattgaaggaacttacattgacaagaagtgcccattcaccggcgatgtctccattagaggccgtattctttctggtacgtgcaacagtgcgaaaatggtgaggaccattatcgttcgtagggactactttcattttgtgaagaaataccaaagatacgagaagaggcactctaacactccagctcacgtttctccttgtttccgtgtgaaagaaggtgaccgagttaccattggacagtgcaggccattgtcaaagactgtgaggtttaatgtcttgaaggtcactccagctggatcttcaggtactggaaagaaggcctttacaggcatgtaacaagcttatggtttggaaaaaacaatgcaatttcatttgcttgttttacagtgacatttgctttctttcacaactttgtgtttcagtacatgtatttggttgctttttacttttgatgtttggcaattatcgtatgattctaacattaaatatcaaattttgatttcgca

SEQ ID NO: 1144 - DNA, 660 bp, Taraxacum officinale
aaagctcggatctctaccaacaatggctgaacagacggagaaggcgtttttgaagcaacctaaggtgttcatctgttcgaagaaaagcgggaaaggaaagaggcctgggaagggcggaaacagattctggaagagtgttggtcttggattcaagacaccaagagaggccattgaaggaacttacattgacaagaagtgcccattcaccggcgatgtctccattagaggccgtattctttctggtacctgcaacagtgcgaaaatggtgaggaccattatcgttcgtagggactacttccattttgtgaagaaataccaaagatacgagaagaggcactctaacactccagctcacgtttctccctgtttccgtgtgaaagaaggtgaccgagttaccattggacagtgcaggccattgtcaaagactgtgaggtttaatgtcttgaaggtcactccagctggatcttcaggtactggaaagaaggcctttacaggcatgtaacaagcttagggttttgaaaaaacattgtaatttcatttgcttattttacagtgaaatttggtttctttaagaagtttatgtttcacttttgatgttggcaattatggtatgattgtaacattgaatatcaatttttgatttcgtacttctacttatta

SEQ ID NO: 1145 - DNA, 1008 bp, Eucalyptus grandis
atccgcttcccagtctctcttcccgtgcctccagaaactagggtttccttccccttccttccgcctcctgctgtcggctcgacctgacctcaagcggccggaccaccatggatgcccagaccgagaaggcgttcttgaagcagcccaaggtcttcctctgctcgcagaagtctggcaaggggaagagacctggcaagggagggaacaggtatcataagagcgttggcttgggcttcaagaccccgagggaggcggtcgaaggcacgtacattgacaagaagtgcccatttactggcaatgtatccatcaggggtcgtattcttgctggcacttgccacagtgccaagatgatgaggaccatcattgtccgccggaactacctgcactttgtcaagaagtaccaaagatatgagaagaggcattccaacattccagcacacatctctccatgcttccgtgtaaaggagggtgaccatgttactgtcggccagtgcaggccactgtcaaagacggtgaggttcaacgtcttgaaagtgatcccagctgggtcatcaggtggaggtgggaagaaggcattcaccgggatgtaagggtagcggcgcagttcttccatcaaagcttattcgtgggagtaatgttaggttcaattttgtgggggtctagatgaggacttgttttgaattttcatgaatggattgtgttacagtttcagttctgctattgaccggaaggtgctttttattttactatggactccactgtggtgatatatgcatgaggtatttgcttagaaagaaattaaagcataatttatgctcaagatgctacctaagagagccagttgtctactcttttagaagaatttcaaagtcgatgagattgacatgctcgacagtcaaaatcttttgtattcatcccggtatttttagttacttcttttccaagatattaagcaactatgtacgaaagaaaaactaattaattaagggattattagatggttcctta

SEQ ID NO: 1146 - DNA, 754 bp, Lactuca sativa
gcctccgcttattttctacctgtgcttccgccactgaaaagctccgatctctaccaacaatggctgaacagacggagaaggcgtttttgaagcaacccaaggtctttctatgttcgaagaaaagtgggaaagggaagaggcctgggaagggtggaaacagattctggaagagtgttggtcttgggtttaagactccaagagaagctattgaaggaacttacattgacaagaagtgccctttcactggtgatgtctccattagaggtcgtattctttccggaacatgccacagtgcgaaaatggtgaagaccattatcgtacgtagggactacttccattatgtgaagaaataccaaagatatgagaagaggcactcgaacactccagctcacatttctccatgttttcgtgtgaaagaaggtgaccgagtcacaattggacagtgcagaccattgtcaaagactgtgaggttcaatgtgttgaaggtgactccagctggatcttctggaagtactgggaagaaggcgtttgcaggcttctaaggaaaaagctttatcttgaatttgatttgctggttttgtagcgatacttgtttttttttaacagtttggtttaaatgtttcggtagatgtatttttttttactttgatgttcgcaattatggtatgattgtaaacattaaaaatcaaattttgatttggcatttgttcttgttttggctatttgttcatttaatgatgattttgatagatgt

SEQ ID NO: 1147 - DNA, 845 bp, Lactuca sativa
aaacaacgtcttgttctctagggtttcttactgattttctctcttgtgtacgccgtttctgagctcgcattccctcctcaacaatggctgaacagaccgagaaggcgtttttgaagcaacccaaagtgtttctctgctcgaagaaaagtgggaaaggaaagaggcctggaaagggtggcaacagattctggaagagtgttggtcttggattcaagacaccacgagaagctatcgaaggtacttacatcgacaagaagtgtcctttcaccggtgatgtctccattagaggccgtattctaactggaacatgccacagtgcaaagatggtgaagaccatcattgttcgaagggactattttcactatatcaagaaataccaaagatatgagaagaggcactccaacactcctgctcacatttcaccttgtttccgtgtgaaggaaggtgaccacgtcaccattggtcaatgcagacctttgtcaaagactgtgaggttcaatgtgttgaaggtgatcccagcaggatcttctggtagcactgggaagaaagcttttgcaggattttaaaagtatatttattgagtctgcaactctttttggttgattatgaaatagattttgagaacataacaggaggttttattgttatgtagacactattatgctgttgtttttggtttatgttatcacttttgagagttgtttaagaaattattatttgggttgtctgttttctttcttcatctgtttttatagtcacaattatcgtttgagtaactcatattaagtatattataaggcgcgaagattagaaattaataaaatttggcaatcaatcaatccgct

SEQ ID NO: 1148 - DNA, 899 bp, Quercus alba
acgagtgcgtttaagcagtggttattcaacgcagagtacgtcgggggtatttagggttttgcatcttcgcctcctctgcgtcttcagcttctacaagtctacacgaaccctagccatggcggaacagacggagaaggctttcttgaagcagcccaaggttttcctctgctcgaagaagactggcaaagggaagaggcctggaaaaggtgggaatagatactggaagaatgttgggttgggcatcaaaactcccagagaggctattgacgggacatacattgacaagaaatgcccgtttactggaaatgtttccatcaggggtcgtcagatttctggtacttgcaacagtgccaagatggtcaggaccatcattgttcgtcgtgattaccttcattttgttaaaaaatatcaaagatatgagaagaggcactcaaacatcccagcacacatatccccatgctttcgtgtgaaagagggagaccacgtcaccattggccagtgcaggccattgtcaaagacagtgaggtttaatgttttgaaggtgacttcagctggttcttcaggaggagctggtaagaaggcatttacaggaatgtgagcttcagtgtgtaacgtttctcagtagtattacatttgaatgagatgatgttagtttaagctgagtccagatgagaccttattgcccatttgtttttgtcattaacatattaaatctttgtattggagttcctgaattttgccatgctataatcatttagattatgggatcctttttaaattgtttcgaaatgtgattgtgttttgccaagaaccttgtgaatctggttgagacttgagttttcatgtccttgtgctacagttcaaaatctagttaccactacctaaaagaagcttgctag

SEQ ID NO: 1149 - DNA, 801 bp, Platanus occidentalis
ttgcctctctgcatcttcttctcttcgagtcgaccatggcagaacagacggagaaggcgtttctgaagcagccgaaggtgttcttatgttcgaagaaatccgggaaggggaagaggcctgggaagggcggaaaccgctactggaagagtattggtatgggaataaagacacccagagacgcgattgaagggacatatattgataagaaatgcccatttactggcagtgtttctgtcaggggccgtatcctaaccggcacttgccacagtgccaagatgatgaggaccattattgtccgacgagactatcttcactatgtcaagaaatatcaaagatatgagaagaggcattcaaacattccagcacacgtatctccatgcttccgtgtgaaggaaggagaccatgttatcattggccagtgcaggccattgtcaaagacagtaaggtttaatgtgttgaaagtggttcctgctggatcttctggcggaggtggcaaaaaggctttcacaataatgtgagttcggtttctcattttctgtcggtcctagatgtcatagattatgagtttagatagaggttggttggccagaggagacttttgccattttgaacggctctaaatttttttaacgtatgaactgctctatgtttttgaattttgattacatcaagctcttggagatacccaaggtcaactagactacaaatatattagctggaagcttgaattttacggtatcgtgcggaaaatattcagtttgtcatttgttctcttaatcatatgccaacttcttaccaaat

SEQ ID NO: 1150 - DNA, 832 bp, Raphanus sativus
gggttctcgaagctttagccgtctctgcctctcctatcatatcgtctcctacattcttgcctcaagctttcacaaaacagcagccatggcggaacagactgagaaggcttttctaaagcagcctaaggtcttccttagctcgaagatatctggaaagggaaagcgacctgggaagggtggaaaccgtttctccaagaacatcggtttgggcttcaagactcctcgtgaagccattcaaggaacttacattgacagaaaatgtcccttcaccggaactgtctccattagaggccgtatcttagccggtacttgccacagcgccaagatgcagaggaccatcatcgtgagaaggaactatctccactttgtcaagaagtatcagaggtacgagaagaggcactcgaacatccctgctcatgtctcaccatgcttccgtgtcaaggaaggagaccatgtcatcatcggccaatgcaggccattgtccaagactgtgaggttcaatgtgttgaaggtgattccagctggtgcttctgctttcgcgaagaaggcttttactggaatgtaagaacggggcttttcagcttagtttatgtttttggatgcttttatcccttttatctatggaagaattctacatttgagtgttcagatattaatgttttaatgcatcgattttgtttattttgctataccactttcatcccatttccattatctcgttttaagtatagcgttctttatctgttgaaaaccggttaaacctatttgtccatccgggtaccggtcttactccaaggggtttgatgactttaaggagaacaaaatatcttta

SEQ ID NO: 1151 - DNA, 780 bp, Raphanus sativus
gggtttcatgaaagcataaagccgtcgctgccgctctatccgtcccctctctactacattcttacctgtcgggaacaaaacaacaagccatggcggaacagactgagaaagcttttctaaagcaacctaaggtcttcctcagctccaagacatcaggcaagggaaagcgacctgggaagggtggaaacagatttgtgaagaacatcggcttgggcttcaagactcctcgcgaagccatttcaggaacttacattgacagtaaatgtcccttcactggaactgtttctattagaggccgtatcttagctggtacttgccacagtgccaagatgcagaggaccattatcgtgcgaaggaattaccttcactttgtcaagaagtatcagaggtatgagaagaggcattcgaacatcccagctcatgtctcaccttgcttccgtgtcaaggaaggcgaccatgtcatcattggccaatgcaggccattgtccaagactgtgaggttcaatgtgttgaaggtgataccagctggtgcttctgctttctcaaagaaggctttcactggaatgtaaggagggattttcttggatagtgttgagatctactactattttatccattttatctatggagaatttcacattgaattttcaagattttaatgcactaagattttgtctacttgttatagctttttaatcccagttttgagatatccctgtgttttattatatttcttaaacaattaaaaatcagttaccagggtctaataagttaaagtag

SEQ ID NO: 1152 - DNA, 724 bp, Raphanus sativus
ctcgaagctttagccgtctctgcctctcctatcatatcgtctcctacatcctcgcctcaagctttcacaaaacagcagccatggcggaacagactgagaaggcttttctaaagcaacctaaggtcttccttagttcgaagatatctggaaagggaaagcgacctgggaaaggtggaaaccgtttctccaagaacatcggtttgggcttcaagactcctcgtgaagctattcaaggaacttacattgacagaaaatgtcccttcactggaactgtctccatcagaggccgtatcttagccggtacttgccacagcgccaagatgcagaggaccatcattgtgagaaggaactatctccactttgtcaagaagtatcagaggtacgagaagaggcactcgaacatccctgctcatgtctcaccatgcttccgtgtcaaggaaggagaccatgtcatcatcggccaatgcaggccattgtccaagactgtgaggttcaatgtattgaaggtgattccagctggtgcttctgctttcgcgaagaaggcttttactggaatgtaagaagggagcttttcattttagtttatgtttttggatgcttttatcccttttatctatggaagaattttacatttgagtgttcagatattaatgttttaatgcatcgattttgtttattttgctataccactttcatcccatttccaaatctcgttttaagtaaa

SEQ ID NO: 1153 - DNA, 740 bp, Raphanus sativus
agtcgctgcctcgcctctcgcatctcttttaacattcctcagcggagagcagcagcagcaaccggtagccatggctgaacagactgagaaggcttttcttaagcaacccaaggtcttcctaagctccaagacatcagggaaaggaaagagacctggcaaaggtggtaaccgtttctcgaagaacattggcttaggtttcaagactcctcgtgaagccattgaaggaacttacattgataggaaatgtccattcactggaaccgtctctgtaagaggacgtatcttagctggtacttgccacagtgctaagatgcagagaaccatcatcgttcgcaggaactacctccacttcgtgaagaagtatcagaggtatgagaagaggcactccaacatccctgctcacgtctcaccctgcttccgtgtcaaagaaggtgatcatgtcatcattggccagtgcaggcccttgtcgaagacggtgaggttcaatgtgctgaaggtgatcccagcgggcgcgtccgcctttgcaaagaaggcattcactggaatgtaagagagcttttttgaagtattggtttttttgatttttggaatgttttgttgaagtctctgatttgccattacctacttccaactttcatctgtttttatcttcgttatctctagaaatcaactactttttgttttacttgatcagaaaaccttactgcaataaatcaaaattagttatttatgataaaaaa

SEQ ID NO: 1154 - DNA, 530 bp, Panax ginseng
caccttcttccccaaatctccagaacctgcaataatggccgaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaagggacttacattgacaagaaatgcccatttactggagatgtttctattaggggccgtattcttgctggtacttgccacagcgccaagatgatgagaactatcattgttcgccgtaactacctgcattatgttaagaaataccagaggtatgagaaaagacattcaaatattccagctcacgtatctccttgcttccgtgtgaaagagggagaccatgtaattgttggccagtgcaggccattgtcaaagacagttagattcaatgtgttgtaagtagatccacgctggtcgttcttggtggtgggaaggaaggacgttctactggtactttgtagtttggttg

SEQ ID NO: 1155 - DNA, 728 bp, Arachis hypogaea
agtgagaactgagaagtgagtacagattaaggcttctgagtgcggctctcattcttcgactctgcaactttcgacgttaacccccttcactcgtctcaatggctgatcagaccgagaaggcttttctcaagcaacctaaagaggttctatgctcgaacaaaagtgggaagggaaagaggcccggatagggtggaaagtgtttctggaaatccattggccttggatttaagactcccagggatgccattgaaggaacctatattgacaagaaatgcccctttaccggaactgtttccatccgtggccgaatcttagctggaacttgtcacagtgctaagatgaataggactatcattgttaggaggaattatcttcattttatcaagaagtatcagagatacgagaaaagacattcgaatattcctgcacatatatcaccctgcttccgtgtgaaggaaggagatcatgttattattggccaatgcaggccacttacaaagacggtgaggttcaatgtgttgaaagtgatcccagctggatcttcaagtggtgcaaagaaggcatttgctggaatttgagatttgattcagttttttgttgaaggataatgttatcttattagttagtaaaactgattcctggaagattatcatataaagatatgatcaattttggatttttcctttaagattgtgtttgtgaatgaccaagtgttatccttttaaatt

SEQ ID NO: 1156 - DNA, 977 bp, Prunus mume
ttagggttccacatatattcgcctcaagcatcgcccttttcgtttccgcatagattagggtttttgctcatcagtctccctccacggcgtcggcttcaaccagtctccacaaagcagcttgaaaatggcggaacagaccgagaaggctttcttgaagcaacccaaggttttcctgagctcaaagaagacagggaaaggaaagaggccagggaaaggaggcaatcgcttctggaagagtgttgggttggggttcaagacacccagagacgctattgaaggaacttatattgataagaaatgccccttcaccggcaatgtctccatcaggggtcgcattctctctggtacttgccacagtgccaagatgtcgaggactataattgttcgacgtaattatcttcattatattaagaaataccaaaggtaaggtcattccacaattcctgcgcacgtttcaccatgcttccgtgtgaaggagggagattatgtcatcattggccaatgcaggccattgtcaaagacagtgaggtttaatgtgttgaaggtgactccggctggttcttctggagctggaaagaaggcattcactggaatatgagcttcttgttttgggcagtattcgtagtgttacgtttgtgcaagaagtgcatttagattgagctactgttgacagatgaactgttttttgccattttattttgatccttaaatatttaatccatgtacggtgaattttaaagtttttcttctgttgaaccattatcttggagtttgatatccataatgtcattttctattcacaatgtttcagaatgtccaagtggtttatgttgtggacatagttttagatcgtttagtaatcttgaagatatatggtatatgggtgtttgttgtctaatgtggtcatgtcagtcagagaaagtgacttcaacatgtttccaataggcttggtgtaggtagagctttgaatgggtcgg

SEQ ID NO: 1157 - DNA, 675 bp, Raphanus sativus
gcctctcgcatctcttttaacattcctcaacagagagcagcagcagcaaccggtagccatggctgaacagactgagaaggcttttcttaagcaacccaaggtcttcctaagctcgaagacatcagggaaaggaaagagacctggcaaaggcggaaaccgtttctcgaagaacattggtttgggcttcaagactccccgtgaagccattgagggaacttacattgataggaaatgtccattcaccggaaccgtctctgtaagaggacgtatcttagctggtacttgccacagtgccaagatgcagagaaccatcatcgttcgcaggaactacctccacttcgtgaagaagtatcagaggtacgagaagaggcactccaacatcccagctcacgttcgccctgcttccgtgtgaaagaaggtgatcatgtcatcattggccagtgcaggcccttgtcgaagacggtgaggtttaatgtgctgaaggtgatccctgcgggcgcatccgcttttgcaaagaaggcattcactggaatgtaagagattttttttgaagtattgttgttacttttgcttggttttttgattttggaatgttttgttggaagtctctgtctgattgccattacctactttcatctgtttttatcttggtatctctagaaatcaattgctttt

SEQ ID NO: 1158 - DNA, 723 bp, Trigonella foenum-graecum
gcggcagcttcaaagtgaaaactcgctttctgaaacaaagcttcatcaaatcaaccatggctgaacaaactgagaaggcttttctgaagcaacaaaaagtgtttttgtgttcgaagatttctgggaaggggaagagacctggaaagggtgggaatcggttttacaaagctgttggccttggatttaagactcctagggatgccattgaaggaacctatatcgacaagaagtgtcccttcactggcaatgtctcaatccgaggtcgtatcctagccggaacttgtcatagtgctaagatgaataggaccattattgttaggaggaattatcttcatttcatcaagaaatatcaaagatatgagaagcgccattccaatattcctgcacacgtatcaccttgcttccgagtgaaggaaggagaccatgttattattggccaatgcaggccactctcaaagaccgtgaggttcaatgtattgaaagtcatcccagctggatcttctagtggtgccggtgccggtgccggtgccaagaaggcgtttacaggaatctaagcattgaagacagttgtaccttagtttcaaatgttttatggtcatgacatagatctcatcaaatttggatatgttttgatggttttcattggtttgagtagttaatgttaaagattttgatttgatatacattatggctttcaaatagtagttgtagtaatttttgaca

SEQ ID NO: 1159 - DNA, 1382 bp, Pinus taeda
tattctatggctatgctgaaattttgttagatgggtttatttgctaaaaatcagttaaccataacaagccctttcagttgaagccaaacgccttttttcaatattctattccattctgaagcttgtatgggtgaacagtgaacatgctgttagtattatcattgttatcaattaatgggacatctctgacacaaattccttgatttgtttttatagactgagagagcttttctaaagcaaccaaaagtctttctcagttccaagacgtctgggaaggggaaacgacctggaaaaggtggcaacaggttttggaagaatgttggtcttggcttcaagacccccaaagaagctattcaagggacctacatcgacaagaagtgcccattcactggtactgtttcaataagaggtcgtatattagctggaacatgttacagtgctaaaatgacacggacaattattgtccgcagggactatctccattttgtcaagaaatatcagaggtatgagaagagacattcgaacataccagcccatatttcaccctgtttccgtgtcaaggaaggggatcatgttatcattgggcaatgcaggcccttgtccaagactgtaaggtttaacgttctgaaggtgattcctgcgggttctagcagtggttctgcaaagaaagccttcactgcaatatgaatccgttttttttctttgtacaagcaaaccatataatccgtcaaatgcaatagagtaggctttgacagagttgagggttactattttatcatttgctcaaattaattttgttagtttaatccttcttttggttactgtattcaattttgaaaaagatgtacggataacgtttactgcttggtggttgaaagtccaccgttcttggatacttttgttttggttttagcatccagtaaacctttcaaagcatattcttggaatatttttttattccaatagccaaatatgaacgatgtcatatttagtttcgcttttaattatttctttaggaggtgacgttcgtgtgcgttaagctgttgtcttggtgataataaatattgctatgaaatgatcaatacgcctaactttcccaacataactttgaatttataaaggtgcctaagacaatctagttatatgtgatggttgccaatagtatttcatgtgaagatgttgaaatttaattcacacgaggtttgtaatgtaatgtgcgtggattttaaactatacgaggtacaaagaaggattcttgccgagttttttgtactgatcgaatatcaagggtccttggcgttgtgaatattgatgctttttccattttctatatcactgatgtaaatgtctagcttattttgagggggcttatgcgagtaaag

SEQ ID NO: 1160 - DNA, 1166 bp, Theobroma cacao
tgccaagctgccatgaaggaaaaaaaagactctgcttttatttatcggaatagtttcgaaatgaaaggcatttccattaattaatatattttaaatttatttatttatatttttaatatatatatatatacacacaattaaactagatatttagattttattaatgaagcagtattgaaatcttaattaaaatttttaaatataattcaatctatctttgatttttctaaataaattctattaaatattcaccctaataataataataatacgaagatttctcgactcctagtgcttttggatgccacctaatgcaaacaattattttcaaacatttggcgattgcatgtcacgtatacgtgaaaaagctgagggtttatcttgttgcctgcttggctttgttgagtcacccacggagaaagctttcttgaggcagcccaaggttttcctttgctcgaagaagtcggggaaggggaagaggccagggaagggagggaatcgtttatggaagagcattgggttgggttttaaggcacccagagaggcaatcgaaggtacttatattgataaaaagtgcccattcaccgacactgtttctatcaggggacgtatcctagctggtacttgccgcggtgcaaagatgatgagaaccatcattgtttgacgcaactatcttcattatgttaagaaatatcagagatatgagaagaggcactcaaacatcccagcacatatatccccatgctttcgagttaaggagggagatcatgttatcatcggccagtgcaggcccttgtcaaagacagtgagattcaatgtgttgaaagtgataccagctggttcttctggtggtggcaagaaagcctttacagggatatgagtttgattcttcgattcaattagttgatgggagaaattttctatttatagtatgttgtaactttgggtgcatcaatttctatttaaggtgtgaagttgaaacatcaagaatatgtcaatcataatatgatatggccaaaagaaaggaatttgttaatgattctttctaaacaattttgatccttatggattatttttcaccatttttatccaaattattaaaaaaaaaaactgacttgtagtgttccttggctatataatattaagtaaatgttcatttacatata

SEQ ID NO: 1161 - DNA, 855 bp, Gossypium hirsutum
gcgcctgcagcgtcgacactatgtggatccacaagaattccggcacgaaggcaagttcaaatccaagggctgccatctttcaattccaaaaattttcttttttctcctcgtagatccaaaaatttttatgtgttgaaactgctttgatctttctttttattgtatattatacggagaaagcatttctcaaacaacccaaggtgtttttaagctgtaaaaaaattgggaaaggaaagagacctggaaagggagggaatcgcttctggaaaagcattgggttaggctttaagacacccagagaggccattgaaggaacatatattgataagaaaagcccatttactggcactgtttctattagaggccgtatccttgccggtacttaccatagtgcaaaaatggtaaggactattatcgtccgaaggaactaccttcactgcatcaagaaataccaaagatacgaaaaaaggcacagcaatatcccagctcatatatccccctgctttcgtgttaaagaaggagatcatgttataatcgggcaatgcaggcctttgtcgaagacggtgaggttcaatgtcctaaaggtcaatccagcggggtcttccggtggtgggaagaaagcttttacagccatgtgagaggttagcttttgaaatggcaaaaattgtagtgttgaggtgtgtgtttagctgtatgaactttggttggtttttggtttaactgttttatttgatggaaaccatcattttgttgttttcgaaatctcccattattacaatttagaggatctatttatgttgctgggttttggattgttggtattacatatgatgcctgtcttctctttgtagaaaa

SEQ ID NO: 1162 - DNA, 909 bp, Cycas rumphii
gccttcccgaaaatgaacagggagggactagggtttatagaggagaaagtgtgttctcctttagccttttggttcgttggcgtgttgatgttcgtcagcatatagaggatcaggagcagagggtgcggcgcggggttgaacgttctgtaaccacggtgggttgatcaggcttcttccatttcttgcagtcatggcggaacagacggaaaaagcttttctgaagcagccgaaggtattccttagttccaagaaatctgggaaggggaaaaggcctggaaaaggtggtaatagattttggaagaatattggtcttggtttcaagacccctaaggaagcaattgaaggaacctacattgacaagaagtgtcctttcactggaaatgtttcaattaggggtcgtatattgacgggaacttgttacagtgcaaagatgacccggacaattatagtccgacgggactatctccactttgttaaaaagtatcaaaggtatgagaagaggcattcgaacatagcggctcacatttcaccttgcttccgtgttaaggaaggtgatcgggttattattggacaatgcaggcccttgtccaagactgtaaggtttaatgtcttgaaagtgattccaatgggttctagcactggtgggagtaagaaagcctttacagcaatctgaagatccattgctgatttttgcttctcatttggtattcatcataccaagtggatttgagctgattattgagttatctggtagtaacattttaaattcaagttttctttgttcctttattaacatgtacatgttttgaaaaatgatttgaatgagcttcaagcataatttatgtggggtaatttttttctgaagattttgatgagataaaggaattgttatttacaatgttgaatatg

SEQ ID NO: 1163 - DNA, 1033 bp, Abies balsamea
aattctcaggcaggaggagcgggagctgctgggacgctgaagatacgaagttagaattcttgaattcctgcagccatggcagaacagactgagagagcatttctgaagcaaccaaaagtctttctcagttcaaagaagtctgggaaggggaaacgacctggaaaaggtggaaacagattttggaagaatattggtcttggcttcaagacccccaaagaagctgttcaagggacttacatcgacaagaagtgcccatttactggtaatgtttcagtaagaggtcgtatattagccggcacatgttacagcgctaaaatgacacggacaattatagtccgtagggactatctccattttgtcaagaaatatcagaggtacgagaagagacattcaaacataccagcccatatttcaccttgcttccgtgtcaaggaaggggatcatgttattattgggcaatgcaggcctttgtccaagactgtaaggtttaatgttctcaaagtgattcctgcgggttctagcagtggttcagcaaagaaggccttcgctgcaatatgagcacgtcttttctgaacttctctaaggaaccatatagttcatcaaatgttatagataggctttgaccgtgatgatggctcttattcatcattgatcaacttaattttgtcagtttgattctttttgattgttactatgttgaacgttgaattatgtatggaacacgttgattttagtcttggtagttgaaagtcaaccggtcttggatatttgaaaatttgttttgggtttagcaccagcaaaagctttgaaggtttaaccttttatggtcggctttcaattttttttttattatttatgcacagaggttttgttttaattatttttttctagtaggtgacattcatttgggaagtgttgtcttggcgacagtaaattgttcttaaaggtccaatgcacaactttcccaacatgactttgaatgtatgaatgttgcataagcaaaaagtagtttgatgattaccaatagtatttc

SEQ ID NO: 1164 - DNA, 943 bp, Amorphophallus konjac
tcgccaaaacggcccacatcgaaaccctattataagaactccgcccacgaggttagggtttctctcttctccctcacttcgcggttctaccttccgccggcggccaccctcctcgtctttccaccagatcccaccatggcggagcagacggagaaggcgttcctgaaacagccgaaggtttttctctgttcgaagaagtcgggaaaggggaagaggcccggcaagggtggcaaccgttactggaagagcattgggctcggattcaaggtccccagggaggccattgaagggacatacattgacaagaaatgcccatttactggtaatgtttctattagaggccgcatcctaagtgggatatgccacagtgccaagatgaacagaaccatcattgttcgcaaagactacctgcattatgtaaagaagtatcagaggtatgaaaaacgtcactccaacatcccggcccacgtttccccttgcttccgtgtgaaggaaggagaccatgtaaccattggacagtgcaggccattgtctaagactgtaaggttcaatgttttgaaggtcactcccgcgggatccgcaggtggtggcaagaaagcttttgcagcattctgagtgtcttgctataggaaattattagatggggatgggtgttaaaattttggatatggtcgaggccatctcatttgaattgttggtttaattatgtgttcactttcccaggagtccgtcttttgaacctttttggtttccagtgttcttgtccggttttttagttaattgagaatttaaggaattttctgcaaatttgatgaaactcattccattaggaatgctgattttcctgttgaactcggcgatggatatgtatgttagcttggccttggaaatgtacacttgaccaaatcgcccatttctctttggtaatggtgatgttcagaag

SEQ ID NO: 1165 - DNA, 746 bp, Arabidopsis thaliana
tttcgtcagaagatttcaaggtttagggtttctgcaattcaaccatggcagagcagacggagaaggcgtttcttaagcaaccaaaagttttcttaagctcgaagaaatctggtaagggaaagaggcctggtaaaggaggtaatcgtttctggaagaacattggccttggtttcaaaactccaagagaggctattgaaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaagatatgagaaaagacactcaaacattcctgctcatgtttccccgtgcttccgtgtcaaagaaggagatcgtgttaccattgggcaatgcaggccattgtcaaagacggtgaggttcaatgtcctgaaggtcattccggctggaagctcttctatcgggaaaaaagcattcactggaatgtaaaagagattcagatttgttgaaaaggtgcgaactagtattctaagagtttagaatttttctagcagagttattggattcgtttcttaagatctatgatcaaaggaaaccagattttctgtttcatttagtgattcaagtatcaagatatgtctatggttatagttttactccaatatatctagtcatgagttgctatctactagtcatgatttcgatgaaaag

SEQ ID NO: 1166 - DNA, 692 bp, Brassica juncea
agtacgcgggggtcccgaagcttttgccgtcgctgcctacatccttgcctcagagcagaacagcagcagccatggccgaacagactgagaaagctttcctaaagcaacctaaggtcttcctcagctcgaagatatctggaaagggaaagaggcctggaaagggtggaaacagattcgtgaagaacattggtttgggcttcaagactcctcgtgaagccactcaaggaacatacattgacagcaaatgtcccttcactggaactgtttcgattagaggacgtatcttagccggtacttgccacagtgccaaaatgcagaggaccattatcgtccgaaggaactaccttcactttgtcaagaagtatcagaggtatgagaagaggcattcgaacatccctgctcatgtctcaccatgcttccgtgtcaaggaaggagaccatgtcatcatcggccaatgcaggccattgtccaagactgtgaggttcaatgtgttgaaggtgattccagctggtgcttctgccttcgcaaagaaggctttcactggaatgtaagaaagggagcttttcatgttagtttatgtttttggatgctattatccctttatctatggacaattttacttttgaattttcagatattaatgttttaatgcaccgattttgtttactttatacctttttcatccatattta

SEQ ID NO: 1167 - DNA, 715 bp, Brassica juncea
ggaagctctagccgtcgctgcctacatcctcgtctcaagctttcacgcgcagagcaaaagcagcagcagccatggcggaacagactgagaaagctttcctcaagcaacctaaggtcttcctcagctcgaagatatctggaaagggaaagagacctggaaagggtggaaacagattcgtgaagaacattggcttgggcttcaagactcctcgtgaagccactcaaggaacatacattgacagcaaatgtcccttcactggaactgtttcgattagaggacgtatcttagccggtacttgccacagtgccaaaatgcagaggaccattattgtccgaaggaactaccttcactttgtcaagaagtatcagaggtatgagaagaggcattcgaacatccctgctcatgtctcaccttgcttccgtgtcaaggaaggagaccatgtcatcattggacaatgcaggccattgtccaagactgtgaggttcaatgtgttgaaggtgataccagctggtgcttctgctttcgcaaagaaggctttcactggcgcttaagagtgtttttttatgttactttatgtttctcgatagagctgaactctggttattacccttttattttaaagagatttttacattgaagtttcagattttaatttttgatgcacttattttatttactattctatagtattttcgtcccaatatttgatatttcg

SEQ ID NO: 1168 - DNA, 763 bp, Brassica juncea
aaagagacctggaaagggtggaagaccttgggttgttgaagctctctagccgtcgctgcctacatcctttgcctcaaagctttcacgtgagattcaaaagcagcagccatggcggaacagactgagaaagctttcctaaagcaacccaaggtcttcctcagctcgaagatatctggaaagggaaagagacctggaaagggtggaaacagattcgtgaagaacatcggcttgggcttcaagactcctcgtgaggccagtcaaggaacctacattgacagcaaatgtcccttcactggaaccgtttcgattagagggcgtatcttggccggtacttgccacagtgccaaaatgcagaggaccattatcgtccgaaggaactacctccactttgtcaagaagtatcagaggtatgagaagaggcattcgaacattcctgctcatgtctcaccttgcttccgtgtcaaggaaggagaccatgtcatcatcggccaatgcaggccattgtccaagactgtgaggttcaatgtgttgaaggtgattccagctggtgcttctgctttcgcgaagaaggcttttactggaatgtaagaagggtgcttttcttcttagtttatctttttgggatgctattatctctctctatctattgagaattttacatttgagttttcagatattaatgttttaatgcatcgattttgtttattttgcgataccatcatcattccaattccaaaatcgcgttttcagatattaatgtttt

SEQ ID NO: 1169 - DNA, 643 bp, Brassica oleracea
ttcccgaagcttttgccgtcgctgcctacatccttgcctcagagcagaacagcagcagccatggccgaacagactgagaaagctttcctaaagcaacctaaggtcttcctcagctcgaagatatctggaaagggaaagagacctggaaagggtggaaacagattcgtgaagaacattgggttgggcttcaagactcctcgtgaagccagtcaaggaacatacattgacagtaaatgtcccttcactggaactgtttcgattagaggacgtatcttagccggtacttgccacagtgccaaaatgcagaggaccattatcgtccgaaggaactaccttcactttgtcaagaagtatcagaggtatgagaagaggcattcgaacatccctgctcatgtctcaccatgcttccgtgtcaaggaaggagaccatgtcatcattggacaatgcaggccattgtccaagactgtgaggttcaatgtgttgaaggtgataccagctggtgcttctgctttcgcaaagaaggctttcactggtgcttaagagtgcttttttatgtttcttgatagagctgaactctgttattacccttttattttaaggatatttttacattgaagtttcacattttaatttttgatgcact

SEQ ID NO: 1170 - DNA, 659 bp, Brassica oleracea
tttgcatctcttctacatcattttcttcagctgagaacagcaaccagtagccatggctgagcagactgagaaagctttccttaagcaacccaaggtcttcctaagctcgaagaaatctgggaaaggaaagagacctggtaaaggtggaaaccgtttctggaagaacattggtttgggtttcaagactcctcgtgacgccattgatggaacttacattgacaggaaatgcccattcactggaactgtttcagtaagaggacgtatcttagctggtacttgccacagtgccaagatgcagagaaccatcgtcgttcgtaggaactatctccatttcgtcaagaagtatcaaagatatgagaagagacactccaacatccctgctcatgtctcgccttgcttccgtgtcaaggaaggtgatcatgtcatcattggccagtgcaggccgttgtcaaagacggtgaggttcaatgtgctgaaggttatcccagcaggtgcatctgcctttgcaaagaaggcattcactggaatgtaagagttttttgaagctatggagagagttttctttgtttggttttgatttttggaatgtgttgtttggtcaccacgtttgtcatcttaaatgttttgtctttggtttggtacttatctctataagagtc

SEQ ID NO: 1171 - DNA, 872 bp, Brassica rapa
gaaggagcgaacttattatataaagattcttgtacattagggttttatccgtcccgaagcttttgccgtcgctgcctacatccttgcctcagagcagaacagcagcagccatggccgaacagactgagaaagctttcctaaagcaacctaaggtcttcctcagctcgaagatatctggaaagggaaagagacctggaaagggtggaaacagattcgtgaagaacattggtttgggcttcaagactcctcgtgaagccactcaaggaacatacattgacagcaaatgtcccttcactggaactgtttcgattagaggacgtatcttagccggtacttgccacagtgccaaaatgcagaggaccattattgtccgaaggaactatcttcactttgtcaagaagtatcagaggtatgagaagaggcattcgaacatccctgctcatgtctcaccttgcttccgtgtcaaggaaggagaccatgtcatcattggacaatgcaggccattgtccaagactgtgaggttcaatgtgttgaaggtgataccagctggtgcttctgctttcgcaaagaaggctttcactggcgcttaagagtgttttttgatgttactttatgtttctcgatagagctgaactctggttattacccttttattttaaagagatttttacattgaagtttcagattttaatttttcatgcactgattttgtttactattctatagtattttcgtcccaatatttgatatttcgttttgaattgcctgagcttatttatctttctcaaactgttaaaaatcgtttaaaccgattggtcctccccggtttggtccgagtggttgatgaattcaatagaaaaaaggatttttat

SEQ ID NO: 1172 - DNA, 973 bp, Fagus grandifolia
ctggaccttggctgtcactcagttagagtgtttccgagctccactttagttttagggtttctattctgcctcctcgtctcgtcaccttgtacatcgtcactcccttcaaccatggctgaacagactgagaaggcatatttgaagcaacccaaggtgtttcaatgctcaaagaaatctgggaagggtaagaggcccggaaagggtgggaatcgcttttggaagagcattgggttgaaaatcaagacacctagagatgcaattgaagggacatatatagacaagaagtgcccgttcaccggtgatgtttctatccgagggcgtatcattactggcacttgccacagtgccaagatgataaggaccattattgttcgaagggactaccttcactttgtcaagaaatatcaaagatatgagaagaggcactcgaacattccagcacatgtttccccatgcttccgtgtgaaagaaggagattatgttgttattggccaatgcaggcctttgtcaaagacagtgaggttcaatgtgttgagagtcgtcccatctggttcttctggtggtgtgaagaaggcatttactggaatttgaaagagtttgactattatagagaaggctggagatattgctggattgaacttttgtaggagcttgctctttcttgtttgtttgtttttttcttcttcttcttcttttgtttaatttcaatatgttttggtagtcctaagtcattttgatggacggcagacttcaggatttgctttctaattaattgcatttttcaagaaagcatttactgcaatgtgaaagagtttgactattatagagaaggctggagatattgggctggattatatttttgtaggagcttgctctttatggtttgtttgttttttttccttatcttcttttgtataatttcaatatgttttggtagtcctaagtcctaagtccttttgatggatggtagact

SEQ ID NO: 1173 - DNA, 1025 bp, Brassica napus
gtttggacgcctgcaggtaccggtctcggattcccgggtcgacccacgcgtccgaagcttttgccgtcgctgcctacaaccttgcctcagagcagaacagcagcagccatggccgaacagactgagaaagctttcctaaagcaacctaaggtcttcctcagctcgaagatatctggaaagggaaagagacctggaaagggtggaaacagattcgtgaagaacattgggttgggcttcaagactcctcgtgaagccagtcaaggaacatacattgacagtaaatgtcccttcactggaactgtttcgattagaggacgtatcttagccggtacttgccacagtgccaaaatgcagaggaccattatcgtccgaaggaactaccttcactttgttaagaagtatcagaggtatgagaagaggcattcgaacatccctgctcatgtctcaccatgcttccgtgtcaaggaaggagaccatgtcatcattggacaatgcaggcctttgtccaagactgtgaggttcaatgtgttgaaggtgataccagctggtgcttctgctttcgcaaagaaggctttcactggtgcttaagagtgcttttttatgtttcttgatagagctgaactctgttattacccttttattttaaggatatttttacattgaagtttcacattttaatttttgatgcacttattttgtttactttcctatagcattttcgtcccatttttgagatctcgttttttctctcaaacagttaaaaagtctattaaactgatcgctccccgtaaccccgcctttcccccacacatgcctgtccctcggcccccaccacgctaaccccgattctgcccatatccatcacaccgccggcacctccagcatgcatctaaaggcccccaattcccctatagtgaaccgcattaccctccccggcccgcggtttccaacgtctggactgggaaaaccctggctctacccccctaaatcccttgccctaccatcccctttcgcaagtggagaaa

SEQ ID NO: 1174 - DNA, 745 bp, Brassica napus
gaaggaacgaacttattatataaagattctcgtacattagggttttatccttcccgaagcttttgccgtcgctgcctacatccttgcctcagagcagaacagcagcagccatggccgaacagactgagaaagctttcctaaagcaacctaaggtcttcctcagctcgaagatatctggaaagggaaagaggcctggaaagggtggaaacagattcgtgaagaacattggtttgggcttcaagactcctcgtgaagccactcaaggaacatacattgacagcaaatgtcccttcactggaactgtttcgattagaggacgtatcttagccggtacttgccacagtgccaaaatgcagaggaccattattgtccgaaggaactaccttcactttgtcaagaagtatcagaggtatgagaagaggcattcgaacatccctgctcatgtctcaccatgcttccgtgttaaggaaggagaccatgtcatcattggacaatgcaggccattgtcaaagactgtgaggttcaatgtgttgaaggtgataccagctggtgcttctgctttcgcaaagaaggctttcactggcgcttaagagtgttttttttaatgttactttatgtttctcgatagagctgaactctggttattacccttttattttaaagagatttttacattgaagtttcagattttaatttttcatgcactgattttgtttactattctatagtattttcgtcccatttt

SEQ ID NO: 1175 - DNA, 753 bp, Cleome gynandra
tcggggagggtttctcagtagctgccgctcgctccaccgtagcctcaagcttcacccgagagcaatcagccatggccgagcagactgagaaggctttcttgaagcagccgaaaattttcctatgctcgaagaggcccggaaaggggaagaggcccggaaagggtggaaaccgcttttggaagaacatcggtcttggattcaagaccccgcgtgaagccattgaaggaactttcattgacaagaagtgccccttcaccggacctgtctcagtcagaggccgtatcttagctggtacttgccacagtgccaagatgcagaggaccattgttgtccgaaggaattatcttcactttgttaggaaataccaaaggtatgagaagaggcactcgaacatcccagcacacatctccccgtgcttccgtgtcaaggaaggagatcatgttatcattgggcaatgcaggccgttgtcaaagacggttaggttcaatgtgctaaaggtgatcccagctggttcatccgccggtggaaagaaggccttcactgccatgtaagagtttggtctaactagtttgtttttttctgggatggagctgaattggatacccttttagtacgatttcaagtttgtgtaagacatgcattttaagttattttgctgcaccacttttgtttattttggggacgaaatttacaacattctgcaagtagatcgatttaaagtgttattctctcttctcatcaatgttttctctt

SEQ ID NO: 1176 - DNA, 872 bp, Cycas rumphii
ggtttatagaggagaaagtgtgttctcctttacccttttggttcgttggcgtgttgatgttcgtcggcatatagaggatcaggagcagagggtgcggcgcggggttgaacgttctgtaaccacggtgggttgatcaggcttcttccatttcttgcagtcatggcggaacagacggaaaaagcttttctgaagcagccgaaggtattccttagttccaagaaatctgggaaggggaaaaggcctggaaaaggtggtaatagattttggaagaatattggtcttggtttcaagacccctaaggaagcaattgaaggaacctacattgacaagaagtgtcctttcactggaaatgtttcaattaggggtcgtatattgacgggaacttgttacagtgcaaagatgacccggacaattatagtccgacgggactatctccactttgttaaaaagtatcaaaggtatgagaagaggcattcgaacatagcggctcacatttcaccttgcttccgtgttaaggaaggtgatcgggttattattggacaatgcaggcccttgtccaagactgtaaggtttaatgtcttgaaagtgattccaatgggttctagcactggtgggagtaagaaagcctttacagcaatctgaagatccattgctgatttttgcttctcattcggtattcatcataccaagtggatttgagctgattattgagttatctggtagtaacattttaaattcaagttttctttgttcctttattaacatgtacatgttttgaaaaatgatttgaatgagcttcaagcataatttatgtggggtaatttttttctgaagattttgatgagataaagaaattgttatttccaatgtta

SEQ ID NO: 1177 - DNA, 735 bp, Taraxacum officinale
cggggggctcttgcccgattatattctctgtgcctccgccactgaaaagctcggatctctaccaacaatggctgaacagacggagaaggcgtttttgaagcaacctaaggtgttcatatgttcgaagaaaagcgggaaaggaaagaggcctgggaagggcggaaacagattctacaagagtgttggtcttggattcaagacaccaagagaggccattgaaggaacttacattgacaagaagtgcccattcaccggcgatgtctccattagaggccgtattctttctggtacctgcaacagtgcgaaaatggtgaggaccattatcgttcgtagggactacttccattttgtgaagaaataccaaagatacgagaagaggcactccaacactccagctcacgtttctccttgtttccgtgtgaaagaaggagaccgagttaccattggacagtgcaggccattgtcaaagactgtgaggtttaatgtgttgaaggtgactcccgctggatcttcaggtactggaaagaaggcgtttacaggcatgtaagaagcttagggtttttaaaaaacaatggaattggatttgcttgttttacagtgacatttggtttctttaagaagtttatgtttcagtagatgtattcggttgcttttttacttttgatgttggcaattatggtatgattgtaacattgaatatcaaattttgatttcgaacttctacttattattgtc

SEQ ID NO: 1178 - DNA, 1007 bp, Mimulus guttatus
gttccgccttacaatctagggtttttgctgctgctgcttctccactttctcacacacttttctcacacactctcacaaactcgcagccatggcggaacagactgagaaggccttcctcaagcagcctaaggttttcctttgctcaaagaagtcaggcaagggtaagacccctggaaagggaggaaatcgctactttaagagcattgggttacaatacaagacaccacgcgaggcttctgaaggcacgtacattgacaagaaatgcccgttcactggtgatgtatccatccgcggccgtattcttgctgggacctgccacagtgcaaagatggtgagaaccatcattgttcggaggaactacatgcattgggtgtcaaaataccagagatatgagaagaggcattcaaatattcctgcgcacatatctccatgcttccgtgtgaaagagggtgatcacgtcaccattggccagtgcaggcccttgtcgaagacggtgagatttaatgttctgaaggtgaatccagcaggttcaactggtcttgggaagaaggcctttacagggatgtgagttggggcacctgagtttcttgtttaagtattaaaaacagtttttgaaaggattgggttttttagacttttactggtttatgttggaactactgtctttcagtttgcattgacaacttaagttttgtatttttgaattggtactctactattgctactttatttatccttttcgtttttactttaaaaattgggtatggaatttattcttcatctgcatttaatggtggattattaatatgcgtatggggtcttaaccaactgtgtgtataagattaatttcttgggatggtaattggggttattgagtagagctgacttgtacaaccttgctatggagaaatgagaagatagaatcagtcaagtaaaatattttattctggcttaagtttatagtagttctgccaaaagagattgtcttggttcaccatatctaatcc

SEQ ID NO: 1179 - DNA, 709 bp, Raphanus sativus
ggattttctttcgtgaagctctctagccgtcgctgcctacatcctttgcctcaaagctttcacgggagcagaagagcagccatggcggaacagactgagaaagctttcctaaagcaacctaaggtcttcctcagctcgaagatatctggaaagggaaagagacctggaaagggtggaaacagattcgtgaagaacattggcttgggcttcaagactcctcgtgatgccattcaaggaacctacatcgacagtaaatgtcccttcactggaactgtttcgattagaggtcgtatcttagctggtacttgccactcggccaaaatgcagaggaccattatcgtccgaagaaactaccttcactttgtcaagaagtatcagaggtatgagaagaggcattcgaacatccctgctcatgtctcaccttgcttccgtgtcaaggaaggagaccatgtcatcattggacaatgcaggcctttgtccaagactgtgaggttcaatgtgttgaaggtgataccagctggtgcttctgctttcgcaaagaaggctttcactggcgcttaaagagtgttttgttatgctagtttatgtttcttgatagacctaaactctgttgttacccttttatcttgaagtttcagattttaatgcactgattttgtttactcttctatagtattttcgtcccaattttgagatttcgtttcgatga

SEQ ID NO: 1180 - DNA, 687 bp, Raphanus sativus
agcaggaggaggaggaggagcaaccagtagccatggcggaacagactgagaaggcatttctaaagcaaccaaaggtgttcctaagctcgaagaaatcagggaaaggaaagaggcctggaaagggtggaaaccgtttctggaagaacattggtttgggtttcaagacttcccgcgaggccattgacggacattacattgacaagaaatgtccactcactggaactgtctctgtgagaggacgtatcttagctggtacttgccacagtgccaagatgcagagaaccatcattgttcgcagaaactatctccacttcgtcaagaagtatcaaagatatgagaagagacattccaacatccctgcccatgtctcaccctgcttccgtgtcaaagaaggtgatcatgtcatcatcggccaatgcaggccgttgtcaaagaccgtgaggttcaatgtgttgaaggtgatcccagccggcgcatctgcctttgcaaagaaggcgttcactggaatgtaatagttttgaagttacggagagtcttcttcgtttggtttttatatttctttcggaattttctgtttgttgatctcttttgtgtaagacttggtctatccacagactgaatagaaacctacgtactactttcgtcatctgaaattactacattcgactgtgctgtgacttctgtctt

SEQ ID NO: 1181 - DNA, 723 bp, Raphanus sativus
ggactttcagtttatcagtcgctgcctcgcctctcgcatctcttttaacattcctcaacagagagcagcagcagcaaccggtagccatggctgaacagactgagaaggcttttcttaagcaacccaaggtcttcctaagctccaagacatcagggaaaggaaagagacctggcaaaggcggaaaccgtttctcgaagaacattggcttcggcttcaagactccccgtgaagccattgaaggaacttacattgataggaaatgtccattcactggaaccgtctctgtaagaggacgtatcttagctggtacttgccacagtgccaagatgcagagaaccatcatcgttcgcaggaactacctccacttcgtgaagaagtatcagaggtatgagaagagacactccaacatccctgctcacgtctcgccctgcttccgtgtcaaagaaggtgatcatgtcatcattggccagtgcaggcccttgtcgaagacggtgaggttcaatgtgctgaaggtgatcccagcgggcgcatccgcctttgctaagaaggcattcactggaatgtaagagctttttttgaagtattgttgttacttttgcttggttttgattttggaatcttgaaatgactactttcatcttttttttatcttcggtatctctagaaatcaactaccttttgtctccttgatcagaaaaccttactgcaataaatcaaaattag

SEQ ID NO: 1182 - DNA, 687 bp, Raphanus sativus
gtgaagctctctagccgtcgctgcctacatccttgcctcaaagctttcacgggagcagaacagcagccatggcggaacagactgagaaagctttcctaaagcaacctaaggtcttcctcagctcgaagatatctggaaagggaaagagacctggaaagggtggaaacagattcgtgaagaacattggcttgggcttcaagactcctcgtgatgccattcaaggaacctacatcgacagtaaatgtcccttcactggaactgtttcgatcagaggtcgtatcttagctggtacttgccactctgctaaaatgcagaggaccattatcgtccgaaggaactaccttcactttgtcaagaagtatcagaggtatgagaagaggcattcgaacatccctgctcatgtctcaccttgcttccgtgtcaaggaaggagaccatgtcatcattggacaatgcaggcctttgtccaagactgtgaggttcaatgtgttgaaggtgattccagctggtgcttctgctttcgcaaagaaggctttcactggagcctaaagagtgttttttatgctagtttgtgtttcttgatagttttgctgaactctgttgttacctttttcaagaaaagagagattttacattgaagtttcagattttaagttttaatgcactgattttgtttaccaaaaaaaaa

SEQ ID NO: 1183 - DNA, 806 bp, Silene vulgaris
cgttttagggtttatcatatcatctgccgatttcaccttcctaaccctaacaatggcagaacagactgaaaaggctttcctcaagcaacccaaggttttcctttcgtcgaagacaactgggaaagggaagagaccaggaaagggaggaaatcgattctttaagagcattggtttgggcttcaagactcctcgtgacgcaatcgaaggaacatacattgacaagaaatgccctttcaccggcaatgtctctatcagagggcgcattcttgctggtacctgtcacagtgctaagatgcaaagaacaataattgttcgtcgtaactatcttcactacatcaagaagtaccaaagatatgagaagaggcactccaacattgctgcgcacgtgtcaccttgcttccgtgtcaaagagggagatcatgttactattggacagtgcaggccattgtcgaaaacagtcagattcaatgtgttgaaggttataccagctgggtctgctgctggtggaaagaaggcctttactgccatgtaaccgcacctatgtgatttcttttgagaggttatgatagttttgtttactaatgtgaaactttttcacgttgtggtcttgtggacaagtctgtagaagagtttttatgatatgattttaaagttattttactcagttgccgaattaatttggcattaccagataattctttcagcatgtctttttttttcgcaactagcttgtcaaaactattggcttgaatatgcgcactaggttttccgttcgaactttgcacaagtttctgtttatgtgttct

SEQ ID NO: 1184 - DNA, 697 bp, Solanum phureja
cccgccttccgttgatcttcctttcaatcatggcggagcagacggagaaggcgtttttgaagcagccaggtgtgtttctaagctctaagaagaccgggaagggaaagaggccaggaaagggaggcaatcgatacttcaaaagtatcgtcttaggatccaagactcctcgtgaggctactgaaggtacgtatattgacaagaaatgcccattcactggcaatgtttctatccgaggtcgtatccttgctggtacatgccacagtgctaagatgaacagaaccatcatcgttcgacgcaattacctacattatgtcaagaattatttcagatatgagaagaggcactccaatattccagctcacatatcaccatgcttccgtgtgaaagagggagatcatgttactattggacagtgcaggcctttatccaaaaccgtgaggttcaatgtcttgaaggtgattccagctggttctggtggtggcgggaaaaaggctttcaccgggatgtaatcttcgtgcctccatttcaaattttgtttcttgtaggaatattatgtcaaaacttttttgctttttactgagttgtcatcttcaaattttggaacttaatgctagtaagtttgttattaagcctctgaactagcttatataatgttatttgattgaagaacctaatacaaaaaggatgtttggtgatt

SEQ ID NO: 1185 - DNA, 720 bp, Tragopogon dubius
ggatctagggtttattgctgctttactctcatcgcgtccgccgctgcagagctcacaatctcgcaccaacaatggcagaacagacggagaaggcgtttttgaagcaacccaaagtgtttctctgctcgaagaaaagtgacaaagggaagaggcctggaaagggcggaaacagattctggaagaacgttggtcttggaattaagacaccaagagaagctattgaaggaacttatattgacaagaagtgccctttcaccggtgatgtctccattagaggccgtattatgaagggtacttgccatagtgcgaagatggttaggaccattatcgttcgaagtgactattttcattttgtcaagaaataccaaagatttgagaagaggcactcaaacactcctgcccacgtctcaccatgtttccgtgtgaaggaaggtgaccatgtcactattggccagtgcagaccgttgtcaaagacagtcaggttcaatgtgttgaaggttgtcccagcaggatcatcaggtggtgttggaaagaaggcatttacaggattttaattatagtagtgttcgtttatttgcttgcttgatcatgtaaaagattttgagaagataacttgagttttgtcgttttgttgacattattaatattctgttgctttttggtttatgccaacacttttaagagttatttaaaactctttgttcgagtttattgcatact

SEQ ID NO: 1186 - DNA, 630 bp, Triticum aestivum
cccgaagcttttgccgtcgctgcctacaaccttgcctcagagcagaacagcagcagccatggccgaacagactgagaaagctttcctaaagcaacctaaggtcttcctcagctcgaagatatctggaaagggaaagagacctggaaagggtggaaacagattcgtgaagaacattgggttgggcttcaagactcctcgtgaagccagtcaaggaacatacattgacagtaaatgccccttcactggaactgtttcgattagaggacgtatcttagccggtacttgccacagtgccaaaatgcagaggaccattatcgtccgaaggaactaccttcactttgttaagaagtatcagaggtatgagaagaggcattcgaacatccctgctcatgtctcaccatgcttccgtgtcaaggaaggagaccatgtcatcattggacaatgcaggcctttgtccaagactgtgaggttcaatgtgttgaaggtgataccagctggtgcttctgctttcgcaaagaaggctttcactggcgcttaagagtgcttttttatgttttcttgatagagctgaactctgttattacccttttattttaaggatatttttacattgaagttcacattttaaat

SEQ ID NO: 1187 - DNA, 910 bp, Manihot esculenta
gggtttagcgagtgaaaagtattttcttcggtgtcttttgcttctctcgctgccgtttcagcttcaccagcttaacttacaaagagctttcaatcatggcggagcagactgagaaggcattcttgaagcaacccaaagtcttcttaagttcgaagaaatctgggaagggaaagaggcctggaaagggtggaaatcgattctggaaaagcattggattgggtttcaagactcccagagaagctattgaaggaacttatattgataggaaatgccccttcactggaactgtgtcgatcaggggtcgtatcttagctggaacttgccacagtgccaagatgatgaggactattattgttcgccggaattaccttcactttatcaagaaataccaaaggcaagtaacagcattactttcaacaatatatgagaagagacattcaaatattccagcacacatatctccatgtttccgtgtgaaagaaggagatcatgttattattgggcaatgcagaccactatcaaagacggttagattcaacgtgcttaaggttattcctgctggatcttctggcagtggcaagaaggccttcactgggatgtgagtttgacggtgatgtttttcaggcaggtattacagtcatggtggacttagggtaatcgggttatttaagataagattttatgtaagatgctccccccctcccttctccctctattctctttttagatcactgattcaattatgggttacttaagatacgtacttcaatttttttggtaatgttgaaatttgttgcttcatacagtgtgtccatcgagtgaattaacgcattttttgtcaaggaaagctagttattggattaacatgaatggtatagagagatgcattcttatatatgttgattgaaac

SEQ ID NO: 1188 - DNA, 722 bp, Cynodon dactylon
cctccatgccctcaccaacgtacctgcccgggcggccgcccgggcaggtcttgaagcagcccaaggtgtttctctgccttaagaaggccaccaaggggaagaagcctggcaagggtgggaacaggttctggaagaacattggccttgggttcaagactccccgtgaagccattgaaggaacctacattgataagaaatgcccattcacgggcactgtgtctatcaggggccgcatcatagctgggacgtgccacagtgctaagatgaacaggaccatcattgtccgtaggaattaccttcactttgtcaagaaataccagaggtatgagaagaggcactctaacatcccagcacacatttcaccatgcttccgtgtgaaggagggagatcatgtgatcattggccagtgccggcctctgtcaaagaccgtgaggttcaatgttctcaaagtcattccggcagggtcaaagagtggagcaggcaagaaggctttcactgccgcttaagatatggtcaactgttgagtaaaaaatccaaggcctggaaaaaacttgtcagaagttttgatgccacctacctgttgcactcatctaccatgtgtactaggaattgggtttgagttacttcaggagcttgagatataaaattctgaaccctgtgtgtacacctgcttgcttagtactaccattctatttcaattacagcatctgattcacgggata

SEQ ID NO: 1189 - DNA, 1453 bp, Prunus persica
cgcaaactagggttagcgtttgttttgttgcaccgaacgttaattcgcctcctctgaaagaccacccctcaactccttgagagctatcaatcaatcatggccgaacagactgagaaggcgtttctgaagcagcccaaggtgttcatcagctcgaagaagtctgggaaggggaagagacctggaaagggtggaaaccgtttctggaagagcgttgggcttggtttcaagacccccagggaagccattgaagggacttatattgataagaaatgcccattcactggaaatgtttctatcaggggccgtatcttggctggcacttgccacagtgctaagatgaacaaaacaatcatcattcgacggaattatctacattacatcaagaaatatcaaaggcatgattcttgtattcatgtgtatgagaagagacactcgaacatacctgcgcatgtgtctccgtgcttccgtgtgaaagaaggggatcatgttaccatcggacagtgcaggccattgtccaagactaagaggttcaatgtcttgaaggtgacccctgctggatcttctggtgctggcaagaaggctttcactggaatttgatttggtatctgatttttgtggtaggctggtgctgaaggcatttttggttttggcaagctgattatgttatagacttgaggagatatagtagcttccccctgttctcacccaccttcttctccccatcgatttttgatgtaatggttaaattttgtggttttgaagatccccatggtatcaaaataggcatatttcaattgtttgtttcccaatccagatcctaataatttgcatcatcaatagtgtcctttgagttgaaatgactactgcaccttgctagaaaatgctaatgttatgagttattttttggatggacatgcttgggcacaagttcttattgcatatgttctgtcgtggagtccgatgaacattgcaattatgtcattgtagttgcagctgttaccacaaccaccaggtctgccgtgtgcgtgctagtactgcaccaccccggctactgaaacgatggctaattttgttttgttaatggtgcgagttgagtgcataccaagttgtctttgtggaagcccaaaaataaaatggtatgggcagcaaagtgggtatgaaattcttgtttacgataaagccaacccagataccacactaacccaacccaagaaataataaggcccatatctctcaacccaagttaatagctttgcaggatgggcaacaccaccgcaagctgcactaataatatccggtggacaaggttgtgccacgtcaggatgcacccactgacaccaggccacgtattggtctcacttggtgttgagtaagcaagcagcctactaggaagattccttttttaaagtataaagaaagtgtcctgaagaagaagaagagctcctcctttctt

SEQ ID NO: 1190 - DNA, 604 bp, Camellia sinensis
ggggattctcagcatccttcttcgactcctctcatcctcctcgtatcctcagaatcgtcaatcatggccgaactgactgagaaggcatttctgaggcaacccaaagtgtttttgtgctcgaagaagactgggaaagggaagaggcctggaaagggtgggaatcgcttctcgaagaacgttggtctgggatttaaaactccccgagaagccattgatggaacatacattgacaagaaatgccccttcactggcaatgtatctatcagaggccgcatcctagctggcacatgccacagtgccaagatgatgagaaccattattgttcgacgaaattatctccactttgtgaagaaataccaaaggtatgagaagaggcactcaaatattcctgcacacatatctccatgcttccgtgtcaaggaaggggatcatgttaccattggccaatgcaggccttatgtcaaagacagtgaggttcaatgtgttagaaagtgatccccgctggatcgtctggtggtggcgggaagaaggtttcgctgccatgtgagcattatcttccaaattgcttcgcagtttatgttgctctattcttggtgatgaccta

SEQ ID NO: 1191 - DNA, 502 bp, Acacia harpophylla
gatcacactttgcattctgctactccattctctaaccccaagtgcttcaaccatggcggaacaaactgagaagggtttcctgaagcagccaagagtgtttctaagctcgaagaaatctggaaaggggaagaggcctggaaaaggagggaaccgcttttggaagtctgttggtcttggattcaagactcccaaggaagctattgaaggaacctacattgataagaagtgcccctttgttggcaatgtttctatcaggggtcgtatcattgctggcacttgtcacagtgctaagatgacaagaaccataattgttagaaggaactatctccattgggtcaagaagtaccagaggtatgagaagaggtactcaaacattcctgctcacatatctccttgctttcgtgtaaaagaaggagatcatgtgatcattggccagtgcaggccactctcaaagacagtgaggttcaacgtggtaaaagtgatcccagctggatcttctagt

SEQ ID NO: 1192 - DNA, 1570 bp, Amborella trichopoda
atgagtgggcagttttgtaattagtgtccttctctgcacccctaatggctattttatggcagttttttgggatataaaagtttagggcgcatggtggcgggggtctgctttcagaggattagggttttggaatctgaaagttggggaccgttctcttcgtcgccatggcggaacagacagaaaaggcttttttgaagcagccaaaagtgtttttgagctccaagaaatccgggaagggaaaaaggcccggcaaaggtggaaatcgtttctggaaaaatattgggttgggtttcaagactcctagagaagcaattgaagggacttttattgataagaaatgtcctttcactgggagcgtctccatcaggggtcgtatattgaccggcacctgctacagtgcaaagatgacaaggaccatcattgttcgcagagactatcttcacttcgttaagaaatatcaaagatatgagaagcggcattctaatattccggcgcacatatccccttgctttcgcgtgaaggagggtgatcatgttgtcattggtcaatgcaggccattgtcgaagactgtacgattcaatgttttgaaagtaataccagctggttctgctggtggtggtgggaagaaggcttttgcacccatctagttggattttctctacatataagcttttaccaattttgctctttgaattcctttttgatctaatcatggttagggttgggaatttccccttactcttttccgtttaaaaactgagagaaagtgaggtctgccagatcgctctccttctattgtggctcaggtatttgtattttttcatctcttttgtagtcaagataatttgaagtctatgaaattgctcttatcctttacatatataagaatctgcgccttaggggttttagactgcatttggctcttggatgtgtgacatgatgatgaattaattgaaagtctaggttgaattaattgagaacgaggaataagagcatggtgagtgacctgatctgttattcaaacacaaaagtgaaagcttgccatcacatgtttgagacatgtatcatgatctcctagactgctttgtacattagtcttgtcttatttgttgggattctaatgatgttaaatatttctgaatgtctgtgacagattaatttactttgattgcttcaaaccctgtgttcattcttgaacttgattggttaagctgtgattggacacctcgtctcaagtttgaatctcactgccaaactaccatgtaacaaggttgtttactttaggtcaagaagaaaatgtcacaatcatcccccgttatggaatctgataattggggatattatttctctatatttttttagggatttatgcaatgagactatttacttttcctacatggggtcacaattatttataatcacttgatgtaaaatctgatagcttggatgtgtcacaaagttcgaggaaatattttttgaactttgagcttgatcaatacaataaatgtagctacccaatttcacatcctatggtcaagattaattgtgactattttataccaaagataaa

SEQ ID NO: 1193 - DNA, 589 bp, Ambrosia trifida
gcctccacaggtaaaaaaccaaaccaaagcttggatcttttcaacaatggctgaacagactgagaagggcgtttttgaagcaacccaaggtgttttatgttcaaagaagagtgggaaaggaaagaggcctgggaaaggtgggaacagattctggaagagtattggtcttggctttaagacacctagagaggctattgatggaacttacattgacaagaaatgccctttcactggtgatgtatccattagaggacgtattattgccggcacttgccacagtgcaaaaatggttaggactattattgttcgtcgggactacctccattatgtcaagaagtatcaaaggtacgagaagaggcactcaaacattccagcacacatttctccatgtttccgtgtgaaagaaggtgaccatgtcactattggacagtgcagaccattgtccaagaccgtgaggttcaacgtgttgaaggtgatcccagctggatcttcaagtgcaggcaagaaggcgtttacaggcatataagacatttatcttgtccatctcgttttgcaaagacagtttaattcgatttgcagattttgaagt

SEQ ID NO: 1194 - DNA, 886 bp, Amorphophallus konjac
aacgaacagagcacgttagtttccgcccacgaggttagggttttcgaacgctctcccccactccgcggttcttccgtccgccggcggccaccttcctcgtcgtcctgccactagatcccaccatggcggagcagacggagagggcgttcctgaaacagccgaaggtttttctctgttcgaagaagtctggaaaggggaagaggcccggcaagggtggcaaccgttactggaagagcattgggctcggattcaaggtccccagggaggccattgaagggacatacattgacaagaaatgcccatttactggtaatgtttctattagaggccgcatcctaagtgggatatgccacagtgccaagatgaacagaaccatcattgttcgcaaagactacctgcactacgtaaagaagtatcagaggtatgaaaaacgtcactccaacatcccggcccacgtttccccttgcttccgtgtgaaggaaggagaccatgtaaccattggacagtgcaggccattgtctaagactgtaaggttcaatgttttgaaggtcactcccgcgggatctgcaggtggtggcaagaaagcttttgcagcattctgagtgtcttgctataggaaattattagatggggtgggtgttaaaattttggatatggttgaggccatctcatttgaattgttggtttaatatgtgttcactttcccaggaatccgtcttttgaaccttttggtttccagtgttcttatccggtattttagttaattaagaatttaaggaattttctgcaaatttgatgaaactcatttcattaggaatactgattttcctgttgaactcagcgatggatgtatgtagcgcttggccttggcaatgtgcactttgac

SEQ ID NO: 1195 - DNA, 591 bp, Castanea mollissima
tgcctcctctttctcttcctcctacttctcccaatctcctcaaccatggctgaacagactgaaaaggcatttttaaagcagcccaaggtgtttctaagctcaaagaaatctgggaaggccaagaggcctggaaagggtggcaatcgctattggaagaacattgggctgaatttcaagacacccagagaggcaattgatgggacatatattgacaagaagtgcccattcactggcaatgtttcaatcagaggtcgtattatttctggcacttgccacagtgccaagatggtgaggaccataattgttcgaagggactaccttcactttgtcaagaaatatcagagatatgagaagaggcactcgaacattccagcccatatttccccatgcttccgtgtgaaagaaggcgattatgttaccattggccaatgcaggcctttgtcaaaaacagtgaggttcaatgtgttgaaagtcctctctgctggctctgctagtgctgggaagaaggcatttacagggatgtgaaagtgtttgattgttatagagaaggctggagatattttcctggattaaattttgtaggagcttgct

SEQ ID NO: 1196 - DNA, 793 bp, Cryptomeria japonica
ggaataaccctctggattaactcgtgtactacacagatgtatgaaaaatagatcaaatgtttccctagttcccctttcacacctctttgccctactcatcgcacgatttaaacccttatataaagatttagacaattctgagcaaggagagaaccagagtggtggcggcggctcttgctcagcaagtgtgcgtgcacagcgtactaaaggttttgggggaaattttgtttttatttgctcgttgcagtttggaaagcacgataattcctcacgtccgcaccttcaagaagggttgaaggaggattggggctaaggttcgcagcgatggctgaacagacggagaaagcttttttgaagcagcctaaagttttcctctgttctaagaagtctgggaaagggaagaggcccggtaaaggaggcaataggttctttaagaatattggacttggctttaaaactcctaaagaagccgttcaagggacatacattgacaaaaaatgcccattcactggaaatgtgtcaatcagaggtcgtattttaactggaacatgccacagtgcaaaaatgaatcgcacaatcattgttcgccgcaattacctccattttgtcaagaagtatcaaaggtatgagaagaggcattcaaacataccagcgcatatttcaccttgtttccgtgtgaaggaaggggatcatattatagttgggcagtgcagacctttgtccaagactgttagattcaatgtcttgaaggtgataccagcaggttctagcagtgggtcagcgaacaaaggtt

SEQ ID NO: 1197 - DNA, 931 bp, Papaver somniferum
ctccgactcagcacacataaacctaaactctctcgtctctcttcctcccactcgcctctgaagaagaaaactcaaccatggctgaacagacggagaaggcttatttgaagcaacttaaggtgttccaatgctccaaagtatctggtaagggaaagcgtcctggaaagggaggaaaccgatactacaagaatgttggtttgggattcaagactccccgagaagctattgaaggaacatacattgacaagaaatgccccttcactggcaacgtttctatcaggggacgtatcctggctggtacttgtcacagtgcaaagatggtgagaaccatcattgttaggagaaattaccttcactatgtgaaaaaatatcaaagatatgaaaagaggcactctaacattccagctcacatttccccatgtttccgtgtgaaggaaggtgaccatgttactgttggtcaatgcaggccattgtcaaagacagtgaggttcaatgttcttaaagtcatcccagctggttcttcaggtggtggtggaaagaaggctttcgtcgctatgtaaggaattggttctcagtagtcttcccagtcaactggattcgatgaagctttaatgtttaagatgttatagaatgagtgaacaacagtttccaaatattgtagtttccttgcgttttattgaatctgttgctggaatttttgttttgatttagaagcaagataattactagacaaggtagataggtgtcctgttttggcatttgactacgatgaacttgatatgattttattttgctcctcttctgcattcattgcttttccatcttttccatgtttgaacatagattaatggcccttactttgttgtgaatgggacttcagcttattagttaattattaaaacatgtaatgaacatgttttgtgctgttcct

SEQ ID NO: 1198 - DNA, 749 bp, Papaver somniferum
ttaagcactctcgtctctcttcctcccactcgcctctgaagaagaatacttaaccatggctgaacagacggagaaggcttatttgaagcaacttaaggtgttccaatgctcaaaagtatctggaaagggaaagcgtcctggaaagggaggaaaccgatactacaagaatgttggtttgggatttaagactcccagagaagctattgaaggaacatacattgacaagaaatgccccttcactggcaacgtttctattaggggacgtattctggccggtacttgtcacagtgcaaagatggtgagaaccatcattgttaggagaaactaccttcactatgtgaagaaatatcaaagatacgaaaagaggcactctaacattccagctcacatttccccatgtttccgtgtgaaggaaggtgaccatgtcaccgttggtcaatgcaggccattgtcaaagacagtgaggttcaatgtccttaaagtcatcccagctggctcttcaggtggcggtggaaagaaggctttcgtcgctatgtaaggtgtcagtggtctttccagtccatggattcaatgaagctttaatttttaagatgttatagaatgagcagacaacagtttccaaatattgtagtttccttctgtttttatgaatatgttgctggaatttttgttttgatttagaagcaagatactagacaagctagatagtgtcctattttggcattttatgtgatctgcgtccaattgat

SEQ ID NO: 1199 - DNA, 665 bp, Papaver somniferum
aaacctaaactctctcgtctctcttcctcccactcgcctctgaagaagaatactcaaccatggctgaacagacggagaaggcttatttgaagcaacttaaggtgttccaatgctctaaagtatctggaaagggaaagcgtcctggaaagggaggaaaccgatactacaagaatgttggtttgggtttcaagactcccagagaagctattgaaggaacatacattgacaagaaatgccccttcactggcaacgtttctatcaggggacgtatcctggctggtacttgtcacagtgcaaagatggtgagaaccatcattgttaggagaaactaccttcactatgtgaaaaaatatcaaagatatgaaaagaggcactctaacattccagctcacatttccccatgtttccgtgtgaaggaaggtgaccatgttaccgttggtcaatgcaggccattgtcaaagacagtaaggttcaatgttcttaaagtcatcccagctggttcttcaggtggtggtggaaagaaggctttcgtcgctatgtaaggaattggttctcagtagtcttcccagtcaagtggattcgatgaagctttaatgattaagatgttatagaatgagttgaacaacagtttccaaatattgtagtttccttctgttcttttaatc

SEQ ID NO: 1200 - DNA, 1147 bp, Papaver somniferum
taaacactctcgtctctcttcctcccactcgcctctgaagaagaatcaaacctaagcactctcgtctctcttcctcccactcgcctctgaagaagaatacttaaccatggctgaacagacggagaaggcttatttgaagcaacttaaggtgttccaatgctcaaaagtatctggaaagggaaagcgtcctggaaagggaggaaaccgatactacaagaatgttggtttgggattcaagactcccagagaagctattgaaggaacatatattgacaagaaatgccccttcactggtaacgtttctattaggggacgtatcctggccggtacttgtcacagtgcaaagatggtgagaaccatcattgttaggagaaactaccttcactatgtgaagaaatatcaaagatacgaaaagaggcactctaacattccagctcacatttccccatgtttccgtgtgaaggaaggtgaccatgtcaccgttggtcaatgcaggccattgtcaaagacagtgaggttcaatgtccttaaagttatcccagctggttcttcaggtggtggtggaaagaaggctttcgtcgctatgtaaggtgtcagtggtctttccagtccatggattcgaggaagctttaatttttaagatgttatagagtgagcggacaagagtttccaaatattgtagcttccttctgtttctatgattctgttgctggaatttttgttttgatttagaagcaagataattactagacaaggtagatagtgtcctattttggcatttgatgtgatcttattttgctcatgtcttgcttatgcatcatctgcgtccaattgatttattttatattgaaacataggatgctggtcttgttttgttgtggacgaggtgtggaagataagagcagtcctgaatatttgatattgacatggggtgcgccgcgaaaatcaaacaagggacttgtgaataaagtgaatacgatgaatatcaaaatatttttacctgaattgtttgctgagtaaggggacgaggtttgttctatagatcatgtaccaagtctcaatggcctcaccgggtttcactgaagtgtgtgaattgcttttttctattgcagttgaaaatagcatgccaaaatttgatcttggacat

SEQ ID NO: 1201 - DNA, 649 bp, Raphanus sativus
gtggagagcagcaggagcaggaggagcaaccagtagccatggcggaccagactgagaaggcatttctcaagcacccaaaggtgttcctaagctcgaagaaatcaggaaaaggaaagaggcctggcaaaggtggaaaccgtttctggaagaacattggtttgggtttcaagactccccgcgatgccattgacggacattacattgacaagaaatgtccattcactggaactgtttctgtgagaggacgtatcttagctggtacttgccacagtgccaagatgcagagaaccatcattgttcgcagaaactatctccacttcgtcaagaagtatcaaagatatgagaagaggcattccaacatccctgcccatgtctcaccctgcttccgtgtcaaagaaggtgatcatgtcatcattggccaatgcaggccgttgtcaaagaccgtgaggttcaatgtgttgaaggtgatcccagccggcgcatctgcctttgcaaagaaggcattcactggaatgtaatagtttttgaagttacggagagtttctttgtttcgtttttatgtttcagaatgttttgtttgttgatccctcttgtgtgagacttggtttatccgcagactgaatagaaacctacgtactactttcgtcat

SEQ ID NO: 1202 - DNA, 737 bp, Silene vulgaris
tctgccgaaacatccaacttctctctctactccaaacatttctcaagcttcaacaatggcggaacagactgaaaaggctttcctcaaacaacccaaggttggaatcttgacgaagagcggagggaaaggtaagagaccaggaaagggaggaaacaggttctttaagagtattggtttgggattcaagactcctcgtgatgccattgaaggaacctacattgacaagaaatgccccttcactggcaatgtgtcaatccgaggacgtattcttgctggtacttgtcatagtgctaagatgcaaaggaccatcattgttcgtcgtaactaccttcactacattaagaagtaccaaaggtatgagaagaggcactccaacattgcagcacatgtttcaccttgcttccgtgttaaggagggagaccatgttatcattggacagtgcaggcccttgtcgaagactgtcagatttaatgtcttgaaggttattccagctgggtctgcttctggtggaaagaaggctttcactgccatgtaatcacatttggtgcccgtctttatttctttcgagaacttaagtttatttcagaaaccgtcttttccagttttgatcatgtactggtagtagaagtatgtgtaatgacgatattagagtttttggctactcgacttcctaaatttggcattaccagattatttctcctttcatcctttgtcgaattcatttatttaccaatctt

SEQ ID NO: 1203 - DNA, 474 bp, Eutrema parvulum
gcagacggagaaggcgtttctgaagcaaccaaaagttttcttatgctcgaagaaatctggtaagggaaagaggcctgggaaaggaggcaatcgcttctggaagaacattggtcttggtttcaagaccccaagagatgctgtcgaaggaggatacgttgacaagaagtgtccctttactggtacggtttcaatcaggggccgtatcctggcgggcacttgtcacagtgcaaagatgcagagaacaatcattgttcgtaggaactatcttcactttgtgaagaagtaccaaagatacgagaaaaggcactcaaacattcctgctcatgtttcaccttgcttccgtgtcaaagaaggagatcacgttatcattgggcaatgcaggccattgtcaaagactgtgaggttcaatgtcctgaaggtcattccagctggaagctctgcttttgggaagaaagcattcgccggaatgtgaag

SEQ ID NO: 1204 - DNA, 694 bp, Triphysaria pusilla
gagcttcgtagcacgcagccatggcggaacagactgagaaggcttttttgaagcagcctaaggtgtttctaagctcgaagaaggcgggtaaggctaaaactccaggaaagggaggaagcagatacttcaaaagtatcgggctgaactttaaaacaccacgggaagctatcgaaggtagctacattgacaagaaatgtccgttcactggtggtgtatccatcaggggccgtattattgccggaacatgtcacagtgcaaagatggttcgaacaataatcgttagacgtaactaccttcactgggacagcaagtacaaaaggtatgccaagaggcattcgaatattgctgcacatatatccccatgtttccgtgttaaggaaggtgaccacgtcatcattggccagtgcaggcccttgtcgaaaacagtgaggtttaatgtcctcaaggttgttccggctggttcttcgggtcttgggaagaagtcttttacaggggcttaagattgggaaaaatctgaaattcatattagtttttttaaagattttggtaattgactattgatgtttcatttggatgtatttccatacttcggcttattgttataagttttgagttttgtggtgcacatttttatttactatgaacaatttttcttatgaaatcaatttagttttttaacaaaaaaaaaaaaaaa

SEQ ID NO: 1205 - DNA, 914 bp, Vinca minor
tcctttacagagttcacagcgcctccccaattcacttccgcagccgacgtcaccgtgagaccaccagcaacttcagccatggccgaacagacggagaaggctttcctcaagcagcctaaggttttcctttgctcgaagaagactggtaagggaaagagaccaggaaagggaggaaacagatactggaaaagcattggattagggttcaagacccctcgtgatgccattgaaggtacctacattgacaagaaatgccctttcaccggcaatgtttcaatcagagggcgcatcctttctggaacctgccatagtgctaagatggtgcgaactatcattgttcgtagaaattacttgcactttgtcaagaagtatcagagatacgagaaaaggcactcaaacatcccggctcacgtttctccatgcttccgcgtgaaagagggagattatgtgactgttggacagtgcaggccactatcaaagactgttcgattcaatgtagtaaaggttattcctgctggttcatctactgggggaaagaaggccttcgccgggatgtgaggaattgttctgaatttccttttaagtttctggagaaaagttgtagacttttcttttactattagtcgaaaattgtatcctttggttttttgcttggcttaaactttgcaactaagtagttgcagtattaatgtcgtttggtttctgatatacaaagtttgatatgaatttcagaattccttaaaactagccccagtagatccgtagagttttgatttattctattgaatgttgtacttgtgagctgaagggttgacttaaccaaagataaggcatgggtagatttactaggtagaagaatttaaagctcgaaaaagtgtgggcgtccctcttaattgggccgatttggttgatgc

SEQ ID NO: 1206 - DNA, 717 bp, Vinca minor
atcgcctccttctagggttttgagagcaccgtctcctccccaattcacagccgtcccgaaccaccaccagcaaccgcaatcagccgacagacatggccgaacagacggagaaggctttcctcaagcagcccaaggttttcctttgctcgaagaagactggaaagggaaagagaccaggaaagggaggaaacagatactggaaaagcattggcttaggattcaagacccctcgtgatgccattgaaggtacctacattgacaagaaatgccctttcactggaaatgtttcaatcaggggccgcatcctttctggtacttgccacagcgccaagatggtgcgaactatcattgttcgtagaaattacctgcactttgtcaagaagtatcagagatatgagaaaaggcactccaacattccggctcacgtttctccatgcttccgtgtgaaagagggagattatgtgactgttggacagtgcaggccactatcaaagactgttcgattcaatgtagtaaaggttattcctgctggttcatctactggtggaaagaaggcctttgctgggatgtgatgatttgttttgaatttcattttaagttactggagagagatgttgtagactctttcactattagtcgaaaatagtatcgattttgtcttgatttcctaaaacttttgcgactaagtagtaacagtacaatctgttggtttctgat

SEQ ID NO: 1207 - DNA, 961 bp, Vinca minor
ttataagtgttcccagccgctcctcctcctccatctccattcacagccaccgctaaaccaccaccagcaaccgccccaatcagcagccatggccgaacagaccgagaaggctttcttgaagcagcccaaggttttcctttgctcgaagaagactggcaagggaaagaggccaggaaagggaggaaaccgatactggaaaagcattggcttaggcttcaaaacccctcgtgacgccattgaaggtacctacattgacaagaaatgccctttcaccggcaacgtttcaatcagagggcgcatcctttctggaacctgccatagtgctaagatggtgcgaactatcattgttcgtcgtaattacctgcactttgtgaagaagtatcagagatacgagaaaaggcactctaacattccggctcacgtctctccatgcttccgtgtgaaggagggagattatgtgactgttggacagtgcaggccactatcaaagactgttcgattcaatgtagtaaaggttattcctgctggttcatctactgggggaaagaaggcatttgctgggatgtgaggaagttctgaatttccttctagtcttggagaggttgtagacttttttttactattagtcaaaaatagttatcgattttgtcttgaatggcttaaactttgcacttaattagccacagtattaatgtctattggtttctgatatttgaaatttgagatgaatttatatccttgaaactaggggtggaaatgagttgagccggctcgtgagtagctcacgattcgattcgatattttggctcaacgagctaagctcataagctaaatgagcgatacatgagcccagatttttggtctcatctaaaatatgaatcgagcttgagctaagtagagttcgactcatttgtctcatgagctggctcaatatatatatataaacatggagtggactagt

SEQ ID NO: 1208 - DNA, 692 bp, Allium cepa
cagccgtccgccttcacttgtacacgaatcttcgcaatggctgagcagactgagaaggctttcttgaagcaaccgaccgtcttcctctgctcaaagaaatctggcaaaggaaagaagccagggaaagcagggaatcgactttggcgcaatgttggccttggattcaagaccccaagagaagcaattgaaggaacttatatcgataagaaatgccctttcactggtcatgtctccattagaggtcgtatcattgcaggaacatgccacagtgcaaagatgaacagaactattattgtcggaagaaattatcttcattatgtgaaaaaatatcagaggtatgagaagaggcactcaaacataccagcacacgtttctccctgtttccgtgttaaggaaggtgaccatgtgatcataggcctagttgtctaggtcctacttgtctaaaacagtgaggttcaatgtgttgagggttattccagctggatctacaggtggtggaaagaaggcttttgtagcagcttaagagttcattttaaagccaatgattgatgatatatgcatgtcttgtttagatgtttcttgatctgtttccctgttttgaggtacgtagttatttttggttccgtggaaatgtttgtttattttgactaaattgcagaatttttatgagactaagcttatgttgttttctg

SEQ ID NO: 1209 - DNA, 806 bp, Cenchrus ciliaris
cgcggcgccgcacacatggccggccgaggtccaccgcgcaagtcatggggggagcagactgagaaggctttcctcaagcagcctaaggttttcctcagcacaaagaaagcggacaagagtaagaagccaggcaaggcaggcaaccgcttctggaagagcattggccttggtttcaagacccccagggaagcaattgaagggacctacattgacaagaagtgcccattcactggaactgtttctatcagaggcagaattattgctggaacatgccacagtgctaagatgaacagaaccatcattgttcgcaggaactacctccactttgttaagaaataccagaggtacgagaagaggcactccaacatcccagctcacatctccccgtgcttccgtgtcaaggagggtgaccatgtcatcatcggccagtgcaggcccctgtccaaaactgtgaggttcaacgtcgtgaaggtcatcccagctggatctactggcggtgcaggcgggaagaaggccttcaccgcagcctgagcttctagactatgttccatgagtagtctatagaacgatgtctttttgctttaaaattcctgctaggctggtgttttcgactatggtttggagattgttccctgtctaaatggagccccatcatctgaacatgttactctttatggaatcctgtcgtgcaaagttttgttatggtctggtatcgtttccccactgatgtggcattgctgcagtacttttacctgcctacggggataaaacttgtgtccttgtaattgtgcaagaacaacactccc

SEQ ID NO: 1210 - DNA, 735 bp, Cirsium arvense
gttttgaagcaaccgaaagtgtttttatgctcaaagaaaagtggaaaagggaagaggcctgggaaaggtggaaaccgattctggaagagtgtaggtttaggctttaagacgccaagagaggctattgaaggaagttacattgacaagaagtgccctttcactggcgatgtctcaattagaggccgtattcttgctggtacttgccacagtgctaagatggttaggaccatcatcgttcgtcgcaactacctccattttgtcaagaaataccaaagatacgaaaagaggcattccaacattccagctcacatttctccttgcttccgtgtgaaagaaggtgatcatgtcacagttggacagtgcagaccattgtcaaagacggtgaggttcaatgtgttgaaggtgatcccagctggatcttctggtggtggaaagaaggcctttaccggcatataattctttactatcttagattcaattttcagagtgaaatatgtactttgcctttaaaatgtcttcttttgtttttcacaatcctataagttttgattgacttactacatcatatttattggttgctactttatggtttgcatttagaaagccacatgaggatatcaccttcaaagggctacttgtttaagtagttgggaggagagtgtaattgtttggtggtgctgaaatcatgatataattgtaccacatgagccaaagatatgcacatatacaagtaaa

SEQ ID NO: 1211 - DNA, 956 bp, Panicum virgatum
aatgttttgcatctgcccattttccagactgagaaggctttcctcaagcagcctaaggtattccttagcacaaagaaatctgccaagggtaagaagccaggcaagggaggcagccgcttctggaagagcattggcctgggcttcaagacccccagggaagcaattgaagggacctacattgacaagaagtgcccattcactggaactgtttccatcagaggcaggattattgctggaacatgccatagtgcaaagatgaacagaaccatcattgttcgcaggaactacctccacttcgttaagaaatatcagaggtacgagaagaggcactccaacattcctgctcacatctccccgtgcttccgtgtcaaggaaggtgactatgtcatcatcggccagtgcaggcccctctccaaaactgtgaggttcaacgtggtgaaagtcatcccagctggatccactggtggcagtggcgggaagaaggccttcaccgcagcctgagctttagactgttccatgagtagtctatagaatggtgtttttttgctaaaaaatcctgctaggctggtgttttcaactatggtttggagattgttcgctgtctgaatggagtctcatcaccagaacatgttactctttatggaatcctctcgtgcaaagttttgttatgatctgtattgtttcccctctgctgctgtggctttggtgcaatgcttttcccagcatatcccagtcatcgttcaagatagttcattgttcaagataatcgaacgtaatttcctctctgctccattgcattaagcagaggcctcgtagcgagcctggtggacgctgccggggttgagcttcattaagcagctgtggcagatttgttgtatattacgctcagtttgagagagttgagtgcgtgagggcatctgttcgtgttgtgcaagataatgctaatgccattcgta

SEQ ID NO: 1212 - DNA, 496 bp, Aquilegia formosa
gctttgtttcttgttaaatacagacagagaaggcttttttgaagcaacccaaggtttttcttagttcgaagaaatctggaaaaggaaagagacctgggaaaggaggaaatcgtttttataagagcattggtttgggttttaagacacctagagaagctattgaaggaacatatattgataaaaagtgccccttcactggtgatgtttcaatcaggggacgtatcctgtctggaacctgccatagtgcgaagatggtaagaaccatcattgttcgcaggaactatcttcatttcgtgaaaaaatatcagagatatgagaaaaggcactccaatattccagctcatgtatctccatgcttccgtgtgaaagaaggtgaccatgtgactataggccagtgcaggcctttgtcgaagactgtcagattcaatgtgttgaaggttattccagctggatcctctggtggtggtggaaagaaggcttttgcagcaatctaact

SEQ ID NO: 1213 - DNA, 702 bp, Arnica chamissonis
gtaagcaaccgaaggtgttcttatgttcgaagaaaagacggtaaggggaaaaggcctgggaagggtggaaacagattctggaagagtgttggtcttggattcaagacaccaagagaggcaattgaaggaacttacatcgacaagaaatgccctttcactggtgacgtgtctattagaggacgtattcttgctggtacatgcaacagtgccaaaatggttaggaccattattgttcgtcgggactacctccattatgtcaaaaagtatcaacggtatgagaagaggcactcgaatattccagctcacatatctccatgttttcgtgtgaaagaaggcgaccatgtgaccatcggacagtgcagaccattgtccaagacggtgaggttcaacgtgttgaaggtgattccagccggatcttctggtggtgggaagaaggcctttacaggcatataagaaagcttatcgtgtctaccttgttaggttttgcaaaaacatttcaatttgatttgctgattttgatgggtaatgtgttttgattatgtttgatgtttacataacgattattaattgccttacacgtctcaacgtgtatgtcatcggtatcttaggttcttatctgtctttatggtatctgattttttattttttgctattgttccgtaagggcatcttggtagttaagtggtgtctcgtaatcaaaat

SEQ ID NO: 1214 - DNA, 446 bp, Bupleurum chinense
tctctcaatggcggaacagactaaaaaagcattcctgaagcaacctaaggtctcctttgctcgaagaaatcagggaagggaaagaggccaggaaaaggagggaatcgtttcttcaagagcgttggcctagggtttaagactcctagagaggctattgaagggacatacattgacaagaagtgcccatttactggagatgtatccatcagaggccgtattcttgctggtacatgccacagtgcgaaaatgatgaggactattattgttcgccgcaactatctgcattatgtcaaaaaataccagaggtatgagaagaggcattcaaacattccagcgcacatttccccttgctttcgtgtgaaggagggtgaccatgtaattattggccaatgcaggcctttgtcaaagacggtgcgatttaatgtgctcaaagtgattccagctgg

SEQ ID NO: 1215 - DNA, 985 bp, Distylium racemosum
agcgagaccggccaacagttccgccacgttaggagtcgcccagatacatatttgcgatcatggcggaaacacagaatgtgcagactgagaaagcatttctcaagcagccgaaggtttttctctgttcaaagaagtctggcaaggggaaaaggccagggaaaggaggtaacaggttttggaagaatattggtcttggtttcaagaccccaaaggaagctattcaagggacctacattgacaagaagtgtcctttcacgggttctgtgtcaatcaggggtcgcatattgactggaacctgttatagtgcaaaaatgaaccgcacaataatagttcgtaggaattatctgcactttgtcaagaagtatcaaaggtatgagaagagacattcaaatataccggctcatatttcaccctgctttcgtgttaaagaaggggatcatgttattgttggacaatgcaggcctttgtccaagactgtaaggtttaatgtcctgaaagtgattcctgctggttctagtggtggtggtgataaaaagaaaggctttgctgcactgtaatccctttatctaacgaattttccacagcagttagattttttcaagtactggggaagagattctgataaagatagatgttggtttcctttttatcataatttgatttgatttttgtcttttgtctaaatttttcactcatttgagatttttaacatcttgaaggcagtcattttggtagagttcaggtttcagaacaagtactatgtactgagttttgtctagttctttatgcgttaacaaaaggtttgaaggtgtaacatttcaatcaaaaacctgagtggaattttccttggttgaaatttgttatcctctttcagaggaagctatgtgatttttggtactgtttgccttactcgactacttaaatgatgtaatgttctcccatgaacgctgatgataatttctcttatcttatatataaagaattt

SEQ ID NO: 1216 - DNA, 846 bp, Gnetum gnemon
caaaattctggtcgaattctgccttgtttttagggttagggttgggcacgattcggaaaagtacgtgtaagggttttaacgttgctagagttgcaggggcagcggagcaggaaaggccaaagaagaagaagaagaagcagcagcagcaactatgtcgcaggccgagcagacggagaaggcttttctgaagcagcctaaagttttcctttgttctaagaaatctggcaaaggcaaacgaccgggaaagggaggaaaccgtttttacaagaacatcggtcttggcttcaagacgcccaaggaggccattacagggaattacattgataagaaatgtccatttagtggaaatgtatccatcaggggtcgcattttggctggaacttgttatagtgcaaaaatgactagaacaataattgtgcgaagggattatttgcattatgtgaagaagtatcaaagatatgaaaagaggcactccaacattgctgctcatatatcccctgcatttcgtgtgaaggaaggtgatcatgtcattatcggacagtgcaggcccttgtccaagactgtcaggttcaatgttttgagggtaattcctgctggttccagcacaggtggtgcaaagaaagcgttcactggaatgtaaaattattatacatttgttgtcactggttgacgcggcttccatgttctaaatttcttaattttagagggatcttcggaatttttgaatctctgtttctgattgagtaggcatgatagtttggcattgttgacttcgatttgttgaaatgaaggaacgttatttttaaaagaattccaactgaatattcataacggaatgtgtctaag

SEQ ID NO: 1217 - DNA, 674 bp, Brassica napus
gcagactgagaaagctttccttaagcaacccaaggtcttcctaagctcgaagaagtcagggaaaggaaagagacctggtaaaggcggaaaccgtttctggaagaacattggtttgggtttcaagactcctcgtgacgccattgatggaacttacattgacaggaaatgcccattcactggaactgtctcagtaagaggacgtatcttagctggtacttgccacagtgccaagatgcagagaaccatcgtcgttcgtaggaactatctccatttcgtcaagaagtatcaaagatatgagaagagacactccaacatccctgctcatgtctcgccttgcttccgtgtcaaggaaggtgatcatgtcatcattggccaatgcaggccgttgtcaaagacggtgaggttcaatgtcctgaaggttatcccagcaggtgcatctgcctttgcaaagaaggcattcactggaatgtaagagttttttgaagctatggagagagttttctttgtttggttttgatttttggaatgtgttgtttggtcaccacgtttgtcatcttaaatgttttgtctttggtttggtacttatctctataagagtccattgcttagcttaatcttaaacaaggacagatattcaatgatttatcctaattgtttatgagttttgtatccaa

SEQ ID NO: 1218 - DNA, 1315 bp, Mimulus guttatus
ggtagaaaatttgttgctagggttttaacagcgtccgccgtatccatccaccactctcacgctcgtcggacggaactgcgatggcggaacagacagagaaggctttcttgaagcagcccaaggttttcctttgctcgaagaagtcggggaaggggaagacacctggaaaggggggcaaccgttactggaagaacatcggattaatttataagacacctcgcgaggctattgaaggcacatacattgacaagaaatgtccattcactggtaatgtgtctatcagaggccgtattatatctggaacctgccatagcgctaagatgatgagaactatcattgttcgcaaggattattttcattgggtaaagaaatatcaaaggtatgaaaagaggcattcaaatatcccagctcacgtatctccatgcttccgtgtgaaagagggtgaccgtgtcacaattggccagtgcagacccctgtccaaaacagtgaggtttaatgttcttaaggtgtcaccagctggctcttcttccgctctagggaagaagtctttcacaggtttctgaagtctttcacaggtttctgagcttaggcaacaacctatttatttattatctttgcaaatcttagagaaagatgagtttagacttttttctgttggaatatttgccttgacggcctttcaattttctactccggctatttttttatcctctattaactagtttttcgaatttcattatttttgtttgggatttgcaattgttgaaccaacatgcaaagcttttttgggtttttgttttcttccatttttgtagtatgcaatttttaaaagatgttttgaacattataatacatgccaatattattgaatttgatattctctttatgcaaagttgatctactggatgtatacattggttcctatattctccaatatttgggagatttgttgattttctattaagctttctttttagtgaagtcggtagaaactttgtttgtatatgaattatttccagaactttgtctgaatattacagcttgtcgaatcgaaagaccaatttttgctcaaacaatttaaagtattatttatatattcatcaatcttcattcatttggttgggtaatggtacccatccatgccggtgggagcatgccagtttggtcatgcactgtcttgaacagtggcggcaacatcttgtaaaccccagcaacttctttcatcgccgccccactactatctccagcgccaccattctctccaccagcgccgcttgtccaaatgctgatctttggctgcaaaccacgcaaagcc

SEQ ID NO: 1219 - DNA, 760 bp, Quercus alba
acttcaggtttagggttttataacactttctttctgcctcctctttctccacctcctacttctcccaatctcctcaaccatggctgaacagactgagaaggcatttttgaagcagcccaaggtgtttctaagctcaaagaaatctgggaaggccaagaggcctggaaagggtggcaatcgctactggaagaacattgggttgaattacaagacacccagagatgcaattgaaggaacatatattgacaagaagtgcccattcactggcaacgtttctatcagaggtcgtattatttctggaacttgccaaagtgccaagatggtgaggaccataattgttcgaagggactaccttcactttgtcaagaaatatcagagatatgagaagaggcactcgaacattccagcccatatttccccatgcttccgtgtgaaagaaggcgattatgttactattggccaatgcaggcctttgtcaaaaacagtgaggttcaatgtgttgaaagtcctctctgctggctctgttagtgctgggaagaaggcatttacagggatgtgaaagtgattgattgttatagagaaggctggagatattggcttggattaaattttgtagtagcttgctcttttttggtttttgttcttaacccttttgatggatgcaagacttcaggatttgttttctattttatcgtaatattcaagaaactttttgcttgggtattcttaaaggcaaagatatgttttcttgtttacttat

SEQ ID NO: 1220 - DNA, 658 bp, Zamia vazquezii
gatgatcagggatcggcgtaggagagcaggagcaggcgggggttgagccgagggtttgaacgtgctctaccaatagtgtattgatcgggtttcttcctttcttgcagtcatggcggaacagacggaaagagcttttctgaagcagccaaaggtatttctcagttccaagacgtctgggaagggaaaacggcctggaaaaggtggtaacagattttggaagaatattggtcttggtttcaagacacctcgggaagcgatcgaaggaacctacattgacaagaagtgccctttcactggaactgtttctattaggggtcgtatattgacaggaacatgttacagtgcaaagatgacccgtactattatagtccgtcgggactatctcccttttgtgaagaagtatcaaaggtatgagaagagacactcaaacatacctgctcatatttcaccttgcttccgtattaaggaaggtgatcgagttattattgggcaatgcaggcccttgtccaagactgtaaggttcaatgttttgaaagtgattccgatgggatcttccactggtggtagtaagaaggcctttacagcaatttgaagattcattggctggtttttgcttctcattcggtattcatcatgtccagcgaatttgaactgatta

SEQ ID NO: 1221 - DNA, 977 bp, Amborella trichopoda
tacctcaacggacgcgggttgatgagcccctgggaattaggtttttggagcgtgttttagagccagagagggagaaggcaaggaaagccgcggcggagggcagtctgcaaatttcctctcaaattccacaccatggctgaggcagacagagaaagcatttttgaagcaacccaaagttttccaaagttctaagaaatctggcaagggtaagagacccgggaagggtggaaacaggttttggaaaaacattggacttggtttcaagacaccaagagaggccattgaaggaacgtacattgacaagaaatgccctttttctggcaatgtttctatcagggggcgtattttgacaggaacatgctacagtgctaaaatgacaagaaccataatcgtgcgcagagattatcttcactttgtgaagaaataccaaagatatgagaagaggcactctaacataccagcacatatttcaccttgctttcgtgtcaaggaaggtgaccatgtcgtgattggtcaatgcaggcccttgtcaaagactgtgaggtttaacgtcctgaaggttattccagcaggttcctcgggcagtggtggcaagaaggcctttgcacccatctaggttttccttgattgctgtcgcgtttatttctgattaggaatattgcgaactcttttatttttggacacatgattagcatagaatgaggtttactggagtttcttgggagttggcaactgggttcttcgtgcatttttcctgttggtggtcttgggagttggaactgtagtcttgatcatttttcctattggtggttttacttgatattttatagagcagtttgttggtgctttcagctgctcttttatatggaaattttacccgagattgtctttttgagcatggtattccatatggagaatatcttttgtgtgaaagcttcacatataaaatcaatcatgatgatcagggttttaaaaat

SEQ ID NO: 1222 - DNA, 556 bp, Trifolium pratense
acagctgctgcaaccaacaatggcggaacaaactgagaaggttttttgaagcaattgaaagtgttcttaagctcgaagaattctttctgggaaggggaagagacctggaaagggtggtaatcgattctacaaatctgttggccttggttataagattccaagagaggccattgaaggaacctatattgacaagaagtgtccatacactggcaatgtctcaatccgaggtcgtattctagccggtacttgtcatagtgctaagatgaataggacccttattgttaggaggaattattttcatttcattaagaagtatcagagatatgagaagcaccattctaatattcctgcacacgtatcaccttgtttccgggtgaaggaaggagatcatgttattattggtcaatgcaggccactctcaaagacagttagattcaatgtattgaaagtgatcccagccggatcttctagtggtgcaaagaaggcgtttacaggaatgtgagtttggaattttcagttggcgttgaagacaagtgtatcttagtttcaagtattc

SEQ ID NO: 1223 - DNA, 745 bp, Trifolium pratense
ggttagggttacccacacagtgctgcttgctgcaaccaacaatggcggaacaaactgagaaggttttttgaagcaattgaaagtgttcttaagctcgaagaattctttctgggaaggggaagagacctggaaagggtggtaatcgattctacaaatctgttggccttggttttaagattacaagagaggccattgaaggaacctatattgacaagaagtgcccatacaccggcaatgtctcaatccgaggtcgtattctagctggtacttgtcatagtgctaagatgaataggaccattattgttacgaggaattatcttcatttcattaagaagtatcagagatatgagaagcgccattctaatattcctgcacatgtatcaccttgtttccgagtgaaggaaggagatcatattattattggtcaatgcaggccactctcgaagacagtgaggttcaatgtattgaaagtgatcccagctggatcttctagtggtgtaaagaagacgtttacaggaatgtgagtttggaatttcagtgagcattgaagacagctgtatcttagtttcaaatattctaagatcatgacatagttatactgtgatcaaacttggatttggtttaatgctttgcattaatttgagcagttaatctgaaagattttgatatacattatagcttttgaatattagttgcagctattttttggcataattgtagtgcttactctgatctatatgtattt

SEQ ID NO: 1224 - DNA, 651 bp, Arachis hypogaea
tcggccggtgggattagggttttgcgtgctccgtgctgttctttgctgctgctcgttctctctgctgcttgcaccacacaccttccaggattcaccaatggcggaacacacggacagatgctttcttgaatcaacccaaggttttcctctgctccaataaatcagggaaagggaataggcctgcaaagacgacgccacacgttctggaaaagcattgctttaagttttaagactcccatgagaggctattcaagggacttacattgacaagaaatgcccattcactggcactgtgtccatccgaggtcgcattcttgcaggtacttgccacagtgccaagatgaccaggactatcatcgttcgtcgcaactatcttcatttcattaagaaataccaaaggtacgagaagaggcactcaaatatcgcagcacatatatctccatgcttccgtgtgaaggaaggagatcatgttatcatagggcaatgcaggccattgtcaaagacagtgaggtttaacgtgttgaaagtgattcctgctggatcgtcctctggagttgctaagaaagccttcacaggaatgtgaagacttctgccaatcccatttcccagattagatttaggaactcgcctgtgtgatttcctaaattcgtt

SEQ ID NO: 1225 - DNA, 968 bp, Brassica napus
gagaacatctcattttgcctcaatccatcagtggagagcaggagcaaccagtagccatggcggaacagactgagaaggcatttttaaagcaaccaaatgttttcctaagctcgaagaaatcagggaaaggaaagaggacctggtaaaggagaaaaccgtttctggaagaactttggtttgggtttcaagactcccccgaagccattgacggacattacattgacaagaaatgtccgttcactggaactgtttctgtaagaggtcgtatcttagctggtacttgccacagtgccaagatgcagagaacaatcattgtttgccaaaactatctccacttcgtcaagaagtatcaaagatatgagaaaagacattccaacatctctgcccatgtctcaccctgcttccgtgtcaaagaaggtgaccatgtcatcattggccaatgcaggccattgtcaaagactgtgaggttcaatgtgctgaaggtgatcccagcaggcgcatctgcctttgccaagaaggtattcactggaatgtaataggttttgaagttatggagagtttctatgtttcagaatgttttgtttgttaatcccttttgtgtgagacttggtttgtccacagactgaatcctacgtactactttcgtcatcagaaattactacattctactgttctgtgacttctgtcttttggtatctctagaagaaatcaagtacaaaaaaaaagaaaagaactgttcagaagcaacaaatgaatgtaatgtttccttccctctttccctctataacacaatcaatgttatagcttgctttgttgcttaacattttcattcatggttgctggctgactctatttcccggattctggcaagcggaggaagtaacacaggctcttatgaagcccctaaggcagctgaaacatgatcaaagtttgtaaaaggaagaacaatatagcaatgtccccatttt

SEQ ID NO: 1226 - DNA, 781 bp, Eschscholzia californica
tcctaaagtctagtacgtccgtaagggttattaatttttcttcgtctactatttcgtttttctttctacttattcttgtctaagtttgctaacctattggtcttgaacagtacttgtagaaggtcttttcttgaagcaacccaaggtttttctctgctctaagaagagtgggaaggggaagagacccggaaagggtggcaatcgttttcacaaaagcattggattgggtttcaaaacacccagggaggctatcgaagggacttacattgacaagaaatgtccctttactggaaacgtttccattaggggacgcatcctttctggtacttgccacagtgcaaagatggtaagaaccatcatcgttcgaaggaactaccttcactatgtgaagaaatatcaaagatatgaaaagaggcattcaaacataccagcccacatttccccgtgtttccgtgtcaaggagggtgaccatgttaccgtcggtcaatgcaggccattgtcgaagacagtgaggttcaatgttttgaaggtcatcccagctggttcttctggcggtggcgggaagaaggctttcgtggcaatgtaatgttctccccgtgttcacaaccaaggttggtcacgctcttatgttttaagatcagtggtagatgagtaacagttggtgacgaacatttagtcgtatgaattgataatagttttcttgattcatctgttttatcactttcttaagtagacagattcagacaagatagttgtcttttttttgcttccttcattgaag

SEQ ID NO: 1227 - DNA, 789 bp, Eutrema halophilum
gcaactcttacacatcctttgcctcaaattcttcagcggagagcagcagcaacctaaccagtagctatggctgagcagactgagaaagcttttcttaagcaacccaaggttttccttagctcgaagaaatctgggaaaggcaagaggcctggaaaaggtggaaaccgtttctggaagaacattggtttgggtttcaagactcctcgtgacgccattgaaggaagttacatcgacgggaaatgtccattcactggaactgtttctattagaggtcgtatcttagctggtacttgccacagtgccaagatgcagagtggccattacggccgggggaactatctccattttgtgaagaagtatcaaagatatgagaagagacattctaatatccctgcccatgtctcaccgtgcttccgtgtcaaagaaggtgatcatgtcatcattggccaatgcaggcctttatctaagactgtgaggttcaatgtgctgaaggtgatccctgcaggcgcatctgcctttggaaagaaggcattcactggaatgtaagacttttcaagtttggagaattttcgtttgtttgattttgatttttgaatgttttgtttggtgatcccttttgttggagactttgattaccacagactaaatagagatctatgttctttcgtcatctgaaattactacattcaactgttttgtctttggtatctctagaaatcatctactttgtctgtctgaaaacaccctcgtaggacatcattatttttgttaatgcatacaaaaagttcg

SEQ ID NO: 1228 - DNA, 776 bp, Amorphophallus konjac
gtcttgccactagatcccaccatggcggagcagacggagagggcgttcctggaaaacagccgaaaggttttttctctgttcgaagaagtctggaaaggggaagaggcccggcaagggtggcaaccgttactggaagagcattgggctcggattcaaggtccccagggaggccattgaagggacatacattgacaagaaatgcccatttactggtaatgtttctattagaggccgcatcctaagtgggatatgccacagtgccaagatgaacagaaccatcattgttcgcaaagactacctgcactacgtaaagaagtatcagaggtatgaaaaacgtcactccaacatcccggcccacgtttccccttgcttccgtgtgaaggaaggagaccatgtaaccattggacagtgcaggccattgtctaagactgtaaggttcaatgttttgaaggtcactcccgcgggatctgcaggtggtggcaagaaagcttttgcagcattctgagtgtcttgctataggaaattattagatggggatgggtgttaaaattttggatatggttgaggccatctcatttgaattgttggtttaattatgtgttcactttcccaggagtccgtcttttgaacctttttggtttccagtgttcttgtccggtattttagttaattgagaatttaaggaattttctgcaaatttgatgaaactcattccattaggaatgctgattttcctgttgaactcggcgatggatatgtatgttagcttggccttg

SEQ ID NO: 1229 - DNA, 1000 bp, Cenchrus ciliaris
gtacaaaactgagcatttcattagagtaatgttgtgggcaccatcagttgcaagttctgattcagcgaaaaacaggtatatcaagatattcttaaaatgcgatacaccacaaaacaggagatacaactgcttagagaaacttcactcgctgagtcctatataaatctcagtacgcctgattcagctaaggacggggaatatgcgtgtcacatgctcaaatggaacagtatcagcagtgttcttcttgagctcggggtgattgaactcgttgcgcggaagaacaatcacttgagactgtccacccttctcaatcacccaacctgcgtttgcggcatggtactccagaaacttgtccaaagcgagagaacaagcccggcaaggggggcaacaggttttggaagaacattggcctcggtttcaagactcccagggaggccattgaaggaacctacattgataagaaatgcccgttcactggcactgtgtcaattagaggtcgcatcattgctggtacatgccatagtgccaaaatgaacaggacgatcattgttcgcaggaactaccttcactttgtcaagaaataccagaggtatgagaagaggcactctaacatcccggcccacatctccccctgcttccgtgtcaaggaaggagaccatgtgatcattggccagtgcaggccactgtccaagaccgtgaggttcaatgtgctgaaggtgatccctgccgggtcaaagagtggtggtgctgtgaagaaggcattcactgctgcctgaggaatacatcaaagatcctgaaagccatagattttgagattttgatgtcccattccgtattgcaattccatctgtactaatatttttgactgagaatatcttgcaaaatcaaagtcaaagagtgctgaattcagcaatattgttaagacaaaaggttcactgatgcttcgttgtgaatgctttgttttagtcagaggatcattttgttgctggttgtgataaaa

SEQ ID NO: 1230 - DNA, 616 bp, Heritiera littoralis
accatggccgaacagaccgaggaggcattttgaagcaaccaaagtgtttttaagctcgaagaaatctgggaaagggaggagaccaggaaagggaaggaaccgcttctggaagagcattggtttgggcttcaagactcctcgtgaagctattgaaggaacctatattgacaagaaatgcccattcactggcacggtttccatcaggggtcgcattttagctggtacttgtcatagtgccaagatgatgagaacaatcattgttcgacggaattaccttcattatatcaagaaataccaaaggtatgagaagaggcattcaaacattcctgcacatatttctccatgcttccgtgtgaaggaaggggaccatgtcattattggtcaatgcaggccattgtcaaagactgtgaggttcaatgtcttgaaagtgattcctgctggatcttctggtggtgggaagaaagctttcactggaatgtaaggtgtctgtggtagtccatggtgtaggaacctatggtgaggacattaagaagtttttgaactgcttctagatttgaggaaatctttgactcttagatgttttctgtttttgttttttactttttacttttatgtt

SEQ ID NO: 1231 - DNA, 786 bp, Cannabis sativa
gtactgtgaaatataatcttttcttttttgtagctcgaagaagtcatctaaaggaaagagacctggaaagggaggcaacagattctttaagagcgttggtttgggtttcaagactcccagagaggccattgaaggtacttatattgataagaaatgccctttcactggtaccgtctctgttaggggtcgaattctcgctggtacttgccatagtgccaagatggtgaggacaatcattgttaggcgaaactacctacattttgttaagaagtatcaaagatacgagaagaggcattcgaacattccagcacatatttctccttgtttccgtgttaaggagggagaccatgtcatcattggacaatgcaggccattgtcgaagacagtgaggtttaatgtgttaaaggttgttccagctgggtcttcgggtggtggcaagaaggctttcacaggaatttaattcaattgttttctactttttgtttacattttatatttgagttgagtgaactaaattaggtatggctggctactctactctttgagaaacaacttaaaacttattttcttctatgtatgatgaattggtttccgattaaacctcttgagtattgcaaattttgaactatgctgaataccctaaggctgataagctctcttttgttttgttgagtgaataccattgttttatgtctattcttagatggttgccgatcattcggattaggaaactagggttaaattttagagatgtatgactttttgtgaaagaaagtttgattaagc

SEQ ID NO: 1232 - DNA, 725 bp, Festuca arundinacea
agtggtatcaacgcagagtacgggggggtagtttattaagccgggcaaggggggtaacaggttttggaagagtgttggtcttggtttcaagactcccaaggaagccattcagagaacctacattgataagaaatgcccattcactggcactgtgtcaatcagaggccgcatcattgctggaacatgccatagtgctaaaatgaacaggactatcattgttcgtcggaactaccttcactatgtcaaaaaatatcagaggtacgagaagaggcattccaacatccctgctcacatctccccttgcttccgtgtgagagaaggtgatcacgtgatcattggccagtgcaggccactgtccaagacagtgcggttcaatgtgttgaaggttgtcccagcaggatcaacgagtggtgcagtgaagaaggcgtttatcgctgcctgagcaaggcacggaagagttcctaaaccttgatcatgagattttgataccacaccaatattgttctgtttgtgtgtagtaggctttttttgactcgagagttctccaaacttgaagataagagtgatgagttcagtgaagttatgttcagagcgcttgaaattatttatcatgttgcatcaatcatttactggctgatgttaataactaaaaaaaaaaaaaacaaaaaaaaaaaacaaaaaaaaaaaaagaaaaaaaaaaacaaaaaaaaaaaaaacaaaaaaaa

SEQ ID NO: 1233 - DNA, 506 bp, Populus trichocarpa
catggctgagcagactgggaagacatttttaaaagaacccagagtgtttcttagttcaaagaagtccaggaaaggaaagaggcctggtaaaggaggaaacagattctgaagagtgtcggattgggtttcaagactccccgagaagccattgaaggaacttacattgataagaaatgccccttcagtggcactgtttctattcgaggtcgtatcttaattagctggaacttgtcatggtgccaagatggtgaggacctgcatcattgtccggcggaattttcttcactaggtcaagaaataccaaagataagacaagaggcattcaaatattccagcacatatatctgatatctccatgccgcttccgtgtgaaggaaggtgatcatcttatcatcgggcaatgcaggccactatccaagaccgtgagatttaatgtcttgaaagtgatccctgctggttcttttgctggttgggaagaaggccttcacaggaatgtgaggcttaac

SEQ ID NO: 1234 - DNA, 860 bp, Arachis hypogaea
acatacgcgtaagcagtggtatcaacgcagagtacgggggagggtttgcgtgctccgtgctgttcgctgctgctgctgctcattctctctgctgcttgcaccacgcaccttctaggattcaccaatggcggaacggacggagaaggctttcttgaagcaacccaaggttttcctctgctcgaagaaatcagggaaagggaagaggcctggaaaaggaggcagcaggttctggaaaggcattggtttagggtttaagactcccagagaggccattcaagggacttacattgacaagaaatgcccattcactggcactgtgtccatccgaggtcgcattcttgccggtacttgccacagtgccaagatgaccaggactatcatcgttcgtcgcaactatcttcatttcattaagaaataccaaaggtacgagaagaggcactcaaatattgcagcacatatatctccatgcttccgtgtgaaggaaggagatcatgttatcatgggcatgcaggccattgtcaaagcagtgaggcttaacgtgttgaaagtgattcctgctggatcgtcctctggagttgctaagaaagccttcacaggaatgtgaagacttctgccgatcccatttcccagatattagatttaggaactcgcgtgtgtgatttcctaaattcgtttaggagggatttatatttgtatgcttttgatttgatatttattccagtctctttttttttcccaccctcacagctgtgttttcagttttgacttttgatgtttgaaatacaattagtcctttagtttctggcaacctcaaaaaaaagaaaaaaaacaaaagtactactgcgttgataccactgctt

SEQ ID NO: 1235 - DNA, 893 bp, Triticum aestivum
tcggccgaggctctcgcctgctttccatcgggttgttgcggcggcggcggcggcgatggcggcggaggacgtggagttcgtggactacgagcgggacgacggcgacgacgggatggaggacgaggaggaggacggggaggtctcggcccgcgcgctccccgtgccccacatcgccgcccccgccgtggcgcgcaccagcaggggccgcttcgtcggccgcagccgctccgtcatcgcctccacccgcgaccgcttcgaatccatccccttcgccggcacctccgcgcacggcggcccgcagcgctcaattgaaggatggataataattgtctcaggagtcaaagaagatgcagaagaaagtgatctgtatgatgcttttgctgagtttggtgaggtcaaggacttgcatttcaacctggagcgccgcactggatatggcaagggatatgcattggttgaatatggatgttttgaggaagcacaaactgcaatcagaagtatgaatgggacacagctgttaacaaagaccatccatgttgattgggcattcaacagaggtcctatacagaacgtcacgagtgcacggccagcacagcgacggtctaggactccgcctcgcaggcttgctgccatgacatactgagagggagctgctaggcctgcaatcttgggccagccttggtcagtgtttttttggtagtcgccagggatttgctatgtcatagattttagtcttaaccgtcgtcttccggcagtaagcggtaaccgaacaatgaaccgggtatgtattgtccagaaaccgagtcctgattctgctagcctgtactgagcttgttcagcggcttggctcacaaactttgatattgaatgcatgatgcaaattggatggatac

SEQ ID NO: 1236 - DNA, 2345 bp, Zea mays
cctgctccccgcccggcgcccgcggcccgccgctcaaacccctaaaccctagccgcaccagcgccctattccctccttcggcggctccggcagcgagcggtcactagcaaccagcatcgtacggcgaagaagcgccgtttacacccatctggcggagatgccgctggggcagcgtccgggggacaagagtgacgcccgctactgcggggtggaggtgctcgacttccctgccggcgaggacctccccgccgtcctcaaccactccctcgcctccgccttcgacttcatcctcgtccctctggttgaccccaactaccggccggcgcccggctccgttctgcccgtgtcggcgtcggacctcatccttggcccggcccagtggagcaaccacgtcgtcgggaagatcagcgagtggattgatttggactctgaggacgagcggctccgccttgactccgagctcacgctgaagcaggagattgcgtgggcgtctcacgtctcgctgcaggcatgtgttcttcctgcccccaggagatctttttgtggcaattatgccagagtcgtgaatcaaattttgcaaggcctgaccaatatgcatttgtggctcaggttgcctctggagaagtccgagcctatggatgatgatcttgataaaataaagaataacagccacacgagtgaaattgtagactcatgggaattatggaattcattcagattgctatgtgaccatagtagccaactatgtgtggcacttgatattttgagcactctgccatcaataaactcattagcaaggtggtttggagagcctgtaagggctgctattctgcaaaccgaggcttttcttacaaatgcaaaaggatatccttgtttatcaaagcgccatcagagtctgctaactggattttttaaacattctgttcaggtgataatatctggaagatcaaatcacaatgttttcccagtatctgaaggagtgctctcaggtgatgagagctacgcagaagattcccgtgttcgacatgcattaactccttaccttgaatacattgcgtacctatatcggaagatggatccgcttcctgagcaggaacgcattgagattaattacagggactttttgcagtctcctctgcagcctctaatggacaatttggaagctcaaacttatgagacatttgagaaggatgttgtgaagtacactcagtatcgaagagcagttgctaaggccttggttgatagggttgctgatgatgcagtctccacaactaggacggtgctgatggttgtgggagcaggacggggacctctagtacgagcatcattgcaggccgctgaagaaactggtcgcaaattaaaagtatatgctgttgaaaaaaatcctaacgctgttattactcttcatagtttgatcaaattggagggttgggaaagcctggttactgtaatttctagtgacatgcggtgttgggacgcccctgaaaaggcagatgttttggtcagtgaattgcttgggtcctttggtgacaatgaactatctcctgagtgtcttgatggtgctcagagattcttgaagcctgatgggatttccattccttcatcatacaccagcttcatccaaccaataacagcatcaaaattgcacaacgatatcaaagcacacaaagacattgcacattttgaaaccgcatatgttgtcaaactacaccgcatagcgacacttgcacctccacaacaggtttttactttcacccatccaaatttctcaccaaatgctagcaaccaaaggtacaccaagttgcaatttgaaatgctgccagatatgggttcatgccttgtgcatggatttgctggctattttgactctgtactttataaagatgttcatcttggaatcgagccaaacacagctacaccaaacatgtttagctggttccccatcttcttcccattgagaaaacccatctacgtgccggaagggtctcctatagaagtgcacttctggcggtgctgtgcccccacaaaggtgtggtacgagtgggctgtgactacaccgaccccgtcgccgatccacaacagcaatggccggtcctattgggttggtctatagtaactagtaaggcaatcaagatggtcgctttgtgttgtaacagagaagaaaaaaaaacagagagatgatagggtccaccggtccagttctatttgagccgggtgctactggtttctgcccggaggagcagatcaaaggatctgtaacgcgttgttatctgaaaggtgcttgacctccaacgttgcctactcgattttgatagttgtagcagtaaaatttcttgtcttgcaaa

SEQ ID NO: 1237 - DNA, 2426 bp, Sorghum bicolor
ctaaacgggcaaagcctgaaaagccccctgctccccgctcgccgcccaaacccctaaaccctagccgcaccaacgccttctctaatccgtccttccccggcggcgggcggccaccagcaaccagcatcgtacggcggagaagcgccgtttacatccgtctggcggagatgccgctggggcagcgcccaggggacaagagcgactcccgctactgcggggtggaggtgctcgacttccccgccggcgagggcctccccgccgtcctcagccactccatctcctccggcttcgacttcatcctcgctcctctggttgacccgaactaccggccggcgcccggcgccgtcctgcccgtgtcggcgtcggacctcgtcctcggcccggcccagtggagcaaccacgtcgtcgggaagatcagcgagtggatcgatttggacgcggaggacgagcggctccgcctggactccgagctcacgctgaagcaggagatcgcgtgggcgtctcacgtctcgctgcaggcatgtgttcttcctgccccccggacatctttttgtggcaattatgccagagttgtgaatcaaattttgcaaggcctgaccaatatgcatttatggcttaggttgcctctggagaagtccgagcctatggatgacgatcttgataaaataaagaataacaaccacatgagtgaaatagtagactcgtgggaattatggaattcgttcagattgctatgtgaccatagtagccaactatgtgtggcacttgatatttcgagcacactgccatcaataaactcattagggcggtggtttggggagcctgtaaaggctgctattctgcaaaccaatgcttatcttacaaattcaaaaggatatccttgtttatcaaagcggcatcagaggctgctaactggattttttaaccattctgttcaggtgataatctctgggagatcaaatctcaatgttttcccagcatctggagtgctctcaggtgatgagagctgcattgaagattcccctgttcgacatgcattagctccgtacctggagtacattgcgtacctatatcagaagatggatccacttcctgagcaggaacgctttgagattaattacagggattttttgcagtctcctctccagcctctaatggataatttggaagctcagacttatgagacatttgagaaggatgttgtgaagtatactcagtatcgaagagcagttgctaaggccttggttgatagggttgcagatgatgcagtctccacaactaggactgttctgatggttgtgggagcaggccgaggacctctagtacgagcatcattgcaggccgctgaagaaactggtcgcaagttaaaagtatatgctgttgaaaaaaatcctaacgctgttattactcttcatagtttgatcaaattggagggttgggaaagcctggttactgtaatttctagtgacatgcggtgttgggatgcccctgaaaaggcagatattctggtcagtgaattgcttgggtcctttggtgacaatgaactatctcctgagtgtcttgatggtgctcagcgattcttgaagcctgatgggatttccattccttcatcatataccagcttcatccaaccaataacagcatcaaaactgcacaacgatattaaagcacacaaagatattgctcattttgaaacagcatatgttgtcaaactacaccgtatagcgacacttgcacctacacaacaggtttttactttcaaccatccaaatttctcaccaagtgctagcaaccaaaggtacaccaagttgcaatttgaaatgctaccagatatgggttcatgccttgtgcacggatttgctggctattttgactccgttctctataaggatgttcatcttggaatcgagccaaacaccgctacaccaaacatgtttagctggttccccatcttcttcccattgagaaagcccatctacgtgccccaagggtctcctatagaagtgcacttctggcgctgctgtgcccccacaaaggtgtggtacgagtgggctgtcactacgccgaccccgtcgccggtccacaacagcaatggccgctcgtactgggttggtctgtaataagtcatcaagatcatcgctttgtgttgtaacagagaagaaaaaagaatagagagatagtgtttagttctatttgagatgatgtcagggtgctactggttctggtttctgcccggaggagcagatcaaaggatctgtaacgtgttgttatcgaggtgattgacctccaacgatgcctagtcgattttgatagttgtgtgggagtaggatttcttgactagcaaatgttctggtttcgtcaaattttgaaacgtctgcagcaaatgttaaggtttcgtcaaattttgaaacgtctgcatccttttt

SEQ ID NO: 1238 - DNA, 2255 bp, Oryza sativa
cctaaaccctaaccccagccaacgcgtcttcctgcccatccccggcggcggcggcggcgtcagcggcggaggtcggcgactagtaccagcgaggaggaggagaagaaggcaaccggagatgccgctggggcaacgcgcgggggacaagagcgagtcccgctactgcggggtggaggtgctcgacttccccgccggcgaggagctccccgccgtcctctcccactccctctcctcctccttcgacttcctcctcgcccccctcgttgatcccgactaccggccgacgcccgggtccgtcctccccgtggcggcgtcggacctcgtcctcggcccggcccagtggagcagccacatcgtcgggaagatcagtgagtggattgatttggatgcggaggacgagcaactccggttggactccgagatcactctgaagcaggagattgcgtgggcgtctcatctctcgttgcaggcgtgcgttcttcctcctcccaagagatcttcttgtgccaactatgctagagttgtgaatcatattttgcaaggcctgaccaatttgcagttgtggcttaggatacctctggagaagtctgaacctatggatgaagaccatgatggagcaaaagataatagcgacatgagtgataccgtagactcttgggaatggtggaattcatttagactattatgtgagcatagcagtcaactgtgtgtggcgcttgatgttttgagcacactgccatctatgaattcactagggcggtggtttggggagcctgtaagagctgcaattcttcaaacaaatgcttttctgacaaatgccagaggttatccttgcctgtcaaagcgccaccagaagctgcttactggattttttaaccattcggttcaggttataatatctgggagatcaaatcataacgtatcccaaggaggagtgctctcaggtgatgaaaaccacactgaagatactgctgttcggcatgcattgagcccataccttgactacattgcttacatatatcagaggatggacccacttcctgaacaggaacgctttgagatcaattatagggattttctgcaatctcctctccagcctctaatggacaatttggaagctcagacatacgagacttttgagaaagataccgtgaaatatacccagtatcaaagagcaattgctaaggcattggttgatagagtttccgatgatgatgtctcaacaacaaaaacagtgctgatggttgttggagcaggccgggggccactagtgagagcgtcgttacaggctgctgaggaaactggccgcaagctaaaagtatacgccgtcgagaaaaatcctaatgctgttatcacccttcacagtttgatcaaattggaaggatgggaaagcttggttactataatttcaagtgacatgcggtgctgggaagcccctgagaaagcagatattttggtcagtgagttgcttggttcctttggtgataatgaactttctcccgagtgtctagatggtgctcagagattcttgaagccagatgggatttctattccttcatcatacactagctttattgaacctataacagcatcaaaactacacaacgatatcaaagcacataaagatattgcacattttgaaactgcatatgttgtcaaactacaccgaatagcaagacttgcaccaacacaatcggtttttacttttgatcatccaaatccctcaccaaatgctagtaaccaaaggtataccaagttgaaatttgagataccacaagagacgggatcatgcctcgtgcacggatttgctggatattttgatgccgtattgtataaagatgttcatcttggaattgaaccaaacacggctacaccaaacatgtttagctggttcccgatcttcttcccattgagaaagcccatctacgtaccgtcgaagacgcctatagaagtgcacttttggcgatgctgcggtgcaacaaaggtgtggtacgagtgggctgtgacggcaccttctccatcaccaatccataacagcaatggtcgatcatattgggtcggcctataagtaaagccatgaagccagttttgttttgttccgattttctttttagggattctttttgttgtcttttgaaagagaggagagaacagattccattgtatggtttcttgtgtggagtgactctttatcagatatgctgcgtgggagattgattcttcagccttaaagcaagtgataactgacagtggaa

SEQ ID NO: 1239 - DNA, 2368 bp, Oryza sativa
ttcccctcctccgccgaccaaaagccctaaaccctaaccccagccaacgcgtcttcctgcccatccccggcggcggcggcggcgtcagcggcggaggtcggcgactagtaccagcgaggaggaggagaagaaggcaaccggagatgccgctggggcaacgcgcgggggacaagagcgagtcccgctactgcggggtggaggtgctcgacttccccgccggcgaggagctccccgccgtcctctcccactccctctcctcctccttcgacttcctcctcgcccccctcgttgatcccgactaccggccgacgcccgggtccgtcctccccgtggcggcgtcggacctcgtcctcggcccggcccagtggagcagccacatcgtcgggaagatcagtgagtggattgatttggatgcggaggacgagcaactccggttggactccgagatcactctgaagcaggagattgcgtgggcgtctcatctctcgttgcaggcgtgcgttcttcctcctcccaagagatcttcttgtgccaactatgctagagttgtgaatcatattttgcaaggcctgaccaatttgcagttgtggcttaggatacctctggagaagtctgaacctatggatgaagaccatgatggagcaaaagataatagcgacatgagtgataccgtagactcttgggaatggtggaattcatttagactattatgtgagcatagcagtcaactgtgtgtggcgcttgatgttttgagcacactgccatctatgaattcactagggcggtggtttggggagcctgtaagagctgcaattcttcaaacaaatgcttttctgacaaatgccagaggttatccttgcctgtcaaagcgccaccagaagctgcttactggattttttaaccattcggttcaggttataatatctgggagatcaaatcataacgtatcccaaggaggagtgctctcaggtgatgaaaaccacactgaagatactgctgttcggcatgcattgagcccataccttgactacattgcttacatatatcagaggatggacccacttcctgaacaggaacgctttgagatcaattatagggattttctgcaatctcctctccagcctctaatggacaatttggaagctcagacatacgagacttttgagaaagataccgtgaaatatacccagtatcaaagagcaattgctaaggcattggttgatagagtttccgatgatgatgtctcaacaacaaaaacagtgctgatggttgttggagcaggccgggggccactagtgagagcgtcgttacaggctgctgaggaaactggccgcaagctaaaagtatacgccgtcgagaaaaatcctaatgctgttatcacccttcacagtttgatcaaattggaaggatgggaaagcttggttactataatttcaagtgacatgcggtgctgggaagcccctgagaaagcagatattttggtcagtgagttgcttggttcctttggtgataatgaactttctcccgagtgtctagatggtgctcagagattcttgaagccagatgggatttctattccttcatcatacactagctttattgaacctataacagcatcaaaactacacaacgatatcaaagcacataaagatattgcacattttgaaactgcatatgttgtcaaactacaccgaatagcaagacttgcaccaacacaatcggtttttacttttgatcatccaaatccctcaccaaatgctagtaaccaaaggtataccaagttgaaatttgagataccacaagagacgggatcatgccttgtgcacggatttgctggatattttgatgccgtattgtataaagatgttcatcttggaattgaaccaaacacggctacaccaaacatgtttagctggttcccgatcttcttcccattgagaaagcccatctacgtaccgtcgaagacgcctatagaagtgcacttttggcgatgctgcggtgcaacaaaggtgtggtacgagtgggctgtgacggcaccttctccatcaccaatccataacagcaatggtcgatcatattgggtcggcctataagtaaagccatgaagccagttttgttttgttccgattttctttttagggattctttttgttgtcttttgaaagagaggagagaacagattccattgtatggtttcttgtgtggagtgactctttatcagatatgctgcgtgggagattgattcttcagccttaaagcaagtgataactgacagtggaagaaacgcatcttggatgcacaggaccagagcaacccagtaaaaaacaaatgatatatcttgatgggttgatgtgtaacatcagagcag

SEQ ID NO: 1240 - DNA, 2463 bp, Secale cereale
cctctcctctgccgaccaaaaccctaaaccctagcccgactaaccccctccccctcctccggcggcggcgtcagccaccggcagcacagacacaccaggcgaagatgccgctggggcagcgcgccggggacaagagcgactcccgctactgcggggtcgaggtgctcgacttccccgccggcgacggcctccccgccgtcctcacccactccctctcctccgccttcgacttcctcctcgccccgctcgtcgatcccgactaccggcccacgcccggcgccgtcctgccggtggcggcctcggacctcgtcctcagcccgtcccagtggagcagccacatcgtcgggaagatcagcgagtggattgacttggattccgaggacgagcagctccggctcgactctgagctcacgctcaggcaggagattgcctgggcgactcatctctccttgcaggcgtgcgttcttcctgctcccaagagatcgacctgtgccaattatgctagagttgtaaataatattttgcaaggcctgaccaatatgcagttgtggcttaggatacctctggagaagtctgaatctatggatgaagaccaagacaaagtaaataataataaccccacgagtgaaacagtagactcgtgggaatggtggaattcattcagactgttatgtgagcatagcagtcaactgtatgtagcacttgatatcttgagctcgctgccatcaatgaactctctagggcggtggtttggggagcctgtgagagctgcaattcttcaaacagatgcttttctaacaaatgctagaggttatccttgcttgtccaaacgccaccagactctgcttactggattttttaaccattcggttcaggcaattatctctgggagatcaaatcatagtgtttcccaagtatctgaaggagtgctctcaggtgatgaaaaccacaccgaagatacccccactgggcatgcgttgagcccgtacctcgactacattgcctacctctatcagaggatggatccacttcctgagcaagaacgctttgagatcaactatagggatttcttacaatctcctctccagcctctcatggataatttggaagctcagacttacgagactttcgagaaagacactgtgaagtacacacagtatcaaagagcaattgctaaggctttggttgataaggtttcagacgatgaagtctcaacaactaggacggtcttgatggttgttggagcaggccgagggcctctagtaagagcatcattgcaggctgcagaagaaactggtcggaagctaaaagtatatgcagtggagaaaaatcctaacgcagttattactcttcatagtttgatcaaattggaagggtgggaaagcatggttactattatttctagtgacatgcggtgctgggatgctcctgaaaaagctgatattttggtcagcgagttgcttgggtcatttggtgataatgagttatctcctgagtgtctagatggtgcccaaagattcttgaagcctgatggaatttctattccttcatcttacacaagttttatccaaccagtaacagcatcaaaattacacaatgatattaaagcacacaaagatattgcacattttgaaacagcatatgttgtcaagctacaccgagtagcaagacttgcacctccacaagaggttttctctttcacacatccgaatttctcaccaaaggctaccaaccaaaggtataccaagttacagttcgaactaccacaagacacgggatcatgccttgtgcacggattcgctggatattttgatgccgtactatataaagatgtccatctcggaattgagccgaacacgtgtacaccaaacatgtttagctggttcccaatctttttcccactgaggaagcccatctacgtaccatcagagtcgcccatagaagtgcacttttggcgatgctgtggtgccaccaaggtgtggtacgagtgggccctggtggcgccgtctccatccccgatccataacagcaatggccggtcgtattgggtcggtctataagttgagaaaaccagaatactcgcttgtgtcattttttttgagagaaagtgtcgatcacatgctaggtttttgagtgcgtccagctgcctggatcaaagaaacagatcttagaacctggatgcagggcacatggtgtaactcgcgagcttttgctttgtaacattatttacttgttattgttgctgccgcgtcagtccttgtgtgcgctagggttttaggagctgagctcgtcatcatttttgacattgctttttgtgttctagaggtgcatcgacgtgcggagttgctggtgacaagttgcggagacgcagatctagtttcgtgccagggttgtgaaaatgtgtttctttgtctgggatgtgcaaggggcttactggagaatcacaaacatgcatagggtact

SEQ ID NO: 1241 - DNA, 2609 bp, Hordeum vulgare
agagagccgccaaagcgacgggcgttcctcttctctgccgaccaaagccctaaaccctagcccgactaacccccttcccctccccctcctcctccccggccgcggcggcggcgccagccaccggcagcacccacccaccaggcgaagaagatgccgctggggcagcgcgccggggacaagagcgactcccgctactgcggggtcgaggtgctcgacttccccgccggggacggcctccccgccgtcctcacccactccctctcctccgccttcgacttcctcctcgccccgctcgtcgatcccgactaccggcccacgcccggcgccgtcctgccggtggcggcctcggacctcgtcctcagcccgtcccagtggagcagccacatcgtcgggaaggtcagcgagtggattgatctggattccgaggacgagcagctgcggctcaattcggagctcacgctcaagcaggagatcgcctgggcgactcatctctccttgcaggcgtgcgttcttcctcctcccaagagatcgacctgtgccaattatgctagagttgtaaataatattttgcaaggcttgaccaatatgcagctgtggcttaggatacctctggagaagtctgaatctatggatgaagaccatgacaaagtaaataataataaccccacgagtgaaacagtagattcttgggaatcgtggaattcattcagactgttatgcgagcatagcagtcaactgtatgtagcacttgatatcttgagctcgctgccatcaatgaactctctaggacggtggtttggggagcctgtaagagctgcgattgttcagacagatgcttatctaacaaatgcaagaggttatccttgcttgcccaaacgccaccagactctgcttactggattttttaaccattcagttcaggtaattatctctgggagatcaaatcataatctttcccaagtatctgaaggagtgctctcaggtgatgaaaaccacaccgaagatacccccactcggcatgcattgggcccgtatcttgactacattgcctacctctatcagaggatggatccacttcctgagcaagaacggttcgagatcaactatagggatttcttgcaatctcctctccagcctctcatggataatttggaagcacagacttatgagacttttgagaaagacactgtgaagtatacacagtatcaaagagcaatcgctaaggctttggttgataaggtttcagatgatgaagtctccacagctaggatggtcttgatggttgttggagcaggccgagggcctctagtaagagcatcattgcaggccgcagaagaaactggtcgaaagctaaaagtgtatgcagtggagaaaaatcctaacgcagtcattactcttcatagtttgatcaaattggaagggtgggaaagcatggttactattatttctagtgacatgcggtgctgggatgctcctgaaaaggctgatattttggtcagcgagttgcttgggtcatttggtgataatgagttatctcctgagtgtctagatggcgcccaaagattcttgaagccagatgggatttctattccttcatcttacacaagttttatccaaccggtaacagcatcaaaactacacaatgatattaaagcacacaaagatattgcacattttgaaacggcatatgttgtcaagctacaccgagtagcaagacttgcacctccacaagaggttttctctttcacacatccgaacttctcaccaaaggctaccaaccaaaggtataccaagttacagtttgaactaccacaagacacgggatcatgccttgtgcacggattcgctggatattttgatgctgtactatataaagatgtccatctaggaattgagccgaacacatgtacaccaaacatgttcagctggttcccaatctttttcccactgaggaagcccatctacgtgccgtcggagtcgcccatagaagtgcacttttggcgatgctgtggttccaccaaggtgtggtatgagtgggctctggtggcgccgtctccatcgccaatccataacagcaatggccggtcgtattgggttggtctataagttgagaaatcagaatatgcgcttgtgtcgggttttgagagagaagaaaatgccaatcatatatgctaggtttttgagtgcgtccagctaccttgatcaaagaaacagatcttagaacctggatgcagggcacatgctgtaactccaaagcttttgttttgtaacattttttacttgttattgttgttgacgtgtcagtccttgcgtgctagagttaggaattgagctcatcatcagttttggcattgccttttgggatgcaaagcaagtggtttactggagaatcacaaacatgcatagggtttactactcatataattctcgatgcccgggaagtaacaatttagttgtcactcctatgtgcccccaaagctgcgcaaaacttcagaatacattctcttggggtgttgaattgtgatgtgataaacttattttataatcctgaatgtaagtgaacagttggttaacctaatggtaaaatataagtcagaaacatatctccc

SEQ ID NO: 1242 - DNA, 2591 bp, Hordeum vulgare
cgttcctcttctctgccgaccaaagccctaaaccctagcccgactaacccccttcccctccccctcctcctccccggccgcggcggcggcgccagccaccggcagcacccacccaccaggcgaagaagatgccgctggggcagcgcgccggggacaagagcgactcccgctactgcggggtcgaggtgctcgacttccccgccggggacggcctccccgccgtcctcacccactccctctcctccgccttcgacttcctcctcgccccgctcgtcgatcccgactaccggcccacgcccggcgccgtcctgccggtggcggcctcggacctcgtcctcagcccgtcccagtggagcagccacatcgtcgggaaggtcagcgagtggattgatctggattccgaggacgagcagctgcggctcaattcggagctcacgctcaagcaggagatcgcctgggcgactcatctctccttgcaggcgtgcgttcttcctcctcccaagagatcgacctgtgccaattatgctagagttgtaaataatattttgcaaggcttgaccaatatgcagctgtggcttaggatacctctggagaagtctgaatctatggatgaagaccatgacaaagtaaataataataaccccacgagtgaaacagtagattcttgggaatcgtggaattcattcagactgttatgcgagcatagcagtcaactgtatgtagcacttgatatcttgagctcgctgccatcaatgaactctctaggacggtggtttggggagcctgtaagagctgcgattgttcagacagatgcttatctaacaaatgcaagaggttatccttgcttgcccaaacgccaccagactctgcttactggattttttaaccattcagttcaggtaattatctctgggagatcaaatcataatctttcccaagtatctgaaggagtgctctcaggtgatgaaaaccacaccgaagatacccccactcggcatgcattgggcccgtatcttgactacattgcctacctctatcagaggatggatccacttcctgagcaagaacggttcgagatcaactatagggatttcttgcaatctcctctccagcctctcatggataatttggaagcacagacttatgagacttttgagaaagacactgtgaagtatacacagtatcaaagagcaatcgctaaggctttggttgataaggtttcagatgatgaagtctccacagctaggatggtcttgatggttgttggagcaggccgagggcctctagtaagagcatcattgcaggccgcagaagaaactggtcgaaagctaaaagtgtatgcagtggagaaaaatcctaacgcagtcattactcttcatagtttgatcaaattggaagggtgggaaagcatggttactattatttctagtgacatgcggtgctgggatgctcctgaaaaggctgatattttggtcagcgagttgcttgggtcatttggtgataatgagttatctcctgagtgtctagatggcgcccaaagattcttgaagccagatgggatttctattccttcatcttacacaagttttatccaaccggtaacagcatcaaaactacacaatgatattaaagcacacaaagatattgcacattttgaaacggcatatgttgtcaagctacaccgagtagcaagacttgcacctccacaagaggttttctctttcacacatccgaacttctcaccaaaggctaccaaccaaaggtataccaagttacagtttgaactaccacaagacacgggatcatgccttgtgcacggattcgctggatattttgatgctgtactatataaagatgtccatctaggaattgagccgaacacatgtacaccaaacatgttcagctggttcccaatctttttcccactgaggaagcccatctacgtgccgtcggagtcgcccatagaagtgcacttttggcgatgctgtggttccaccaaggtgtggtatgagtgggctctggtggcgccgtctccatcgccaatccataacagcaatggccggtcgtattgggttggtctataagttgagaaatcagaatatgcgcttgtgtcgggttttgagagagaagaaaatgccaatcatatatgctaggtttttgagtgcgtccagctaccttgatcaaagaaacagatcttagaacctggatgcagggcacatgctgtaactccaaagcttttgttttgtaacattttttacttgttattgttgttgacgtgtcagtccttgcgtgctagagttaggaattgagctcatcatcagttttggcattgccttttgggatgcaaagcaagtggtttactggagaatcacaaacatgcatagggtttactactcatataattctcgatgcccgggaagtaacaatttagttgtcactcctatgtgcccccaaagctgcgcaaaacttcagaatacattctcttggggtgttgaattgtgatgtgataaacttattttataatcctgaatgtaagtgaacagttggttaacctaatggtaaaatataagtcagaaacatatctccccttg

SEQ ID NO: 1243 - DNA, 2577 bp, Brachypodium distachyon
gcgcgttcctcttctccgccgaccaaaaccctaaaccctacccggacccaaaccctccctcctctcctcctccggcggcggcggccacagcaatcggagatgcctctggggcagcgcgccggggacaagagcgactcccgctactgcggggtggaggtgctcgacttccccgccggcgacgggctccccgccgtcctcacccactccctctcctccgccttcgacttcctcctcgcccctctcgttgaccctgactaccggcccacgccaggcaccgtcctgccggtggcggcgtcggacctcgtcctcagcccgtcccagtggagcagccacatcgtcgggaagatcagcgagtggattgatttggactccgaggacgagcagctccggctggactcggagctcacgctcaagcaggagatcgcctgggcgtcccatctctccttgcaggcatgcgttcttcctcctcccaggagatcgtcctgtgccaattatgctagagtagtgaataatattttgcaaggtttgacgaatatgcagttgtggcttaggatacctctggagaagtctgaacctatggatgaagaccgtgaccagagtgacatagtagactcatgggaatggtggaattcattcagactattatgtgagcatagcagtcaactgtatgtagctcttgatatcttgagctcactgccatcaatgaactccctagggcgatggtttggggagcctgtaagagctgcaattcttcaaacggatgcttttctaacaaatgcaagaggttacccttgcttgtccaagcgtcatcagactctgcttactggattttttaaccattcagttcaggcaatcatctctgggagatcaaatcacaatgtttcccaagtagctgaaggagtgctctcaggtgctgaaaaccacaccgcagatacccccattcgccatacgttgagtccgtaccttgactatattgcctacctctatcagaggatggatccacttcctgaacaggaacgctttgagatcaactatagagatttcttgcaatctcctctccaacctctcatggataatttggaagctcagacttacgagactttcgagaaagatactgtgaaatatgcacagtatcaaagagcaattgctaaggctttggttgataaggtttcagatgatgaagtctccacaactaggacggtgttgatggttgttggagcaggccgagggcctctagtaagagcatcattgcaggctgcagaagaaactggtcgcaagttaaaagtatatgctgtggagaaaaatcctaatgctgttattacccttcatagtttgatcaaattggaagggtgggaaagcatggttactataatttctagtgacatgcgatgctgggatgcccctgaaaaggctgatattttggtcagtgagttacttgggtcctttggtgataacgaattatctccggagtgtctagatggtgcccagagattcttgaagccagatgggatttctattccttactcatacacaagttttatccaaccagtaactgcatcaaaactacacaatgatatcaaagcacacaaagatattgcacattttgaaactgcatatgttgtcaagctacaccgagtagcaagacttgcacctccacaaccggttttttctttcacacatccaaatttcccaaaggctacgaaccaaaggtacaccaagttacagtttaagctaccacaagatacgggatcatgccttgtacacggatttgctggatattttgatgctgtgctatataaagatgtccatcttggaattgagccgaacacatgtacaccaaacatgtttagctggttcccaatcttcttcccgttgaggaagcccatctacataccatcggagtcacccatagaagtgcacttttggcgatgctgtggtgccaccaaggtgtggtatgagtgggctatgatggcgccgtccccatcccctatccataacagcaacgggcggtcctattgggttggtctataataagttgacaaatcgggatcttattttttggtttttgaggcagaagagaaagggcccatttatatgctagattttccagtgcatccgaccagctgaagtttgtatactgatgatcaggaaacaggttttttggaacttgtgtctgcagggctgtcaacatgcaaggggccggttttgtaacaccatattaacgtcctctggtcaatccttgtgcgtgctagagtggagtaggacttgggagtggagctcatcatcaattttggctttgcgtttcttgaggagcatgagaagatcctgtgaacagattcgtggactcagatctatgttttgtacttaacttgtcgaaaatgggcgcaaagcatttggcttactgggaattcaccggcgcctgaagtttattttcggctgatagtttgtgtcgaattcctagtaattcagacaaattagcttactgattctttcttttttttcgagttgccacctcttctatcagaactaatgagtatcctttgaagctaagcagccattacagagtgtgtttctttc

SEQ ID NO: 1244 - DNA, 540 bp, Echinochloa colona
ctcgccgcctcccctcgaactcgcgcccgcggcggccgctgctcgtctgctccggcgatggcgactgtgccagttaaccctaaacctttcttgaacaacctgacggggaagcctgtaattgtcaaacttaagtggggtatggagtacaaaggctatcttgtttctgtggactcgtatatgaatcttcagcttgctaacacagaggagtacattgatgggcaattctctggaaacctgggagagattttgatcaggtgcaacaatgttctgtacctccgaggtgttccagaggatacggagatagaggacgcggagtgagaagactcgaaccatgtttagattgattgatgtaatatgattctgacatgtgctcgtgacaacctatcctgcagaatcctagctttgaactctatgagtgatgaatgttaaactatactgtcatttcggtgaatgtttcaaccgaaagcttgtcctagatgctgttcaaacttgtatcattttactgtcattctgctgaatgaagtacgagatttgttgacc

SEQ ID NO: 1245 - DNA, 594 bp, Echinochloa colona
aggccgcgttagggtagctttactcctgctcgccgcctcccctcgaactcgcgcccgcggcggccgctgctcgtctgctccggcgatggcgactgtgccagtcaaccctaaacctttcttgaacaacctgacagggaagcctgtaattgtcaaacttaagtggggtatggagtacaaaggctatcttgtttctgtggactcgtatatgaatcttcagcttgctaacacagaggagtacattgatgggcaattctctggaaacctgggagagattttgatcaggtgcaacaatgttctgtacctccgaggtgttccagaggatacggagatagaggatgcggagtgagaagactcgaaccatgtttagattgattgatgtaatatgattctgacatgtgctcgtgacaacctatcctgcagaatcctagctttgaactttatgagtcatgaatgttaaactatactgtcattctggtgaatgtttcaactgaaagcttgtcctagagatgctgttcaaacttgtctcagtttactgtaattctgctgaatgaagtacgagatttgttgaccagtcgtggtgtggtcggcgtctct

SEQ ID NO: 1246 - DNA, 366 bp, Oryza sativa
ctcatctcgtcggcggcggcggcggagcggaggagcacggcgagctagctgctctaccttggaatggcgactgttccagttaacccaaaacctttcttgaacaacctgacagggaagcctgtcattgtcaaacttaagtggggtatggaatacaaaggataccttgtttctgtggactcttatatgaatctgcagctggctaatacagaggagtatattgatggacaattctctggaaacctgggagagatactgattaggtgcaacaatgttctgtatctccgaggcgttccagaggatgccgagatagaggatgcagaatgagataacctggacctatgcgcagatcgatttgtgtaatatgca

SEQ ID NO: 1247 - DNA, 508 bp, Brachypodium distachyon
cccttccgcacgaacctcacggctgttcctcctgcttcccctcgtcgccttcgtctccgcctccagcccgccgcgccagctcgtcttctccgatggcgactgtgccagttaacccaaagccattcttaaacaacttaaccgggaagcccgtcatcgtcaagcttaagtggggcatggagtacaaaggatatcttgtttcggtggattcctacatgaatctgcagcttgctaatactgaggaatacatcgatgggcagttctctggaaatctcggggagatactgataagatgcaacaatgttatgtacctccgaggcgttccagaggacacagagatagaagatgcagagtgaagagtacatggactgttcttaggttgatgcatgttgtccgctactgtaaaacagtcatagctcgtctccgattgcactttgcgggcaccgagccatgttaactcgagttctgtatcccgaatgaatgaatgatcaacttgcatgttttaaacggc

SEQ ID NO: 1248 - DNA, 579 bp, Festuca arundinacea
tccgcctccgaccagccgcgcggcctcgccaccagctcgtatcctccgatggcgaccgtgcctgttaacccaaagccattcttaaataacttaaccgggaagcctgtcatcgtcaagctgaagtgggggatggagtacaaaggatatcttgtttcagttgactcttacatgaatctgcagcttgctaatactgaggaatacattgatgggcagttctctggaaatttgggcgagatactgataagatgcaacaatgttatgtacctccgaggtgttccagaggacacggagatagaagatgcagagtgaagagtacatgacctgttcctaggttgatgcatgttgttatttcgctgctgaaaaacgcctctgtagttcgtctcatttgtgcccaatgacaatattaacgagtattgtgctcatgttaactcgaattctgtatcctggatgaatggatgattgactggcatgtcttaaaacggctgattgcctatggttctgctgtaaccgttggatagggtttgatgtttggtatgtgatggactcgacataggtgacgtaaagaaaaaaaaaaaaaac

SEQ ID NO: 1249 - DNA, 486 bp, Festuca arundinacea
tccgcctccaaccagcagcgcggccgcgtcaccagctcgtctcctccgatggcgaccgtgcctgttaacccaaagccattcttgaataacttaaccgggaagcctgtcatcgtcaaactgaagtgggggatggagtacaaaggatatcttgtttcagtggactcttacatgaatctgcagcttgctaatactgaggaatacattgatgggcagttctctggaaatttgggtgagatactgataagatgcaacaatgttatgtacctccgaggtgttccagaggacacggagatagaagatgcagagtgaagagtacatgacctgttcctaggttgatgcatgttgttatttcacttctgaaaacgcctcggtagttcatctcatttgtgctcagtgacagtattaacaagtattgcgatcatgttaactcgaattctgtatgctgaatgaatggatgactgactggcatgtcttaaaacggctgat

SEQ ID NO: 1250 - DNA, 795 bp, Lolium multiflorum
gccagcccagcccaacaataaatctcaatccccttcccatacaaccctagccccgcttccccacgaaccccgcacggctgctcctcctccgtcgtcttcgcagttcgcctccgcctccgaccagccgcgcggccgcgccaccagctcgtctcctctgatggcgactgtgcctgttaaccctaagccattcttaaataacttaaccgggaagcctgtcatcgtcaagctgaagtgggggatggagtacaaaggatatcttgtttcagtggactcatacatgaatctgcagcttgctaatactgaggaatacatcgacgggcagttctctggaaatttgggtgagatactgataagatgcaacaatgttatgtacctccgaggtgttccagaggacacagagatcgaagatgcagagtgaaggagtacatggactgttactaggtcgatgcttgttgtgtgatgctgaaaaacaccactgtagtttgtctccatctgcgcaagtgactgtattagcaagcattgcgctcatgttaactcaaattctgtatcgtgaatgaatggatgattgactggcatgtcttaaaacggctgattgcttattgctggtaggttctgctgcaaccgtttggtgtttgatatgtgactgtccagcgactcaacataggtgcatgagctgatgtttctgctccagttagatctttcttttcgctaatagatgtcattatcctgtaacatcttttagccctgtattaaatttttaccagttgccaaaagtacctcggccgcgaccacgct

SEQ ID NO: 1251 - DNA, 608 bp, Pennisetum glaucum
gtaaacctatccgaccaccgcgctagctgctcgacctcgccgcctcgccctttcgccgccttcgcctcgacctcgcacccgcggcggccgctgctcgtctgctccgatggcgactgtgccagttaacccaaaaccatttttgaacaacctgacagggaagcctgtaattgtcaaattgaagtggggtatggagtacaaaggttatcttgcttctgtcgactcttatatgaaccttcagcttgctaacacagaagagtacattgatgggcaattctctggaaacctgggagagattttgatcaggtgcaacaatgttctgtacctccgaggtgttccagaggacacggagattgaggatgcggagtgagaagacttgaaccttgaggtagattggtgtaatatgtttctaacgcgtttggctgtgctggtgacaacctattctgccgaatcctagcttgaacttaatgagtaatgaagaacacaagtctgctttctgtcattctgctgtatcgtctgaactgaaagctaggactagagaattcaaacttctttcagtttagtattactgtcattctgctgaatgtgagaattaccagatttcttgacca

SEQ ID NO: 1252 - DNA, 559 bp, Elaeis guineensis
ctcctcccaagctcctcttctcgttcccatggcgacagttccagttaacccaaaaccattcttgaacaatttgactgggaagcctgtgattgtgaaattgaagtgggggatggaatacaaaggttatcttgtctcagtagattcctatatgaacttgcagctagccaacactgaagaatacattgatgggcaattctcaggaaatcttggggagatactgataagatgcaacaatgtgctgtacctccgtggtgtaccggaggatgaagaaattgaagatgctgaatgacaattacatccaggagccatttttctttctgctgatacccggatgtctgaaagcaggattagcagatgcggatgtagttttaactctgcacacaatggatcatcacttttatcgggtgtattaaaagaaaatggtaaaacaaaaacatgctcgatgctgctttaattgtgtattgtataatttttttttatggtttcggtactattggtactttagtagttaaaatctgtagactgtaccgaagggaccacgaacagggggtatagggcc

SEQ ID NO: 1253 - DNA, 590 bp, Oryza sativa
accaacccctcgctctcccactcatctcgtcggcggcggcggcggagcggaggagcacggcgagctagctgctctaccttggaatggcgactgttccagttaacccaaaacctttcttgaacaacctgacagggaagcctgtcattgtcaaacttaagtggggtatggaatacaaaggataccttgtttctgtggactcttatatgaatctgcagctggctaatacagaggagtatattgatggacaattctctggaaacctgggagagatactgattaggtgcaacaatgttctgtatctccgaggcgttccagaggatgccgagatagaggatgcagaatgagataacctggacctatgcgcagatcgatttgtgtaatatgcagctgacatgaacaatttaagtgtcatgtaaaattgatgcacagattccttgttgacctggatcttaactatggtcatgatatggttatattaggcattgaaactgatttcatattgactagtgtcattgctcaaatgtgtgagagatcatatttcgtgagataatataccatttgcctgtcgagatggatgacgaactgaacat

SEQ ID NO: 1254 - DNA, 723 bp, Panicum virgatum
ccccttgtgagattctaaaagctggcgaaggcccataaggtccagcctacgaagctttccgttgcggtttttccctgcttccctaagccccgcttcggctgccccctctactcgccgagtcgtccgccgtcgccgcctccctcgccctcccctcgacctcgtgcccgcggcggccgctgctcgtctgctccgatggctactgtgccagtcaaccctaaacctttcttgaacaacctaacagggaagcctgtaattgtcaaacttaagtggggtatggagtacaaaggttatcttgtttctgttgactcctacatgaatcttcagcttgctaacacagaggagtacattgatgggcaattctctgggaacttgggagagattttgatcaggtgcaacaatgttttgtacctccgaggtgttccagaggatgctgagatagaggatgcggagtgagaagacttgaaccatgtttagattgattgatgtaaggacgtgtgtttgggtgtgccggggacaacctattctgccgaatcctagctttgaactttatgattgatgaagtgtatcctgctttcagttaggctatactgtcatgaacatttgaagtttgaactgaaagctaggactagagatgatgttcaaactttcagttatgagtattctgtcattctgctgaatctgagaagcatcagatttcctgaccacctgctcatttgtctgctc

SEQ ID NO: 1255 - DNA, 912 bp, Panicum virgatum
atggggagcagctatgggcaggctgacgggtgggacgttgggcgatgtgagtgccagcctcgggcccagggcgcagcccatcagagaggtggtggtggtggccccgcgaggagaaattttcttccctactttcctcgaacccccgcttcggctgccccctcaaccctagtccgcccgccgcgccggctactccaatactcgccacccaagccgcccgccgtctcgccctcccgccgcctccctcatcctcccctcgacctcgtctgctcctatggcgactgtgccagtcaaccctaaacctttcttgaacaacctaacagggaagcctgtaattgtcaaacttaagtggggtatggagtacaaaggttatcttgtttctgtggactcctacatgaatcttcagcttgctaacacagaggagtacattgatgggcaattctctgggaacctgggagagattttgatcaggtgcaacaatgttctgtacctccgaggtgttccagaagatgctgagatagaggatgcggagtgagaagactttgaaccatgtttagattgattgatgtaatatgattctgacatgtgtttggggtgctggggacaacctattctgccgaatccttgctttgaactttatgattgatgaagcgtgtcctgctttcagttaggctatactgtcattcttctgaacgtttgaagtttgaactgagagctatgactagacatgatgctcaaacttctttcagttatgagtatgactagacattctgctgaatctgagaagcatcagatttcctgaccacctgctcatttgtctgacatgaaattatataaatatgagctttgcatgatgtgttcgacatcatccctagccaagccaacaagcaaacgtatacttgattttcttcttgc

SEQ ID NO: 1256 - DNA, 584 bp, Musa acuminata
ggaaccctaactcgagaagagccttcctccgtctcaattgcaattcggtaaaccctaagaaagatcggctctttcctcttctcgttggttgttcgtccgtccctagaagcttcacgtttcctcgcaaatggcgactgtgccagttaacccaaaaccttttctgaacaatttgactgggaagcctgtgattgtgaaattgaagtggggaatggaatacaaaggttatctcgtgtcagtagattcctatatgaacttacagttggccaacactgaagaatacattgatgggcagttcactggaaacttgggggagattctgataaggtgcaacaacgttctgtatctacgcggtgtaccagaagatgaagagattgaagatgccgagtgagcatgagcaaaaatttcatggatttcggtgagccacttctgttggcctcatttggcactcgaacaacggatgtgcacttagcaactaatgtatactcatctaaagctcattataattttcttgtttgtattccctttgtgatggatgcttgtaggtcacttcttggttcagtctcttatccataagctttactatc

SEQ ID NO: 1257 - DNA, 747 bp, Brachypodium distachyon
cttctcccggagagtcgcggacgccggcctctgctccgccgtctcgcttcagcgtttctcagcgaacctctccagctgaccggcgacggcgacctcacttcgtctacaaccggctgccaaccatctcgctctctataccagatagacggccaccccatcctgctcgccctctctcacaggcctcggcagatctacacgggcggcgggcgacccgcgttttcggcagcacaaccaaccccgcagtcctccctatggccactgtaccagttaacccaaagcctttcttaaacaacctgacagggaagcctgttattgtcaaactgaagtggggcatggagtacaaaggataccttgtatctgtggactcatacatgaatctacagcttgctaatacagaggagtatattgacgggcaattctctggaaaccttggagagatactgataaggtgcaacaacgttatgtatatgcgtggcgttccagaggataccgagatagaggatgcagagtgagaagacatgggaccgctatcatgcccgattgagattgatgcaatatgcttctgacatgaaagggctgatctagcccgtttcaggtgtaatctccatctgtagatgtttggttgtgctgatgacaagatttttcagttttctttcattcatctggatggtactatcattctgtgaacgtgagaagtattagatttcttcagtggttcctcagttgatccatcgatccgtttattat

SEQ ID NO: 1258 - DNA, 769 bp, Festuca arundinacea
ccagcccaacaacagatctcctatccacccccatagaaccctagtctgcttccgttccgcacgaaccctcctcctcgtcgcctccgcctccgaccagccgcgcggccgcgccaccagctcctctcctccgatggcgactgtgcctgttaaccctaagccattcttaaataacttgaccgggaagcctgtcatcgtcaagctgaagtggggcatggagtacaaaggatatcttgtttcagtggactcatacatgaatctgcagcttgctaatactgaggaatacatcgacgggaagttctctggaaatttgggtgagatactgataagatgcaacaatgttatgtacctccgaggtgttccagaggacacagagatcgaagatgcagagtgaaggagtacatggactgttactaggtcgatgcttgttgtgtgatgctgaaaaacactactgtagtttgtctccatatgcgcaagtgactgtattagcaagcattgcgctcatgttaactcaaattctgtatcctgaatgaatggatgattgactggcatgccttaaaaacggcgattggttattgctggtaggttctgctgcaaccatttggtgtttgatctgtgactgtccagcgactcaacataggtgcatgagctgatgtttctgctccagttagatctttcttttcgctaatagatgtcattatcctgtaacatcttttagcactgtattaaatttttaccagttgccaaaagcaaaaaaaaaaaaaaaaaaaaa

SEQ ID NO: 1259 - DNA, 486 bp, Festuca arundinacea
ccagctcgtatcctccgatggcgaccgtgcctgttaacccaaagccattcttattaaataacttaaccgggaagcctgtcatcgtcaagctgaagtgggggatggagtacaaaggatatcttgtttcagtggactcttacatgaatctgcagcttgctaacactgaggaatacattgatgggcaattctctggaaatttgggtgagatactgataagatgcaacaatgttatgtacctccgaggtgttccagaggacacagagattgaagatgcagagtgaagagtacatgacctgttcctaggttgatgcatgttgttatttcactgctgaaaagcgcacccgtagttcgtctcattgttaactcgaattgagaagtactgcgctcatgttaactcgaattctgtatcctgaatgaatggatgattgactggcatgtacctaaaaaaaaagaaaaaaaacaaaagtactctgcgttgataccact

SEQ ID NO: 1260 - DNA, 606 bp, Setaria italica
cgccgcgctagctactcgacgcctcgccccctcaccgcctccgtcgccctcgcctcgacctcgcgcccgcggcggccgctgctcgtctgctccgatggcgactgtgccagttaacccaaaacctttcttgaacaacctgacagggaagcctgtaattgtcaaactcaagtggggtatggagtacaaaggatatcttgtttctgtggattcttatatgaaccttcagcttgctaacacagaggagtacattgatgggcaattctctggaaacctgggagagattttgatcaggtgcaacaatgttatgtacctccgaggtgttccagaggatgcggagatagaggatgcggagtgagaagacttgaagcatgtttagattgattgatgtaatatgattctgacgtgtgcttgggtgcgctggtcacaacctattctgccaaatcctagctttgaacttagtgagtggtgaagcatgtcagtctactttctgtcattctgctgaatgtttgaactgaaagctaggactagagatgttattcaaacttctttcagttaagagtattgctgtcattctgctgaatgtgagaattaccagattttttaacc

SEQ ID NO: 1261 - DNA, 441 bp, Setaria italica
cggctcgcctgctctaatcccgaccgccgcgctagctactctccgtttcgccctcgcctcgacctcgcgcctgaggcggccgctgctcgtctgctccgatggcgactgtgccagttaacccaaaacctttcttgaacaacctgacagggaagcctgtaattgtcaaacttaagtggggtatggagtacaaaggttatcttgtttctgtggactcttatatgaaccttcagcttgctaacacagaggagtacattgatgggcaattctctggaaacctgggagagattttgatcaggtgcaacaatgttatgtacctccgaggtgttccagaggatgcggagatagaggatgcggagtgagaagacttgaaccatgtttagatcgattgatgtaatatgattctgacgtgtttgggtgtgctggtgacaacctattctaccg

SEQ ID NO: 1262 - DNA, 736 bp, Lolium multiflorum
gccgccgccgccgccgccgctaccggatagacggacaccgcatcctcctcgcccttcctctcgagcttcagtgaactacgcgcgcggcagccctgcttgccggcggcccaaccctagccatggccactgtaccagttaacccgaagcctttcctgaacaacctgacagggaaacctgttattgtcaaactgaagtggggtatggaatacaaagggtaccttgtctctgtggactcctacatgaatctgcagcttgctaacacagaggagtacattgatgggcaattctctggaaaccttggagagatactgataaggtgcaacaacgttatgtatatgcgcggcgttccggaggataccgagattgaggatgcagagtgagaagatgagcgctgctgtcatggttaggttgagatttatgcaatatgcttttgacatgaatgtgataaatcttgcctgtttcagctgtaatcctatctagatgtttggttgtgttagtgaccagattttttcaacttctcattcgcctggattgtgctatcctcctgttgaatgttagaagtcaatttcttcagcaattcctttttgggatgtttggtttcagaaactgtatgaagaatggacccaatcctatctcattcgttttggttgagggatacaatgtcttgatctatcgccacttatcatgattgacctaccgatctaggatgaggtttttctctatcttcatatacgac

SEQ ID NO: 1263 - DNA, 648 bp, Eragrostis curvula
gcgacaacaagccacaaaaaaaacaagcccccacttgttcttggctgccaatctgcgtcggcgcgacagctgccctcgccgccttcctcttcgtctcctcgactagtacccgcggcggccgctgttcgtctactccgatggcgactgtgccagttaacccaaagcctttcttaaacaacctgacagggaagcctgtaatggtcaagcttaagtggggtatggagtacaaagggtttcttgtttctgtggactcctacatgaatcttcagcttgctaatacagaggagtacatcgatgggcaattttctggaaaccttggagagattcttatcaggtgcaacaatgttctgtacctccgaggcgttcctgaggataccgagatagaggatgcagagtgagaaaattcgctcctgaggataccaaggttagaggatgaagagtgagaagacttggaccatgccaagccaagattgatggatgtaatttgtttctgacaataacatattagttaagcgtatcccagatgcactttggtgatccactatgtttgctcctgtactattctcttgtacgggtgagtcagtgaccaacaattgtactgtatccttggtttatgagatgtgtgacgatccgggtttcacacaaaaa

SEQ ID NO: 1264 - DNA, 740 bp, Avena sativa
agacaagcttccccaggaaccccgcacggctgctcctcctcctcttcctcgtcgccttcgtagctcgcctccgcctccgaccagccgcgcggccgctccacaagctcgtctcctccgatggcgactgttcctgttaacccaaagccattcttaaacaacttaaccgggaagccggtaatcgtgaagctgaagtggggcatggagtacaaaggatatcttgtttcagtggactcctacatgaatctgcagcttgccaataccgaggaatacattgatgggaaattctctggaaatttgggagagatactgataagatgcaacaatgttatgtacctccgaggtgttccagaggacacagagattgaagatgctgagtgaagagtacatggctggtttctaggttgatgcgtgttgctatttcactgctttgcgctcagtgactgtaaacaagcattgcgctcatgttaactcgtattggttatgtctgtaccccctgccgccaccctactaaatattggttaaaagggtattttagtagtacttcatattaactcatgtcaactgaaactgtttaattcgtgttagtctgtcagaccgtcacacgaatatgcatgttgtcttggcctagcaaactgtactatgtatccatcctgggagctgctggagaagtgggataggggcggctaggcataagcataggaggctgcccgatgtgcccaggcctgtggcgcgctgtcaac

SEQ ID NO: 1265 - DNA, 555 bp, Avena sativa
cccgtttccaatagaaccctagactcgctttcccacgaaccccgcacggctgctgctgctccccctcctcgtcgccttcgaagttcgcctccgcctccgcctccgaccagccgcgccaccagctcgtttcctccgatggcgactgttcctgttaacccaaagccattcttaaacaacttgaccgggaagccagtcatcgtgaagctgaagtggggcatggagtacaaaggatatcttgtttcagtggactcctacatgaatctgcagcttgctaataccgaggaatacattgatgggcaattctctggaaatttgggagagatactgataagatgcaacaatgttatgtacctccgaggtgttccagaggacgcagagattgaagatgcagagtgaggggtacatggccggttcctaggttgatgcatgttgttatttcactgctgaaaaacacctccctagttcgtctcatttgcgcacggtgactgtaaacaagcattgtgctcatgttaactcgtattggttatgacctgtgcttgcgtaccccctgccacc

SEQ ID NO: 1266 - DNA, 552 bp, Avena sativa
gccgcgccaccagctcgtttcctccgatggcgactgttcctgttaacccaaagccattcttaaataacttaactgggaagccagtcatcgtgaagctgaagtggggcatggagtacaaaggatatcttgtttcagtggactcctacatgaatctgcagcttgccaataccgaggaatacattgatgggaaattctctggaaatttgggagagatactaataagatgcaacaatgttatgtacctccgaggtgttccagaagacacagagattgaagatgcagagtgataagtacatggactgttactcggttgatgcttgttcgctgctgaaaaacacctccttagttcgtccccatctgagcgagtgactatttaacaagcattgtgctcacgttaactccgaattctgtatcctggatgaatgaccaacttgcatgtcttaaaacgcctgttcggtaattgctggtaaactctgctgtaaccgttggatatggtttggtgtttgatatgtgactcaacatggcgcatgaggatgtttctgctccaggaac

SEQ ID NO: 1267 - DNA, 456 bp, Elaeis guineensis
ctagccttcgtctccgttctctcgctctctcctcgctccgtcttctcacgggcttgtttctcctgccaagcttcgcttcttgttcccatggcggctgttcctgttaacccgaaacctttcttgaacaacctgactgggaagcctgtaattgtgaaactgaagtgggggatggaatacaaaggttaccttgtctcagtagattcctatatgaacttgcagcttgccaacacggaagaatacattgatgggcaattctcgggaaatcttggggagatactaataagatgcaacaatgtgctgtacctccgtggtgtaccagaagatgaagaaattgaagatgctgaatgattgcttgtatccagaagccacttttcttttcactgttatccaggtgtgtgtaggatatgcagcaaatgtgattgtagtgtcaaaacacaatatatcatcacttttagt

SEQ ID NO: 1268 - DNA, 1150 bp, Ananas comosus
aaaaaccctacgaaacccctcggagtcgacactcccaaccccacccctcgcgaaaccctcgaaccatcgaagctccattttcgccccccctcgctaatggcggccgtgccagttaatccgaagcctttcttaaacaatctgaccggcaagcctgtgattgtgaagctcaagtggggcatggaatataaaggttatctcgtttcggtggattcgtatatgaacctacagcttgccaatacagaggagtatattgatggccagttctcaggaaatctcggggagatactgataaggtgtaacaacgttctataccttcgtggcgtaccggaggacgaagaaatagaagatgcggaatgaggcttcttagatatgtgttaaaggcgaaacagcatcaatttctattcttattactgaaatcttctttatctgacaagtaatagcttgctctagttcagcatactttttacatgaactttgtatgttaagagttagaattcaagagcccaatgttttaagagatccaatccccgcatgacgctgacgctgccccaggtcggcctccttgattgagaagacatacactccttttcgtcgagcaggtactcatatgccataacttgtgtcttgggagttctgtggtctctaatgtttattcagtgcggtcgctaaacttcgtttgtcgcatcagcgtgcccgaattggcaaattttcttctagcttcagtatatgtcctcagctcctgctgctgcgggacgaaaatttgatgagacatgttaagtcactttgaaagatggcaaattgctaggttcaaagaagccttgggacttactaaaagtcccaaggcaacgatgataggaactgtttgatggcttgagcccctcatatttcaaatctcggagcggaatatgaaacaccagcaatcgattagtttcgagtgctttgataatgttagggttcttgaagggctagttcgggaatgcgttctctacaaaactttaggtctattttatgaatgtataattttacctggcaaaggtgcttctatttcgaaggccattcataatatcctctttgtgtcgttcattaaagccttgcgctcctttaatgagtcgtgttttcgatgatgggtaaaacttcaatggtttagccc

SEQ ID NO: 1269 - DNA, 486 bp, Sorghum bicolor
cctccgctccaagccccccgctttgcccggtcgtcgactcgctgccgccttcctcgacccgcaccgcacccgcagaagctaatggcgactgtgccagttaacccaaaacctttcttgaacaatctgactgggaagactgtaattgtcaaacttaagtggggtatggagtacaaagggtatcttacttctgttgactcatacatgaaccttcagcttgctaacacagaggagtacattgatggacaattctctggaaacctgggtgagattctgatcagatgcaacaatgtcctttatctccgaggtgttccagaagatacagagatagaggatgcagagtgaggagccgggagtgggggaccatgccttaagattggttctgataaccatgtattagctgtcatcttaagattggttgatgatatttcagatgcgcactactgaatacaaaattgctgatgcatttgcctgcttgcacggcacgac

SEQ ID NO: 1270 - DNA, 567 bp, Saccharum officinarum
cttcctagacccgcacccgcagaaaataatggcgactgtgccagttaacccaaaacctttcttgaacaatctgacagggaagactgtaattgtcaaacttaagtggggtatggagtacaaagggtatcttacttctgttgactcatacatgaaccttcagcttgctaacacagaggagtacattgatggacaattttctggaaacctgggtgagattctgatcagatgcaacaacgtcctttatctccgaggtgttccagaagatacagagatagaggatgcggagtgaggagacatggaccatgccttaagattggtcgatgatattgttctgacaacaatgtagccttaagattggttgatgatatttcagatgcgcactactgaattcaatattgctgatgcatttgcctgcttcctgcccccgttctatctaatactagtaagatactaagatgcatttgctcggcatggcaagacattgtgaaatcatttggtcaatgtagtacggactattccaatcttgccttgtttgttttggcccaataacttgtctgctggaaagtc

SEQ ID NO: 1271 - DNA, 361 bp, Triticum aestivum
gcacccgcagaagctaatggcgactgtgccagttaacccaaaacctttcttgaacaatctgactgggaagactgtaattgtcaaacttaagtggggtatggagtacaaagggtatcttacttctgttgactcatacatgaaccttcagcttgctaacacagaggagtacattgatggacaattctctggaaacctgggtgagattctgatcagatgcaacaatgtcctttatctccgaggtgttccagaagatacagagatagaggatgcagagtgaggagccgggagtgggggaccatgccttaagattggttctgataaccatgtattagctgtcatcttaagattggttgatgatatt

SEQ ID NO: 1272 - DNA, 471 bp, Oryza sativa
acacttgaatctgccatgctgctcaagatgcaagaacaagaagtgttcccattccttgctcactattctgactggtacatcactgttcacatcaaggttctctatgtggactatgctttacttgaattggagcttcagaagagcattgaggaactattgtatccctctttgagtggggaaaacaaagacaatgacccagtgactgtgccagttaacccgaagcctttcttgaacaacctgacagggaagcctgtcattgtcaaacttaagtggggtatggaatacaaaggatatcttgtttctgtcgactcttatatgaatctgcagctggctaatacagaggagtatattgatgggcaattctctggaaacttgggtgagatactgataaggtgcaacaacgttttgtatctccgaggcgttccagaggataccgagatagaggatgcggaatgagatagcccgggccat

SEQ ID NO: 1273 - DNA, 489 bp, Musa acuminata
gcctttgtcctcgcgggtggtggttcatcggcccctgccccgacccccgagcgtattgcccttctttgcgaatggcgactgtgccagttaacccaaaacctttcttgaacaatttgactgggaagcctgtgattgtgaaactgaagtggggaatggaatacaaaggttatcttgtgtcggtagattcctacatgaacttgcagttggccaacactgaagaatacattgatgggcaattcactgggaacctgggggagattctgataagatgcaacaatgtgctgtatctacgtggtgtgccagaagatgaagagattgaagatgctgactgagaatgagcagcaatgttgtctttggacttgaatgattggtgtacaattactctttattatccagttacatcacaacatcatctgttaaatcggagagagatgtgactgcaattcctaaccatgtttctgtagaatcctctttcttctgttaatgcgc

SEQ ID NO: 1274 - DNA, 759 bp, Cocos nucifera
aaaaagttgaaaaaatgtctttgggcttacatatcaaaccaaccctagaaccctaagatgatgtgatgccgcgctgtctcgctagaagggctgcaaccaactcgatgcctaaagattccctttcctgagctcaaagaaagcaatgcgtacagttccagttaacccaaaacctttcttgaacaatttgaccgggaagcctgtaattgtgaaattgaagtgggggatggaatacaaaggttatcttgtctcagtagattcctatatgaacttgcaggtagccaacactgaagaatacattgatgggcaattctcaggaaatcttggggagatactgataagatgcaacaatgtgctgtacctccgtggtgtaccagaggatgaagaaattgaagatgctgaatgacaattacgtttaggagccacttttctttttgctgatacccagatgtctgaaagcaggatcagcagatgcggatgtagttttaactcggcacacaacggatcatcacttttatccgtgcattaaaagaaaacggtgaaatcaaaaacatgcttgcttgctgctttaattatgtatcaatattttttccccccccccccccttttttatgttggcatgctcatctaaaatgcatgttagtactgcatttctttcccctgcttcaatcaacgggtcctggtttgaacagtctcaaaattgcagcacctgcttcattgtattaacttgacatgcaataaatcttcactttatcagggaaa

SEQ ID NO: 1275 - DNA, 771 bp, Cocos nucifera
tttttctctccctctccctctccctcacctccgtcttctcgttcttccgtgccgagatcccgtcgcgagtgctttcttgcccctccgatggcgactgtacctgttaacccaaaacctttcttgaacaatttgactgggaagccagtgattgtgaaacttaagtggggaatggaatacaaaggttttcttgtatcagtagattcctatatgaatttgcagcttgcaaacactgaagaatacattgatggccagttcacagggaaccttggggagatactgatacgatgtaacaatgttctttaccttcgtggtgtaccagaggatgaagaaattgaagatgctgaatgagatcgaacagaaccgctgttggccatgttctttatctggttagatccagactcacaactttgtgcctagatgtaggaatgcaggctctgctgctaatgtgtcggtagtcttctttatctatcacaactagacttttggccttgttatactacattaccatgtatcaatgcgaccctgtccccaagtcaatccatcctgatacggcagccaaacaagttgagtcttgggaatccgttggattaattaccttagaaggaaacgcttgtcgcaggttgagctggcaaaataggtcaggattatgggtcggtccatttggtcctaaaaatggattgggctggatgacaaaattttggccctttaagtgagtatttttggcttggcccttatagctcatggattgaactgggttagggccgggtcagc

SEQ ID NO: 1276 - DNA, 712 bp, Festuca arundinacea
agtggtatcaacgcagagtacgggggacctttgctctcgcagacccggacgccggcccctgctccgccctctcgctcccagcgacggcgacctcgcttctcctacgaccggctgccaacccaaccgccttggctaccggggagacggataccgcatcctcgtcgccctcttcctctcgagcttcagcagatctacgcgcgcggcgacccagctagccatggccactgtaccggttaacccgaagcctttcctgaacaacctgacagggaagtctgttattgtcaaactgaagtggggtatggaatacaaagggtaccttgtctctgtggactcctacatgaatctgcagcttgctaatacagaggagtacattgatgggcaattctctggaaaccttggagagatactgataaggtgcaacaacgttatgtatatgcgtggcgttccagaggataccgagattgaggatgcagagtgagaagatgctggctgctgtcatgcttagattgggatttatgcagtacgcttttgacatgaacgtgataaatagcctgcttcagatgtaatcctattgtggcaggcgcagaatttaccatctatcttgcctatttagattgttggtggtgctggtcaccagtaattttttaaaaacaaaaaaaaaaaaaaaaaaaaacaaaaaaaaaaaaaacaaaaaaaaaaacaaaaaaacaaa

SEQ ID NO: 1277 - DNA, 997 bp, Zea mays
gaggtccctgtaccccgcttgggctctcctaaaccctaatcgtgaccgccgcgccagcgccaggaactgtagtttcgtcctcgcggccttctctccctccagtcgaaccgcgccgacgagcgacgacaactgctgctgcattcttcaatggcgactgtgccagttaacccaaaacctttcctgaacaacctgacggggaagcctgtaattgtcaaactcaagtggggtatggagtacaaaggttatcttgcttcagtggactcctatatgaatctccagcttgccaatactgaggagtacattgatgggcaattctctggaaacctgggagagattctgatcaggtgcaacaacgttatgtatctccgaggcgttccagaggatgcagagatagaggatgcagagtgagaagatgtgaatgtaatttgattctgacatgtatgtttgaatacgccggtgacaactagacctatcggatctttatgttgtcattctattgaatgtgaggaatatcagatttccttgaaacagtttctcttgcctcattgccaactacctccctcgtttcaaattatagattttttttagatacgaagctctatgtctagtaaagccaaaacgtataatctggagtggagggaatatcacgaattatttgaatgtgaacttgcacgatgtgttagatgttatatcaatgcaaaacaatcggctctggttgctgagatcatagaaatgaaattgctgctgagatcatagaaatgaaattgcattgttgcaaattatagcaaactgacgacttactacacaggcatggtaaaaaaatattaaatggatctagctagcttacaaatgcaaattgaggcatgtcatgataccgaacgccacagctactccattccaccagctcgtagcactgcgtccggcgggcgatggaaccttggctgccatgccgccgtgcacgctaggaatcggaataattcctgtctcacctagcgcc

SEQ ID NO: 1278 - DNA, 376 bp, Zea mays
tcccgtttcgtcctcgcggcattcgcggcgttttctcccactgctcgaaccgcgccgacgagcgacgacaagagctgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggatgcagagtgagaagatgcgatcaatgttag

SEQ ID NO: 1279 - DNA, 505 bp, Elaeis guineensis
ctcggcctgccaagatcttgtcgcgagtgccttcttccccctccgatggcgactgtacctgttaacccaaaacctttcttgaacaatttgactgggaagccagtgattgtgaaacttaagtggggaatggaatataaaggttttcttgtttcagtagattcctatatgaatttgcagcttgcaaatactgaagaatacattgatggccagttcacagggaaccttggggagatactgatacgatgtaacaatgttctttacctccgaggtgtgccagaggatgaagaaattgaagatgctgaatgagatcaaacagaactgccgtcggccatgttctttatgtagtagttagatctagtctcacaacgttgtgcctagatgtaggaatgcaggctctgctgctaatgtgtcggtagttttcttttcaggacactgtattacctatcacaatgagactaacatggttgtttgaccttattatactgcattactgtgtatcaatgca

SEQ ID NO: 1280 - DNA, 540 bp, Saccharum officinarum
caaaccctaatcctgaccgccgcgccagcgccagcgcctccctctgctcgaaccgcgccgacgagcgacgacaaccactgctgtgttctccaaatctccaatggcgactgtgccagttaacccaaaacctttcatgaacaacctgacagggaagcctgtaattgtcaaactcaagtggggtatggagtacaaaggctatcttgcttcggtggactcctatatgaatctccagcttgccaacactgaggagtacattgatgggcaattctctggaaacctgggagagattctaatcaggtgcaacaacgttctgtatctccgaggcgttccagaggatgcagagatagaggatgcagagtgagaagatgcgatccatgttagattgataactgtaatatgattctgacatgtatgtttgaatatgccggtgacaactagacctaccggatcctagctatgatcttttgagtgatgaaacatgatgacagtaggtcttgaggtgctgttcaaactgcttccaattagactatgccgtcattc

SEQ ID NO: 1281 - DNA, 431 bp, Curcuma longa
tagttcttcagtaatggcgactgtgccagttaacccaaaacctttcttaaacaatttaactgggaagcctgtgattgtgaagttgaagtggggaatggaatacaaaggttaccttgtgtcagtagattcctacatgaacttgcagttggccaacactgaagaattcatcgacggccaatttactggaaatctgggggagattctcataaggtgcaacaatgttttgtatcttcgaggtgtgccagaggacgaagagatcgaagacgctgattgaggatggttattatcttgttcttattttacaaactttgcatgcattttaatgcagtcagatcattgtaacctagtgacacttaatttggaattttttagattgtatgtatttttaagtcaatccgatgacgcaccaagaactgataacggatgaacta

SEQ ID NO: 1282 - DNA, 930 bp, Sorghum bicolor
tgctaaacgggccgaggcccaaaaagcccagcccaaccacttttctggtggcggttcgtccctgatttcctggagtccggtccccctagatcctgcttgggctttcccaaaccctaatcctgatcggcgccagcgactccctctgctcgagccgcagcaaacgagcgacgacaaccgctgctctgctcgaaccgtgccgactagcggcgacaaccgcctgctgtgctctccgatggcgactgtgccagttaacccaaaacctttcctgaacaacctgacagggaagtttgtaattgtcaaactcaagtggggtatggagtacaaaggttatcttgcttcggtggactcctatatgaacctccagcttgccaacactgaggagtacattgatgggcaattctctggaaacctgggagagattctgatcaggtgcaacaacgttttgtatctccgaggcgttccagaggatgcagagatacaggatgcagaatgagaaatccgtgttagattgataaatgtaatatgattctgacatgtatggttgaatatgccgttgacaactagacctagcagatactagctatgatcttttgggtgatgaaacgtgatgacaatagggcccaggtgctgttcaaactgctttcagttagaccatgctgccattctgctgaatgtgatgagtatcagctttcttgaacaactcttgcctgattgcctcattgcctactaccacggattatcggatgcgaacttgcacgatgccttagacgttatatcagggcaaaacaattggctccgttggttactgagatcatagaaatgaaattgcattgttgcagattataggcacgataaaaagatgaaatggatctagctagttgatccaaacatacatacccgaacgcctacctgttgcaagctacagtacct

SEQ ID NO: 1283 - DNA, 627 bp, Platanus occidentalis
cttgctcgctaaaccctcgctgcctccgtccactttgcagaggaattttccttcgttttctccgtcttcttgagctcaaatggcgactgtaccagtaaacccaaaaccctttttgaacaatttgactggaaagcccgtcattgtgaagctcaaatggggaatggaatataaaggttatcttgtttcagtggattcatatatgaatttgcagctggccaacactgaagaatatattgatggacaattcacaggaaatcttggagagattttgatcaggtgtaataatgttctctatcttcgtggtgtaccggaggatgaagaaattgaagaagctgaacaagattaagaggagcaacacagttagtttcaaatctagacctacttaacagtatatttacgagggacatgtctgatgttgagattttaatattcatcttttaaccagtaagaggcataaacatcttttaaccagaaaaaatatgcctgaggaagaatccagtactcttttggtgtgcacaaacttgaagtaatggtatcgttgtatctattaattggtggtgttgtgatctgattttgttaggaattcaggcacttgtatcagtgttgacaacagcattataacatacc

SEQ ID NO: 1284 - DNA, 835 bp, Amborella trichopoda
tcctcgtcgactttcctcttcacagggaaaattcccgcccataagaagcctgcaaagtctattgtttttaacccaacaatcccttatgtttttagggtaaagccactcaactagggttaacttttcgggattcagcgctacttgcttctatattcaatggcgacagtaccagtgaacccaaagcctttcttgaacaatttgacagggaagcctgtcatggtgaagcttaaatggggaatggaatataaagggtatcttgtttcggtggattcatacatgaacttgcagctagcaaacactgaagaatacattgatgggcaattatctgggaaccttggagagattctcatcaggtgcaacaatgttctctacctaagaggtgtaccagaggatgaagaagtagaagatgctgattaagtttcagaatctgagtatattaccagtcgccttttgaatttagctgttcctttttggcttaaccttgcatgtatttttctcactttataaaggaaaaaaaagaaagaagggagatggtttttcctttccacaaactggtgattaatggctttatagttgctgcttagggagaatatttagttaatgctttgattcttccctttggtctggatgattttttctgcaatcttaaggattgtatcaagataacagaattgtgcactattaatacatgacaatctgattctgtgttggaacttctgctgtcgaatggatgccttcaaagcaccatgtcccttgcttcagctgttcttcacggagataatgtacttaagtttatctatagaggagttaatggcaatttatacctctcataatt

SEQ ID NO: 1285 - DNA, 625 bp, Secale cereale
cctactgaacctgccttgtcgtagccgggccagccggcgcgttctcacttctcagacgcgcacgcggcacgcctgcctcaaccgacggcgacctcgcttctctacgaccggctgccaacccaaccgccgtctctaccggataggcggccaccgcatcctcctagccacccctcttaagcatcagcagatctacggcgaccggtgaaaccaacctagcggccctccctagccatggccactgtaccagttaacccgaagcctttcctgatcaacctgacagggaagtctgttattgtcaaactgaagtggggtatggagtacaaagggtatcttgtttctgtggactcctatatgaatctgcagcttgctaatacagaggagtatattgatgggcaattctctggaaaccttggagagatactgataaggtgcaacaatgtcatgtatatgcgtggcgttccagaggataccgagatagaggatgcagcgtgagaagacatggaccgctgtcacgcgtagatatctgacaggaacgttccaatctagcccgtttcagatgtagtctcttgagatgcaggattttaggaggttgtttggttgacaaaaatggtaacgttaacgttaa

SEQ ID NO: 1286 - DNA, 1604 bp, Zea mays
cctggtcaccaaactagccctcagaggttgtttggttcccttgactgaagtttagttcgtgtcacatgaaatatcaattatgagtaataggcttaattaggtttaataaattcgtctcgtcttttagtcttcatctatgtaatgagttttataattagattatatttaatactcgtaattatcatacaaacattcggtgtgacagggagtaaactttagttgggtggaaccaaacacccccttaatgttagggcatgcttggactgaactttttttgggggagtgactaccaaattttatatctgagtagccaaaaaccggatgtggaaacatgacaggcctttctgtctctttttatggatgtcactgcttctgatctcagtcatacctatcagaagttcaggccagtggtttcacctttaccagtaccactgaagtatcatataatagctgcagttgtttctgctaacttaatccaaaggtaattttgcattccggttctaaaattgcttgtgatctcaacatcacatgaaaaagcatcaaattgtaatgagctaagcagggcataagctgttaagcttgattcccagtcttgttattatattgaattgctaaagttgcaggttaaatctaatttacagtgaaatacttgactagataatcggacaactgcgtttgttctaaattatgggtctcactgtctctttccaaggtgacatagatcatgagatttaaaatgtggacctgcttatacatcttgatgcttaatatgtgctgtattattggtctattttcagttaaacattgagccactgtgtgcatcgtgttatgcatgtcatatctttgtgatgctctttatgcaccatactattgtaatttgtaaatgccttcctttccaattgagaagctttgtctcactgcaaaatgctggggtaaggcttgcctcggttattccttacccaaaccctactgggtctgtccttcctttccaattgatggcagaaagttatcatctagttgaccaatggacttcagtaataataagctacagagatccaaagaatgaaatgagtcttgttatgtatgtttgcaatccataataaagtatggtcttacggtatatactcacttatcagctctcgttttgtgcagaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggacgcagagtgagaagatgcgatcaatgttagattgataaatgtaatatggttctgacatctatgttcgaatatgccggtgacaagtagatctatcggatcgctttgttctcttgagtgatgaaacatgatggcgtcgggccaagggtgaagctgctttcagttagactatgctgtcattctgctgaatgtatatcagatttcttgaac

SEQ ID NO: 1287 - DNA, 376 bp, Glycine max
tacaaaaccctaatcaccgcttcgagctctgtcattgtctcaagttccaggtttcagcgatttcgatctcgcatagcattctacaatggccactattccagttaaccccaagcctttcttgaacaatttgactgggaagcccgtaattgtgaaactcaagtggggaatggagtacaagggctatctcgtttccgttgattcctacatgaacttgcagctggccaacactgaagagtacattgagggacagtttactggaaatttgggagagattttaatcagatgtaacaatgttctctaccttcgaggagtaccggaggatgaggaaatcgaagatgttgcagaagactagatagtgataaaagctgctaatggc

SEQ ID NO: 1288 - DNA, 627 bp, Centaurea maculosa
cagaaagctgcaatcggcggtctgctattctccacgaacatggcgactgtaccagttaatcccaaacctttcttgaacaatttgactgggaagcctgtcattgtgaaactcaagtggggaatggagtacaaaggttatcttgtgtcggtcgattcatacatgaacttgcagttggcaaactctgaagaatacattgacgggcaatttactggaaaccttggagagattctaatcagatgtaataatgtcctgtatttacgaggtgtaccagaagatgaagaaatagaggaagcagagcgcgactaattagcaccttctgtactattggaatctattagttatcttcaacctcttctgttcttgtatgactttgggaatacctgtagatgtaatgctccaaatgacaccggcctagaaaccctaaacctctgattttctgttagtccaattgggttgaagtggactatattcagtttggatatatcaaacaatgttggatggttgttgctgtttctcatttctttttttggttatagattgaatcttgaaacaacctctcttatccttttggtttggttagagttcagatttgtgtacatctacgttccataatgcgagttatgcttt

SEQ ID NO: 1289 - DNA, 479 bp, Centaurea maculosa
ttctccacgaacatggcgactgtaccagttaaccccaagccttttttgaacaatttgactgggaagcctgtcattgtgaaactcaagtggggaatggagtacaaaggttatcttgtctcggtagattcgtacatgaacttgcagttggcaaactctgaagaatacattgatgggcagtttactggaaaccttggagagattctaatcagatgtaataatgtcctgtatttacgaggtgtaccagaagatgaagaaatagaggaagcagagcgcgactaacgggcacattctgtaccattggatctattagttttatcttcaaccgcttctgttcttgtatgactttgggaatacctgtagatgtaatgatccaaatgacaccggcctagaaatcctaaacctctgattttctgttagttcaattgggttgaagtggactactatattcagtttggatatatcaaacaatgttggatggt

SEQ ID NO: 1290 - DNA, 503 bp, Centaurea maculosa
ctgtaatcggcggtctgctattctccacgaacatggcgactgtaccagttaatcccaaacctttcttgaacaatttgactgggaagcctgtcattgtgaaactcaagtggggaatggagtacaaaggttatcttgtctctgtggattcatacatgaacttgcagttggcaaactctgaagaatacattgatgggcagtttactggaaaccttggagagattctaatcagatgtaataatgtcctgtacttaagaggtgtaccagaagatgaagaaatagaggaagcagagcgcgactaacgggcacattctgtaccattggaatctattagttttatcttcaacctcttctgttcttgtatgactttgggaatacctgtagatgtaatgatccaaatgacaccggcccctaaacctctgattttctgttagtccaattgggttgaagtggactatattcagtttggctatatcaaacaatgttggatggctgttgctgtttct

SEQ ID NO: 1291 - DNA, 537 bp, Centaurea maculosa
ccctaaaaccttcaccgtccagaaagctgtaatcggcggtctgctattctccacgaacatggcgactgtaccagttaatcccaaacctttcttgaacaatttgactgggaagcctgtcattgtgaaactcaagtggggaatggagtacaaaggttatcttgtgtcggtcgattcatacatgaacttgcagttggcaaactctgaagaatacattgacgggcagtttactggaaaccttggagagattctaatcagatgtaataatgtcctgtatttacgaggtgtaccagaagatgaagaaatagaggaagcagagcgcgactaacgggcacattctgtaccattggaatctattagttttatcttcaacctcttctgttcttgtatgactttgggaatacctgtagatgtaatgatccaaatgacactggtctagaaaccctaaacctctgattttctgttagtccaattgggttgaagtggactatattcagtttggatatatcaaacaatgttggatggttgctgctgtttctc

SEQ ID NO: 1292 - DNA, 494 bp, Cirsium arvense
aatcgactcttctctacgaatatggcgactgtaccagttaatcccaaacctttcttgaacaatttgactgggaagcctgtcattgtgaaactcaagtggggaatggagtacaaaggttatcttgtctccgtcgattcatacatgaacttgcagttggcaaactctgaagaatacattgatgggcagtttactggaaaccttggagagattcttatcagatgtaataatgttctatatttacgaggtgtaccagaggatgaagaaatagaggaagcagagcgcgattagcagatgtaatgatccaaatgacgcccgaacgtctgagttgctaagagtttaattgggtggatgcggactatattcagacaatgttgcatgttagttgctgttttatatcttttctggccactgattaaatttgctaattggaaacaaccgctctatccttttggtttttggtcaagtctgtgtacgtctcaaatccttagattaca

SEQ ID NO: 1293 - DNA, 596 bp, Glycine max
gaggtacaaaaccctaatcaccgcttcgagctctgtcattgtctcaagttccaggtttcagcgatttcgatctcgcatagcattctacaatggccactattccagttaaccccaagcctttcttgaacaatttgactgggaagcccgtaattgtgaaactcaagtggggaatggagtacaagggctatctcgtttccgttgattcctacatgaacttgcagctggccaacactgaagagtacattgagggacagtttactggaaatttgggagagattttaatcagatgtaacaatgttctctaccttcgaggagtaccggaggatgaggaaatcgaagatgttgcagaagactagatagtgataaaagctgctaatggctatgacataaaatgaactcgaattttctactgtttttgtatcttaacttaaatgtaggtttttttgtagttgtgtagagatttgaaatgatgcactcgcttgtgtatagggtgcctatgttcaagttgtctgttattttattttcatgcttctgaatatgttatttctctgtttatgtaataatcaatatcatttgaacacatcgataagtcgtcc

SEQ ID NO: 1294 - DNA, 545 bp, Prunus persica
gtctttcagctcagctcgactgaaggtgtcttctcaatcgccaatggccacaataccagttaacccgaaacctttcttgaacaatctgactggaaagactgtgattgtgaaacttaaatggggaatggagtacaaaggtttcctggtctcggtggattcctatatgaacttgcagttggccaacacagaagaatatattgatggacaattcacaggaaatctgggagagattttgatcaggcgaatgtaacaacgttctctaccttcgtggggtgccagaggatgaagaaattgaagatgctgaacaggaagatgtgcaatgaggattggttcaaaaaacagaactgaagtaacaggatttggattttatctctactttttattttttttatgttcaagtattgctggatgttcgactgacatgcccgtgccatttaaagggctcttactgacaaatggttctcaaaagtcaatgaaactatgtatacaaatattgagctgaatttcctatgtgatcaattgaagtctactatgcaacttagctc

SEQ ID NO: 1295 - DNA, 351 bp, Chelidonium majus
ctctcatcctctcaaagcagaggtttttagttcagacttcagagtcttcagacatcaatggcgagtgtgcctgttaatccaaaaccttttcttaacaatcttactggcaagcctgtcatggtgaagctcaaatggggaatggagtacaaaggttatctcgtttccgtagattcatacatgaacttacagctggccaacactgaagaatacatcgatggacaattcacaggaaatcttggagagatcctcatcaggtgtaataatgtttatatcttcgtggtgtgccggaggatgaggagatcgaagatgctgataaagattaataactattgatgatgatccaaagcaacg

SEQ ID NO: 1296 - DNA, 846 bp, Triticum aestivum
ctgccgctgctccgccctcccgcctccaccgacggcgacctcgcttctctacggccggctgccaacccaaccgccgtctctaccagataggccaccaccgcatcctcctagccatccctcttaagcatcagcagatctacggcgaccggtcgaaccagcgtagcggccctccctagccatggccactgtaccagttaacccgaagcctttcctgaacaacctgacagggaagtctgttattgtcaaactgaagtggggtatggagtacaaagggtaccttgtttctgtggactcttacatgaatctgcagcttgctgatacagaggagtatattgatggacaattctctggaaaccttggagatatactgataaggtgcaacaatgttatgtatatgcgtggcgttccagaggataccgagatagaggatgcagcgtgagaagacatggaccgctgtcacgcgtagatatctgacatgaacgtgccaatctagccccgtttcagatgttgtctccattgatgcaggatgtacgatttacctgctcccatgctatctacatgtttggttgtactggtgaccagatttttcagttttcaatcgtctggatggtgctatcgtccttgctgagtgttagaagtactgaatttcttcagcaattctattttggcatgcctggttttggaaactatatgccgaattgaccctccgttcctacctcattggtttggtttgaggtatatcatttcttcatcaatagccacttcggtattatagacaaacgatctgtgatgaggttattattcaaagcaaacatccaaattgtcaatttgttggggtgtttgata

SEQ ID NO: 1297 - DNA, 453 bp, Glycine max
caagttccaggtttcagcgagcattctacaatggctactataccagttaatcccaagcctttcttgaacaatttgactgggaagcctgtaattgtgaaactgaagtggggaatggagtacaagggctatctcgtttccgttgattcctatatgaacttgcagctggccaacaccgaggagtacattgagggacaatttactggaaatttgggagagattttaatcagatgtaacaatgttctctaccttcgaggagtaccggaggatgaggaaatcgaagatgctgctgaagactagagagtgatagaagctgctaatggctatgacataaacagaactcgaatttctactgtttttgtatcttcacataaatgtaggttttttgtagtcaatgtgtagagatttgaatcaatgatgcactcgcttgtgaatagggtgcctatgttcaagttg

SEQ ID NO: 1298 - DNA, 540 bp, Phaseolus vulgaris
gtagcttcacagtaccaggtttcagcgattgcgatcttgtagagcacagcataacgttctactatggctactataccagttaatcccaagcctttcttgaataatttgaccgggaagcctgtaattgtgaaactcaagtggggaatggagtacaaggggtatctggtttctgttgattcgtatatgaacttgcagctggcaaacactgaggagtacattgagggacagtttactggaaatttgggagaaattttaatcagatgtaacaatgttctttacctccgaggagttccagaggatgaagaaatcgaagatgccgctgaggactagattgatagaaattactaattgtgatgacgaacagaacttctactctttacctgcttttgtctttcgatgtatgtttttgtagttatatgtagagatttgaatcaatgatgccctcgtgaatattagggtttctgtgtgcaagttgttcacaatccttcaggtgattctgcataaatatgtaactgcatcatgtgttttcatacgattcaa

SEQ ID NO: 1299 - DNA, 822 bp, Cichorium intybus
gatagtggagggtataatactagtttatatactgcctttcatgttgacgcgaagccttcaaaaaccctaaaccttcactgcccaggctgtattctcttttcgacgaacatggctactgttccagttaatcccaaacctttcttgaacaacttgactgggaagcctgtcattgtgaaactcaagtggggaatggagtacaaaggttaccttgtctctgttgattcatacatgaacttgcagttagccaactctgaagagtacattgatgggcagtttactggaaaccttggagagattctaatcagatgtaataatgttctgtatttacgaggtgtacctgaggatgaagaaatagaggaggcagatcgtgactagcaggtggatgttagatctatcggtttttatttttatttcttgtgttcttgtatggaaatacctgtagatgttatggtccaaatgacactcaattcaaaaagcctgaacttttaattggctacaacttcaattgggcagacgtgaatccattctagatcatcttgggtctgaatgtatcagacaatgttgtatggtagttgctgtttctttttcatttttggcaaaaatatgaatcgtggtgattgataggtatctcaagatccacgttgagccccctctgcttcttatgacatgataacaagtcgactttgtactaaagattgggaatgatggcaattagacaaaaatagcagtttgttatgccacctaaaagagggagaaaagaccggtcatagggtctcatcgtgtacctctaggtgaggggggaatgtaagctaaggctaggtg

SEQ ID NO: 1300 - DNA, 439 bp, Cirsium arvense
ttctccacgaacatggcgactgtaccagttaatcctaagccttttttgaacaatttgactgggaagcctgtcattgtgaagctcaagtggggaatggagtacaaaggttatcttgtctctgtggattcgtacatgaacttgcagttggcaaactctgaagaatacattgatgggcagtttactgggaaccttggagagattctaatcagatgtaataatgtgctgtatttacgaggtgtaccagaagatgaagaaatagaggaagcagatcgcgactagcgggcacattctgtaccttggatctattagttttatcttcaacctcttctgttcttgtatgactttgggaatacctgtagatgtaatgatccaaatgacaccgacctagaaatcctaaacttctgattttctgttagttcaattgggttgaagtggacta

SEQ ID NO: 1301 - DNA, 527 bp, Vigna unguiculata
gcagcttcacggtaccaagtttcagcgattacgatctcgtagagcataggataacattctactatggctactataccagttaatcccaagcctttcttgaataatttgaccggaaagccagtaattgtgaaactcaagtggggaatggagtacaaggggtatcttgtttctgttgattcgtatatgaacttgcagctggcaaacacggaggagtacattgagggtcagtttactggaaatttgggagaaattttaatcagatgtaacaatgttctctaccttcgaggtgtcccagaggatgaagaaatcgaagacgccgcagaagaatagattgatagaaattactaattgtgatgacaaacagaactaatattcgttacctgcttttgtatctacggtgtatgtttttgaatcaatgatgatgcctcgtgaatattggggtgcctttgtgcaagttgttagcaatccttctggtgattctatataaatctgttactgcaaaaaaaaaaaaaaagggcggccgcccc

SEQ ID NO: 1302 - DNA, 631 bp, Eschscholzia californica
attagatcgatagtctagtcttctcacgagaactataataaaaccctaaacctccacttcaccgttcttcatcttgtcgattttccctcttctcctcattcttgtgtgtgcttcgtgttgtttccgaacatcaatggcgagtgtaccagttaacccgaaaccttttctgaacaatcttacgggcaagcctgttatggtgaagttgaaatggggaatggagtacaaaggttatcttgtctcggtagattcatacatgaacttgcagcttgccaacaccgaagaatacattgatggacaatttaccgggaatcttggagagattctcataaggtgtaacaatgttctttatcttcgtggagtaccggaggatgaggaaattgaagatgctgataaagattaaaatggtgaagatgaagatcagcagacttttgttatcggaagcctcggcgttgttttcttctttgtccatcatcttgtgttgagtcgaaatttgattgctaatacattatatatgtaaccctttttaaacccttgtatagacaaggaaggatttacaagtcttatatctgactctcttgaaagtctaggaaggatgtaatagctaggattaacctaaagcaaactcattatt

SEQ ID NO: 1303 - DNA, 505 bp, Eschscholzia californica
gtgcttcgtgttgtttccgaacatcaatggcgagtgtaccagtcaacccgaagccttttctgaacaatcttacgggcaagcctgtcatggtgaagttgaaatggggaatggagtacaaaggttatcttgtctcggtagattcatacatgaacttgcagcttgccaacaccgaagaatacattgatggacaatttaccgggaatcttggagagattctgataaggtgtaacaatgttctttatcttcgtggagtaccggaggatgaggaaattgaagatgctgataaagattaaaatggtgaagatgaagatcagcagacttggaagccccagcgttgttctcttctttgtccatcatcttgtgttgagtccaaaatttgattgctaatacattatatatgtaaccctttttaaacccttgtatagacaaggaaggatttacaagtcttatctgactctcttgaaagtctaggatgtaatagctaggtttaacctaaagcaaactc

SEQ ID NO: 1304 - DNA, 505 bp, Gerbera hybrid cultivar
gaaacctttcaacgtgtaggacgctgcgatcagttgtgcccttttctacgaatatggccactgtaccagttaaccccaagcctttcttgaacaatttgaccggcaagcccgtcattgtgaaactcaagtggggaatggagtacaaaggctatcttgtctcagtggattcatacatgaacttgcagctggccaactctgaagaatacattgatgggcagtttactggaaatcttggagagatactaatcagatgtaataatgttctgtatttacgaggtgtaccagaggatgaagaaatagaggaagcagaccgtgactagccattagatcttatctaccggttttattttcaaccaattgtgttcttgtgtgattcttgaaatacatgtagatgtttatgatccgttcactagactatttttagttcgaatatatcagacaatgttgtattgtaattggagttaaatccaaatcgatcccctgtactaaaaaaaaaaaaaaaaaa

SEQ ID NO: 1305 - DNA, 358 bp, Lactuca sativa
ataatctgttgacggaacgtcaaaaccctaaacgttcatcgtcaaatcggctgtttgccttttctcgacgacaatggctactgtaccagttaatccgaaacctttcttgaacaacttgactgggaagcctgtgattgtgaagctcaagtggggaatggagtacaaaggttatcttgtctctgttgattcatacatgaacttgcagttggccaactctgaagaatacattgatgggcagtttactggtaaccttggagagattctaatcagatgtaataatgttctgtatttacgaggtgttccagaggatgaagaaatagaggaagcagatcgtgattagctagcaagcaggtggatt

SEQ ID NO: 1306 - DNA, 574 bp, Lotus japonicus
gccgtgaaagtgtgaaaccaaaccctatttcgttccgtgtcaagctgaagcagagagagcagaagaagagagtgtgtctccgcgcgtgcgttaatggcgactatacctgttaatccaaagccattcttgaacaatttgactgggaagccagttattgtcaaactcaagtggggaatggagtacaagggatatcttgtttcagttgactcctacatgaacttgcagctggccaacactgaagagtacattgagggtcagtttactggaaatttaggagagattttaatcagatgcaacaacgtcctctaccttcgtggagtaccagaggatgaagaaattgaagatgctccagaagactagaatgataaaacctgctattttttatgacataattaaaagttaaaactattttttctgtcattgtatcttcacttaaatgcaggtttgcattttgtagttatgtgtagagatatggatccatgatgcactcgaaaacagcgtgcctatctttagactgttcacatttcttgtggtgattatagggaaatctgacattgcttaatgctcttcatat

SEQ ID NO: 1307 - DNA, 660 bp, Lotus japonicus
gggggtcttcactaccacacaggcccattccgtattgggaacttctccttccctattcccttgtgtgaaaccctaatttcagtctcaagctcaagcagaagagattctctgcgcgttttgcgatttccaacccttctacaatggcgactataccagtcaatcccaagcctttcctgaacaatttgactgggaaaccagttattgtgaaacttaagtggggaatggagtacaagggatatcttgtttcagttgattcctatatgaacttgcagctggccaacactgaagagtacattgagggacagtttactggaaatttaggagaaatattaatcagatgcaacaatgtcctctaccttcgtggagtaccagaagatgaagaaattgaagatgctccagaagactagaatgataaaagcttctttgttatgacataattaaaacttaatttttttctgtcattgtaactttacttaaatgcagctttgcattttgtagttatgtgtagagatatggatccatgatgcactccaaacagcgttcccatctttagattgttcacatttcttggggtgattttagggaaatctgacgttgctttgatgctcttcttatatttggatagaactagatacaagcaggttggggcttggtacgttt

SEQ ID NO: 1308 - DNA, 590 bp, Cajanus cajan
cccgtggactttgggcaaaaccctaactacctctgtgactgtgagttagcttcaacaatttgttgcagagcataacattctaccatggctaccatacccgttaatcccaagcctttcttgaacaatttgactgggaagcctgtgattgtgaaacttaagtggggaatggagtacaagggttatctcgtttctgttgactcctatatgaacttgcagctggccaacactgaagagtacattgagggacagtttactggaaatttgggagagattttaatcagatgtaacaatgttctgtatctacgaggagtaccagaggatgaagaaatcgaagatgctgcagaagactagagagtgataaatgctgctaactgttatgacataaactgaactcaatttatttttcagtctttgtattttagtttagattgtagttatgtgtagagatttgaatcaatgatgcactcgcgtgtgaatagggtgcctatgttatagttcacattctttcatgtgcttctccttatatctcttaatgcattatggttttcaaatatttcaaatacgggtgagactgagattagcttttctag

SEQ ID NO: 1309 - DNA, 705 bp, Cajanus cajan
aggggtgtattaacaacataactaagcccattgggcttcgccaaaaaagcccgaacccatcccagttcctttcttcccctggccttgggcacaaaacaaaaccctaactaccgctgcgagctagcctcaacaatttcaggtttcaatcgcgatcttgcagagcactgcattctgccatggctaccataccagttaatcccaagcctttcttgaacaatttgactgggaagcctgtaattgtgaaacttaagtggggaatggagtacaagggttatcttgtttctgttgactcctatatgaacttgcagctggccaacactgaagagtacattgagggacagtttactggaaatttgggagagattttaatcagatgtaacaatgttctgtaccttcgaggagtaccggaggatgaagaaatcgaagatgctgcagaagactagggagtgataaatgctgctaattgttgagacattaactgaactcaatttattttttcactctttgtattttagtttagattgtagttatgtgtagagattcgaatcaatgatgcactcgcttgtgaatagggtgcctatgtaaatctcttgatgcattatggttttcaaatatttcaaatacttcaaatacgggtgagactgagattagcttttctagaaaatgcttgcggctcgatttgataattatggtttttcatttaat

SEQ ID NO: 1310 - DNA, 674 bp, Carthamus tinctorius
cgggggtcaaaccctaaccttcaccgcccagaaagctgtaatcggcggtctgctattctccacgaacatggcgactgtaccagttaatcccaaacctttcatgaacaatttgactgggaagcctgtcattgtgaaactcaagtggggaatggagtacaaaggttatcttgtctccgtcgattcatacatgaacttgcagttggcaaactctgaagaatacattgatgggcagtttactggaaaccttggagagattctaatcagatgtaataatgtcctgtatttacgaggtgtaccagaagatgaagaaatagaggaagcagagcgcgactagcgtgcacattctgtaccattggaatctattagttttatcttcaacctcttctgttcttgtatgactttgggaatacctgtagatgtaatgatccaaatgacactgacctctgattttctgttagtccaattgggttgaagtggactatattcagtttggatatatcaaacaatgttggatggtaaaaaaaacacaaaaaaaaatcacgataatttcccagcactattgaataaagaaatctctgttacttatacttctcccctcatctataaccatattttctgcggatcgcttttgggattgactcgactgtttcacttgaaagggtgccgccgcccct

SEQ ID NO: 1311 - DNA, 497 bp, Scabiosa columbaria
tttaaatccgttgctctaataagaaaaagaagcagcccctgtttctcgtttcattttcgtcggccgccgtcacgatcctcactcatcatctccgggtaattgaaactgcaagcagtgcaaggcactaataaccttgaacctcttcgttttcatctccatggcgactgtacctgtaaatccgaaaccgttcttgaacaacttgactgggaagcctgttattgtgaaactcaaatggggaatggaatacaaaggttatcttgtttctgtggattcgtacatgaacttgcagctggcgaattctgaagaatacattgatggacaattcactggcaatctcggagaaattctgattaggtgtaacaatgttctgtatcttcgaggtgtaccagaggatgaagagatagaggaagctgatcgcgattaatatgaatatagcaagtgagcaagtatgttttgtaaccaatcaacttaaagcgggctgacttacttatttgctc

SEQ ID NO: 1312 - DNA, 530 bp, Glycine max
aagttccaggtttcagcgagcattctacaatggctactataccagttaatcccaagcctttcttgaacaatttgactgggaagcctgtaattgtgaaactgaagtggggaatggagtacaagggctatctcgtttccgttgattcctatatgaacttgcagctggccaacaccgaggagtacattgagggacaatttactggaaatttgggagagattttaatcagatgtaacaatgttctctaccttcgaggagtaccggaggatgaggaaatcgaagatgctgctgaagactagagagtgatagaagctgctaatggctatgacataaacagaactcgaatttctactgtttttgtatcttcacataaatgtaggttttttgtagtcaatgtgtagagatttgaatcaatgatgcactcgcttgtgaatagggtgcctatgttcaagttgtctgttattttatttttatgcttctgaacaggttatttttcagtttatgcaatcaacagtaatcaatatcatttaaac

SEQ ID NO: 1313 - DNA, 636 bp, Amorphophallus konjac
gaccctccctgcgcgcgggccgcctccacgccccgacggtcgttggctgcccctctccatggcgactattccagttaatccaaaacccttcttaaacaatttgactggcaaacgtgtgattgtgaagctaaagtgggggatggaatacaaaggttttcttgtatcagttgattcatacatgaatctgcagttggcaaataccgaggaatacatcgagggacagtttacaggaaacttgggggaaattctgattaggtgtaacaatgttctgtatctccggggtgtaccagaggatgaagacattgaagatgctgaatgaaagtcgagtggcgacgatgctactatggcctcgggagttcaagctcttgacggagtagcactcctcgagagggtttgtaactgatgattttgggatatgaagtatctcgttttggaccatgttgtaaaactctcaatgttggtagcttgaatgttcatctcaggttgtttgatgaagaggattttatatttgtgtaatgttgttacttgaagctgtattgcgacacgtggaaaggtgtctaggttttgtcatgggatttttgcatgcaaattattgttagagatgaatctataaaaaatatttttgaaaatatatta

SEQ ID NO: 1314 - DNA, 602 bp, Allium cepa
ttgcaaggtcgcacttcaatttttggttcaaatattcacccaattgtatactaggcggcgctatcagttttcctcttaatggcggctatacctgttaacccaaaacctttcctgaataatttgactgggaagcctgtgattgcaaaactgaagtggggaatggaatacaaaggctttcttgtctcagtggattcttatatgaatttgcagcttgccaacactgaggaatacattgatgggcagttcacaggaaatcttggggagattctgattagatgcaacaacgtattgtacctccgaggagtgccagaggatgaagaaattgaagatgctgattaagatgtaagagcttcaattgttattttatttccgactaggaactcctattgtatgcgtagaggtttgatcagactgtttagtgatctgtttcagcacgaattcataccgactttggttgccggctgttcttatttaaggcttttgagaaagatatggccttcttatgccgtttgttttgaattaattgagttcacatagtgctttatgcaatgtaatcagaatcagattatgtgatacagtgactatcaacgtcataactccca

SEQ ID NO: 1315 - DNA, 724 bp, Allium cepa
acaatggcggctatacctgttaacccgaaacctttcttgaataacttaactggaaagcctgtgattgcaaagcttaaatggggaatggaatacaaaggttttcttgtctctgtggattcctatatgaatttgcagcttgccaacactgaggaatacattgatgggcagttcacaggaaatctgggggaaattctgatcagatgcaacaatgttctatatcttagaggagtacccgaggatgaagaaatagaagatgcagattaagatacaaccatgttttccctttccatattgtctcagaaaacatgtcctattgtagggctattatattgccattgagctgagattctttgcttctgatttccaatggaccgagtttttgtcttatctttagcgactagagtttttagaaaaaagatgaccatctgtaggctctgaaaaatgttatcagtaaaggtctttatgaccatctataatccttctgggtaaccttttttattattgctgtaaataccatatttgaaaaaagcatcccaagtaggggtattatttgagtatctataccagtaggggtagccatttgggatatcaacatccaaatttcagctacattagttgatcgtctatcaggtaacgagatttatcggatctttggtcaaatgatatattaatttggatcgtgtttgtttaatcagttgattgttgattgtatagttaaattaag

SEQ ID NO: 1316 - DNA, 693 bp, Allium cepa
gcctagttacgggggactggcatcataagagaatacaaattgcaggtttaagaaaatagaattatagttctgcaaggtcgcacttcaatttttggttcaaatattcacccaattttatactaggcggcgctatcagttttcctcttaatggcggctatacctgttaatccaaaacctttcctgaataatttgaccgggaagcctgtgattgcaaaactgaagtggggaatggaatacaaaggctttcttgtctcagtagattcttatatgaacttgcagcttgccaacactgaggaatacattgatgggcaattcacaggaaatcttggggagattcttattagatgcaacaatgttttgtacctccgaggcgttccggaggatgaagaaattgaagatgctgattaagacacaagagcttcaattgttatttaatgtccagccaggaacttttattgtaggcgtagtggtttgctcagactgtttagtgatgtgtatcaaactttcagcactgattcataatggctctggttgtcggctgttcttatttacagtttttgagaatgtagtggccttcttatgctgtttgttttgaattggttgaggtcccaagtgctgtattgctatttaatcagaatcaaattatgtgatattgttaccatttacatttggaaggaagaggttttaatctac

SEQ ID NO: 1317 - DNA, 524 bp, Allium cepa
caatcaacagccagtttccgtaactgggtttgctctgattatttttcccaaatttgaacttcattgttgcggcgatctcagtcgattcctacaatggcggctatacctgttaacccaaaacccttcctgaataacttaactggaaagcctgtgattgcgaaacttaagtggggaatggaatacaaaggttttcttgtctcggtggattcctatatgaatttacagctcgccaacactgaggaatacattgatgggcagttcacaggaaatcttggggagattctgattagatgcaacaacgtattgtacctccgaggagtgccagaggatgaagaaattgaagatgctgattaagatgtaagagcttcaattgttattttatttccgactaggaactcctattgtatgcgtagaggtttgatcagactgtttagtgatctgtttcagcacgaattcataccgactttggttgccggctgttcttatttaaggcttttgagaaagatatggccttcttatgccgt

SEQ ID NO: 1318 - DNA, 599 bp, Cyamopsis tetragonoloba
tttcgtttctcgctccagcagtctgcattcttcaatggcaactataccagttaatccgaagcctttcttgaacaatttgaccgggaagcctgttattgtaaaacttaagtggggaatggagtacaagggttttcttgtttcagttgattcctatatgaacttgcagctggccaacactgaagagtacattgagggacaattcactgggaatttgggagagattttaatcagatgtaacaatgttctctaccttcgcggtgtaccggaggatgaagatatcgaagatgctgccgaagacagaatgataaaagctccatttatcaccagttctgcaccttcacttaaatgtagtttttccccataggtatgtgtactgtgtagagatttggatcagtgatgcctcacttgcaaatagtgcttatgttgttcttatacgtttggaatggttgggaacggtttggtgaatctgattatgaactcgttgtaaacaagctttgcattgcaggaatcacatttggtgcatgaaactggctattgtaattgctgccaagtttttttgttttcaactcctgatacttgattattcatgcttatacttg

SEQ ID NO: 1319 - DNA, 1464 bp, Distylium racemosum
tgctactagatcattagatttctactcattctgtaattagaacttacattgtatgaatattaaaaggtttaaatttttgaagatcagggtgatgttatattacagaactataacagaattaaatatcacaaaaacacgttgttatatcctggcagcattccagaacttgtatcttatctcacctcaaactgctaatcaaaaatttgatgagatcacaacgaaatctaaaatttagagaaactaagttaaaaactgctatcctcttctgacatcctaataattggaaatccacacccaaacagttgggaagcagataaatttaaaactctctcagatcacctttcagaactacattcaatgtttgagattcctgccttaggcatcttcaatatcctcgtcttcaggcacaccacgtaaatataagacattgttgcaccttattaaaacttctccaaggttgccagtgaactgcccatcaataaactcttcagtgctggccaactgtagattcatataagaatcaactgataccaaataacctttgtactccatgccccattttaatttcacaataacaggcttcccggttagattgtttagaaatggtttggggttcactggtacagtcgccatgatctacccaagtctttgaaccttcgccttcaaccggttaagtggaaggaaccaaataccgcagcacaatttggtgttgcagtgaatgaaagcactttcttggaccggtgacttcgcagaagacttctcctgcagccaaccgctctaatgcggtcgaacaggtgtcatattgcacgaataagtctaaatctaaatccaaagcgcagtgcagtgcacacagaggaaaaccttctgctgtgggaaatcgctgggtgtcgatcggtcgagggatctcggagcatcaattcttcaattctctgaagtcatggattcaaacaagggacagggtggaattcagttattgctgtctgcagagcaggaagctcagcacattatttcttctgctagatccgcaaaaacggctagattgaaacaggccaaagaggaagctgataaagaaattgctgcttatcgggcacagagggaaagagaatttcggaagaaggttgcagagacaagtggcgattctggatccaatgttaagcgtcttgaggaggaaacacaaatcaaaattgatgatttgcaaaatgaagcagcgaaagtttctcctgaggttgttgacatgcttatgaagtatgttaccactgtgagaaattgatgcacatggatctggttgttctggcaatattcatctgttatcttgttaatcaaatttaattctggggttcctgtacctttaggttaaattctcatgttgtgcctcattgtgaggctatcaaaagattgcagttttcaaagatagttacgctaatatgtttgaaagtcgagcaatacagactactctgtgtacct

SEQ ID NO: 1320 - DNA, 552 bp, Conyza canadensis
cctttctattttagtttgactccctcaagtcaaaaaccctaaacccctgttcgttcgcaaatcgaatatggccacagtaccggttaacccgaagcctttcttgaacaatctgaccggaaagcccgtcattgtgaaacttaaatggggaatggaatataaaggttttcttgtctctgttgattcttacatgaacttgcagttggcaaactctgaagaatacattgacggcgtgttgtctggtaacctcggagagattttaatcagatgtaataacgttctctatctacgaggtgtaccagaggatgaagaaattgaggatgcggaccatgactagcaagtccatgctcttgctatattaggtctatcggtgttattttcacgtcctttgtttctgtatggaagtactgaagtacctgtagatgttatgatccaagtgacactcaatctagaatgctaaagtcttttattggctgcaagttcagttgggtggatgtcaattcatttagacttatatttgatccgagtgtatcagataatgttgtactggagttt

SEQ ID NO: 1321 - DNA, 599 bp, Conyza canadensis
ccgtcaaaaaccctaaacccctgttcgttcaggaagctgcaaatcgaatatggccactgtaccggttaacccaaaacctttcctgaacaatctgaccggaaaacccgtcattgtgaaacttaaatggggaatggagtataaaggttatcttgtctctgttgattcatacatgaacttgcagttggcaaactctgaagaatacattgacggagagttgtctggtaaccttggagagattctaatcagatgtaataatgttctctatctacgaggtgtaccagaggatgaagaaatagaggaggcgggccatgactagcaagtccatgctcttgctattttcacgtccttcgtttctgtatggaagtacctgtagatgttatgatcctagtgacactcgatctagaatgctagaacctttgattggctgcaagttcagttgggtggatgtgaattcattttagacttatatttgatcctagtgtatcagataatgttgtattgaagttctttctcttttatgtagccaaaatgtttgaatcgtgtttagtaagattatacattgaaggtcacaattgcatggaaggcaagctgttttttct

SEQ ID NO: 1322 - DNA, 1066 bp, Aristolochia fimbriata
gtctcgtgtcgattccacccctgcagctccttctcacttacgaaactaaacccggaaacttaaagaccaggcttgaagagagagaaactgatagcagcagacgaaaaagtatctggcgctgcaatggcgacacctgttaacccaaaaccttttctgaacaatcttacgggggagcctgttattgtgaaactcaagtggggaatggagtacaaaggatatctagtgtcagtggattcatacatgaacttgcagttggccaacactgaagagtacgttgatgggcaattcactggaaaccttggagagattttgataagatgcaacaacgttctttaccttagaggtgtgcaggaggatgaagaaattgaggatgcggagaaagactgagaaagcagccagctgcggtagcttactcattgaatctggttttgctgttgccccatcctgatttgtggctgtactaatattctgctttcttgtgaaggatataccatggtagacgtacgtttgtagttagtgaaagaagaaaagaaaaatcccaagggtattttactatttagtgatccggagatgtgttaggaccctaaacgtttagattaaatcagttttagtctccttttaaatctgtatgtagctgcaatgttctattcaaagtaagaaatttgacttggttcggcgtaaaaaggttctagagatcaaaatgaaatatagaccaacgttcatgagctgaaatgaacccaactcgaaccgtctctagaagcacatagaaaagttccctcaattgtcatgaaagcgtatatgtttctgtcaatcagcgataaatattgttctgcagaaagcatatgtatgcttttatcttgcaagagctcggtttcaatcttcatgtaattttttttcttcttcttttcattctatcttcatctagttccttcattttgttggacactgtttcatgctgctggtttcttttgcttcagaaagctattttcttctctttgaagttacaatctatgtttgagctggctcaaagacatcatcgcctggcaagaccaagtctgaacttgag

SEQ ID NO: 1323 - DNA, 427 bp, Chelidonium majus
gtagctcctgtttataccagacaccaatggcgagtgtgcctgttaatccaaaaccttttctgaacaatcttactggcaagcctgtcatggtgaagctcaaatggggaatggagtacaaaggttatcttgtttcagttgattcatacatgaatttacagcttgccaacactgaagaattcattgacgggcaattcactggaaatcttggagaaatcctcatcaggtgtaataatgttctttatcttcgtggtgtaccggaggatgaggaaattgaagatgctgataaagactagataaatgccgatcatcattctgaaccgaaaaaaacgaaatgttaatgatatcacaattgtctgcagcaatcggggtgacctctttttctgaactacttgtacttaatttgataatagttatgtacctcttaaag

SEQ ID NO: 1324 - DNA, 730 bp, Cicer arietinum
gcgggctattgggctacccgaaaataataaaagcccatcacaatttcatcggcaacaaaaccctaatttttccactttcaatccgagacagagagaagaaatccttcaccatttcagcgtctccgttctacaatggccactatacctgttaatcccaaaccctttttgaacaatttgactgggaagcctgttattgtgaaactaaaatggggaatggagtacaaaggttatcttgtatcagttgattcgtatatgaacttgcagctggccaacactgaagagtacattgagggatcatttactggaaatttaggagagattttgatcagatgcaacaatgttctctaccttcgtggtgtaccagaagatgaagaaattgaagatgctgcagaagactagaatgaaaaaaatcagctaactgttatgggcataaatagaactcaatttgtttttactgttattgtatcttcacctaaaagcaggcgtttatctttgtgtagttatgtgtagagatttgaatcaatgattcccttgatgttggcgtgattcaacggaaatctgatgttgtttagactctttttgaagtaacatatagttttatgtggattttaaagaattaatatacaaaaatgtcagtttttttttttttactttcaagaggttgcaagtgaaggatgcaaccatgtaaaagatgattttttttaaatgattttttttcttcctattttat

SEQ ID NO: 1325 - DNA, 563 bp, Vigna unguiculata
ctcgcagaacatagcaaacattctactatggctactataccagttaatcccaagcctttcttgaataatttgaccgggaaaccagtaattgtgaaactcaagtggggaatggagtacaaggggtatctcgtttctgttgattcgtatatgaacttgcagctggcaaacactgaggagtacattgagggacagtttactggaaatttgggagaaattttaatcagatgtaacaatgttctctaccttcgaggagtcccagaggatgaagaaatcgaagaagccgcagaagactagattgatcgaaattactaattgtgatgacaaacaaaactaacattcgttactacctgctttggtatctttggtgtatgtttttgtagttatgtttttgaatcaatgatgacaccctcgtgaatattggggtgcctatgtgaaagttgttagcaatccttcatgtgatttttctacataaatctgtttctgcaccatgtttttcatactacttgaatacgagttaaggactggacttggattttatagaatcatgcagcccaatatcgagg

SEQ ID NO: 1326 - DNA, 475 bp, Taraxacum officinale
gcgggggtctcagagaaaaccctaaacctccaccgtcgagaatcgtaatcggttgtctgctatttcgacgatcatggctactgtaccagttaatcccaaacctttcttgaacaacttgactggaaagcctgtgtttgtgaaactcaagtggggaatggagtacaaaggttatcttgtctctgtcgattcatacatgaacttgcagttggccaactctgaagaatacattgatgggcagtttactggaaaccttggagagattcttatcagatgtaataatgttctctatttaagaggtgtacctgaggatgaagaaatagaggaggcggatcgtgactagcaacatttatctgtttttatttaaatttattatgtttttgcatggacttgaaaatactttgtagatgttatggttcaaatgacacttgaaatagcacgcctgaacgttctaattggctacaagtttttatttacc

SEQ ID NO: 1327 - DNA, 536 bp, Flaveria ramosissima
gatcgtcaaaaaccctaaaccttctcagtagaagaagctgcaatcgccatttgttaatctctacgaatatggccacggtaccggttaaccccaaaccttttttgaacaacttgactgggaaggctgtaattgtgaaactcaagtggggaatggagtacaaaggttatcttgtctctgttgactcttacatgaacttgcagttgtcaaactctgaagaatacattgatggtcagtttactggtaaccttggagagattctaatcagatgtaacaatgttctgtatttacgaggtgtaccggaggatgaagaaatagaggatgctgatcgtgattagcaatcttgctgttagatccatgagtttcattttcaatatctttcagtcttgtatgaaaatacttgtagatgttaagatcctactgacaccaatttagaaagcctgaacttttaattagcacaagttcaagtggctggatgtgcatttattctagacttcttttagtttgaatgtatcagacaaggttgaatggtaattgtc

SEQ ID NO: 1328 - DNA, 513 bp, Flaveria ramosissima
tcgtcaaaaaccctaacccttctcaggctaacaagctgcaatcgctatctgctcatctctacgaatatggccacggtaccagttaaccccaaacctttcttgaacaacttgactgggaaggctgtgattgtgaaactcaagtggggaatggagtacaaaggttatcttgtctctgttgactcatacatgaacttgcagttgtcaaactctgaagaatacattgatggtcagtttactggtaaccttggagagattctaatcagatgcaacaatgttctgtatttacgaggtgtaccggaggatgaagaaatagaggatgctgatcgtgattagcaatcgtgcatttagatccatgagtttcaatttcaacagctttcagtcttgtatgaaaatacttgtagatgttaagatcctaatgacaccaatttagaaagcctgaacttttaattagcacaagttcaagtggctggatgtgcatttattctagacttctattggtatgaatgtaatatt

SEQ ID NO: 1329 - DNA, 889 bp, Vitis vinifera
tcgactcactacttgtctctctcgtcttccatggctaccgtaccactgaaccctaagcccttcttgaataacttgactgggaagcctgtcattgtcaaactcaagtggggaatggagtacaaaggttatcttgtatcagtggattcatacatgaacttgcagctggccaacagtgaagaatacattgatggacagttcactggaaaccttggagagattttgatcagatgtaacaatgttctctatcttcgtggggtaccggaggatgaagaaatagaagaagctgaccgagactaggatggatatcagcaatggtttagtgtaatcataacatccttaaaaaaaaaactgttatcgttttttacttgtttgtcatcaacctaaagcagcaatacattgtatttctctcttagcattgtttatgggttgtctgattcttagactgcctatgtttggacagaaagcagcactaaggcatggatctgtgaagtatctcctgtcttacacttctccaggctgatgatatgtgaaaccgagtcaattggtttgggaaatgatctgggttctctggatttggtaagtagcatgtctcagtggaaatgccaggaaaaaaaattaccatttaaattgtaatttcatcaataaatggagtataagacctgtgtacttgttgcatgttttgttgagctcttataatgtatttttgcttgcctatcaaaagaaatagaatatcagtaaatgggggatctgatccatttaccacagaggccacctgggaatatgggtacctctaccttcaaggatcactattgggtagctccttttagttctctaaagccaatcagttttggagaccattaagtctgtgcttgcacctattgatgcccag

SEQ ID NO: 1330 - DNA, 1797 bp, Lupinus angustifolius
atgggcctattacgcaggtcattgggtgggcctttgggcctgtatcgttacccttaggcatgaaaccctaatttccacgtcaagctcacgcagcgtgactccatcatcatcggtgttgcgtttcatcgttttttcttcacaatattcagcaatggctactatacctgtaaatcccaaacctttcttgaacaatttgactgggaaacatgttattgtcaaactaaagtggggaatggagtacaagggttatcttgtttcagttgattcctacatgaacttgcagctggccaacactgaagagtacattgagggtcagttcactggaaatttaggagagattttaatcagatgtaacaatgttctctacctccggggagtaccagaggatgaagaaattgaagatgctccagaagattagaatgataaacttgctaatcgctgacataaacagaaccccattatttactgattttgtatgtcactttatatgtagagtttggtcatttggatcaatgttttattgctgatatggtgcctatgttcaaagcgttcacatttcttatgatgatattgtgtaaatctaatgttgcttaatgtcctttaatgtctcaaatagagtatcaatgagacgagcagcttttgaacctgtttaaattaccaactcctaaagttagaaatttgagttgattttcacgagcgtaacaattctatacgataatccagttgccattcaaagatgtgttcacattaacaactccgaacacttgaatacggtcatattatgatggcaaaagagattgtatgtttcaagatgaggttttaattgaaacagtgacttgtataagcttgttatttaagaatttgacagggaggaattaacttttctacaaatgagtgtcctattctgttagaacatgtagtacctagatgttcctattttacgtatcattaatggcaatgttttgttctacacatattgtcaaatgccaagcatgatacgtatgtcttgtttaataccagccaccaaatgtataggaatgcaggacgtaactactataatattccgtttctttatcttcttcatatacaataatggggtcttgttggtcaattttcttactactgtgatataacattagttaaaatatatatatagaacatctcttattttagctctccacgaatctctgttattcatatgcatcaacatcattcgccccttcacggcagaggtgagtgaaagggaaggtagcgtgatatttttgatgagggtcggtgagtgtaattccttaaaataaaattgatattttggtttcaattttatttgtaataaaattattttattatctgcatttattgtggaaataatagtataaaaattatttccacattaacctttgattatcattagctttaattataagtaatatattagtgaataataaatgatatattgattgtgtataaatttttatacagataatatatatattattataacccccccccccccccccccccccccccaattactcaattaagaaatcgaaaaaaataaatataatatttatttctgaaaactatattaattttaaatagtttatacacagatactagttacaaagacaggcgcaacgttttgatgagtaactccataaatttctcaaacagagaatagaggcccacatttatttgtgtggtgtaaactctctggcgtgttcactaaagtggtgcattattaatttcaataatgttggttgcagagcttgatggattcaatatagaatctctagtagc

SEQ ID NO: 1331 - DNA, 877 bp, Lupinus angustifolius
cattgggatgaatccctagtttccacttcaaactcacgcgttgcgtttcatcgttcccccttctacagtattcaacaatggctactataccagtaaatccgaagcctttcctgaacaatttgactgggaagcatgttattgttaaactaaagtggggaatggagtataagggttatcttgtttcagttgattcctacatgaatttgcagctggctaacactgaagagtacattgagggacaatttactggtaatttgggagagattttaatcagatgtaataatgttctctaccttaggggggtaccagaggatgaagaaattgaagatgctccagaagattagaatgattaagctgctaatttccatgacataaacagaactccattatttactgtttttttgtcttctttttgcatttatgtgtagagatttggatcaatgttgcactcacttgcaaatagggtgcctaagttcaagttgttcacatcccttcaggtgttattgttgcgtaaatctgatgccttttaatgtctcaaatagagtagcaatgtgccccgcagcttgtgaaccttctcaaattaacaactcagttggaaatttgagttgtttttttcaggtgactaacaattttataggataatccagtatggcacctcaattcattatattcagtgaatgtatcattcatggatgtgcatagcctcttgggagaaaaactttttacacctgttcacccaaagagtgtaatatatatgcactgatacacagtcagtgtatcatctactatttatttgtattacttttcttgtaagtcaatggtcaatgaaaatgaatgatggatgttataatgatagtgtaaaaaatttacattgtaa

SEQ ID NO: 1332 - DNA, 370 bp, Lupinus angustifolius
gcttcaagctcattcctccttgttcttcgtttcatcgattttcccttttacaatggctactataccagtaaatcccaaacctttcttgaacaatttgactgggaagcatgttattgttaaactaaagtggggaatggaatacaagggttatcttgtttcagttgattcatacatgaacttgcagctggccaacactgaagagtacattgagggacagttcactggaaatttaggagaaattttaatcagatgtaacaatgttctctaccttcggggagtaccagaggatgaagaaattgaagatgctccagaagattagaatgataaagctgctaattgctattacataaaacataaccccattgtttaa

SEQ ID NO: 1333 - DNA, 848 bp, Arachis hypogaea
ccccctataccccctgtgtgcctttggcagtctcagaagcagtggtatcaacgcagagtacgggggattaaaccctaacttcagctgccgttgccaccatcgtcagccattgttgccgcgtttcaggttttgcgatctcctcctccaatggcgactataccagtgaatccgaagcctttcttgaacaatttgactggaaaaccagttattgttaaattgaagtggggaatggaatacaaaggttatcttgtttcagttgattcctatatgaatttgcagcttgccaacactgaagaatacattgagggacaatttaccggaaacttgggagaaattttaatcagatgtaacaatgttctctaccttcgtggtgtgcctgaggatgaggaaattgatgatgctgcagaagactagaatgataaaattatctcattgttataacataattagagacctcttaaattcaggttgtgtatttatgtgtagagatttggatcaatataggttgcctatgttctgcttgtttagacctcttgatttctactgttttgaatttgatttttcctagttttaaaaagttgaagtagtggtctgatctggtctggtgctgctatgctttcttcttgaatgttgctgcatagttggatagtcgtgttctctattggaaagtgaggtctttcttataaatgttcaggcttgtatattgggttaaagttttgtgtgatgataagtgataacccatattccattgacaatttggtatataaccttgctgttagaggttttggaaaggtaaattctagaactgatattgatttcaaaaaaaaaaaaaaaaaaacaaaagtact

SEQ ID NO: 1334 - DNA, 522 bp, Rosa hybrid cultivar
aggtttttctcttcgaacctcgaaagcgcccctcatcttttctgctcagctccaccgaagcactctctctctcccctctttctctcgccaatggctacaataccagttaacccgaagcctttcttgaacaatctcactgggaagaccgtgttcgtgaagcttaaatggggaatggaatacaaaggtttccttgtctctgtggattcctatatgaatttgcagttggcgaacactgaagaatatattgatggacaatttactggaaatcttggggagattttgatcaggtgcaacaatgttctctatcttcgtggggtgcctgaggatgaagaaattgaagatgctgaacaagactgagatgttaactttgtaggagtggctttggttctaaaaacagaaactcagtaaaaatcagtattttgtatctttattatctgtagtgtatttgaaggttctatctgatgtttgattgacaggcctgtgacaagtttgatgctctacaagattctctattttccgaaa

SEQ ID NO: 1335 - DNA, 616 bp, Fragaria vesca
acaagacccaagtctctcccctttaggttttctcagaacccaccaaagcgcacctcatcttttctgctcagctctaccgaagctctctctctctctctctctctctctctctcgccaatggctacaattcctgtcaacccgaaaccttttttgaacaatctcactgggaagaccgtgtttgtcaagctcaaatggggaatggaatacaaaggtttccttgtctctgtggattcctacatgaatttgcagttggccaacactgaagaatatattgatggacaatttactggaaatcttggggagattttgatcaggtgcaacaatgttctctatcttcgtggggtgcctgaggatgaagaaattgaagatgctgaacaagactgagatgttagctttgtagaagtggcgttggttctgaaaacagaaactcagtaaaaatcagtatttgtatctttattatctgtagtgtattcgaaggttctatataatgtttaattgacattgctgctgaaagcctctaattgacaaatgactcaagtttgatgctctacaagattctctatttttctaatctttttaattaagagcatgatttacttgctctattttggagatg

SEQ ID NO: 1336 - DNA, 595 bp, Helianthus annuus
caacgcagagtgcggggggcttcttgtgtcgacagtacctcctcaaaaccctaaaccttctcagtcgacgaagctgcaatcgctctctgttctcctctacgaacatggctacggtaccagttaacccaaaacctttcttgaacaacttgactgggaaggctgtgattgtgaaactcaagtggggaatggagtacaaaggctatcttgtctctgttgactcatacatgaacttgcagctgtcaaactctgaagaatacattgatggtcagttcactggaaaccttggagagattctgatcagatgtaacaatgttctctatttacgaggtgtaccagaggatgaagagatagaggatgcagatcgtgattagcattcgcgcatttagttctatccgttttacattcaacgtcttatgtttttgtatgtagttgttaagatccaaaatgacactcaatttagaaagcctgaacttttgattggtgcaagtttaattgggtggatgtgcattttttctgacttctgttggtatgaatgtagcagacaatgttgaatgttagtttctttttctttttctctattgataaaacttaaatc

SEQ ID NO: 1337 - DNA, 563 bp, Abies balsamea
aaagacattcacccgtcttcctcaactataggcacatccttattctctgtttttcaggtacagatcaactattcgataaaagggacctttgacaaattgttggggtgcagcattgctcttttcagtttggaatctttggtgggttgctatcggtgttggctgtggcgtttgctacactgtggccgagcggtggaaggagaagactcgaatagttcatggcgactgtaccagtgaacccaaaaccttttctaaacaatctaactgggaagccagttattgtgaaacttaaatggggcatggaatacaaaggttacttggtttctgtcgactcctatatgaatctacagttggcgagtactgaagagtatattgatgggcagttcacaggcaaccttggagaagttttgatcaggtgcaataatgtactatatttgcgtggtgtgccagaggatgaagatattgagaatgaatgaaatttgatgtcttgttttacataattttgtattaaacttgtccctaattgctcaggcatagacaccctgtcattgacatgtgtaatgata

SEQ ID NO: 1338 - DNA, 587 bp, Artemisia annua
cccagaagctgcaatctttgtctactcactatggccactgtacctgttaacccgaagccgttcttgaataatttgactgggaagcctgtcatcgtgaagctcaagtggggaatggagtacaaaggctatcttgtctctgttgattcgtatatgaatctgcagttggcaaatagcgaagaatacgttgatgggcagtttactgggagcctcggagagattctgataaggtgtaataatgttctctatatgcgaggtgtacccgaggacgaagaaattgaggaggcagattgagactagatggtggacactcttgccattagatctatcggtttatttttaccaatttgttcttgtatgaagtacctgtagatgttatgatccaaacgaaactcaatttagaaaatcagaacatttgattggccgtaagtttaactaggtggatgtggatctcttctatctttagtctgagtatatcagacaatgttgtatggtacttgctgtttcttttccaatgttatggcaaaatattgaaatctgttggttgaaaaaaaaaaaaaaacaatgtcggatctagaattagagacacg

SEQ ID NO: 1339 - DNA, 645 bp, Cedrus atlantica
atccatattttctgtttttcaattacagatagacaatttgataagaaggattttgacaaattgtgggggtgcagcatttctcttttaggtgggttgcaagcagtgttggctttggtatctgctattctgtggcggagcggtggaagtagaaaactcgaatagatcatggcgactgtaccagtgaacccaaaaccttttctaaacaatctcactgggaagccggttattgtgaaactcaaatggggcatggaatacaaaggttatttggtttctgttgactcttatatgaatctacagttggcgagcactgaagagtatattgatgggcagttcacaggcaaccttggagaagttttgatcaggtgcaataatgtactgtatttgcgtggtgtgccggaggatgaagatattgaggaatgaatgaaatttgatgtcttgttttacagaattttgtgtttaactttgtccgaaattgctcaggcatggacactatcatagagatgtggaatgatagtgccaaacttcaactgagagcttttccttcatagtgtatttgacctagctgtattttggttatacttatcctcaattgtatgtcttgtcaggaatttaagctgagatactacttattagattagaatgctt

SEQ ID NO: 1340 - DNA, 667 bp, Gnetum gnemon
ccaagccgcagtcggtgggacttcgcagcaatatcacgacgactgcacgatctgtgttgtggtagacggtgtcttcttgcaagtgttcgccgttcactttgcaacagtttagaaaggtagccgtggattgccacttagaccagaactcggattcaagacgtctagcctatattattcagcatggccactgtacctgttaacccaaaaccttttttgaacaatcttactgggaagcctgttattgtgaaactcaaatggggtatggaatataaaggttacttggtctctgtagactcgtacatgaatttgcagttggcaagcactgaagagtatattgatggacaattttctggaaaccttggcgaagtgttaatcaggtgcaacaatgttttataccttcgaggtgtacctgaggatgatgatgtagaggaatgaaataatcacgaccgctgacactgcagacactgacatagtctttgttctagtttgttagaaaatggttgcgatggtattggaaaattttgattctagaagctaggatgcaatatatgttaagatgattttgttgggagatggcagaagctgaatattttagcaatttttgttcaatttgggaactgcagacatatgaatgaattatcagtcatcgcccttgcaatacgaaatg

SEQ ID NO: 1341 - DNA, 909 bp, Pinus pinaster
cgattggatttgtccacaagtatttctctcgcaatagaataattgcgtgcataactcgcgcgcttccacagttgccttcgaaatgccctgtcactaatgtccctccaactttaaaccctactcaaaatacttcattccagggatccaaagaaatcttgcttcaccaccaacgctatttgggaaaccctacttttgcgtcctccacggagttttggaaatttgaaagtgaaatccattccagttttgcacgctgctaccctgcaaaggcgtgtacaatcctccattcaaaggcattcagtcagtgtacaatccttcattcgaaggcattcaatcatctttgttgttcagtgttggctgtagcgtttgctactttgtaggccagcggcggaagtggaagccttaaatagatcatggcgactgtaccagtgaatccaaaaccttttctaaacaatctaactgggaagccagttattgtgaaactcaaatggggcatggaatacaaaggttatttggtttctgttgactcgtatatgaacctacagttggcaagcactgaagagtatattgatgggcagttcactggcaacctaggagaagttttgataaggtgcaataatgtactatatttgcgtggtgtcccagaggatgaagatattgaggaatgaatttgcaaatttttgttagacaaatttttgtattaaacttattcctaattgcttaggaatggtcactctattatagagtgtgaaatgatagtgccaaacttcaacttacagcttttatttcttgatttagttgtcatagctgtaattttgattctaattttcctcagtagaatgttttgtgggaattttatttgagatactactactttcaaggttagaatgcttaaaacgtagctgactttac

SEQ ID NO: 1342 - DNA, 951 bp, Pinus taeda
ctctcgcaatagaataattgcgtgcataactcgcgcgcttccaccgttgccttcgaaatgccctgtcactaatgtccctccaactttaaactctatccaaaatacttcattctaggggtccaaagaaatctttcttcaccatcgaacgctatttgggaaaccctacttttgcgtcctccacggggttttggaaatgtgaaagtgaaatccattccagttagcacgctgctaccctgcaaaggagtgtacagtcctccattcaaaggcattcagccggtgtacaatcctccattcgaaggcattcaatcatctttgttgttcagtgttggctgtggcgtttgctactttgtaggccagcggcggaagtggaagccttaaatagatcatggcgactgtaccagtgaatccaaaaccttttctaaacaatctaactgggaagccagttattgtgaaactcaaatggggcatggaatacaaaggttatttggtttctgttgactcttatatgaacctacagttggcgagcactgaagagtatattgatgggcagttcactggcaacctaggagaagttttgatcaggtgcaataatgtactatatttgcgtggtgtcccagaggatgaagatattgaggaatgaatatgcaaatttttgttagacaaattttcgtattaaacttattcctaattgcttaggaatggtcactctattttagagtgtgaaatgatagtgccaaacttcaacttacagcttttatttcttgatttagttgtcatagctgtaattttggttataattttcctcagtagaatgttttgtgggaattttatttgagatactactactttcaaggttagaatgcttaaaacgtgctgactttccaaaagtttgattcattacattaagcaacatagttttggttctagaacactgaaaaaaaaaaaaaaaaa

SEQ ID NO: 1343 - DNA, 762 bp, Podocarpus macrophillus
aaagttgtccacatttaggtttatgatttgatgtttgaactataatcctctattcgttcgaggagatcaagcagaggaagcgaagacttcgaaaattgttgttaatccatttttgatctgcagaaccagaacttactaacagagacctgtggagtcgtcgtctttgttttccacgggtcgaagttgaacgttgaggacttgggcagaccatggcgactgtaccagtgaacccaaaaccatttctaaacaatctgactgggaagcctgttattgttaaattaaaatggggcatggaatacaaaggttatttggtgtcagttgattcttatatgaatctgcagttggcaagcactgaagagtttgttgagggccagttcacaggcaaccttggagaagtattaatcaggtgcaacaatgtactatatttgcgtggagtgcctgaagatgaggaaattgaagatgcctgaagatgagaatctcaaaaaatcaaatacatttatgagattattttctataattttgtatttatcttctccccgactgtttgggtgtagattgcaattattgtgatatgagaagcggatggcaaattgaacattgcaactttatgtttttctaaaatacaggtagtgtaactatattcaaaatgcccttatgatctcaccaaactttaagtcatcaatttggagtttggacaagagataagctacaagttcaagaatgctttctgtcctagatttacaaaaaattaatgatgttttt

SEQ ID NO: 1344 - DNA, 653 bp, Primula obconica
acaaaaccctagtctccagtctggtgctcgattcgaagactcataaaccgtaattttgaattttctacaatggctaccgtgccagtcaatccgaagccatttttgaacaatttgacaggcaagacggttatcgtgaaactcaagtgggggatggaatataaaggatttctggtctccgtggattcttacatgaacttgcagctggcaaatagcgaggaatatatcgatggacagtccactggaaatcttggagaaattcttatcagatgtaacaacgtgctctatctccgtggagtacccgaggacgaagaaatcgaagaagctgattagttttaccaattttcaggggtacattcattcatattatcccaaaataggattctgatttgtgtttttcaaatgtaactttccccttgtggtttgcacaagtgtatttgtatcacttagtagatgctaagccgaaaaccaatttggtattgttttccgtaacatcacagatcgatgaaatcaacaatttcctttttcttttgtgtagatttccgatgaacaaattatgtgttttccttgatatttttaaatccgatagctagctttttgaaaaaaagttggtgtaaaatattgggggtttcaatgctcaatagctttaaagctta

SEQ ID NO: 1345 - DNA, 756 bp, Pseudotsuga menziesii
atcatcagtgtccctgctcgaacaccggaaaggaaaggctggtcaattttcgattcaaagctactcattcgtctcgtccagttagagatacatcgttactgtctgtttttcgggttgctagcagtgttggctgtggcatcttctactttgcgggtgagcggcggaagttgaagactcaaatagatcatggcgaccgtaccagtgaaccccaaaccttttctcaacaatctaactgggaagccagttattgtgaaactcaaatggggcatggaatacaaaggttatttggtttctgttgactcttatatgaatttacagttggcgagcactgaagagtatattgatggacagttcacgggcaaccttggagaagttttgatcaggtgcaataatgtattatatttgcgtggcgtgccagaggatgaagatatcgaggaatgaatattcaaagtcttgttttagagaaatttgtattgaacttgtccctagttgcccaggcatggacacttcatcatagagatttgaaaggattgccaaacttcaactcagcgtttgtatttcttaatttagttgtcctaactgtatttttggttataattttcctcagtagtatgtcttgtcgtgaatttgtgctgagatactacttccaatattagaatgcttataacacctgaatttcgaagagttttagttctagaattctgaatgatactataaagatctgtcatttttgtcatgtaattccaagtaaagttt

SEQ ID NO: 1346 - DNA, 792 bp, Sciadopitys verticillata
cgattttctccttgcgttttcatttttcgactttcgcgtgcgagctcaacgtggaccgcgtctgaaaccttgtcgtctgaaacgtggagccaaagtcgaatgccgtgacttaggtttaggagattgttgtggcttcttctccttttcattggactgatcgaaattgaaggttagaagtcttgggttgatcatggcgactgtaccagtgaacccaaaaccatttctaaacaatctgacagggaagcctgttattgtcaaattaaaatggggcatggagtacaaaggttatttggtgtcagttgattcttatatgaatcttcagttggccaacactgaggaatacattgacgggcagttcacaggaaaccttggagaagttttgatcaggtgcaataatgtgctatatttgcgtggtgtgcctgaagatgatgatcttgaagaatgaatgcagttgtagaagctgatttttagagagtttttgtatttaactgcttccttaatgttctggagactctcccgtaatgaagacatgagaacagaatcacaatattcacctttgaaatgtattttatatattaaatttggtttttattcctgacagttttgattaacaaattgttagatgatataagttacaagttctagaatgctgtcagtgccacactagaaagctgccgtaatgatgtttttttcagatttaattctcttttaatccatagtctgtttaattcgatttaaaagagatttggcttccgtaataatgcacaatttctactgtccagacatttgctg

SEQ ID NO: 1347 - DNA, 922 bp, Picea glauca
gaactttacttccaaagcgattacaacatattgaggcaggtaccataaactacactatttgataaaccctagttttgcttcctccacagcctttttgaaatttgaaagtgaaatccactccagtgtgccttgctactataacgcagaggcctgcacaatcctccattcaaaggcattcgttcgtctctgtttttcagtgttggctgtggcatctgctactttggggccaagcggcggaagtggaagactcaaatagatcatggcgactgtaccagtgaacccaaaaccttttctaaacaatctaactgggaagccggttattgtgaaactcaaatggggcatggaatacaaaggctatttggtttctgtcgactcttatatgaatctacagttggcgagcactgaagaatatatcgatgggcagttcacaggcaaccttggagaagttttgatcaggtgcaataatgtactatatttgcgtggtgtgccagaggatgaagatatcgaggaatgaatatgcaaagtttcgttttacagaattttgtattaaacttgtccctaattgccgaggcatggtgactctatcatagagatgtgaaatgatagtgccaaacttcaactcacagcttttatttcttaatttagttgtcctagctgtatttttggttataatattcctctgtagtatgtcttgtcgggtatttgagctgaaatactacttactagattagaatgcttataatatgctgaatttccagaagtttgattcattatagtaaaaaacatagtttatttctagaacactggaagatagttataaagatctgtcatttttaataggtcctttctgtcatgtaattcttagtaaaatttttggcttctgtgaaatataattcaatttctgataaaaaaaaaaaaaaaa

SEQ ID NO: 1348 - DNA, 902 bp, Picea glauca
aacatattgaggcaggtaccataaactacactatttgataaaccctagttttgcttcctcaacagcctttttgaaatttgaaagtgaaatccactccagtgtgccttgctactataccgcagaggcctgcacaatcctccattcaaaggcattcgttcgtctctgtttttcagtgttggctgtggcatctgctactttggggccgagcggcggaagtggaagactcaaatagatcatggcgactgtaccagtgaacccaaaaccttttctaaacaatctaaccgggaagccggttattgtgaaactcaaatggggcatggaatacaaaggctatttggtttctgtcgactcttatatgaatctacagttggcgagcactgaagaatatatcgatgggcagttcacaggcaaccttggagaagttttgatcaggtgcaataatgtactatatttgcgtggtgtgccagaggatgaagatatcgaggaatgaatatgcaaagtttcgttttacagaattttgtattaaacttgtccctaattgctgaggcatggtgactctatcatagagatgtgaaatgatagtgccaaatttcaactcacagcttttatttcttaatttagttgtcctagctgtattttttgttataattttcctctgtagtatgtcttgtcgggtatttgagctgaaatactacttgctagattagaatgcttataacatgctggatttccagaagtttgattcattatagtaaacaacatagtttatttctagaacactggaagatagttataaagatctgtcatttttaataggtcctttctgtcatgtaattcttagtaaattttttggcttctgtgaaatataattcaatttctgatgcttgagcattgttaaaaaa

SEQ ID NO: 1349 - DNA, 739 bp, Amorphophallus konjac
gtcccgctgctgcgatatcttcctctttcttccttcgtgagatcgcacaagcgctctgtaaaccctaacaggcattttttcacggtttccgatctcgttgggggagcagagatgccctggaatccgccgcaggaggaggacaagaagccggcggagcagtcggcgcacatcaacctcaaggttaagggccagactattccagttaatccaaaacccttcttaaacaatttgactggcaaacgtgtgattgtaaagctaaagtgggggatggaatacaaaggttttcttgtatcagttgattcatacatgaatctgcagttggcaaatactgaggaatacatcgagggacagtttatcggaaacttgggggaaattctgattaggtgtaacaatgttctgtatctccggggtgtaccagaagatgaagaaattgaagatgctgaatgaaagtctgagtggcgacgatgctaccatggccttgggagttcaagctcttgacggagtaacactcctccggaggatttgtaactaaagatttttggatatgaagtatcttgttttggacatgttgtagaactaccaacgttggttgcttgaatgttcatctcaggctgtttgatgaagaggattttttatttgtttaatgttgttatttgaagctgtctagcggcacgtggaaaggtggctagattttgttatgagatttttgcatgaaaattattattagaggtgaatttag

SEQ ID NO: 1350 - DNA, 637 bp, Vaccinium corymbosum
aaagaacccgccgtttttctcgctccaaaaccctaaaccccaatcaacttccaatccgaagcgtcgtttgccccgattgttgtcttctccaatggcgacagtaccagtcaatccaaaaacctttcctgaacaatttgactggaaagagggtcattgtaaaaactgaagtggggaatggaatacaaaggttttctcgtctcagtggattcatacatgaacctgcagctggccaacagcgaagagtatatagagggacagttcacaggaaatcttggagagattctgatcaggtgtaacaatgttctctatcttcgcggtgtacctgaggatgaagatatagaagaagccgaaccagaagactaactggtggaatttctaggtagtctagtcctggcctggcccacgatttagaagtctggtttctatcagaaatgtatatccggttttgtgcctgtacctgtcccggaaatattgtagcagtttagtgcttatttggcgtgatttcttcttatgcaaattttctatcatctaagcgtagcatgcccagaccttgagcatatcgagatttttaatcatttggatgaatgtatttcatgtcttacataacaaactgagattattttttgctaaaaatcta

SEQ ID NO: 1351 - DNA, 538 bp, Bruguiera gymnorhiza
ggtaaacccttcgagcctctgcaggaacagaagtcgcttctcgcttcccatggctactgttcctgttaaccctaaacctttcttgaacaacttgactgggaagaccgttattgtaaaactcaagtggggaatggaatacaaaggttttcttgcatcagtattcatacatgaacctgcagctgggcaatgctgaagagtatattgatgggcaattcagtggaaatttgggagaaattttgatcagatgcaacaatgtcttgtatcttcgtggggtgccagaggacgaagaaatagaagatgcagaccgtgactaacctgactagcaaattcctagacactaaaaatagggatctgcctatttgcttttcaagtcgagcatgccaatgcacttcaagttgtcttctgttaatttaacatgtcttattaatcgattggtgtcgcctaactttcattctggtaatgtttgacagtttgtaagtctccaattgtagccttcccaaaagcaggtcagaagacgaggtgaattttgatgtcaaaa

SEQ ID NO: 1352 - DNA, 444 bp, Taxus baccata
aggttattaccaacctgacaaatcattactccgttcttcctaacaaaagggtaggaagacacagtcggcattggagggttctcaacgtgcaaagtaatttgtgtcgaccttctgcaaaaccagagattgttgtggaacttgctccttcccactggactggccaaagttgaagggtagaagacttggctagataatggcgactgtaccagtgaacccaaaccatttctaaataatctgactgggaagcctgttattgtaaaattaaaatggggcatggagtacaaaggttatttagtgtcagttgattcgtatatgaatctgcagttggctagcactgaggagtatattgacgggcagtttacaggcaaccttggagaagttctgatcaggtgcaacaacgtgctttatttgcgtggcgtgcctgaagatgaggatatggaagat

SEQ ID NO: 1353 - DNA, 473 bp, Thalictrum flavum
tcgattctgttctgaggcaaagtgcaaactctctcttcgcttcaatggcagcaagtgtaccagtgaaccccaaacctttcttgaacaatctgactggaaaacctgttatggttaagctcaagtggggaatggaatacaaaggttccttgtgtcagtggactcatacatgaatttgcagctggccaacactgaggaatatatagatggacagttcactgggaacctgggagaaattttgataagatgcaataatgttctctatcttcggggtgttccagaagatgaagaaatcgaagaagctgatcgagattaaatggagcattattatgctttgggctgtagtgttcatttgaagattgattgtgtttatgttagaaacttatagagcacttgactggtgttgtgattagcatcccttaactgaggtacatgctgtgtgcaccattttacactggtgtatgatctgtgtagta

SEQ ID NO: 1354 - DNA, 538 bp, Spinacia oleracea
caggaattcaggataacacggcgttcttgactgtgaatctaaatggcgaccgtcccagttaacccaaaacctttcttgaacaatttaactggaaaacctgtcatcgtgaagttgaagtggggaatggagtataaaggttatcttgtgtctgttgatggctacatgaacctacagctggcaaatactgaagagtatattgaaggccagaagactggagatcttggagagatcctcatcaggtgcaacaatgtcctatatcttcggggtgttcctgaggacgaggagatagaggatgctgataaagactgacatacaagcttttaggattgttatatgttgcagatctatcacagccagctcatgggagacggatatattagggcgtagaagttactggctaagatgggtgtgatacatgacatacaatttacagagtgcgtattatgtaaaagaatcgcttaatgtggcgtaacaaaatattcgtacgagttttatggaaatggaaatctggttagttggatgttgtagtttatgacct

SEQ ID NO: 1355 - DNA, 742 bp, Spinacia oleracea
tgggcttctaaaagccaggaaacaaagttccaagcaaaacacaatttccctcctttcgtacactctcttcatctcttgcagtcttgcctaacaatttctctctcctccacaccggcgacctactccgtctacgaattcaattttctctcacatctgagaacccccatcaattttccttttcgcaggattgcaggacgctgttgaccgtaaaacaaaatggctactgtcccggttaacccaaaacctttcttgaacaatttgactggaaagcctgtcattgtgaagctgaagtggggaatggagtacaaaggttatcttgtgtcagttgatgggtacatgaacctacagttggcaaacacagaagagtatattgaaggccagaagactggagatcttggggagattctcatcaggtgcaacaatgtcttgtatcttcgaggagttcctgaggacgaagaaatagaggatgctgacaaagactgaagaaatatacggagttacctttttgctaggaatgcaattgatggattgtaatgcattatgctcgtctgagaaggttaatgttaggcgcaacaactaaggaatttttaggtggatttgatacattttatgtataaaaagttcacttattatgaaaaatagaaattccttatttgtaatgatagcaaaattttatgttttatgacttgtgacatccaaataagggattttctcaagttatcggatagggaattttgggttt

SEQ ID NO: 1356 - DNA, 562 bp, Ambrosia trifida
aggcattccaggatattctccctccctccttccttccttttactttgtttccaataataatcatctcagttgaacgaagccgtcatcaaacggagtagctgatccacgtcgtccaagaagctgacatcgctctttgttctcgtcttcgaatatggctacggtaccggttaacccgaaacccttcttgaacaacttgactgggaaggctgtgattgtgaaactcaagtggggaatggagtacaaaggctatcttgtctctgttgactcgtacatgaacttgcagttgtcaaactctgaagagtacattgatggtcagtttactggaaaccttggagagattctgatcagatgtaacaatgtcctctatatgcgaggcgtaccagaggatgaagagatagaggatgcagatcgtgattagcaatcctgcatttagatttatctgttttagttccaacatcgaattcttgtatgtagaagttaagatcctaagtgactatttagaagaccggaacttttgatttgtgcaagtttaatcgggtgtaagtgcattatttctggactt

SEQ ID NO: 1357 - DNA, 756 bp, Beta vulgaris
attcgactattcccaacaaaaattaaaatttcctttgaaactcaaaagtgaaacccctgaaaggccaaaaccctaattcagtaatcccttccccatctctaccaccgtccactgattggccttccaattttcttggcctcttttgtaattggattgcggaacaatattgattaggaatcttaatggcgactgtcccagtaaacccaaaacctttcttgaacaatttgaccggaaagcccgtcattgtgaagctgaaatggggaatggagtacaaaggttatcttgtgtcagttgatagctacatgaacctacagttggccaacacggaagagtatattgaaggccagaagactggagatcttggggagattctcatcaggtgcaacaatgtcttgcaccttcgtggagttcctgaggacgaggagatagaggatgctgacaatgactgaagaattctgacattattgcttgcaatgtcgctgatagtctgtaatgcgagaacgcgttgcagatcaagtagtaatacaaagctcatttgagttagttcctagactcggccaccgacttcttggaggacattatacattcgtttgtaagagattcagcttaacgaattatatttcttattgtgatggttttggaatcctacttcttggatttatgttatcagtagagttgaagaatggagatcttcctgattgtacagttttgagattgaaaatcttcaagatgaattatgatatgcgattttaatgt

SEQ ID NO: 1358 - DNA, 617 bp, Castanea mollissima
ttgaatagtttgatactctctctctcagataaaaccctaaaataggccaaaaaccctttcactcggcgcaaagctcagctcagctcacagattcgcctcacctctctcgttcccaatggctactataccagttaacccaaaaccattcttgaacaatttgactgggaagcccgtcattgtgaaactcaagtggggaatggagtacaaaggctttcttgcctcagtggattcatacatgaacttgcagctggctaacactgaagaatatattgatgggcaattcactggaaatctgggagagattttgatcagatgtaacaatgttctctatcttcgtggagtaccagaggatgaggaaattgaagaagctgatcgtgactaagtaggattcagtaagcctaagtaggattccagtattttattttgcttcttcgagtcatggcacctacattgtacttgtatcccatgtagaggtcttctggatgttccattgctcatgctaacaatgccttataaaaggactctcatagatgtattgttcccttaagtttggttttgattgcctgccctttatcatggtgaatagttcaatgcactgcaaaaatatttcactttgt

SEQ ID NO: 1359 - DNA, 468 bp, Castanea mollissima
cccataaaccctcttcactcggcacagaacagctcctctctcgttccgaatggcgacaataccagttaacccaaagccattcttgaacaatttgaccgggaagcctgtcattgtcaaactcaagtggggaatggagtacaaaggttttcttgcctcagtggattcatacatgaacttgcagctggctaacaccgaagaatacattgatgggcaattcactggaaatctgggagagattttgatcagatgtaacaatgttctttatcttcgtggagtaccagaggatgaggaaattgaagaagctgatcgagactaagaaatggggcatcccagcggttcagtagtggcctaagtaggattccagtattctattttgcttctttgagtcatggcacctacgttgtacttgtatcccatgtagaggtcttctggatgttccatggctcatgctaacaatgccttataaaa

SEQ ID NO: 1360 - DNA, 1262 bp, Trifolium pratense
aaaaaccctaattccaccaatttcaaacagagagaagaatcaccgttcgagcttctccattttcgtaccgttctacaatggccaccatacctgttaatcccaagccttttttgaacaatttgactgggaagcatgttattgtcaaactgaaatggggaatggagtacaaaggttatcttgtttcagttgattcctatatgaacttgcagttggccaacactgaagagtacattgagggaaattttactggaaatttgggagagattttaattagatgcaacaatgttctctaccttcgtggagtaccagaggatgaagaaattgaagatgctgctgaagactagaatgaaaaaacctgataactgtcaatttatttactctttttgtatcttcaattaaatgcatgtgtttttctggtgtagttattgtgtagagatttgaatcaatgatacccttcaacaatggggtgtatatgttcaccggaaatctgatgtttagactctagatagtatgtacttgtagtttgtggttgttacaaataggagtagaaaaaacaaatgaaacagatgggaacctactagtgctagtgctagtgctagtgttagtgttagtgccttgcaaaggcaattgaattcccattcaatcagcaataaataaaattaggcatatcagggggaccattcaccagtacaactgtgttctaactgatcctcacaaattggttcccattaaaatcaaagcatgaccacatcaattcccttctaggaaactgtctcaattcaaaccttcaatctatccttacatgtgaaatgatttttgattgctaataaccatatgttcatatagttttaatatctaggttaatattcttaaaatggttggatactctgttttattaggaccccccctgtagccatattaagattgttccactcatgtggtaaagtcattgccatgtggtctttgtgcactccactaatgtggtacacgaaaaatcaatttcaataatgttggttgtgaagtttggtgtcttcatacttcaagaatcctctagcaatttatgcaacttagctttcaatgtgattacagcattgatcaccacttttcccccccccctaaatgttatgttttaaaatacagtatttatgttaagagtttttgtactggcaatttttattttatatgctggttttgtatggttactttagattcaatctaaagttttaagaatttaactaattgtgctacttattataggaaaa

SEQ ID NO: 1361 - DNA, 1120 bp, Trifolium pratense
aaaaaccctaattccaccaatttcaaacagagagaagaatcaccgttcgagcttctccattttcgtaccgttctacaatggccaccatacctgttaatcccaagccttttttgaacaatttgactgggaagcatgttattgtcaaactgaaatggggaatggagtacaaaggttatcttgtttcagttgattcctatatgaacttgcagttggccaacactgaagagtacattgagggaaattttactggaaatttgggagagattttaatcagatgcaacaatgttctctaccttcgtggagtaccagaggatgaagaaattgaagatgctgctgaagactagaatgaaaaaacctgataactgtcaatttatttactctttttgtatcttcaattaaatgcatgtgtttttctggtgtagttattgtgtagagatttgaatcaatgatacccttcaacaatggggtgtatatgttcaccggaaatctgatgtttagactctagatagtatgtacttgtagtttgtggttgttacaaataggagtagaaaaaacaaatgaaacagatgggaacctactagtgctagtgctagtgctagtgttagtgttagtgccttgcaaaggcaattgaattcccattcaatcagcaataaataaaattaggcatatcagggggaccattcaccagtacaactgtgttctaactgatcctcacaaattggttcccattaaaatcaaagcatgaccacatcaattcccttctaggaaactgtctcaattcaaaccttcaatctatccttacatgtgaaatgatttttgattgctaataaccatatgttcatatagttttaatatctaggttaatattcttaaaatggttggatactctgttttattaggacccccccccccattaggaaattgtagccatattaagattgttccactcatgtggtaaagtcattgccatgtggtctttgtgcactccactaatgtggtacacgaaaaatcaatttcaataatgttggttgtgaagtttggtgtcttcatacttcaagaatcctctagcaatttatgcaacttagctttcaatgtgattacagcattgatcaccactttt

SEQ ID NO: 1362 - DNA, 1273 bp, Trifolium pratense
taacaaaacaaaccctaatttccaccgagctcaaacagagagaagaagaatcaccgttccagcgtctccattttcgtaccgttctacaatggccactatacctgttaatcccaagccttttttgaacaatttgactgggaagcatgttattgtcaaactaaaatggggaatggagtacaaaggttatcttgtttcagttgattcctatatgaacttgcagttggccaacactgaagagtacattgagggaaatttcactggaaacttgggagagattttaatcagatgcaacaatgttctctatcttcgcggagtaccagaggatgaagaaattgaagatgctgctgaagactagaatgaaaaaacctgataactgtcaatttatttactctttttgtatcttcaattaaatgcatgtgtttttctggtgtagttattgtgtagagatttgaatcaatgatacccttcaacaatggggtgtatatgttcaccggaaatctgatgtttagactctagatagtatgtacttgtagtttgtggttgttacaaataggagtagaaaaaacaaatgaaacagatgggaacctactagtgctagtgctagtgctagtgttagtgttagtgccttgcaaaggcaattgaattcccattcaatcagcaataaataaaattaggcatatcagggggaccattcaccagtacaactgtgttctaactgatcctcacaaattggttcccattaaaatcaaagcatgaccacatcaattcccttctaggaaactgtctcaattcaaaccttcaatctatccttacatgtgaaatgatttttgattgctaataaccatatgttcatatagttttaatatctaggttaatattcttaaaatggttggatactctgttttattaggaccccccctgtagccatattaagattgttccactcatgtggtaaagtcattgccatgtggtctttgtgcactccactaatgtggtacacgaaaaatcaatttcaataatgttggttgtgaagtttggtgtcttcatacttcaagaatcctctagcaatttatgcaacttagctttcaatgtgattacagcattgatcaccacttttcccccccccctaaatgttatgttttaaaatacagtatttatgttaagagtttttgtactggcaatttttattttatatgctggttttgtatggttactttagattcaatctaaagttttaagaatttaactaattgtgctacttattataggaaaa

SEQ ID NO: 1363 - DNA, 723 bp, Echinacea purpurea
ttctcggctgcaatcgctcatatggctacggtaccagttaacccgaagcctttcttgaacaacttgactgggaaggctgtgattgtgaaactcaagtggggaatggagtacaaaggctatcttgtctctgttgactcttacatgaacttgcagttgtcaaactctgaagaattcattgatggtcagtttactggaaaccttggagagattctgatcagatgtaacaatgttctctatttacgaggtgtaccagaggatgaagagatagaggatgcagaccgtgattagcaatcctgcttttagatctatctgttttaatataaactttaaattcttgtatgtagaagttaaaatcccaaatgacaaatttagaaagcctgaacttttgattggtgcaagtttaattggatgagtgtccattatttctggattctgttagtttgaatgtatcaaacaatgtttaatgttagtttcctttttcttttcctcctagttgataaaaacttaattggttccattgaaggtgcaattgtagggaaaagaactatttagttctaatagaaactttctggctgttgatgaacttgtagtgcgttttattgatcttgaatcacgtgtgtggatgatggaagtcacaggcaaagtttcggtaactagtagatctagcaatatatgcatccaatggttattcgttgtacattctgcaatatcagattatcagtc

SEQ ID NO: 1364 - DNA, 524 bp, Fraxinus spp
ctccaatggctactgttcctgtcaatcccaaacctttcttgaacaatctgactgggaagcctgtcatggtaaaactcaagtggggaatggaatacaaaggttttcttgtctctgtggattcatacatgaacttgcagctggcaaatgctgaagaatacattgatggacaattcagtggaagtcttggagaaatcttaatcagatgtaacaatgttctctatcttcgtggagttccggaggatgaagaaatagaagaagcagatcgtgactagattcttcgtgttgtactaatttcttgttcggaaaacgaaattattatctctgttctgttactgttagcttccccattgaatcccaaaattacattctgttttcatactattgctatgagtgctattagttgacttggtactgctcgaaatagacattattattagtattatgcttagttagttatggattttaggattaagatgtaatggttggatgatctaacggtgtaagcattttgattttcgaattag

SEQ ID NO: 1365 - DNA, 824 bp, Panax ginseng
ggtatcaacgcagagtacatggggaggccaactagaaaacgcactgtcggagttattttctctcctagatccctcactccaaaaccctaaaaccctcagccgcgtggccaagagaagttctcctatccaagattcttcaatggcgactgttccggttaatccaaagcctttcttgaacaatttgactggaaaacctgtcatcgtcaaattgaagtggggcatggagtacaaaggttatctagtctctgtggattcgtacatgaacttgcagcttgcaaactctgaagaatatattgatggacaattcacagggaaccttggagagatactaatcaggtgtaataatgttctatatatgcgcggggtgccagaggatgaggaactagaggaagcggatcgcgactagaagactacttttaatttgtattctaagtactgcaatagattgaattacttgggagtttagattgcctgacaaagacgtatttacttatttttgtgcttagaagtgttcaacaatatctgcttattacgctatgttggttgtataatgcttgatgctattttctctggcgggttaagctttcttagagaactgttatatctgtgggcatagctcacactgaggttacattttggcacattgttgcatatagtgttgtcaccacctcgaagatagctggaattgaaacggtctatagtttgccattctgatttagcctaaaatgattgttgtctagtgggagcactccccctctgtgatcattggttggggaaatcttttatctttctgtgtgcttataataacattatactgttgattt

SEQ ID NO: 1366 - DNA, 709 bp, Panax ginseng
aacgaatagtggactgacttgggccgtcaggccgactagaaaacgcactgtcggagttattttctgtcctagatccctcactccaaaaccctaaaaccctcagccgcgtggccaagagaagttctcctattcaagattcttcaatggcgactgttccggttaatccaaagcctttcttgaacaatttgactggaaaacctgtcatcgtcaaattgaagtggggcatggagtacaaaggttatctagtctctgtggattcgtacatgaacttgcagcttgcaaactctgaagaatatattgatggacaattcacagggaaccttggagagatactaatcaggtgtaataatgttctatatatgcgcggggtgccagaggatgaggaactagaggaagcggatcgcgactagaagactacttttaatttgtattctaagaactgcaatagattgaattacttggagtttagattgcctagacgtatttacttatttttgtgcttagaagtgttcaacaatatctgcttattacgctatgttggttgtataatgcttgatgctattttctctggcgggttaagctttcttagagaactgttatatctgtaagcatagctcacattgaggttacattttggcacattgttccatatagtgttgtcaccaccttgaagatggctggaattgaaacgatctataatttgccattc

SEQ ID NO: 1367 - DNA, 1456 bp, Panax ginseng
aggccaactagaaaacgcactgtcggagttattttctctcctagatccctcactccaaaaccctaaaaccctcagccgcgtggccaagagaagttctcctatccaagattcttcaatggcgactgttccggttaatccaaagcctttcttgaacaatttgactggaaaacctgtcatcgtcaaattgaagtggggcatggagtacaaaggttatctagtctctgtggattcgtacatgaacttgcagcttgcaaactctgaagaatatattgatggacaattcacagggaaccttggagagatactaatcaggtgtaataatgttctatatatgcgcggggtgccagaggatgaggaactagaggaagcggatcgcgactagaagactacttttaatttgtattctaagtactgcaatagattgaattacttggagtttagattgcctgacaaagtcgtatttacttatttttgtgcttaaaagtgttcaacaatatctgcttattactctatgttggttgtgtaatgcttgatgctattttctctggcaggttaagctttcttagagaactgttatatctgtgggcatagctcacactgaggttacattttggcacattgtttcatatagtgatgtcaccacctcgaagatagctagaattaaaacgatctataatttgctattctgatatagcctaaaatgattattgtctagtgggagcactcccccctgtgatcattggttggggaaatcttttatctttctgtgtgcttataataacattatagtgttgatttagaacttgttgtttttgccttttattttgaaactcatccatatggctgcgaactcccagacagaaaaagcagagaggacttcaggtagagagggctttcctgcaattatctttagtaaattagattcaactctattcactgcgactgtattcatgccaacttgaaattaacaactggtttttggggacatgttgacctacaatcatgctcactttattcggtattgtaaatttttatttgtaggattgttgatccttagctccaattatatacctgtgactaattaaatgtgttttgctaatatagtgtgaggtattggttaacaaaatttgcaggatcttgagttagtgtgaaaggattagaagagcatgaatacattttagttgtctcctaattagttttttcttcctgtgcacaaaaactcgaacttgggtctcttaggtttgccgtttggtaaagtcatgcaaccaatcaatattaccattgatattgccttgtggaaatttgagaccactaggtactactacactgtcattgatgcccctggacatcgtgactttatcaaggacatgattattggtacctcacatgatgactgtgatgtcctcatcattgactccaccagtggtggttttgaagctggtatctctaaagatgg

SEQ ID NO: 1368 - DNA, 573 bp, Actinidia deliciosa
ccactgtgctgtttctcccaaaccctagacccttcgttcatcttcgaacccactagcgtttcttctgctccgaactttctccaatggcgactgtaccagtcaaccccaagccttttctgaacaatttgactggaaagaaggtcattgtgaaactcaagtggggaatggaatacaaaggttttctcgtctcagtggattcttacatgaacttgcagctggccaacagtgaagaatatattgagggacaattcactggaaatcttggagagattttgatcagatgcaacaacgttctctatcttcgtggtgtaccagaagatgaagaaattgaagaagctgaagaagactgaagttggtttcatctatgttgcagtcatggtcctccatccatttgaaattagtattatctacccttttgctgctagcacattgtagttgtactatgagtaccgactgttagttgttcacgagcggcttctgcaacctacaacataatgatccattgtactttaaccttgactggatgctatgccctgctaagctctgtctatttgtgctccgcttttaagcttc

SEQ ID NO: 1369 - DNA, 512 bp, Actinidia deliciosa
caaagcataccccacattcgcgctgaatactccgtttctcacccgagaaatcctaaaccctcgcagactcagagtcgtttgctccgatcatcctctccaatggcgactgtaccggtcaaccctaaacctttcctgaataatttgactggaaagaaggtcattgtaaaactcaaatggggtatggaatataaaggttttctcgtctcagtggactcatacatgaacttgcagctggcaaacagtgaagaatatattgagggacaatttactggaaatcttggagagattctgatcaggtgtaacaatgttctctatcttcgcggtgtacctgaggacgacgaaatagaagaagctgaagaagactaagtggtggatttcggcgaataggcccacctagtattagaattctggtttctatttaaattaatatcatttaccggtgtagtttgcatattttatatgtatgaactccagctgtattctgtgctttgttaactgttaatccatgtcac

SEQ ID NO: 1370 - DNA, 574 bp, Liriodendron tulipifera
gttccctcccctctctaaaaccctaaaaaaaaccaaagacccaaaggagaagaagaacagaagattccactgcaatgacgacacctgtcaacccgaagcctttcttgaacaatcttactgggaagcccgtcattgcgaagcttaagtggggaatggaatacaaaggttaccttgtttcagttgattcatacatgaacttgcagctggccaacactgaagaatacattgatggacagtttacgggaaaccttggagaaattctgataagatgcaacaacgttctttatcttcgaggtgtaccagaggatgaagaaattgaagacgcagacaaagattaagaagtctgaattttttttatggagaagctggtcttccatttcactctcattcttcaatcgggctgtaacttcgatattagattctatctcatgtctcagtaaaagtcgccatcgttgcaagcttccaagtttcaagtaagttatagtttggcaccttctgttacattgcagtatattggttttgttaagcagatccttttctttggatacaatgcaagctgtttgagaatttttct

SEQ ID NO: 1371 - DNA, 458 bp, Medicago truncatula
cttcaagctgaaacagagaggagaaagcatccaccgtttcagcgtcttcgttttcgaaccgttctacaatggccactattcctgttaatcccaagccttttttgaacaatttgactggaaagcctgttattgtgaaactcaaatggggaatggagtacaaaggttaccttgtttcagttgattcctacatgaacttgcagctggccaacactgaagagtacattgagggaaactttactgggaatttaggagagattttaatcaggtgtaacaatgttctctacatgcgcggagtaccagaggatgaagaaatcgaagatgctgctgatgactagaattgactgttatgacatcaagaaaacgctatttaccgtttttgtatcttcacttaaatgaggggtttttttcttgtctagttgtatgtagagatttgaatcaatgataccctcaacacttgg

SEQ ID NO: 1372 - DNA, 800 bp, Quercus alba
ctcttttaaaattatagtctttaagggtgtggatttgggtaaaagggaaggctgacccggattcaaattattttagtttaatgctctctgagtgtctgtgtctcagatagaagaacagaatagaaccctaaaaaaaagcccaaaaaccctcttcactcggcacagaacagctcctctctcgttccgaatggcgacaataccagttaacccgaaaccattcttgaacaatttgaccgggaagcctgtcattgtcaaactcaagtggggaatggagtacaaaggttttcttgcctcagtggattcatacatgaacttgcagctggctaacaccgaagaatacattgatggacaattcactggaaatctgggagagattttgatcagatgtaacaatgttctttatcttcgtggagtaccagaggatgaggaaattgaagaagctgatcgagactaagaaatggggcatcccagcagtttggtagtggcctaagtaggattccagtattctattttgcttctttgagtcatggcacctacattgtacttgtatcccatgtagaggtcttctggatgttccattgctcatgctaacaatgccttataaagggaccctcatagatatattgttcccttaagttggttctgattgcctgccctttatcatggtgaatagttcaatacactgcaaaaatatttcacttagtgttaactatccctttggtttgaaatgaacgcatttttcttccattgcattaaaatcatttcatcacaatgagaatcatatgaagttttaatttaaa

SEQ ID NO: 1373 - DNA, 611 bp, Quercus alba
aaaaggccaaaaaccctttcactcggcgcaaagttcagctcacagattcgcctcaactctctcgttcccaatggctactataccagttaatccaaaaccattcttgaacaatttgaccgggaagcctgtcattgtgaaactcaagtggggaatggagtacaaaggttttcttgcctcagtggattcatacatgaacttgcagctggctaacactgaagaatatattgacgggcaattcactggaaatctgggagagattttgatcagatgtaacaatgtgctctatcttcgtggagtaccagaggatgaagaaattgaagaagctgatcgagactaagtaggattcagtaatggcctaagtaggattccagtattttattttgcttcttcgagtcatggcacctaattgtacttgtatcccatgtagaggtcttctggatgttccattgctcatgctaacaatgccttataaaaggactctcatagatgtattgttccctaagttggttctgattgcctgcaaaaaatatttcactttgtggtaacttttcttccattgcattaaaatcatttcatgacaatgagaatcatatgagatattaatttttggt

SEQ ID NO: 1374 - DNA, 523 bp, Olea europaea
gaaatctttcctctcgttttccctccatcggaaacactccaatggctactgttcctgtcaatcccaaacctttcttgaacaatctgactgggaagcctgtcatggtaaaactcaagtggggaatggaatacaaaggttttcttgtctctgtggattcatacatgaacttgcagctggcaaacgctgaagagtacattgatggacaattcagtggaagtcttggagaaatcttaatcagatgtaacaatgttctctatcttcgtggagttccggaggatgaagaaatagaagaagcagatcgtgactagatttttcttcttgttctaattgtgttcggaaagtgaaattattatctctgttttgttagcttccccattgaatctcaaattacgtgatgttttcatgccattgctaagagtgccatcagttggcttggtaagctcaagctagacattattattatcatcgtggatttgaggattaagatgtaattgttggatgatctaatggtgaaattgttaaa

SEQ ID NO: 1375 - DNA, 666 bp, Olea europaea
tccgtaatccttccctctttttcacaacccttaccctaaacccgctcgacgcttaaaccctcgcacggtgaaacctctcttttccttccaaaagacgttgctctaatggctactgtaccagttaaccctaagccttttttaaacaatttgactgggaagcctgtaatggtaaagctcaagtggggaatggagtacaaagggtttctcgtctcagttgattcatatatgaacttgcagcttgcaaatgctgaagaatacattgatggacaattcagtggaagtcttggagagatcttgatcagatgtaacaatgtgctttatcttcgtggggtgccagaggatgaagaaatagaagaagcagatcgtgactagttgcctctcctcgtttatgtattgttgtttaaaatgctattacctagtggacatgccatcttgtggattcagttgatcatactgcatttttagatatgatatcgggattatgccattaattccaatttaatttgagtgggagtggcattcgttgatgatagtatgttcagtttcgtactttggttaaaaatgagagttttagcatatattgataaaaattgattaaatgtgtggttgaaaatttagcctttggttgagcctcattataaagagaaattttattaaaatttaaaa

SEQ ID NO: 1376 - DNA, 685 bp, Olea europaea
cgcattttcctggaagtttcaaccttgttgactatgacaagagtcgcgaatataaagagactcgtgactatggcagggcggtacgctctgctctctcgcgacccctactctaatcaaaagccttatttggtccctccaaaaccctacgccaactcgaaacctcaaaacttgcagaagagaaatctttcctctcgtcttccctccatcggaaacactccaatggctactgttcctgtcaatcccaaacctttcttgaacaatctgactgggaagcctgtcatggtaaaactcaagtggggaatggaatacaaaggttttcttgtctctgtggattcatacatgaacttgcagctggcaaacgctgaagagtacattgatggacaattcagtggaagtcttggagaaatcttaatcagatgtaacaatgttctctatcttcgtggagttccggaggatgaagaaatagaagaagcagatcgtgactagatttttcgtgttgtactaattttgttcggaaagtggaattattatctctgttttgttagcttccccattgaatctcaaattacgtgatgttttcatgcaattgctaagagtgctatcagttggcttggtaagctcaagctagacattattattatcattgtggatttgaggattaagatgtaatggttggatgatctaa

SEQ ID NO: 1377 - DNA, 526 bp, Olea europaea
tccaatggctactgttcctgttaatcccaaacctttcttgaacaatctgaccgggaagcctgtcatggtaaaactcaagtggggaatggaatacaaaggttttcttgtctctgtggattcatacatgaacttgcagctggcaaatgctgaagaatatattgatggacaattcagtggaagtcttggagaaatcttaatcaggtgtaacaatgttctctatcttcgtggagttccggaggatgaagaaattgaagaagcagatcgagactagattcttcgacttgtactattttcttgttcggaaagcagaattttatctcttctttgtcatgcgcttacattgaataccaaaattaaatgatcttttatgtcattgctaagattgccattagttaactcggtatggctcgactagatattattatgcatagatcataatggattacaaggattaaggactaatggctggatatctaatggtgaaattgttaaattgtcgtgtaagccctttgattttcgattgctt

SEQ ID NO: 1378 - DNA, 672 bp, Orobanche aegyptiaca
tccctttttcgttctgcatccccaaattcacctcccctaaaaaccctgcttgcaagctctctagcacgcacggcaatggctactgtaccagttaatccaaagccttttctgaacaacttgaccgggaagcctgtaatggtgaaactcaaatggggaatggaatataaaggtttcctcgtctctgtggattcttatatgaatttgcagcttgccaatgctgaggaatatattgatgggcagtgcacaggaagtcttggggagatcttaatcagatgtaataatgttctttatcttcgtggggtacctgaggatgaagaaatagaagatgcagaacatgactaggtggcttgcagggagccgttgcgatttctgttgtcctacatctctttcaaaccgtaaaaaaagcctgattgtatttgaatcacatcgaagagaattaatcaacttaaatcctgtcgggtgaactttgttaatttggtgttggactaaagtgcatcaatcatgctgtaacatgaatgatgtagacttttctgtttttattgctcaggaactagatactgtcatagtttcttgttggctacttcaaatctttaacttttaacactaagcgtgggataacttgcaagtcgactaagtgagccgattaatattgatgcttgtcgactgttgtgc

SEQ ID NO: 1379 - DNA, 777 bp, Arachis hypogaea
gttgccgcgtttcaggttttgcgatctcctcctccaatggcgactataccagtgaatccgaagcctttcttgaacaatttgactggaaagcaagttattgttaaattgaagtggggaatggaatacaaaggttatcttgtttcagttgattcctatatgaatttgcagcttgccaacactgaagaatacattgagggacaatttaccggaaacttgggagaaattttaatcagatgtaacaatgttctctaccttcgtggtgtgcctgaggatgaggaaattgatgatgctgcagaagactagaatgataaaattatctcattgttataacataattagagacctcttaaattcaggttgtgtatttatgtgtagagatttggatcaatataggttgcctatgttctgcttgtttagacctcttgatttctactgttttgaatttgatttttcctagtttgaaaaagttgaagtagtggtctgatctggtctggtgctgctatgctttcttcttgaatgttgctgcatagttggatagtcatgttctctggaaagtgaggtctttcttataaatgttcaggcttgtatattgggttaaagttttgtgtgatgataagtgataacccatattccattgacaatgtggtatataaccttgccgttagaggttttggaaaggtaaatgctagaactgatattgatttactaaaaaaaaagaaaaaacaaaagtactctgcgttgataccactgcttctgagactgccaaggcacacaggg

SEQ ID NO: 1380 - DNA, 516 bp, Chenopodium quinoa
agccttttcactttttgcgctgcacctcttccggcgctgcttctcttccattgaaacatactctgaattctccattgaagcagcttctgagctatatctcctccataaaagcagctttttaaagattgcaggacgctgttgactgtgaagctaaaatggcgactgtcccagttaacccaaaacctttcttgaacaatctgactggaaagccagtcattgtgaagctgaagtggggaatggagtacaaaggctatcttgtgtcagttgatgggtacatgaacctacagctggcgaacacagaagagtatattgaaggccagaagaccggagatcttggagagattcttatcagatgcaataacgtactgtatctccgtggagttcctgaggacgaggagatagaggatgctgacagagattgaagaagaataacctttttgctcacgatgcagctgatacaatgttatgcaaaaactcagttaagattgagtattattaagctcatgtgagatggtt

SEQ ID NO: 1381 - DNA, 625 bp, Chenopodium quinoa
tactctgaattctccattaaagcagcttcggagctatctcccctccatcaaagcagcttcttaggattgcaggacgctgttgactgtgaagctaaaatggctactgtcccagttaacccaaaacctttcttgaacaatctgactggaaagcctgtcattgtgaagctgaagtggggaatggagtacaaaggttatcttgtgtcagttgatggctacatgaatctacagctggcaaacacagaagagtatattgaaggccagaagactggagatcttggagagatcctcatcaggtgcaacaatgtcctgtaccttcgcggtgttcctgaggatgaggagatagaggatgctgaccgagactgaaacagacttatatatcccaatcccatgatacaagtttgccattgtcatatggagaattactgctgacataccagctcatggaagacagatatatagggtgtagaaactactgagtgagactgatttgacacaccttatgtaaaagaatcacttgatatccacaacaaaatttttgtattatgatgaggttaaaattttgcttttgggatgttatgtttattgtctagaagttgttcatttaccatttcagtttaagtttttc

SEQ ID NO: 1382 - DNA, 548 bp, Chenopodium quinoa
attgaagcatactctgaattctccattaaagcagcttctgagctatctctcctccattaaagcagcttcttaggattgcaggacgctgttgattgtgaagctaaaatggctactgtcccagttaacccaaaacctttcttgaacaatctgactggaaagcctgtcattgtgaagctgaagtggggaatggagtacaaaggctatcttgtgtcagttgatgggtacatgaacctacagctggcgaacacagaagagtatattgaaggccagaagactggagatcttggagagattctcatcagatgcaacaacgtactgtatctccgtggagttcctgaggacgaggagatagaggatgctgacagagattgaagaagaataaccttttgctcacgatgcagctgatagaatgtcatgcaaaaactcagttaagattgagtattattaagctcatgtgagatggttattgttaggcgtaactgttaaattccctggatgtgatacatttgatgtaaaaggttaacttttcatgaaaatagaaacttctt

SEQ ID NO: 1383 - DNA, 408 bp, Salvia sclarea
aaaaaaaccctaaacccttctgacgctgcgagaattccccgaccaagaaattctctctcattcctaatcagctgccatggctactgtaccagttaaccccaagccgttcttgaacaatttgactggaaagcctgttatggtcaaactcaaatggggaatggagtataaaggttatcttgtgtctgtggattcatacatgaacttgcagcttgcaaatgctgaggaatacattgatgggcagtgcactggaagccttggagaaatcttgatcagatgcaataatgttctgtatcttcgcggtgtccctgaggatgaagaaatcgaagatgctgatcgcgattagccgacaattggcatcaactattgtatcaatgattgctaattgagctggagtgagatctagcatcg

SEQ ID NO: 1384 - DNA, 621 bp, Sarracenia psittacina
aaattgaccgtcgacgagtcaggtataccgcgttcgccgtttatactccaaaaccctaaacctcaaccaacttcggatccaaagagagtttttgctccgaacatcgtctccaatggcgactgtaccagtcaatcctaaacctttcctgaacaatttgactggaaagagggtgattgtaaaactcaaatggggaatggaatacaaaggttttctcgtatcagtggattcatacatgaacttgcagctggccaacagtgaagaatatattgaggggcaatttactggaaatcttggagagattctgatcagatgtaacaatgttctctatcttcgcggtgtacccgaggatgatgaaatcgaagaagctgaagaagagtaaaagaggtggattcctgcggtgatctgttcttggccctcgcactagaattccggattctatttgaaattaatatttactctttggtagtttgcatattattctaaatgcattacttctagagatcttgttatctatttatgcacatccatataacatacatgatactggttcacagtttatcttatgctcgcttggtattatggatgagattgagtaatactgtgggtcccacatttttttaa

SEQ ID NO: 1385 - DNA, 564 bp, Sarracenia psittacina
tcgttcagcttcgaatccaaagagaggttttgctccgtacatcttctccaatggcgactgtaccagtcaatcctaaacctttcctgaacaatttgactggaaagagggtgatcgtaaaactcaaatggggaatggaatacaaagggtttctagtatcagtggattcatacatgaacttgcagctggccaacagcgaagaatatattgaggggcaatttactggaaatcttggagagattctgatcagatgtaacaatgttctctaccttcgaggtgtacccgaggatgacgaaattgaagaagcggaagaagattaaaagaggtggatttttgcggtgatctggtcttggcccttgaactagatttctggattctatttgaaattaatgtctatttactctttggttctttgcatattattgtatctgtattacttctggaagtattgttatctgtttagcgcagccatataacatacagtatgctggttcacagttatcttatgcctttaagattagagctaactggtgcttcatggcattgaagccactccaatcctaggtg

SEQ ID NO: 1386 - DNA, 573 bp, Sesamum indicum
caaaaggcatacgccgccatttgtcccttctgcgctccaaaaaccctaaacccccacatttgcccaccaaagaaatctctctccctccaaggctccaagaaggcaacaaccaacgcaatggctactgtaccggttaatccaaagcctttcttgaacaatttgactgggaagcctgtgatggtaaaacttaaatggggaatggaatacaaaggttatcttgtctccgtggattcatacatgaacttgcagctcgctaatgctgaagagtatattgatggacaatccactggaaatcttggagagatcttgatcagatgcaataacgtcctatatcttcgaggtgtgcctgaggatgaagaaattgaagaagcagatcaggactagggttcgattggtgtcttttgtatcatgacattctaactgaattgagatctttgtgtctatcattaggtgtacttgaatcaaacctaagggtactcttgtctgaagcagagactatctttgtcgtgtaaaaatgtccagaatcatgttatgagtgttatattaagggcatttttacacgacaaagatagt

SEQ ID NO: 1387 - DNA, 558 bp, Trigonella foenum-graecum
cttcacatcaagctcagacagagagaaaggagaaagcgtcaaccgtttcagcgtcttcgttttcgcaccgatctacaatggccaccatacctgttaatcccaagccttttttgaacaatttgactggaaagcctgttattgtgaaactcaagtggggaatggagtataaaggttatcttgtttcagttgattcctatatgaacttgcagctggccaacactgaagagtacattgagggaaattttactgggaatttaggagagattttaatcagatgtaacaatgttctctacatgcgcggagtaccagaggatgaagaaattgaagatgccgccgaagattagaatgaaaaccctgctaactgttatgacatgaataaaactcaatttatttaccgtgtttgtatcttccgcttaaatgtatgtgtttttcttgtgtagttatgtgtagagatttgaatcagtgacacccttatcaatcgggtgcctatgttaaaattgttcaatttacatggcgtgatttgccggaaatatgatgttagattctatttaaattagc

SEQ ID NO: 1388 - DNA, 551 bp, Vicia sativa
cagaaagctttaacgtttccagcaactaagctttcgcaccgttcaataatggccaccatacctgttaatcccaagccttttttgaacaatttgactgggaagcatgttattgtgaaactaaaatggggaatggagtacaaaggttatcttgtttcagttgattcctatatgaacttgcagttggccaacactgaagagtatattgagggaaattttaccgggaatttaggagagattttaatcagatgtaacaatgttctctatcttcgtggagtaccagaggatgaagaaattgaagatgctgctgaagactagaatgaaaaaaccattgtaaggtgtaaccatgttctctaccttttcgggagtgtactagaggatgaagaaattggagatgctgctgaacactagaatgaaaaaatcttactgttataaattgaactaaatttatttactgtttttgcatcttcatttaaatgcatctgtcttttatgtagttacatgtagatatttgaatcaaagaaccctcatcaatcagtgtgcttatgataaag

SEQ ID NO: 1389 - DNA, 494 bp, Zostera marina
cctttctcttttctcgtctcgaatttgcagactgcagaggcacagaacatcttctcccatggcgactgtacctgtgaatccaaaaccgtttttgaacaatttgactgggaagcatgtgattgtaaagcttaagtggggaatggaatacaaaggttttcttgtttcaattgattcctacatgaacttgcagcttgccaacaccgaggagttcattgaagggcagttcactggtaacctaggggagattttgatcaggtgcaacaatgttctttatctcaggggtgttcccgaagatgaagagattgaagatgcagaacgggattaacaaaaaatgcaatcttcctagttcctaatttctacttcctaacataagaatgccatatttatattttattctacaacaatgtataccatatttagtctgtgaaatagacttaataccctttgctttgaatttaagataccatttgtgttaaaaagcgattaagaagaac

SEQ ID NO: 1390 - DNA, 893 bp, Pteridium aquilinum
gatgctgaatactaaggaaaatagtcttaaatctgtgatgggaaccggaagcagggatcgatcacgccacgaaggggtttttgatttttgagagggaaaacaagaacccacctctaggtttgcgagatcaaagtttatcgacctagcagaagggttttctgtgttggcgagagtcttcttcgtcttcgacatggctgccattcctgtgaatcccaagccttttctcaacaatctcaccggaaagcctgttatcgtcaagctcaaatggggcatggagtacaaagggtaccttgtgtctgtggattcatacatgaacctacagctagcaagtacagaagagtatatcgacggtcaactgataggcaatcttggagaaatattgatcagatgcaataatgttctctatttgcggggtgttccggaggatgaagagattgatgaggcagaggaataatggcacacattttctggctttcatgcatctttttcccgaggtccacacaactcaaagctagcagttgatctttttagccatgtcctttcaacagatttattttttgagctgttgattacccatttcaaatttatgtgggggcttgggtgtaatgtttatgacattattaatcggacgtgctacaggatttgagaagaattgctaggttgttggattactatcctattttctctggaaaccaatacagggcaccagatcatcagtactttcatggcttttggacattgatgcttgaaactgatgactcatatgagacccttgtggcaggcgagtctgtggtcccacagttcttgttttgtgtgctggtacttaggttcgagccactaagattttatcaatcaacacttataatgaaagcagttggctgtaatttgattta

SEQ ID NO: 1391 - DNA, 497 bp, Flaveria ramosissima
aaccttctcagtagaagaagctgcaatcgccatctgctaatctctacgaatatggccacggtaccagttaacccaaacctttcttgacaacttgactgggaaggctgtgattgtgaaactcaagtggggaatggagtacaaaggttatcttgtctccgttgactcatacatgaacttgcagttgtcaaactctgaagaatacattgatggtcagtttactggtaaccttggagagattctaatcagatgtaacaatgttctgtatctacgaggtgtaccggaggatgaagaaatagaggatgctgatcgtgattagcaatcgtgcatttagatccatgagtttcaatttcaacatctttcagtcttgtatgaaaatacttgtagatgttaagatccaaatgacacccaatttagaaagcttgaacatttaattagcacaagttcaagtggctggatgtgcatttattctagacttcttttagtatgaatgtatcaga

SEQ ID NO: 1392 - DNA, 1156 bp, Linum usitatissimum
tgaaaatggaacacaacagaggaaggagctcgaagatcgtgctgcaggcgggaccgtggggtgggaccggagggagcagttgggacgatggagctcaccgtggcgtcaaggagatcaagctcgtctacgaccgttgtgtagattcaatcaggttcgtatatgagaagaagggtgggaagaccgtcgtcggagagagacatggtggccttggtggcaccaagacagctgagattaaactgcaataccctgatgagtatttgacccaaatacacggatactaccacccggtcgtccatggcggccacccagtgatccggtcactaacgttcatgaccaacaagaggagattcgggcctttcggtgttgaagaaggcactccctttacacagggcttggctggagtttttgtggtgggattcaatggcagaggtggctggtacttggactccattggtgttcactatgttgaatacaacaagtccaagaccatcttcacaaagcttcagcagaagtttcagaggatctcgtcggtcgcgagaccttccagggatgctagaacagcctattagttcactatttcagtccagggtactgcagtaagtactatgtaactacttattaaggaagagcagtcgtatataagtaaaagagcaatagtatggacagggaataaaaaccggtttgtccattgattaatggatgaaacagcatgagtttggacaagatctgttgcttacaatacaaagtacaccatgatcatagcacgctggtggctgaaaaacagccataaggtttcctttcacatatccttagtctaattctaatcacgatcagcgtcttctatttcctcgtcttctggtacgcctcgcatgtagagaacattgttgcaccttatcaagatctctcccagattcccagtgaactgcccgtcgatatactcttcagcattccctagctgcaggttcatgtaggaatcaactgaagcaagaaaacctttatattccattccccatttcagcttcacgatcacagtcttaccggtcaagttgttcaagaacggcttagggtttactggtactgtcgccattgattacagagagaagacgaagaaactctggagactgcgacgatcgatgttcgattttgaatttccgcc

SEQ ID NO: 1393 - DNA, 471 bp, Petunia hybrida
cttgagaaaaccctaaaccctcgcaaaattcttcaatggcaacagtaccagttaatcgcaagccttttttgaacaatttgactggaaaggcctgtgatggtaaagcttaagtggggaatggaatacaaagggtatctggtctccgtggattcatacatgaacttgcagcttgcaaatgctgaggaattcattgatggacaaagctctggctctcttggagagatcctgattagatgtaataatgtcctttatcttcgtggtgtccctgaggatgaagaactggaagatgctgaccgcgactagaaagtgtgttgtactaatagtgtaattgttctgcaagttaagatcagatttcttgttcatggatcatgtggaattgatttgtggtcatcttcttgaatgtattatcgattatgtgttttagctttctaagaatgctgctatcaaatatatgttaatggatggttgggc

SEQ ID NO: 1394 - DNA, 663 bp, Primula obconica
tacgaagaatgtcccgtcgaagaaaaacttaaggagaaggaccgaaacgactgctggtaaagggaaggtcagcttgaagacacccacttacggaccgaacttaccctcctctctctctctctctccgaagctcagaaaaccctttcacaaatggcgaccgtaccagtcaatcccaagcctatttttgaataatttgacaggaaagaaggttatcgtgaaactaaagtgggggatggagtataaagggttcctcgtgtcagtggattcttacatgaacttgcagctggcgaacagcgaagagtatatcgagggacagttcactggaaaccttggagagattctcatcagatgcaacaatgtgctttatcttcgtggggttcccgagaatgaagaaatcgaagaagctgatcaagactgagaacaagactcgagctttttccatttcagcgatagctccaggcattatggccaaataggattctgatcactgttatcgattttaatataacttactctgtggttttcacatttatttttgtactgtatcatttagtacatgcctgctaaaacaagctaaaccgtgttgtccttgtttctaaaacatcagtagggtcgatggatcaaccttttcttatgtgggtgtaaattaaagtattgtaatga

SEQ ID NO: 1395 - DNA, 377 bp, Carpinus betulus
aggtagcttaagctagagacagccgcggaggagaaacagagcagagcagagggtcagctactccaacttgaaggctcacttacacaaaaaatgtctatcccagtttaacccaaaacctttcttgaacaatttgaccgggaagcctgtcattgtgaaactcaagtgggggatggagtacaaaggttttctcgcctctgtggattcatacatgaacttgcagctggctaacactgaagaatacattgatgggcaattcactggaaatctgggagagattttgataagatgtaacaatgttctctatcttcgtgggggtaccagaggatgaagaaattgaagatgctgatcgagactaaagagacaggattcccagtatt

SEQ ID NO: 1396 - DNA, 1142 bp, Cycas rumphii
tttgaaccaccaaaatacgaatagagaatccttcctaggttttgctcaaaatgataattatcagcattattatttaaattttaatggagtaacgaactctgcaaacgttctgcggttagactggatggtaaagtagaattgccattcggtagccctaaatttttacttttgtcaagtcggagatcctctggagcaacggctctacctgtggaggctcaaggcgcataagattttgtaggatttacaagggcaagggttcctctctgaacggccctttctctggtctgcgtacagcagaaagctggttctgactgagtggtgggaggctggaggtgaaaggttagaagatttcggtggatcatggcgactgtaccagtgaacccaaaaccgtttctgaacaatctgacaggaaagcctgtgattgtgaagctgaaatggggcatggaatataaagggtacctggtttcagtggactcttatatgaatctacagttagccagcactgaagagtttattgatggacagttcacaggcaaccttggagaagttttgattaggtgcaacaatgttttatatttgcggggtgtgccagaagacgaagatgttgaagattgaatgaattcggaggactttagagagacaaagttgtatccacctactcgctaatttctttgacttgagtgcttaattattgagatgtgagaatatgcattgttttatacaatattcaagtctgtatttgatagtttggtgggcctagctgtaattataaatttgactatattttacatgactaatttaatttgtattttttaatcagagatttaaatctgagacaatcaacttggctgatttagaatctaaacttcaaatggtcaaagaatggtaagtctggaagcttgggttgctgtaccaagcaacaatatagtggttctgttttagaatgttaaaaatgtatgtgatctttttggtattgctttagtattctttctaaatttggttgctccaaattaaaattgattattaagcttatcaggtcttacgtattttatgatgttatgtaaacaatgttgaggtctgttgagaatactctcaaaatttcaaatgcttgaatagtgtcttcaaccctgtttcagatctgg

SEQ ID NO: 1397 - DNA, 620 bp, Cephalotaxus harringtonia
tgggattgccctgcactgcaatccacaaggcgaaaattgccattacgtcctccaaaaccagagattgctgcagaagatttgaatagatcatggcgactgtcccagtgaacccaaaaccatttctaaacaatctgactgggaagcctgtcattgtaaaattaaagtggggtatggagtacaaaggctatctggtgtcagtcgattcatatatgaatctgcagttggccagcactgaggagtatattgatgggcagttcacaggcaaccttggggaagttttgatcaggtgcaacaatgtactatatttgcgtggtgtgcctgaagatgaggatcttgaagaatgagcgcagttttagaatttgattgtttaatgagttttgtatttatcttcttcctaaccgttggttgtgaaattcccaatttaggggatctgagaagagtggcattattcagctttaactgttttttattgcatttcagtctgctattttatgtctaagtttcattatgatttccttatagttttgaatagcattttgagctaagttcaagttctagaatgtccttgccaatgtcaagctactttctgcactagaatgctgccaaggtgtaatgatttt

SEQ ID NO: 1398 - DNA, 531 bp, Chrysanthemum coronarium
aaccctctttgtccccagaagctgcaaaatctttgtctactcactatggccaccgtaccagttaacccgaaacctttcttgaacaacctgactgggaagcctgtcattgtgaagctcaagtggggaatggagtacaaaggctatcttgtctctgttgattcgtacatgaacttgcagctggcaaactctgaagaatacattgatggggagtgtactggaagccttggagagattctaatcagatgtaataatgttctctatatgcgaggtgtaccagaggatgaagaaatagaggaggcagattgagactagatggtgggcactcttgccaatagatctatcggttttatttttaccattttgttcttgtatgaagtacctgtagatgttatgatccaaacgaaactctatttagaaaacctgaaactttggccacaagtttaactagatggatgtggatccattttatcttcagtctgagtatatcagacaatgttgtatggtacttgctgtttcttttctaatgttatg

SEQ ID NO: 1399 - DNA, 495 bp, Chrysanthemum coronarium
actatggccaccataccagttaacccgaaacctttcttaaacaacttgactgggaagcctgtcattgtgaagcttaagtggggcatggaatacaaaggatatctggtctcagtggattcgtacatgaacctgcagctggcaaactctgaagaatacgttgatggggtgtgtactggaaacctcggagagattctaatcagatgcaacaatgttctctatatgcgaggtgtaccagaggatgaagaaatagaagaggcagagtgaccagctggtggacgctcttgctaccagatccatccaatttatttccattctcttgttcttgtatggaactacatgtagatgttatgatcgaaacggaacttaatttaaaaaacctgaccctttgattggcggcaagtttaactaggtcgatgtggatcccttttatcgttagtctgagtatatcagaaaatgttgtatggtacttgatgtttcttttctatgttatggcca

SEQ ID NO: 1400 - DNA, 614 bp, Chrysanthemum coronarium
acactactcgtaaaaacccttaaaccctctttgtccccaaatcgttgtttgtctactactcactatggccaccataccagttaacccgaaacctttcttgaacaacttgactgggaagcctgtcattgtgaagcttaagtggggaatggaatacaaaggatatcttgtctcagtggattcgtacatgaacttacagctggcaaactctgaagaatatgttgatggggtgtgtactggaaaccttggagagattctaatcagatgcaacaatgttctctatatgcgaggtgtaccagaggatgaagaaatagaagaggcagagtgaccagctggtggacgctcttgctaccagatccatccaatttatttccattctcttgttcttgtatggaactacatgtagatgttatgatcgaaacggaacttaatttaaaaaacctgaccctttgattggcggcaagtttagcaaggtcgatgtggatcccttttatcgttagtctgcgtatatcagaaaatgttgtatggtacttgatgtttcttttctaatgttatgaccaaaaattgaattctgttggttgatatagtttacaaaaatgttgttagaacgtcgccaa

SEQ ID NO: 1401 - DNA, 754 bp, Cryptomeria japonica
agaggtcaccaagaataagttctcgagcgcggatctcttgcgctgcgattggcgaggagaaattgtcattcatttgttacctcctgcagaaagaaaggttctcgtggcatttgagctatggcgactgttcctgtgaacccaaaaccatttctaaacaatttgactgggaagcctgttatcgtgaaattaaaatggggtatggaatacaaaggttacttggtgtcggttgattcttatatgaatctgcagttagccagcacagaagaatatattgatgggcagttcacaggcaaccttggagaagttttgatcaggtgcaacaatgtactatatttgcggggtgtgcctgaagatgaggatcttgaagaatgagcgcagttttaggtgttgattgtttagctgacatttaagtgctattttcccagtcatagagatgcaagaagaggatggatacattttaactttaaactttgtttcctaaatctcattggtcatgttgtaacttaaggttcagtgtgatatactgaaaattttggttagtaatctgcgataagttccaagctctagaatatgctctgccattggcaactactttgcaactagaatgctgccaacgtgtaatgatgttttgtcctaccaaatctttttttaattgaaaactaatcctctttgaaggaaaatgcatgtaatcttaataggcactctgtatcgttctttggttttaaattttaatggaacaacacaatttcttttt

SEQ ID NO: 1402 - DNA, 1001 bp, Cycas rumphii
caaaatgataattatatcattattattatttaaattttaacggagtaagcgaacgctgctgacgttctgcggttagactggatggcaaagtacaattgccattcggtacccctaaattttacgtttgtccagtcggacatcctctggagcaacggctctacctgtggaggctcaaggcgcataagattttgtatgatttacaaggacaagggttcctctctgaacggccctttctctggtctgcgtacagcagaaagctggttctgactgagtagtgggaggctggaggtgaaaggttagaagatttcggtggatcatggcgactgtaccagtgaacccaaaaccgtttctgaacaatctgacaggaaagcctgtgattgtgaagctgaaatggggcatggaatataaagggtacctggtttcagtggactcttatatgaatctacagttagccagcaccgaagagtttattgatggacagttcacaggcaaccttggagaagttttgattaggtgcaacaatgttttatatttgcggggtgtgccagaagacgaagatgttgaagattgaatgaattcggaggactttaaagagacaaagttgcatccacctcctcgctaatttctttgacttgagtgcttaattattgaaatgtgagaatatgcattgttttatacagtattcaagtctgtatttgatagtttggtgggcctagctgtaattataaatttgactatattttacatgactaatttaatttgtattttttaatcagagatttaaatctgagacaatcaacttggctgatttagaatctaaacttcaaatggtcaaagaatgctaagtctggaagcttgggttgctgtaccaagcaacaatatagtggttctgttttagaatgttaaaaatgtatgtgatctttttggtattgctttagtattctttctaaatttggttgctccaaattaaaattgattattaagcttatcaggtcttacac

SEQ ID NO: 1403 - DNA, 689 bp, Sequoia sempervirens
gaatagactgaagcaactgaagggtttcgtaaatttttccttgcaaactctgcccctttttttcatcggcatcggtgagagcacgacataatttgtgaataatcttgagaggttcctgtggcatttgatccctttcatcaacattagaaagaaggttacgagatttgaatagatcatggcgactgttcctgtgaacccaaaaccatttctaaacaatttgactgggaagcctgttattgtgaaattaaaatggggtatggaatacaaaggttatttggtgtcagttgattcttatatgaatctgcagttggcgagcactgaagaatatattgatgggcagttcacaggaaaccttggagaagttttgatcaggtgcaacaatgtactatatttgcggggtgtgcctgaagatgaggatcttgaagaatgagcgcagttatagattatggttgtttacgaccatttatgtgcgattttcccagtcatggagatgcaagaagagattggatatattttaacttcaaactttgtttcttaaatctcgttggccatgttgtatcttaagttacattgtgatatactgaaaattttgattagtaatctgagctaagtttcaagctttagaatgctctgccattggcaactactctgcacgctaggatgctgccaaggtgtaatgatgtttttcc

SEQ ID NO: 1404 - DNA, 573 bp, Zamia vazquezii
gctaccgggttcaatagccctaaaagtttccatcctcaacggctggagagcttctgcacggaagactggacaccctcagcacagaaggctgtagcatccgcagattttgcatgatttaggtgcacaagctctgctgcctgtgggatcttctaggccttttgccagagcaaattaacagagctgcctctgacggagtgggcgaagactggaagttaaagctctagaagatttcagtagatcatggcgaccgtaccagtgaatccaaagccatttctgaacaatctgacgggaaagcctgtgattgtgaagctgaaatggggcatggaatataaaggttatctggtttcggtggactcttatatgaatctacagttagccagcactgaagagtttattgatggacagttcacaggcaatcttggagaaattttgataaggtgcaccaatgttctatatttgcggggtgtgcctgaagatgaagatcttgaagattgagcgactttggaaggcatctttatatgattttgtgttcatagcctcactaatcttgagatgtacgaatatgtgcccttg

SEQ ID NO: 1405 - DNA, 572 bp, Prunus mume
ggaccttagagtttcgcaaaacctaaaccctcgaaaaagtccacagaaaaacctcgtctttcagctcagctcgactgaaggtgtcttctccatcgccaatggccacaataccagttaacccgaaacctttcttgaacaatctgactggaaagactgtcattgtgaaacttaaatggggaatggagtacaaaggtttcctggtctcggtggattcctatatgaacttgcagttggccaacacagaagaatatattgatggacaattcactggaaatctgggagagattttgatcagatgtaacaacgttctctaccttcgtggggtgccagaggatgaagaaattgaagaagctgaacagttacaggactgagatgattgctggatgttcgactgacatgcccgtgctatttaaagggctcttactgacaaatggttctcaaaagtcaatgaaactatgtacaaatgttgaactgaatttcctatgtgatccattgaagtctattatgcaacttagctcaatctccgcataggaaattttgaggtgggtaatcaatgtttcgattcaaagggg

SEQ ID NO: 1406 - DNA, 503 bp, Lippia dulcis
cgactgaaatcaaacccctaaaacccttggcttcggagctcgccggcgaaaaccccttttctcccaagaagcacgacaatggctactgtaccagttaatccgaagcccttcttgaacaatttgactgggaaacctgtaatggtaaagctcaaatggggaatggagtacaagggttttctcgtctctgtggattcttacatgaacctgcagctagcgaatgctgaagagtatattgatgggcagtgcacaggaagtcttggagagatcctaatcagatgcaataatgttctataccttcgtggggtaccagaggatgaagaaatagaagatgccgaagatcgtgactgattgtgtttttctgtatgcttctttggaagttagacaatttgcacattgtatttgtatcagaccaagagtatcattacttaatgcacatgccatcttcttgccatatgagatttatataattgctatgaaagatttatgtattttacaaaaaagaa

SEQ ID NO: 1407 - DNA, 859 bp, Conyza canadensis
ttgacttccaatagtcaaaaaccctaaaaacaccattcgctcaggaatctgcgaatcggctctactctacacacgaatatggccacggtaccggttaacccgaaaccgttcttgaacaacttgactggaaagcctgtgattgtgaagctcaagtggggtatggagtacaaaggttttcttgtctctgttgattcatacatgaacttgcagttggcaaactctgaagaatacattgatgggcagttgagtggaaaccttggagagattctaatcaggtgtaataatgttctctatctgcgaggtgttccagaggatgaagatttagaggaggcagatcgtgactagctggtgaacgctcttctcattaggtctattggctttattttcaacattttctgtttttgtatggaaatacctgtagatgttatgattcaaggtgtaatgatccatgtgacgctcaatttagaattctagaacctttggattggcgagaattcaattgggtggagtgtgaatccattctagactatctttactttgagtatcagacaatgttgtattcgagtcccttttcatttctttttgcaaatggctttctcctcaaacaaattaaacacatactaagtaaaaaactcaatccatgctgatatgttgcacaactagggatgtgcgaatgacccttaaacccgcgacctatacaaacccgacctggaacgaaaccgaaacacaatactacatgttttgctatctgaaaatggctgaatccattttgactttacttacaatctcaagcaagcactattctactacataacgtgtacgtttaaagttctttgccttgttctgttcgtttttggag

SEQ ID NO: 1408 - DNA, 505 bp, Rosmarinus officinalis
ccgcttcactctccaaaacgaaaaccctaaaccccttgacgctgcttcctcgcccaagaaattacctctcatcctaaaacctctgcccatggcgactgtaccagttaaccccaagcctttcttgaacaacttgactgggaagcctgtcatggtcaaactcaaatggggaatggaatacaaaggttatctcgtctctgtggattcatacatgaacttgcagcttgcaaatgctgaggaatacattgatgggcagtgcactggaagccttggagaaatcctgatcagatgcaataatgttctgtatcttcgcggtgttcctgaggatgaagaaatcgaagaagctgatcgcgactaggcatccatcggcatatcttgtatcattgtatgcctaattgaactggagtgagatcttgcatctgctcaactgagcttctattatttgtgtagtagtacttgacaaacattctatctttgttcacgtaaaatttatgcactattatcggga

SEQ ID NO: 1409 - DNA, 510 bp, Rosmarinus officinalis
cggccgggggacgcaggcttttcttcttttattttagttttaaagtagcaacccgttggattttccctctcttaaaaccctaaaccgtcgtcattcgaagccaaagagaagctccgctgctctccgagaaactgcaatggctactgttcctgttaatcctaaacctttcttgaataatctcactgggaagcctgtgatggtaaaactgaagtggggaatggaatacaagggttatcttgtttctgtggactcatacatgaacttgcagctggcaaatgctgaagaatatattgaaggacaattcagtggaagtcttggggagatactgataagatgcaacaatgttctctatctgcgtggagtttctgaagatgaagaggtagaagatgctgatcatgattagaggatagatatgcatggtagttattgcctggcaacaaagagtctcatttcttatcccttgttcctaccaagatattggaaattacatattgtatcttaatgcctttc

SEQ ID NO: 1410 - DNA, 641 bp, Rosmarinus officinalis
gccggggggaggaccgaaggagtagttttttccatatataaactatctcgatacgtcgtcggttcatccgcttcaatctcctaaacgaaaaccctaaaccccttgacgctgcgagaattcctcgcccaagaaattacctctcatcctaaaacctctggccatggcgactgtaccagttaaccccaagcctttcttgaacaacttgactgggaagcctgtcatggtcaaactcaaatggggaatggaatacaaaggttatctcgtctctgtggattcatacatgaacttgcagcttgcaaatgctgaggaatacattgatgggcagtgcactggaagccttggagaaatcctgatcagatgcaataatgttctgtatcttcgcggtgttcctgaggatgaagaaatcgaagaagctgatcgcgactaggcatccatcggcatatcttgtatcattgtatgcctaattgaactggagtgagatcttgcatctgctctactaagcttctattatttgtgtagtagttgtactcgactgacattctatctttgttcatgtaaaatttatgcactattatcaggaggacttgagcttatgatttctaatggttggtagatttttatattatattttcattatttat

SEQ ID NO: 1411 - DNA, 641 bp, Ambrosia trifida
aacatcatcagaagccctataaacgtcaatctgcaatcgattagactgttcttctccaccaatatggccaccgtaccggttaaccctaaacctttcttgaacaatttgactgggaagcctatgattgtgaaactcaagtggggaatggagtacaaaggttttcttgtctctgttgactcatacatgaacttgcagttggcaaactctgaagaatacatcgatggtcagttcactggaaatctaggagagatattaatcagatgcaataatgttctttatatacgcggtgtacctgaggatgaagaaatagacgacgcagatcgtgactagtacccttgccattagatttcaatttattttcaacatttgtgtcgccttatccaaaacgaccaatcagtttacctatacttttgattggttactagtattactgtgaatgtatcagacaatattgtatggtggttgccatttctttagtaaaagaagaggtacattctagttgttttcttctttaactgtcttgatttaatattatctcatccttggtttaaaaaagcgcgcatcgcacaaaagcgcgaggtctaagtgcatcgcgcaaaaaagcgtgagattttcgttacccaaagcacacactaattata

SEQ ID NO: 1412 - DNA, 556 bp, Malus domestica
tagagtgaagagaaaaagcgtcatctttcagctttagcttccctgaagctctcctctctctcgccaatggcgacaataccagttaaccccaaacctttcttgaacaatctgactggaaagactgtcattgtgaaacttaaatggggaatggagtacaaaggcttccttgtctcaacggatgcctatatgaacttgcagctggccaacaccgaagaatatattgatggacaatccactggaaatctgggagaaattttgatcaggtgtaacaacgttctctatcttcgtggggtgccagaggatgaagagattgaagacgctgaacaggactgagacgtgcagtaagggttggttatgaaaacagatatttaagtaatcaggattttatctctgcttttgttgttgtttaggtgcattgtatggagtggcattgccggatgtttgatttttgacaaatgcttcgtaaacgttgaatgaaccattcctttcatgtaacaaggctcgtatcgttggaagttggaaatgaaaaacctttgtagtgatttactgcacccaa

SEQ ID NO: 1413 - DNA, 612 bp, Malus domestica
aaatctttaaaaacaaaaaagtcgtctgggaattgggataaaccctaaaacctccgtagagtgaagagaaaaagcgtcatctttcagctttagcttccctgaagctctcctctctctcgccaatggcgacaataccagttaaccccaaacctttcttgaacaatctgactggaaagactgtcattgtgaaacttaaatggggaatggagtacaaaggcttccttgtctcaacggatgcctatatgaacttgcagctggccaacaccgaagaatatattgatggacaatccactggaaatctgggagaaattttgatcaggtgcaacaacgttctctatcttcgtggggtgccagaggatgaagagattgaagacgctgaacaggactgagacgtgcagtaagggttggttatgaaaacagatatttaagtaatcaggattttatctctgcttttgttgttgtttaggtgcattgtatggagtggcattgccggatgtttgatttttgacaaatgcttcgtaaacgttgaatgaaccattcctttcatgtaacaaggctcgtatcgttggaagttggaaatgaaaaacctttgtagtgatttactgcacccaa

SEQ ID NO: 1414 - DNA, 753 bp, Aristolochia fimbriata
aaccctgaaacttaaagaccaggcttgaagagagagcgaaactgatagcaccagacgaaaaagtatctggcgctgcaatgacgacacctgttaacccaaaaccttttctgaacaatcttacgggggagcctgttattgtgaaactcaagtggggaatggagtacaaaggatatcttgtgtcagtggattcatacatgaacttgcagttggccaacactgaagagtatgttgatgggcaattcactggaaaccttggagagattttgataagatgcaacaacgttctttaccttagaggtgtgccacaggatgaagaaattgaagatgcggagaaagactgagaaagcagccagctccggtagttcactcattgaagctggttttgctgttgccccatcctgatttgtggctgtactaatattctgttttcttgtgaaggatataccatggtagacgtcgatttgtagttagtgaaaaaaaaaagaaaaatcccaagggtatttaactactttgtgatccggagatgtgttataaccctaaatgtttagattaaattggtcttagtctccttttaaatctatatgtagctgcaatgttctattcagagttagaaatttgattcggtttggtgtaaaaacgttctagagataaaaatgaaatatagaccaacgtccatgagctgaaatgaacccaacttgaaccgtctctagaagcgcatggaaaagttccctcatttgtcatgaaagcgtatat

SEQ ID NO: 1415 - DNA, 732 bp, Artemisia annua
agcactgtagaagtagtggtatcaacgcagtacttaacggggaaaagaaagttttttgattcaacagttcaacacccggtgacacccgaacgcgcccttaaaagaaaagccctaaaaccctctttgtcccagctgcaatcgttaatggccaccataccagttaacccgaagccctttttgaacaacttgactgggaagcctgtcatcgtgaagctcaaatggggaatggagtacaagggttatcttgtctctgtcgattcctacatgaatttgcagttggcgaacactgaagaatacattgatgcacagttcactggaagactgggggagattctaatcagatgtaataatgttctctatatgcgaggtgtaccagaggacgaagaaatcgaggaggcagatcgtgactagctggtggacactcttgccattagatccatcagttttatcttcattctcttgttcttgtatggaactacctgtagatgttatgatttaaacgaaacttaatttagaaagcctgaacctttaattggtcgcaagtttaactaggtaaatggggatcccttttatctttagtcttatcagacaatgttgtatggtacttgctgtttcttttctaatgttatggcaaaaaaagatggtgctaaattacgcaagcgttggctctatactggaaataactatagactcatgattgaaccgctagacattggtgaatactacaaaaag

SEQ ID NO: 1416 - DNA, 749 bp, Beta vulgaris
gcacgaggccccattttccagttttccctccttcactgcgcgcagcttaagctctttgccggattgtaggacgctcttgacttgaagctaaatggcgactgtcccagttaacccaaaacctttcttgaacaatttgactggaaagcccgtcattgtgaagctgaagtggggaatggagtacaaaggttatcttgtgtcggttgatagctacatgaacctacagctggcaaatacagaagaatatattgaaggccagaagactggagatcttggagagatcctcatcaggtgcaacaatgtcttgcatcttcgtggagttcctgaggatgaggagatagatgatgcagaccaagactgaagaatacttttgtattgctcatgatacagcttggaattataccagctcatctgagaggctatatttggggaatagggggtagaaactactggctgagatggatatgattcgttctcgtatgtaaaagaatgacttaattcaagataaggaactggaatttctgttctcagatgtcatgtttatggctttaaaagagttccttaacatttcagattagaattctgagatcctgttatttgatcggactgaaaagcatcataagtgttttctatgatgtctttaaatgatacacttaactaagaatcccaatgtagaacatatgagaataattaagactttgggtgtacaatactacgggcctgttctccccagtttattttcagttcagttc

SEQ ID NO: 1417 - DNA, 632 bp, Vaccinium corymbosum
gaacgatagaatcagtcgatgcactacaccgcgtttctcactccaaaaccctagaccctcactttttccattgaatcagcggagaatctctcaacatcttccgcaatggcgactgtaccagtcaatccgaaacctttccttaacaatttgactggaaagagggtcatcgtaaaactcaagtggggaatggaatataaaggttttctcgtctcagtggattcatacatgaatttgcagctggccaacagtgaagaatacattgagggacaatttaccggaaatcttggggagattttgatcagatgtaacaacgttctctatcttcgtggggtaccagaggatgaagaagtagaagaagctgaagaagactagtcatggccctccgaactgaaatctgctttctatgatatcaatattatcaaatccctaacagtttggttagtatggttcgggattagtattagtctctatgtgctgttagttgttcagttcacaaactaaaattgttttctgtaacatgtcattgtattgagattgcatgccatttaagggtgacccgtgcttcatggcagtaaagccattctgctacttttggtttcgagcaatggaagcaatcgagcagttgtctgctt

SEQ ID NO: 1418 - DNA, 624 bp, Manihot esculenta
tttgctcgagggctcgagcaaggtgtaccggccgctcaaacagacatttccagcgccctccacccttggactcttttcgcctttctcgcgctctccatggctaccataccagttaatcctaagcctttcttgaataacttgacggggaagactgttatagtaaaactcaaatggggaatggaatataaaggttttcttgcttccgttgattcttacatgaacctacagctaggcaacactgaagaatatattgatggacaattcactggaaatttgggagagattttgatcagatgcaacaatgttctgtatcttcgtggtgtccccgaggatgaagacatagaggatgctgaacgtgactgagaaagagattggcagacattgaattgtataactgttgtagtttttaccttggattaatcccaagtgaaacctttagttgattaaaatgttacattcaacgcctagacacgagatggcttgatggtttagtcttgtcgtactattactagttaatttttgtatctcatttcaagcctgtgcagttatcatacatttcaaaatagtctttcgcaaaaattttgcgtgcatagcacaattgaattcaacaaaaccttcatacaa

SEQ ID NO: 1419 - DNA, 453 bp, Cyclamen graecum
ctcgctcttaaagaaaccctagtcttcagtcttctccttgattcaaaggcccataaaccctaattgtcttcaatggctactgtgccagtcaatccgaagccatttttgaacaatttgacgggaaagaaggttatcgtgaaactgaagtgggggatggaatataaagggttcctcgtctctgttgattcttacatgaacttgcagctggcaaacagcgaggaatatatcgagggacagttcactggaaatcttggagagattcttatcagatgtaacaacgtgctctatctccgtggggtaccggaggacgaagagatcgaagaagctgaccaggactgaggtgtcttccagtttcagtgctagcttttagtcgtggtggcccaaataggattctgatttcgattctccatttgaatgactctctttaatggtttgcacttttgcattgtatac

SEQ ID NO: 1420 - DNA, 473 bp, Echinacea purpurea
cggccgggggatccgcttcaatctcctaaacgaaaaccctaaaccccttgacgctgcgagaattcctcgcccaagaaattatctctcatcctaaaacctctgccatggctactgtaccagttaaccccaagcctttcttgaacaacttgactgggaagcctgtcatggtcaaactcaaatggggaatggaatacaaaggttatctcgtctctgtggattcatacatgaacttgcagcttgcaaatgctgaggaatacattgatgggcagtgcactggaagccttggagaaatcctgatcagatgcaataatgttctgtatcttcgcggtgttcctgaggatgaagaaatcgaagaagctgatcgcgactaggcatccatcggcatatcttgtatcattgtatgcctaattgaactggagtgagatcttgcatctgctctactaagcttctattatttgtgtagtagttgtact

SEQ ID NO: 1421 - DNA, 754 bp, Eucalyptus grandis
aagccgctccaggcgaaggggaaggtgcaaaaccctagaaacctttcgatcgggaagtagcagctgcaagcggagaagaaactcaagggagcaaaagatcgcgcctttccttctctgcgaaccccaaaaaggcctctttgcctcaccttctttctcttccaatggctactattccagttaatcctaagcctttcttgaacaacttgactgggaagccagttattgtgaagcttaagtggggcatggaatacaaaggttttcttgtctcagtggattcctacatgaatttgcagcttgccaacacagaagagtacattgatggtcaattcactggaagtttgggagagattctgatcagatgtaacaatgtcctgtatcttcgaggtgtccctgaggatgaagatcttgaagatgcaaatcaggactaattgcgattcagcttcaaacatcaaatgtttagctctacgcggtttgcgttctgagtaaagctgaatgttattcatccaagagaaccgtaatcatcaaaaacaagagctgggtttcgtgtcgtatttatgtgtctttccggagaagcatttttttgtctgaaactccaaaaatcatccatgggcttgtatatgaatttggtgggataacttgagtttaacctgaatttgactagactttagcttccaaatacgttgggcttttctgcagatcatgtgttccctgtttcttttgtctcgcaaggcaattacccaatcttcattgcaag

SEQ ID NO: 1422 - DNA, 586 bp, Actinidia deliciosa
cgcgtgagtcgtgacaaacaagtagtctagcgcgttttactttctgataaccaaagccaccccacattcgagctgtgtccgccgtttctcacccattaaaccctaaaccctcgcagagtcgtttgctccgatcatcgtctccaatggcggctgtaccagtcaatcctaaacctttcctgaataatttgactggaaagaaggtcatcgtaaagctcaaatggggaatggaatacaaaggttttctagtctcggtggattcatacatgaacttgcagctggcaaacagtgaaaaatatattgagggacaatttagtggaaatcttggagagattctgatcaggtgtaacaatgttctctatcttcgcggtgtacctgaggatgacgaaatagaagaagctgaagaagactaagtggtggatttcggcaactgagccctagtattagaattatggtttctatcgaaattaatgtcatttaccagtgtagtttgcattgtgtcggtatgacctccagtagtattctgtgctttgttaacgtttaatccattgcactgagaccattccgacactcctgactgctcacaatg

SEQ ID NO: 1423 - DNA, 501 bp, Lippia dulcis
tacgtcgtcggtttcaccactttcaatctccacagccaaaaccctaaaccctcctacctcaataaattctctcccatggcgactgtaccagttaaccccaagcccttcttgaacaatttgactgggaagcctgtcatggtcaaactcaaatggggaatggaatacaaaggtttcctcgtctctgtggattcatacatgaacttgcagctcgcgaatgctgaggaatacattgatgggcagtgcactggaagccttggagaaatcttgatcagatgcaataatgttctgtatcttcgcggtgtgcctgaggatgaagagatcgaagatgctgaccgtgattagtccgattgtatcatcgtatgcctaattgaactggtgtttgatcttgcatctgcacttctcctaagcttccatcatttgtgtagtagttgtacttgacatgcattctatctttgttcatgtaaaatttatgcacatgagctgttgaagggatatatttcg

SEQ ID NO: 1424 - DNA, 767 bp, Populus trichocarpa
gagagaacaagccctggggttttgggtcatcaaactttgacccaacaacatcaacaagcccttctaaaattttaattacaatactaaaacccattccatttaattgaccgcaaacacacacaaaccctcaaaacccttgacactccaccttctctctatctctctctctcgtttgccatggccactgtaccagttaaccctaagccttttttgaacaatctgactggaaagactgttattgtcaaacttaaatggggaatggagtacaaaggttttcttgcttctgttgattcatacatgaacctccagctgggaaatactgaagagtatattgatggacagttcactggaaatctgggagagattttgatcagatgcaacaatgttctctaccttcgtggagttccggaggatgaagacatagaagatgccgaccgagactaagaagaggtcttcaatgtctcttggtcttcaatgtactgagttaatagaactccatttccatttccatttccatttcagatatgctaatgttatatttgtgttataattagagtttcgttgtttgcctttgacatgagccatggcatttactgcacttgatggaccgattcatatcaccttatttaactctttgattgcttgcttctggattttcactaaacacctctgtttttcacctgttctagagtgatctagttgaatgatacatggattccatcatctcgtgtcacataaccatcttctagagtaggtcgtgaattgaa

SEQ ID NO: 1425 - DNA, 504 bp, Papaver somniferum
ttgtgctcatctccgaatcaatggcgagcgtacctgtgaatccgaaacctttcttaaacaatcttactgggaagacggtcatggtcaagctcaaatggggaatggagtacaagggttttcttgtttcagtagattcatacatgaacttacagcttgccaatactgaagaatacattgatggacagtttactggaaatcttggggagattctcataaggtgcaataatgttttgtatctccgtggtgtggcggaggatgaggaaattgaagatgctgataaagattgaatgggaatgctgaaggtggtttctatgtagccgcacaaccagtagcgggggaagcatcagcccattcttcttcttttatcattgatgactaagaaaattgaactccttaatcttaagatacttgaaaatctagactagtgtaagaagatgaaatatctattgactggaacatataagagcaatctaaaatgttagttctttttcaaaaaaaaaaaaa

SEQ ID NO: 1426 - DNA, 523 bp, Ipomoea nil
tgctctctccgtggaaagcttcaatggctacagtaccagtgaatcccaagcctttcctgaacaacttgactggaaagcctgtcatggtgaaactgaagtggggaatggagtacaaaggatttctggtttctgtggattcatatatgaacttgcagctggcaaatgcagaagaatacattgatggacaaagcactggaacacttggagaaatcctcatcagatgtaacaatgtcctctaccttcgtggggtacccgaggatgaagaggtggaagatgctgctgagtagaactaggaagtccacttcgtgctgtagtcatcatctggagaggcaacccgagtacaagctcatgtcaaacgatgcttcagcctatcctcagaattgcatcatgtattgggttattaaccaccttgtgtgtaattagttaatgacactaatcttttttaaggctgccttttgctgtaaaagattgtcggattatttctttcagggatggatggatgattaaggtgccaaaaaaaaaa

SEQ ID NO: 1427 - DNA, 473 bp, Marchantia polymorpha
ttcgattctcctgcttcggggctcgtggtcggtgattcgcgacgagcaatggcgactgtacccgttaatccgaagccgttcctcaacgatctgacgggaaagcctgtcatcgtgaagctcaaatgggggatggagtacaaaggatatctggtatcagtcgattcctacatgaacttgcagcttgcgagtactgaggagtatattgacgggcagttcacaggcaatcttggagaggtgcttattagatgtaacaacgtgttatacttgcgcggtgtaccggaagacgaggatgccgttgaggaagatgaataacgagttgctttcagatacgactgttgtgtagatataggacagtacaacctagagtgctctttttacagattagatacaagcttcgcactgtgaactggaattttttctttggtcgaggaccaatattcagataaagcttgggtttgcagctaaaaaaaaaa

SEQ ID NO: 1428 - DNA, 289 bp, Artemisia annua
accctctttgtccccagaagctgcaatctttgtctactcactatggccaccgtacctgttaacccgaaaccgtttttgaacaatttgactgggaagcctgtcatcgtgaagctcaagtggggaatggagtacaaaggctatcttgtctctgttgattcgtatatgaatctgcagctggcaaacagcgaagaatacgttgatgggcagtttactgggagcctcggagagattctgataaggtgtaataatgttctctatatgcgaggtgtacccgaggacgaagaaattg

SEQ ID NO: 1429 - DNA, 589 bp, Chrysanthemum coronarium
acctaaaccctctttttccccaaatcgttgtttgtctactatggccaccataccagttaacccaaaacctttcttgaacaatttgactgggaagcctgtcattgtcaagcttaagtggggaatggagtacaaaggataccttgtctcagtggattcgtatatgaacttgcagctggcaaactccgaagaatacgttgatggggtctgtactggaagcctcggagaaattctaatcagatgcaacaatgttctctatatgcgaggtgtaccagaggatgaagaaatagaagaggcagagtgattagctggtggacgctcttgctaccagatccatccaatttatttccaatctcttgttcttgtatggaactacatgtagatgttatgatcgaaacggaacttaatttaaaaaacttgaccctttgattagcggcaagtttaactaggtcgatgtggatcccttttattgttagtctgagtatatcagaaaatgttgtatggcacttgatgtttcttttctatgttatggccaaaaattgaattctgttggttgatagagtttacaaaaatgttgttagaacgtcgccaa

SEQ ID NO: 1430 - DNA, 569 bp, Chrysanthemum coronarium
caaactctgaagaatacgttgatgggcagtgaggaaaccctaaaacctctttcaacgattgtctcctctcctcctaactatggccaccataccagttaacccgaaaccttttttgaacaacctgactgggaagcctgtcatcgtgaagctcaagtggggaatggagtacaaaggctatcttgtctctgttgattcctacatgaacttgcagctggcaaactctgaagaatacgttgatgggcagtgtactggaagccttggagagattctaatcagatgtaataatgttctctatatgcgaggtgtacctgaagatgaagaaatagaggaggcaggttgagactagattggtggacacccttattagatctatcggtttcattttcaatcttttgttcttgtatggaagtacatgtagatgttctgatccaaacgaaactcaatttagaaacctgaacctttgattggccgcaagtttcactaggtggatgtggacgcctttgatctttagtccgagtatattggacaatgttgtatggtacttgcttttattttttaatgttattggc

SEQ ID NO: 1431 - DNA, 371 bp, Arachis hypogaea
tgatagagcgcagtggtatcaacgcagagtatggaggacagcttcagcagttgctgcttttagagtgcagagagaactatcgttgcgatctcatcctccaatggcgactataccagtgaatccgaagcctttcttgaacaatttgactgggaaacaagttattgtcaaattgaagtggggaatggaatacaaaggttatctagtctctgttgattcctatatgaatttgcagctggctaataccgaagaatacattgagggacaatttacaggaaacttgggagaaattttaatcagatgcaacaatgttctttacttcgaggtgtgcctaaagatgaagaaatagatgctgctgcagaagactagaatga

SEQ ID NO: 1432 - DNA, 584 bp, Citrullus lanatus
cattgtagagcatcccagttaacccgaagccgtttttgaacaatttgactggcaagactgtggttgtgaaactaaagtgggggatggaatacaaaggctttcttgtctcggtggactcgtacatgaacttgcagcttgctaatactgaggaatatatcgacggacaatttactgggagtcttggagaaatattgatcaggtgtaataatgttctttatcttcgtggagtaccggaggatgaagagattgaagatgccgagcgtgactagcatgtaaatttttggcagctcttcgttgtcgtagtagcagtaaagtatttagctttgtagttttctagtttttctttcttctgttgcttaatttgtatctttgttgttgatactaatctttaaaggtcaggaacaccctctgatttggtcgatttcagacttgcaacaattattcttgaatctgaatgtaacacctatttttcctggtagctttgaattgcttcagtttttctacgtaagatatagttgagctttttataatttgttcatgtggagtgcaatgggatggaatatattcatgacgtggtacgtctt

SEQ ID NO: 1433 - DNA, 893 bp, Prunus mume
cccacgtgccctacacaaccactcctagaaagaaagaaaaaaattcctagctcaaattgtaaaaaccctaaaaccctctttgttctctgctccactgaagctctcgtctctgcctctctcgccaatggctacaataccagttaacccaaaacctttcttgaacaatctgactggaaagactgtcatcgtgaaacttaaatggggaatggagtacaaaggttttcttgtctcagtagattcctatatgaacttgcagttggcaaacactgaagaatatatcgatggacaatccactgggaatcttggagagatattgatcagatgcaacaatgttctctatcttcgtggggtgccagaggatgaagaaattgaagaagctgaacagttacaggactgagatgtggactttggagcaatagtcttgctaatggacggaacgaaacgcaagtactagaaactcttgaacaaaacagaagttcagtaatcagtttttctctacttttgttgcttttttattttaacctggagtggttaggatgtatttgtattgtgtgtagagatagatattgttggatgttcaattgacatgccagtgtcatttaaaagggccctagctgacaaatggttttctaaacttaaatgagctccagttcgtcgctgtacaagaatcattccgttttcatgttacaaaaccatgatttgaaatggaacctttttagttattcactgcaccaaatttgaagcatttcatcatttggatgttcattgtagcatttctgtagatggcataatttactctctttattttggagatgtgacgaagatttgcaggatcttcatttttcgttttgttaactgtatgtatgaacttattttattacaacaattttaca

SEQ ID NO: 1434 - DNA, 671 bp, Prunus persica
caaattgtaaaaaccctaaaaccctctttctcctctgctccactgaagctctcgtctctgcctctctcgccaatggctacaataccagttaacccaaaacctttcttgaacaatctgactggaaagactgtcatcgtgaaacttaaatggggaatggagtacaaaggttttcttgtctcagtagattcctatatgaacttgcagttggcaaacactgaagaatatatcgatggacaatccactgggaatcttggagagatattgatcagatgcaacaatgttctctatcttcgtggggtgccagaggatgaagaaattgaagaagctgaacagttacaggactgagatgtggactttggagcagtagtcttgctaatggacggaacgaaacgcaagtactaggaactcttgaacaaaacagaagttcagtaatcagtttttctctacttttgttgcttttttattttaacctggagtggttaggatgtacttgtattgtgtgtagaggtagatatcgttggatgttcaattgacatgcccgtgtcatttaaaagggccctagctgacaaatggttttctaaacttaaatgagctccagttttgtcgctgtacaagaatcattctgttttcatgttacaaaaccatgatttgaaatggaacctttttagtta

SEQ ID NO: 1435 - DNA, 478 bp, Amaranthus tuberculatus
gtattcgcaactgctcatcgccattgttgctctcgccttcttgctcgccagccatattgaagttcgaaccaggtttgcaagacactgttgactgtgaagctaaatggctactgtccctgttaaccctaaacctttcttgaacaatttgactggaaagcctgttatagtgaagctgaagtggggaatggaatacaaaggttatcttgtgtcagttgatggctacatgaacctacagttggcaaacacggaagaatatattgagggccagaaaactggagaccttggggagattctcatcaggtgcaacaatgtcatgtatcttcgcggagttcctgaagatgaagagatagaggatgctgacagagatgactgatttgtaatgcgaggcgactttttagaaaacactctgttagtcgagaaatctactgtgttttcaggacttattgtggctcatgtaaaaccatttcgtttatgaaaa

SEQ ID NO: 1436 - DNA, 639 bp, Vaccinium corymbosum
aaagaacccgccgttttctcgctccaaaaccctaaaccccaatcaacttccaatccgaagcgtcgtttgctccgattgttgtcttctccaatggcgacagtaccagtcaatccaaaacctttcctgaacaatttgactggaaagagggtcattgtaaaacttaagtggggaatggaatacaaaggttttctcgtctcagtggattcatacatgaacctgcagctggccaacagcgaagagtatatagagggacagttcacaggaaatcttggagagattctgatcaggtgtaacaatgttctctatcttcgcggtgtacctgaggatgaagatatagaagaagctgaaccagaagactaactggtggatttccaaggtagtctagtcctgtcctggcctggcccatgatttagaagtctggtttctatcagaaatctgtatcatttacccttgccagttttgtgcctgtacttgtcccggaaatattgtagcagtttagtgcttatttagcgcaatttcttcgtatgcaattttcgatcatctaggcgtaacaggttctccatgcccagaccttgagcatatcgagatgttaatcatttggatgaatgtatttcatgtgttacataacatactgagatt

SEQ ID NO: 1437 - DNA, 575 bp, Rosmarinus officinalis
aatatctgtacgtagtttttacatataaaactccaaaccaaaaccctaaaccccttgacgctgcgagaattccccgcccaagaaattatctatcatcctaaaacctctgcaatggctactgtaccagttaaccccaagcctttcttgaacaacttgactgggaagcctgtcatggtcaaactcaaatggggaatggaatacaaaggtttccttgtctctgtggattcatacatgaacttgcagcttgcaaacgctgaggaatacattgatgggcagtgcactggaagccttggagaaatcctgatcagatgcaataatgttctgtatcttcgtggtgttcctgaggatgaagaaattgaagaagctgatcgcgattaggcatccatcggcatctatgtatcatcgtatgcctaattgaactggggtgggatcttgcatctgctctactaagcttctattttttgtgtagtagttgtacttgacatgcattctatttttgttcatgtcaaattttatgtacatgagttctgtggaaggaatatttgttttaatttcagatcaagcccagaaaatta

SEQ ID NO: 1438 - DNA, 604 bp, Malus domestica
gaaaaaccctaaaccttctcgtcaaactcgactctaccgctgaagcccctcttctctctctgtctccaatggctacaataccagttaacccaaagccgttcttgaataatctgactggaaagactgtcattgtgaaacttaaatggggaatggagtacaaaggttttcttgtctcgacagatgcctatatgaacttgcagttggcaaacactgaagaatatattgatgggcaatccactggaaatcttggagagattttgataagatgcaataatgttctttatcttcatggggtgccagaggatgaagaaattgaagatgctgaacgggaatgagttttgcagcagttatcttgcttgaaaaccagacttcggtaaccagtattttttctctacttctgctgttgcttttcttgttttaacatggagtggttagattgtatttgtattgaatgtagagttgggtatcctactatccttggatattaaatcgacatgcccgtgccctttaaaaagggctgtaactgacaaatggttctctaacttgaatgagattgtaacaagactatatgagttgaaatgaaacctttttagttattcgctgc

SEQ ID NO: 1439 - DNA, 652 bp, Daucus carota
gccacttggggagcgcagttccaaaaccctagaccctgtcaaaacctctgagcgtcacatcctctctacacaaatggctactgtaccagttaatcccaagccattcttgaacaatttaactggaaagcgtgtcatagtgaaactcaagtggggaatggaatacaaaggattccttgtctctgtggattcatacatgaatttgcagcttgcaaactctgaagaatatattgatggacagttcacaggaaaccttggagagatactgatcaggtgtaacaatgttctatatatgcgcggggtgccagaggatgaggacctggaggatgcggatcacgactagaagtcaaattctgtgacaatcaacctgtatttgagacccaggggtttagatcactgtagaatgactgcttggatttgaaatttgttaaacagcgttgtattaagttagtttttaccatgatttttgctgctcggtagaatgtgttttgcgtgctgcggtaactgcaagttcctcagtgatgccccatattaacattgaagttatattcatgtcgcgtgaaactgcatttgattggacaagttatgcgtaggggtgattggaatcgaaagattatgtaatccaccaatttcagtataactctgataaaaattt

SEQ ID NO: 1440 - DNA, 415 bp, Daucus carota
atggctactgtaccagttaatcccaagccattcttgaacaatttaactggaaagcgtgtcatagtcaaactcaagtggggaatggaatacaaagggtttcttgtctctgtggattcatacatgaatttgcagcttgcaaactccgaagaatatattgatggacagttcacaggaaaccttggagagatactgatcaggtgcaataatgttctatatatgcgaggggtgccagaggatgaggacctagaggatgcagaccgcgactagaagtcaactttcatgtatttctgcgacaaatcaacctgtacttgagttgctagggcctaaatgttgttaacaagactgatacacttaaattttgtacttactattgttagccaacatctgatgtttattgtgtcgtgtaatatcttat

SEQ ID NO: 1441 - DNA, 603 bp, Daucus carota
taaaaagtgaatcaggcttgagttgcaaaaccctaaaccccaaaagccgacgacatctgaacgtctccgatggccactgtaccggttaatcccaaaccattcttgaacaatttaactggaaagcatgtcattgtcaaactgaagtggggaatggaatacaaagggtttctcgtctctgtggattcatacatgaacttgcagcttgcaaactctgaagagtacattgatgggcagttcacaggaaacctcggagagatactgatcaggtgcaataatgttctatatatgcgaggggtgccagaggatgaggacctagaggatgcagaccgcgactaaaagtcaactttcatgtatttctgcgacaaatcaacctgtacttgagttgctagggcctaaatgttgttaacaagactgatacacttaaattttgtacttactattgttagccaacatctgatgtttattgtgtcgtgtaatatcttatttcttatattataattctagatactgggttgtatttttctagtatttatctgatggctgttagccaaatagctggcgatcttcataaggactacagactactacctatccatcgtaatg

SEQ ID NO: 1442 - DNA, 608 bp, Daucus carota
aaaaagtgaatcaggcttgagttgcaaaaccctaaaaccccaaaagccgacgacatctgaacgtctccgatggccactgtaccagttaatcccaaaccattcttgaacaatttaactggaaagcatgtcatagtcaaactgaagtggggaatggaatacaaagggtttcttgtctctgtggattcatacatgaacttgcagcttgcaaactctgaagagtacattgatgggcagttcacaggaaaccttggagagatactgatcaggtgcaataacgttctatacatgcgaggggtgccagaggatgaggatctggaggatgcagaccgcgactagaagtcaactttcatctatttctgtgacaaatcaacctgtacttgagttgctagggcctaaatgttgttaacaagactgatacacttaaaattttgtacttactattgctagccaacatctgatgcttatcgtgtcgtgtaatttcttatattgtaattctagataccgggttgtatgtttctattttttatctgatggctgttagccaaattgctggcgatctttgtaaggactacagactactacctatccaccgtaatgttatgttgcct

SEQ ID NO: 1443 - DNA, 608 bp, Daucus carota
aaaaaatcgccgcgccacttggggagcgcagttcgaaaaccctaaaccctatcaaaacctctctgcgtcacatcctctctacacaaatggctactgtaccagttaatcccaagccattcttgaacaatttaactggaaagcgtgtcatagtcaaactcaagtggggaatggaatacaaaggattccttgtctctgtggattcatacatgaatttgcagcttgcaaactccgaagaatatattgatggacagttcacaggaaaccttggagagatactgatcaggtgtaacaatgttctatatatgcgcggggtgccagaggatgaggacctggaggatgcggatcatgactagaagtcaaattctgttacaatcaacctgtatttgagacccaggggtttagatcactacagaatgactcgtgtgcttggatctgatatttgttaaacaacgttgtgttaagttagtttttaccatgatctttgctgcttgttagaatgtgttttgcttgatgcggtaactacaagttcctcagtgatgccctatattaacattgaagttatattcatgtcgcctgaaactgcatttgattgccatatcaaatattat

SEQ ID NO: 1444 - DNA, 721 bp, Manihot esculenta
gggaagcggaaaaggaattagggatttcaaactcttgaagcagcgccgggtgaagaacagagctgagtgcagcttcggccgtcgagtttcttcgaaccacaatatcagcgatctctggtgaaaggaagtttgattgatagccttgatcagcctctctcagcttctcgtgtctccatggctaccatacctgttaatcctaagcctttcttgaacaacttgactgggaagactgttattgtaaaactcaagtggggaatggaatataaaggttttcttgcttcagtggactcatacatgaatttacagcttggcaacactgaagaatatattgatggacaattcactggaaaccttggagagattctgatcagatgcaacaacgtcctctatcttcgtggtgtccctgaggatgaagacatagaagatgcagaccgtgactgacaagtgatcttcagtcattgaaatgatttcctgtagtttttcacttcaagccaatgatggtaggcatttgttgttttaatactgatattttccatgtctagagcagtatctgatttaacaaattgatagcactaagtttatcatggatttgttgcttgtggaatcgtgacctggttatatatatatacaggggcgattagatgtaaaaggcaggctgaacgtttgcggtaatttgcaattatgtccaaacttacatatatagtatttctgtggatgtgac

SEQ ID NO: 1445 - DNA, 543 bp, Chrysanthemum coronarium
ccctaaaaccctctttgtccccagaagctgctgcaatctttgtctactcactatggccaccgtaccagttaacccgaagcctttcttgaacaacctgactgggaagcctgtcatcgtgaagctcaagtggggaatggagtacaaaggctatcttgtctctgttgattcgtacatgaacttgcagctggcaaactctgaagaatacattgatggggagtgtactggaagccttggagagattctaatcagatgtaataatgttctctacatgcgaggtgtaccagaagatgaagaaatagaggaggcagatcgagactagatggtggacactcttgccattagatctatcggttttattttcaatcttttgttcttgtatggaagtacctgtagatgttatgttccaaacgaaactcaatttagacaacctgagcctttgattggacgcaagtttaactaggtggatgtggatcccttttatctttagtgagtatatcagacaatgttgtatggtacttgctgtttcttttttaattttatggc

SEQ ID NO: 1446 - DNA, 406 bp, Chrysanthemum coronarium
aatctttgtctacccactatggccaccgtaccagttaacccgaagcctttcttgaacaacctgactgggaagcctgtcatcgtgaagctcaagtggggaatggagtacaaaggctatcttgtctctgttgattcgtacatgaacttgcagctggcaaactctgaagaatacattgatggggagtgtactggaagccttggagagattctaatcagatgtaataatgttctctatatgcgaggtgtaccagaggatgaagaaatagaggaggcagatcgtgactagctggtggatactgttgccattagatctatcggttttattttcactatcatttgttcttgtatgaagtacctgtagatgttatgatccaaacgaaactctatttagaaaacctgaaactttg

SEQ ID NO: 1447 - DNA, 805 bp, Citrus clementina
atggagtcaccactttggccagtactttaccccttatgggctgacccggtgcgagcggggattagtctgggttgtgaaagcaaaaaacccttgcaagttgcaactgctccaccacagatcaagatcatcaatagaacacgcagcgacagcgtactttccttccttcctcgtccttcgatggctacgataccggttaacccgaaacctttcttgaataacttgactggaaagactgtcattgttaaactcaagtggggaatggagtataaaggtttccttgcctcagtggattcttacatgaacttgcagctaggaaatgctgaagaatatgttgatggacagttctctggaaaccttggagagatcttgatcagatgcaacaatgttctctatctccgcggggttccagaggatgaagaaatagaggatgctgatcgagactaagggatttgttcaagcattttagtcatcggctaaatagaactctgttattttaagcttaaacctgctccattgtacttgtatgtaagtttcagatgatttgtaattttactgatatattccccatgcctttcatcggggcctgacaaacaaattgatttccctttgatatgaattctggcgtttgaatgccctgtaaacttagcttcgggtaattctctcggttctttgaaaaacaatacttttgtcgggaggaatttatcattttggtacttacgctattggccagatggtcctccattgaggacaagtttgaactgaggcagtggggagctgcctgtaaaatgaaaaaaaagattttcaa

SEQ ID NO: 1448 - DNA, 475 bp, Linum usitatissimum
gggcggcgtctcggtctccagagtttcactgtcttctctctgtaatcaatggcgacagtaccagtaaaccctaagccgttcttgaacaacttaaccgggaaaactgtgatcgtgaagctgaaatggggaatggaatataaaggttttcttgcttcagttgattcctacatgaacctgcagctagggaatgctgaagagtatatcgacgggcagttcactgggaatctgggagagatcttgataaggtgcaacaatgttctctacatgcgaggagtaccagaagacgaggaaatagaggacgctgatcgtgattagaattgggctaaggatatgtaaaaggaaaccttatggttgtttttcggccactagcgtgctatgatcatggtgtactttgtattgtaagcaacagatcttgtccaaactcatgctgtctcatccattaatcaattgacaaaccggtttttattccctgtcc

SEQ ID NO: 1449 - DNA, 477 bp, Hevea brasiliensis
tttcagagctagcagatcaacaatatcggcgaggcgacctctgaaattctagcttaaagcaattttattaccttgatcagcctttctctgcttctcttttgccctccatggctaccataccagttaatcctaagcctttcttgaacaacttgactgggaagactgttatcgtaaaactcaagtggggaatggaatacaaaggttttcttgcttcagtggattcatacatgaatctacagctgggtaacactgaagaatatattgacggtcaattcactggaaatcttggggagattctgatcaggtgcaacaatgttctctatcttcgaggtgtcccggaggatgaagacatagaagatgcagaccacgactgagaagtggatttcagttattgaattggtaggcctcttgtagttcctgttcaagccaatgatggtaggcatttgttgtttaaatctgatgttgtccaagacatgt

SEQ ID NO: 1450 - DNA, 552 bp, Hevea brasiliensis
agctcaaatacgcatttcccgcaccgtccactcttggcctctatctgctctctcgcgccctccatggctaccataccagttaatcctaagcctttcttgaacaatttgactggcaagactgttatagtcaaactcaagtggggaatggaatacaaaggttttcttgcttccgtggattcttacatgaacctacagctaggcaacactgaagaatatattgatggtcaattcactggaaatttgggagagattttgatcagatgcaacaatgttctgtatcttcgtggtgttccagaggatgaagacatagaggatgctgaccatgactgaggaatggacttacagtcgttgaattatataactgtaatcccatgtgaaatctttacttggttaaaatgttatgttcaacgcatggacgcgagtgatggcttgattttttagtcatgtcgtaatattactagttaatttttgtatctcatttcaagaccgtcaaggctattttcaatcaactttaaaatagatggaatatctattagcactttcagatctctc

SEQ ID NO: 1451 - DNA, 640 bp, Humulus lupulus
aacggccacggtagcctagccacctctctctcactcgcaagttcgcaactctcctctcatactggctctcttacgaacggtttgtgatatctcagggttttgcaggcgaccactggagctccaaaagagtttctcaaaaccctagctctctgtcttctagcttcgaaaacatgagcataccagttaacccaaaacctttcttgaacaatttgactggaaagacagtttttgtaaagcttaaatggggtatggagtacaaaggttttctcgtctctgtggattcttacatgaatttgcagttggccaatactgaagaatatattgatggacagttcacaggaaatcttggtgaaattttgatccgatgtaacaatgttctttatcttcgtggagtaccggaggatgaagaaattgaagatgcggaacgggaatgaatggcagctcaactatgtggtttacatacaagggatgggaacaaaagaagagacagagaggttttgtatgtcaacactggtattaagactaagaggatgttccataaatttgtatattcaattacatttgtgctctacatttgttttaacctaaagagttcttgaggtggattttgctgtttaatgtagatgagttaattaaaggt

SEQ ID NO: 1452 - DNA, 575 bp, Tropaeolum majus
caagctctcttctttggaatttcgttaattccttctctgttcttcgatggcgacgattccggtcaatcccaaacccttcttgaacaacttgactggaaagacagttattgtaaaactgaagtggggaatggagtacaaaggctaccttgcctcagtagattcttacatgaacttgcagctaggtaatgctgaagagtatatcgaagggcaattcactggaaatttgggagagattttgatcagatgcaacaatgttctctatcttcgtggtgttcctgaggatgaagaaatcgaagacgctgacagagattagtgatgggtttccatccgcaggttgtttatggctgaattagaacgcctaaccctctttgactccatattgttaatcggctttaaaggttgatgtccgtaaacccgattagttaatcatacatgtggcttcaattaagttgttgaatgaatgcttgtgttattaggagctttgacacatacttgaagtaaaatggatttattttcattttgaactataaagcgatacaagttttttttgctatcaatggaaaaatggatgccat

SEQ ID NO: 1453 - DNA, 507 bp, Tropaeolum majus
gatcaaaacagcaagctctcgtctttgaaatttcgttaattccttctctgttcttcaatggcgacgattccagtcaatcccaaacccttcttgaacaacttgactggaaagacagttattgtaaaactgaagtggggaatggaatacaaaggctaccttgcctcggtagattcttacatgaacttgcagctaggtaatgccgaagagtacatcgaagggcaattcactggaaatttgggagagattttgatcagatgcaacaatgttctctatcttcgtggtgttcctgaggatgaagaaatcgaagacgctgacagagattagtgatgggtttccatccgcgggttgtttatggctgaactataaccgtctttgactcgatattgttaatcgcctttagaggcgtgatgtctgtaaaacccgattcgttgatcatacatttgcagaagtacggtatcaaggaaattactatggcttcaattaagttgtggttgaatgaatgcttgt

SEQ ID NO: 1454 - DNA, 955 bp, Petroselinum crispum
agcaagagaatacttacgctccgcccctttttgtacttgaccccaaattgagttgcaaaaccctaaaccccaaaaagcgctacacgaccttctcaacatctccaatggctactgtaccagttaatccgaaaccgttcttgaacaatttgactggaaagcatgtcatagtcaaactcaagtggggaatggaatacaaaggatttcttgtctctgtggattcatacatgaacttgcagcttgcaaactctgaagaatacatcgatgggcagtttacaggaaaccttggagagatactgatcaggtgcaataatgttctgtatatgcgcggggtgccagaggatgaggacctagaagatgcagatcgcgactagaagttaacttttatgtatttctgtgacaaatcagcctgtacttgagtgcctggggtttagattgtgttgacgagatctattcacttaaaatttgcacttacagttgttggacaaaatttggtggttattgtgttatgtaatatttatactataattctagctactcagttgtattatttatgttgctctggtggctgttagccggtagccccttgatgactattactttttagtcatgctccatacttatgtcattcgttggctgaaatcactttcttgtgcaccagtcatctatggtcattgacacggagagagtattataatctgtgctatcataatatcgtgaagattttaagtagtgtctcgactcctgttggtagaactctctccatgatcatggcattcatttgtatgcgttccataacaagctcttttacgttaattcaaaccttttacaataaccccaaacccgccccttaaaccttctactgtgtgaaacccctgaatatagaaagagaaagataacgccaagtgcagagctttttacggcctgctagatcttcatagttattactgcacatacc

SEQ ID NO: 1455 - DNA, 618 bp, Helianthus annuus
tgtaacaaatgataactgaaagaaaggaatgtaaattattcattgtacactgtcaaaagccctaaacattctcagtcgacgaacttgctcttctctaccatatggccaccgtaccagttaacccgaaacctttcttgaacaacttgactgggaagcctgtgatagtgaaactcaagtggggaatggagtacaaaggttttcttgtctctgttgactcctacatgaacttgcagttagcgaactctgaagaatacatcgacggccagttcactggaaatcttggagagattttgatcagatgtaataatgttctgcatttacgtggtgcgccagaggatgaagaaatagacgaggcagatcgtgactaacacccttgccctttatttttgtatggagattatatgcagatgttataattcaaaatgacaattaagaaatcgtaacttttgaccattctagactcacctaaagtatgagaatgaatagccttttctttagtaaaaaaagaggtacattctacttgtgttcttctttaactgtcatgagaacaagactttttgtctagacatatacaatggtggtgttcaaattcaagagaatttttatttttctgttttc

SEQ ID NO: 1456 - DNA, 478 bp, Tabernaemontana elegans
aaaccctaaacccgcttcacgcaaagctaaagaggagctccgctgctctccaagaagctacaatggcgactgttcctgttaatcctaaacctttcttgaacaatctcactggaaagcctgtgatggtcaaactgaagtggggaatggaatacaaaggttatcttgtatctgtggactcatacatgaacttgcagctggcaaatgctgaagaatatattgaaggacaattcactggaagtcttggagagattttgatcagatgcaacaatgttctctatctgcgaggggtgactgaggatgaagaggtagaagatgctgatcgtgattagacaatagatatccatgttggtcatatccggcaacaaagagtctaatttgttatcccatatttctatcaaaatcttggaaattacatctgtattcttaacacagctagaatattattttcctaaatacgcatcgacctctttagtgtata

SEQ ID NO: 1457 - DNA, 695 bp, Secale cereale
ccctcctccccctcgccgtcgccgtcgccgtcgtctccgcccccaaccggcggccgcgccaccagctcgtctcttccgatggcgactgtgccagttaaccccaagccgttcttacaaaacttaacagggaagatggtcatcgtcaagctgaaatggggcatggagtacaaaggataccttgtttcagtggactcctacatgaatctgcagctaagtggtaccgaggagtacattgatgggcaatgctctggaaatttgggagacatactgataagatgcaacaatgtgatgtacctccgaggtgttccagaggaggacacggacattccagatgcggcctgaagagcacatggagttttcctggttgatgcttgctgttcaatgctgaaaaagaacttcctagttggtctccatttgcgcctactggactgtattacgtacaggcggtgaactgatgttaactctagttctgcatcctgaatgagcgaatgattaacttgcatgtttgaaacggcctgattgctggtaggtcctgatcgcgccgttggatatctatatggtttgatgtctgaattgcaatgagtgtgtttgtttgtgcaatttgaactgtatttgctgagttaccgagcacggactcaagtcacatacgcagcatgacgggatgcttctgctccattgaagccaaaaaaaaagtc

SEQ ID NO: 1458 - DNA, 726 bp, Secale cereale
caggggactaccggcgcccgcgcgtcgcgtcgcgtcgcgtcgccttcgtctccgcctccaaccggcggccgcgccaccagctcgtctcctccgatggcgactgtgccagttaaccccaagccgttcttacaaaacttaaccgggaagatggtcatcgtcaagctgaaatggggcatggagtacaaaggataccttgtttcagtggactcctacatgaatctgcagctaagtggtaccgaggagtacattgatgggcaatgctctggaaatttgggagatatactgataagatgcaacaacgtgatgtacctccgaggtgttccagaggaggacacggacattccagatgcggcctgaagagcacatggagttttcctggttgatgcttgctgttgaatgctgaaaaagaacttcctagttcgcctccatttgcgcctactggactgtactacgcacaggcgttgaactgatgttaactctagttctgcatcctgaatgagcgaatgattaacttgcatgtttgaaacggcccgattgctggtaggtcctgatcgtgccgtttgatatctatatggtttgatgtctgaattgcaatgatcgtgtttgtttgtgcaatttgaaccgtatttgctgagttaccgagcatgggctcaacatacgcagcatgacgggatgcttctgctccattaaagtctttttcttgctggatgtttattgctgagtgcc

SEQ ID NO: 1459 - DNA, 781 bp, Triticum aestivum
acggcagcctctcctcctccccctcgccgtcgccgtcgccttcgtctccgcctccaaccggcggccgcgccaccagctcgtctcctccgatggcgactgtgccagttaaccccaagccgttcttacaaaacttaacagggaagatggtcatcgtcaagctgaaatggggcatggagtacaaaggatatcttgtttcagtggactcctacatgaatctgcagctaagtggtactgaggaatacattgatgggcaatgctctggaaatttgggagacatactgataagatgcaacaatgtgatgtatctccgaggtgttccagaggaggacacggacattccagatgcggcctgaagagcacatggactgttcctggttgatgcttgctgttcaatgctgaaaaagaacttcctagttcgtctccatttgcgcctactggactgtattacgtacaggcgttgaactcatgttaactctagttctgcatcctgaatgaatgaatgattaacttgcatgtttgaaacggctgattgcttattgctgataggtcctgatcctgccgttggatatgtatggtttgctgtctgaattgcaatgatcgtatttgtgcaatttgaactgtatttgctgagttcctgagcatggactcaagtcacatacccagcatgaagggatatttctgctcaatttatgtctttttctactagatgttcatgttgagtgccaaattccacaagagctctgtgtgctgtacacttgcaccgttcataggttgatgcatg

SEQ ID NO: 1460 - DNA, 445 bp, Ambrosia trifida
aacatcatcagaagccctataaacgtcaatctgcaatcgattagactgttcttctccaccaatatggccgtatcgatccttcatgcttcttttaaccctaattgaagaataccgtaccggttaaccctaaacctttcttgaacaatttgactgggaagcctatgattgtgaaactcaagtggggaatggagtacaaaggttttcttgtctctgttgactcatacatgaacttgcagttggcaaactctgaagaatacatcgatggtcagttcactggaaatctaggagagatattaatcagatgcaataatgttctttatatacgcggtgtacctgaggatgaagaaatagacgaggcagatcgtgactagtacacttgccattagatctcaatttattttcaacatttgtgtcgccgtatccaaaatgaccaatcagtttacct

SEQ ID NO: 1461 - DNA, 1167 bp, Ricinus communis
agcggggtttcctaaagtagtaggcttcttctcaggttataaaagcaacttccttgttcaacttgtctctgctgctctctccattctccatggcaaatttcttgcaactggaaaaaaagactataccagttaatcctaagcctttcttgaacaacttgactgggaagactgtaattgtaaaactcaagtggggaatggaatacaaaggttttcttgcttcggtcgattcatacatgaatctacagcttggtaacactgaagaatatattgatggtcagttcactggaaatcttggagagattctgatcagatgcaataatgttctgtatcttcgtggcgtcccagaagatgaagacatagaagatgcagaccgtgactgaaaatggggacttcagtcattgaatcaatggagaacttgtaaatttattcgtcaagcaaatgacagtaggaattttgtttttttgtcttccagtgggtagtgtttaccttgatgtcgttacatgcgaaatcttgacggcttgctttggctcgtatgtaatgtaagagagggagagagagagagagaagaaatacctggaatttacgaatatctggtatatgtccgaatggtggaggcagggttaccacgatagaaaagcccacagagatgcatgcagccagctatccaattaataaccaacatcccaaaacttgagcaaacatctctgggttaattgctccctcaatcctgacagaatctctgaactctgcaacacaaccctttctattacaatttggatcaagtcaagaaatctgaacagaatgagaacattcaaagatgagaagctcagaatatcaaatgatgcccttcttgaccatgacaaagacgggattgcgatatccgatgacgtccgcaatagttggacaggggtttcttctttacaatgcagtctgtgatgctctcaagaaggaatatccaaagtcgacaggcgatgaattatttcggtatgcgagattggtgatctccgcagtcattgcaaagattcacaccatttctgaaaactgatacattattagcaacgatgagggcaaactggatttctatgcaaaacctgacacgcgtgaaagaagaccacaatttggattgactaaattatttgttttaatgggtcatcaatcatgtggagc

SEQ ID NO: 1462 - DNA, 463 bp, Nicotiana tabacum
gcgggcccacttttcagaaaactgtaaccttgaaaagcttccatggcgacagtacagttaaccccaagccttttagaacaatttgactggaaagcctgtgatggtaaagctaaagtggggaatggagtacaaagggtacctggtctcagtggattcatacatgaacttgcagcttgcaaacgcagaagaatacattgatggacaatgcactggttctcctggagagatcctgattagatgtaataatgtcctctatcttcgtggtgtacctgaggatgacagaattggaagatggcgaccgcgactagatagtgttttgtattagtagtgtgatggttcttttggtgcaatcagatttctggttcattgaacatgatggaacaacatattcgtctgctcgaatgtattatcaattatgtgtaagctttcctagatgctgctatctaatctatatgaatgatgg

SEQ ID NO: 1463 - DNA, 418 bp, Cleome gynandra
aaatccaggcttggtttgtcttctccgatcgtcgaatcgcttattcgttcgctaatcaatggcaactatacccgtaaacccgaaaccattcttaaacaatttgacagggaagacggtgatcgtcaagcttaaatggggaatggaatacaaaggattcttggcctcagtagattcctacatgaacttgcagttgggcaatgctgaagagtacattgatgggcaattgactggaaatttaggagagatcttgatcagatgcaacaatgttttatacatgcgtggtgttcctgaagatgaggagctcgaagatgctgaataagactcaatctaatggcgaatcagaccaaagttaacctgttttgtctgaatgttagataatggtatcgaacccctaaccccatcttaagactatctattt

SEQ ID NO: 1464 - DNA, 447 bp, Avena sativa
gctcccaaacccggacgccgtccccctgccccgccctctcgctccaagcgacggcgaccttgcttctcctacgaccggctgccaacccaaccgctgccgctaccggatagacggacaccgcatcctccttgcccttcatctcgagcttcagcagatctacgcgcgcggctacgctgcttgccggcggtccaatcaacccagtgcccaaccctagccatggccactgtaccagttaacccgaagcctttcctaaacaacctgacagggaagcctgttattgtcaaactgaagtggggtatggagtacaaagggtaccttgtctctgtggactcctacatgaatctacagcttgctaatacagaggagtacattgatgggcaattctctggaaaccttggagagatactgataaggtgcaataatgttatgtacatgcgcggcgttcca

SEQ ID NO: 1465 - DNA, 270 bp, Ananas comosus
atcggaaaccctaatttttcttcaacaatggctactgtgccagttaacccgaagccatttttgaacaatttgacgggaaagaaggttatcgtgaaactgaagtgggggatggaatataaagggtttctcgtctctgtggattcttacatgaacttgcagctggcgaacagcgaggaatatattgagggacagttcactggaaatcttggagagattcttatcagatgtaacaatgtgctctacctccgtggggtaccggaggacgaagaa

SEQ ID NO: 1466 - DNA, 491 bp, Thalictrum flavum
taaaaagttaacgtaaacactctcgctcgattcttctctcttcgcttcaatggcagcaagtgtaccagtcaaccccaagcctttcttgaacaatctgactggaaagcctgttatggttaagctcaagtggggaatggaatacaaaggttttcttgtctcagtggactcgtacatgaatttgcagcagctggcgaacactgaggaatatatagatggacagttcactgggaaccttggagaaattttgataagatgcaataacgttctctatcttcgaggtgtaccggaagatgaagaaattgaagaagctgatcgagactaaatagagcattagtatgcttcggctctagtgttcatttgaagattgattgttttatgtaagaaacttatagagcacttgaccagtgatgtaattagggtctcttaactgaggtacatgttgtttgacaaaagtttgaccaattggaagcactctacacagaacacatgtt

SEQ ID NO: 1467 - DNA, 553 bp, Amsonia hubrichtii
cgctactctccaagaaactacaatggcgactgttcctgttaatcctaaaccgttcttaaacaatcttactggaaagactgtgatggtaaaactaaagtggggaatggaatacaaaggttatcttgtatctgtggactcatacatgaacttgcagctggcaaatgctgaagaatatgttgatggacaattcactggaagtcttggagagatactgatcagatgcaacaatgttctctatctgcgtggggttactgaggatgaagaggtagaagatgctgatcgcgattagaggatagagatatccatggtagtaattgccctgcaacaaagagtctcatttattatcccatgttgaaaatattggaaattacatattgtattcttagcgcttcttgaatgttattattcctaaatgtatgtcgacctctttcgtttataatgcctcaaaaagccccttgattcgaatgtttgctggtctactaaatatgatgtagtgaatctcccaaaggaaagaagttatttttgtgggaggctgttacaaatagttccgatt

SEQ ID NO: 1468 - DNA, 582 bp, Antirrhinum majus
agctcaatggctactgtaccagttaacccgaagcctttcttgaacaatttaactgggaaatctgtgatggtgaagcttaaatggggaatggagtacaaagggtttttagtctctgttgattcgtacatgaatctacagcttgcaaatgctgaagaatatattgatggacaatgcactgggagtcttggagagatcttgattagatgcaataatgttctttatcttcgtggtgttcctgaggatgaagaaatagaagaagcagatcgtgactaggttctgttttgatagcttagttgaagtatgatctggttacctgctttattggacttctagttatcccaagcaaatgcttggtgtgctctaatcacagcttaaaaaaagttttaccgtatggacatccccatattctgtcatgtggaatgctcgacaatcatgctttcataggataggctactgcacaagtatatgattatgtggtactatgagcatagagtgcgttttaatattgttgtgggatgtaattctgctgaaaaatttgtgaattcgttcgagctttcattttatatgttctatacttgttac

SEQ ID NO: 1469 - DNA, 328 bp, Ocimum basilicum
acggtaccagttaaccccaagcctttcttgaataatttgactgggaagcctgtcatggtgaagctcaaatggggaatggaatacaaaggttatcttgtctctgtggattcatacatgaacttgcagcttgcaaatgctgaggaatatattgatggacaatgcactggaagcctcggagaaatcttgatcaggtgcaataatgttctgtatctacggggcgtccctgaggatgaagaaattgaagaagccgaccaagattaggcatcatcgtatggtgcgagatggcctcctgctgattgcttagaagatttgtacttgaatcaagaac

SEQ ID NO: 1470 - DNA, 345 bp, Ricinus communis
cccttgctgccgcccaatatctcgcacccccagtttcttctttttcctcctccatggcaactataccagttaatccaaagccattcttgaacaacttgactggcaagactgttattgtcaaacttaaatggggtatggagtacaaaggttttcttgcttcagtggattcatacatgaatctacagctaggtaacacagaagaatttattgatgggcagtttactggaaatcttggagagattttaatcagatgcaacaatgttctctatctccgcggtgttccagaagacgaagaattagaagatgcagatcgtgactgagataggggcctaacagttattaaat

SEQ ID NO: 1471 - DNA, 742 bp, Catharanthus roseus
ccaaagaattcggcacgaggctaaaccgtggtccatcgaagccagagagaagctcctccgctgctctccgagaatctacaatggctactgttcctgttaatcctaaaccattcttgaataaccttactggaaagccggtgatggtaaaactgaagtgggggatggaatacaaaggttatctggtatctgtggactcgtacatgaacttgcagctggcaaatgctgaagaatatattgaaggacaattcactggaagtcttggagagatactaatcagatgcaacaatgttctatatatgcgtggggttactgaagatgaagaggtagaagatgctgatggcgattaaaggatagatatccatggtaattgccgagcaacaaaaagtactcgtctcatatcccatgtttctatcaagatattgggcattacattttatatctcaatgcctctcaaatattatttttcctaaatgctcatcaacgtccttcatgtatgatgggctaagagcacctagattctgagtatcatgtaatgaatctcacgggggaaaaattaccgaggattattaaattatggacactgcttggccagccttcatgggaggatattgttctgtttgattagtttcggggctatctgtattactgtaaaagcagcatttgtatttggccattgtcgccgccttgagcaggttaactgacatgtttttctaacgttcttctcatggcagtattttatttt

SEQ ID NO: 1472 - DNA, 871 bp, Cucumis sativus
agaaatgaagagaaattagaataaagaaaagaaagaaaaaaaccctaaacctctctccctttccctcccttgtgtcttcgactgtgcattagccgcagccctctgatcgtttcagtgcagtcgccgaccaatcccttccccatccttttcttcttcctctgccgagtttcggcggtcaacccacggcgaccaggagtcttcccttgtaacattttcggaaccatgagcataccagttaacccgaagccatttttgaacaatttgactggaaagactgtggttgtgaaactcaagtggggaatggagtacaaaggatttcttgtctcggtagactcgtacatgaacttgcagcttgccaatactgaggaatatatcgacgggcaatttactgggagtcttggagaaatattgatcaggtgtaacaatgttctttatcttcgaggagtaccagaggatgaagagattgaagatgccgagcgtgactagcatgtaaatcttagcagcttttcattgtcgcagtaacagtgaagtcaggaactttcttctttggttgatttcaaacctgcaacaatggtagattaagtattcttgactctcaaagtaacatctatgtttccgggtagcttgaattgctttagttttctatacaagaaatagttgagcttttatagtttgttcatgtggaatgcaacgggttggaatatatttgtgaccttgtactgcttagattggccaagtttcaaaatttacatgtcaccttcatctaatagcatgagtaatgtattatctacttttgtttttcccatatgtgccatagatatacgttgtgatactcttgtagatgcaaatggcaatcttgtgattctaaatc

SEQ ID NO: 1473 - DNA, 861 bp, Fagopyrum esculentum
aacgaaaccctatttcctaatgagtgatggcgccgtaaatgtttcacaattcacgctacagtcgacaatcgtctctctaaagaagtctctagccgatactcccgataggcgacagccctctctacttctcggatcgacagtctcagcctctccggccctctcggctctctctgtgccgactctctcagtcccgactttcacagtcacttacagtcacagtctcgacagtcgagtctcttggtcagactacgtcgcgtctgatctaatctcagcggaaatcaggagctttctcttaaccgtttcaagctaatggcgaccgtaccagttaacccaaaacctttcctcaacaatcttactgggaagcgtgttattgttaaattgaagtggggaatggagtataaaggttttcttgtttctgttgactcatatatgaatctgcaattggctaacacagaggagtacattgagggggagcatactggagatttgggagagattcttatcaggtgcaacaacgtgctatatcttcgtggggttcctgaagacgaggaactagaagatgctgatcgagactgaagagggtttgaatttgctgctctttggacgtttatgaggagcttatttgtagtgaacaaatctattgttattctgggggagcccataacttgtgaattgccatctaattaatgtggaaaagaaaggcgatgcttatggcatcttgaggccagggatatttaggctgagtttattgtatcgtctctttattcggtgtgctaagttgatattaaattgtttgcttttgctcactgtcggatcatccgatcctgaatattgaggctgatcaaccatatcggttctact

SEQ ID NO: 1474 - DNA, 723 bp, Fagopyrum esculentum
cttggaggtggattcaaacgaaaaccctaaacccaagtacttctcgacgccaaacacccgaagttctgtcccctcggcgccatctccctcttcttgcccgtcgattcttccgtcagatcgttgttcgcagctttctcggtttttatttagaggaaatcaggagctttctcttttccctttcgcgctaatggcgactgtaccagttaacccaaaacctttcctcaacaatctaactgggaagcgtgtcattgttaaattgaagtggggaatggagtataaaggttttcttgtttctgttgactcatatatgaatctgcaattagctaacacagaggagtacattgagggggagcatactggagatttgggagagattcttatcaggtgcaacaacgtgctgtatcttcgtggggttcctgaagacgaggaactagaagatgctgatcgagactgaagagggtttggatttgacaagctcttgttcactctacatttaagataagtttcagctttgctactctttggaagtttatgaggagcttattcgtagtgaacaagtctggtggtattctgggggagcccataacttgtaaattgccatctaattactgtggaaaagaaaggccatgtttatggcatcttgaggtcagagatatttaggctaagcttattgtatcgtgcctttcttcggtgtgctaagttgatattaaattgtttgctttt

SEQ ID NO: 1475 - DNA, 722 bp, Fagopyrum esculentum
aggtggattcaaaggaaaaccctaaacccaactacttctcgacgccaaacacccgaagttcagtccgctcggcgctatctccctcttgttgcccgtcgattcttccgtcagatcgttgttcgcagctttctcggtttttatttagaggaaatcaggagctttctcttttccctttcacgctaatggcgactgtaccagttaacccaaaacctttcctcaacaatctaactgggaagcgtgtcattgttaaattgaagtggggaatggagtataaaggttttcttgtttctgttgactcatatatgaatctgcaattagctaacacagaggagtacattgagggggagcatactggagatttgggagagattcttatcaggtgcaacaacgtgctgtatcttcgtggggttcctgaagacgaggaactagaagatgctgatcgagactgaagcgggtttggatttgacaagctcttgttcactctacgtttaagataagttcaggtttgctactctttggaagtttatgaggagcttattcgtagtgaacaagtctggtgttactctgggggagcccatagcttgtaaattgccatctaattactgtggaaaaggaaggccatgtttatggcatcttgaggccagggatatttaggctgagcttattgtatcgtgtctttattcggtgtgctaagttgatattaaattgtttgctcttgctct

SEQ ID NO: 1476 - DNA, 694 bp, Fagopyrum esculentum
aacacccgcagttctgtcctctcgtcggcgccatctccctcttgttgccggtcgattctcccgtctcgttgttcgcagctttcttggtgttcatctagcggaaatcaggagctctctcttttccctttcaagctaatggcgactgtaccagttaacccaaaacctttcctcaacaatcttactgggaagcgtgtcattgttaaattgaagtggggaatggagtataaaggttttcttgtttccgttgactcatatatgaatctgcaattggctaacacagaggagtacattgagggggagcatactggagatttgggagagattcttatcaggtgtaacaacgtgctgtatcttcgtggggttcctgaagacgaggaactagaagatgctgatcgagactgaagaggatttggatctgacaagctcctgttcattctacatttaagataagtttcatctttgctgctcttcggaagtttatcaggagcttattcgtagtgaacaagtctggtgttattctgatggagcctgtaacttgtgaattgccatctaatcactgtggaaaagaaatgcgatgtttattgcatcttgaggccagggatatttaggcttgagcttattgtgtctttatttggtgtgctaagttgatattaatgattgcttttattcactagctgatcgtctgatcctagaa

SEQ ID NO: 1477 - DNA, 877 bp, Cucumis melo
acagttaagaaatgaagagaaattagaataaagaaaagaaacgaaaaaaaccctaaacctctctccctttccctcccttgtgtcttcaaccgtgcattagccgcagccctctgatcgtttcagtgcagtcgccgaccaagcccttccccatcgttttcttcttcctcttccctgtttcgaccgtcaactcacgtcgaccacgagtccgcccttgtaacatttcggaaccatgagcatcccagttaacccgaagccatttttgaacaatttgactggaaagactgtggttgttaaactcaagtggggaatggagtacaaaggatttcttgtctcggtggactcgtacatgaacttgcagcttgccaatactgaggaatatatcgacgggcagtttactgggagtcttggagaaatattgatcaggtgtaacaatgttctttatcttcgaggagtaccagaggatgaagagatagaagatgccgagcgtgactagcatgtaaatcttagcagcttttcgttgtcgcagtaacagtgaagtcgggaactttcttctttggttgatttcaaacctgcaacaatggtagattaagtattcttgactctcaaagtaacatctatttttccgggtagcttgaattgctttagttttctacaaaagaaatagttgagcttttaatagtttgttcatgcggaatgcaaagggttggaatatatttgtgaccttgtacttcttagattggccaagtttcaaaatttacatgtcacgttcatctaatagcatgaataatgtattatctacttgtgtttttcccatatgtgccatagatacgttataatactcttgtagatgcaaatggcaatcttgtgattctaaatc

SEQ ID NO: 1478 - DNA, 659 bp, Mimulus guttatus
gctctcactcttttgctctccaaaaccctaacccagcatccgcaagcccttgaaagatcttcgctccatatccagagaagaacagctccaatggctactgtaccggttaaccctaagcctttcttgaacaatttgaccgggaaacctgtgatggtaaaactcaaatggggaatggaatacaaaggttttcttgtttcagtggattcatacatgaacttacagcttgcaaacgccgaggaatatattgatgggaaatgcactggaagtcttggagagatcttgatcagatgcaacaatgttctttatcttcgtggtgtgccggaggatgaagaaatagaagaagccgatcaagactagtaggggttggttgcgtttcgtatcttttagtactgaaactaaaagaggctcgtcgttatttgcatgcttgtattatttccaaaagtataccttctagctataaatctgtcctaattcactttttcaattcttgtaatgaatgtattatgactgtttgatagttattgctttgatagtataagaccatattttgtagttgggttgtgtggatttggatattaaagtaggattttcgtggtaactattataatttatttgcttaacttttatctggaaaataaatactaaccagatttattttt

SEQ ID NO: 1479 - DNA, 717 bp, Carica papaya
aaatgtatcggctatctataaacctctaaaccctgcgaagagtagacggaagatcttctccgagttcttctcttcgtcttcttcaatggcgactataccagttaaccccaaacccttcttgaacaacttaactgggaagacagttattgtaaaattgaagtggggaatggaatataaagggtttctagcctcagtggactcttacatgaacttgcagctgggaaatgctgaagaatatattgagggacagttcacaggaaatctgggagagattttaatcagatgcaacaatgttctttatcttcgcggggtgccagaggatgaagaaattgaagatgctgaccgagactaattacctttttgaacattagcttggccttcggtagcaagctctggttttctttcatgtcaagcatgtattatactttatcattgttgggcgtgttaaacggacttgtgattcctggatacctatgtcatttacagacccttaatgcaagaaacttcaaaactgaattctttcttgttttcagttgtatgattttgtactggttatcgttgtctgggaatctactttatatcagataggttatatttttccaagtgtggatagacagacttgttgttacaagtgcaacctcggagcgaaacattatttatgatcatattgtgaatgcagttatttatttatcttgagatatagttggaatttagatg

SEQ ID NO: 1480 - DNA, 502 bp, Eutrema halophilum
acaataaggagttgtttgttttctcccaatcttcgactcgtctcttctttcgctaagtaatggctacgataccagtaaacccgaaaccattcttgaacaacttgaccggaaagacagttattgttaagctcaaatggggaatggaatacaaaggttaccttgcctctgttgactcctacatgaacttacagctgggaaacaccgaggaatacattgacggccaattgacgggaaaccttggtgagatcttaatcagatgcaacaacgttttgtacgtgcgaggtgtgccagaagatgaagaactcgaagacgctgatcaagactagcctgtgcttgaggacttagatatcaccagtctgtttgaaccttcattgtattctatcagcattttaatacaatttgtgagatttcagtatgctgttcttgaatcttttgagatgttgatacgtttaaaactgaaagtcacaagctgtttagcgaaatgaaagaccaaacttcttgc

SEQ ID NO: 1481 - DNA, 587 bp, Triphysaria pusilla
cgctaacccagcctccacctctgaccttcattatttacccgttctgcatcccgtagatacaaatctgcaaagccctaaaaccccaccgcttcgaagctcccaagcacatcaatggcgactgttccagttaatccgaagcctttcttgaacaatttgactgggaagtcagtaatggtgaaactcaaatggggaatggaatataaaggttttctcgtctctgtggattcatacatgaatttgcagcttgcaaatgccgaagaatatatcgatgggcagtgcacaggaagtctcggggagatcttaatcagatgcaataatgttctttatctacgtggggtgacggaggatgaagaaatcgaagaagcagaacaggactaggccaatttctagtagcctttggggtttaatctcttttccttcatttcattaaactgaaaaaaaagcaacttgtatctgtatcagagctaagagaattaatcacccctatttttaatttcgtgttgggcaaaaaaatattcagatcgatcatgttataacatgaattatgtagattttcctggtattatattgctaaggaacaaggtgtc

SEQ ID NO: 1482 - DNA, 528 bp, Triphysaria pusilla
aaatctgcaaagccctaaaaccccaccgcttcgaagctcccaagcacgacaatggcgactgttccagttaatccgaagccttttttgaacaacttgactgggaagtcagtaatggtgaaactcaaatggggaatggaatataaaggttttctcgtctctgtggattcatacatgaatttgcagcttgcaaatgccgaagaatatattgatgggcagtgcacaggaagtctcggggagatcttaatcagatgtaataatgttctttatcttcgtggggtgacggaggatgaagaaatcgaagaagcagaacaggactaggccaatttctagtagcctttggggtttaatctcttttccttcatttcattaaactgaaaaaaaaagcaacttgtatctgtatcagagctaagagaattaatcacccctatttttaatttcgtgttggacaaaaaaatattcagatcgatcatgttataacatgaattatgtagattttcctggtattatattgctaaggaacacggtgtc

SEQ ID NO: 1483 - DNA, 556 bp, Zostera marina
ggtttgaatttctttcgcatttgtcgtaactgttttcagtttcggatttgagcagagatctagcttcttcgatggcgactgtacctgttaatcccaaaccatttttgaacaacttgaccgggaagcatgtgatcgtaaagctcaagtggggaatggaatacaaaggttttcttgtatcgatcgattcttacatgaacttgcagcttgcaaatactgaggaatttattgatggacaattcacaggaaaccttggtgagattttaataaggtgcaacaatgttctttatctaagaggtgttcctgaagatgaagatattgaaggcgtcaatcaagattgatttctttggagttgggacgtgatgatatccaaaataacaacattgtcggatgattaaaacatttgttaaaagtcttattcctctcttcaggaacagttttaaacccatcttatgagtgtttgtgggaagatttatgtaactccaaacacgggatcgggatggttcttattgtatttgtatcttactttggggatggttttatttttaaacatgatttg

SEQ ID NO: 1484 - DNA, 657 bp, Papaver somniferum
ttcaaaactgacttcttctgccttaaaaccctaaagaaggcgcaacactcctcgcagaagtgcagagttcctccagctagttccaatcaatggcgagtgtacctgttaatccaaaaccttttctgaataatctcactgggagccctgtcatggtgaagctcaagtggggaatggagtacaaaggttttcttgtttcggttgattcatatatgaatttacagctagctaacactgaagagtacattgatggacagtttactggaaatcttggagagattctcatcaggtgtaataatgttctgtatcttcgtggtgttccggaggaaattgatgctgatgaagattagatggttccggaggaaattgatgctgatgaagattagatggtaatgatattatcaccagccctcaccctcaccccctccacagaagtcaccaccatcttcttctcttgttctgcctgtgcttttattaactaaatgatgttaactaccatgtaagaattttaccatactactgaagatagcaagggagactcatgctgtgctatttttattttattttaccccttaggctgaggtgcatggtgtcacagtggaataggcatcttttgttgacgtattttagtgatgaaatttggtttttggcttgtgctcg

SEQ ID NO: 1485 - DNA, 415 bp, Brassica juncea
aaaaccctaagcagagatcgaagataagaagaagcagaacaaagagaagcgatttgtttcctcccactcttcgattcgtctcttcgtttcatcactcatggctaccataccagtaaacccgaagccgttcttgacaacttaaccggaaagacggttatcgtcaagctcaaatggggaatggaatacaaaggtttcctcgcctctgttgactcctacatgaacttgcagcttggaaacactgaagaatacatcgatggacagttgacagggaacctcggagagatcttgatcagatgcaacaacgttttgtatgtccgaggtgtgccagaagatgaagaactcggggatgctgaacaagactagcttggtaccaaggacgtagagttcgccagtctgtttgaagtcttgttgtatt

SEQ ID NO: 1486 - DNA, 378 bp, Coffea canephora
tgatacagaagctcccctgctctccagacaactataatggctactgtaccagttaatcctaaacctttcctgaacaatcttactggacagcctgttatggtaaagctcaagtggggtatggagtacaaaggttttcttgtctctgtggactcatacatgaacttgcagctagcaaatgctgaggaatatattgaggggcaggttactggaaatcttggatagattctgatcagatgtaataatgttctctatattcgtggagttccagaagatgaagaagtagaggatgctgatcgagattaggagcttctgcagtaaaatgatttcagatgaaacatttgattttttatcccggcatcctatcttcctgtgggaata

SEQ ID NO: 1487 - DNA, 635 bp, Saccharum officinarum
ttcacatctctcatcatccctacaccaggacaaattcgcttattctccaaatttcaatccacgccgacgatcgacgacaaccactgctgtgttctccaatggcgactgtgccagttatcccaaaacctttcctgaacaatctaacagggaagcctgtaattgtcaaactcaagtggggtatggagtacaaaggctatcttgcttcggtggactcctatatgaatctccacattgccaacactgaggagtacattgatgggcaattctctggatatctgtgagagattctaatctggtgccaacaacgtcctgtatctccgacgcgttccttaggatgcacatattaatgatgccgagtgagaagatgtgatcaatgttatttcgatacctggcatatgattcggacatgtatgtttgaattatgccagtgaatttcgtttgactatggcggtgacactaccagctaaccgatcctagcaatgatcttttaagtgactaaacttgattcaccctacgcttcgaggtcgatcattcaacctgcttcaaattacactcagctttctcttcgcgtcgcatctaagcactttctcatttcttgtcctaccaggggtgcggcaccctagcagcatacctta

SEQ ID NO: 1488 - DNA, 649 bp, Panicum virgatum
atggattcttgctttgtgcaggctgctgtgccagtcaaccctaaacctttcttgaacaacctaacagggaagcctgtaattgtcaaacttaagtggggtatggagtacaaaggttatcttgtttctgtggactcctacataaatcttcagcttgctaacacagaggagtacattgatgggcaattctctgggaacctgggagagattttgatcaggtgcaacaatgttctgtacctccgaggtgttccagaggatgctcagatagatgatgcggactgagaagacttgaacggtgcttagatggattgatcattgatgtaattttattctgacgtgtgtttgggtgtgccggggacaacctattctgccggggacccacgaccgtctttgtgtcgcttgctaccatgtacttacaaatgcaaatgcagacatcttgtcaccccgagggccaaggcggcgatactactccaccagccccactgccggaaatcgagtgtttgctgattgctgagtgtatttttgtttgccgagtgttttatctcgggcactcggtaaagagattatttgccgagtgttctatttttgcactgtaccactcggtaaatgacaaattcaaagcatattatggaagcagtaaaataattcaagt

SEQ ID NO: 1489 - DNA, 566 bp, Fagus grandifolia
cagacagacgcacgcatatagattaagaaaagaaaacacacacacagacggaaacgaaagaggaaacggtacacagacgcagacgagaaagaggcatagcattgggcgattgctctagaattgttgaaccctagagatggcggcggctataccagttaacccaaaacctttcttgaacaatttgaccgggaagcctgtcattgtgaaactcaagtggggaatggagtacaaaggttttcttgcctcagtggattcatacatgaacttgcagttggctaacactgaagaatatattgatgggcaattcactggaaatctgggagagattttgatcagatgtaacaatgttatctatcttcgcggagtaccagaggatgaagaaattgaagaagctgatcaagactaagaaacggtgcatccctacagttcagtcatagcacctacattgtgcatgtatcccatgtagtagaggtcttctggatgttccatcactcatgctaacaatgccttataaatcactcatagacgtgttgttcccttgagttggttctgattgcctgccctgt

SEQ ID NO: 1490 - DNA, 472 bp, Arabidopsis lyrata
ctctttctctcccaatcgtcgtatcgtcgtctcttctttggctatctcatggcgaccattccggttaacccgaaaccattcttgaacaacttgaccggcaagactgttatcgtcaagcttaaatggggaatggaatacaaaggtttccttgcctctgttgactcctacatgaacttgcagctgggaaacaccgaggaatacatcgatggacaattgacagggaaccttggagagatcttgatcagatgcaacaatgtcttgtatgtccgaggtgtgccagaagatgaagaacttgaagatgctgatcaagactagaggacttagaaattgccgcccgtctgtattttttagtcttgtattctaatgagcaattcaacccagtttgtgagatttcagtatgatgttcttgaatcttttgactttgttgatacctcgaatgtaacaagccgtttagttttatgataaaaccaac

SEQ ID NO: 1491 - DNA, 471 bp, Arabidopsis lyrata
ccaaaaacctcccgacaaatcttcgttcgctgctaactcatggctaccataccagtaaacccgaaaccattcttgaacaacttgaccgggaagacggttatcgttaagcttaaatggggaatggaatacaaaggttttctcgcttctgttgactcctacatgaacttgcagctgggaaacaccgaggaatacatcgatgggcaattgacaggaaaccttggagagatcttgatcagatgcaacaacgtcttgtatgtccgaggcgtgccagaagatgaagaacttgaagatgctgatcaagactaacctgtgctgatgtcgcaaaattctcaagtttgtgttttaccttgaaagtaacaagccatttagttttatgtaatactaaacgaatcttgccggtattttttttaaccatcttcagtttaccacccgtcataagccgtgatatgtcatgtgatcctccagatatgt

SEQ ID NO: 1492 - DNA, 400 bp, Arabidopsis thaliana
cgtatcgatatttgttctcccagatcttcgtttcgtctcttcgttctcaaactcatggcgactattccggttaacccgaaaccattcttgaacaacttgaccggcaagactgttatcgtcaagcttaaatggggaatggaatacaaaggttttctcgcctctgttgactcctacatgaacttgcagctgggaaacaccgaagaatatattgatggacaattgacagggaaccttggagagatcttgatcaggtgcaacaatgttttgtatgtccgtggtgtgccagaagatgaagagcttgaagacgctgatcaagactaacctgtattgagtacttagaaattgcaagtctgtgtgttttaatttttgtattctgtgagcactttaatcttagtgtgat

SEQ ID NO: 1493 - DNA, 421 bp, Brassica juncea
aaaaccctaagcagagatcgaagataagaagaagcagaacaaagagaagcgatttgtttcctcccactcttcgattcgtctcttcgttccatcactcatggctaccataccagtaaacccgaagccgttcttgaacaacttgaccgggaagacggttattgttaagctcaaatggggaatggaatacaaaggtttcctcgcctctgttgactcctacatgaacttgcagcttggaaacactgaagaatacatcgatggacaattgacaggaaacctcggagagatcttgatcagatgcaacaacgttttgtatgtccgaggtgtgccagaagatgaagaactcggagacgctgaacaagactagcctgtgccagtggacttagaaatcgccagatcttgttgtattctatgagcatcttaa

SEQ ID NO: 1494 - DNA, 579 bp, Brassica juncea
aagcagagatcgaagcagaagaaggcaggaaggagcgatttgtttcatcccaaatcttcgactctcatctcttcgtttcccccctaaaaccatggctaccataccagttaacccgaagccgttcttgaacaatttaaccggaaagacggttatcgttaagctcaaatggggaatggaatacaaaggtttcctcgcctctgttgactcctacatgaacttgcagctggggaacactgaggaatatatcgatggacagttgacaggaaacttgggagagatcttgatcagatgcaacaacgttttgtatgtccgaggtgtgccagaagatgaagaactcggggatgctgaacaagactagcttggtaccaaggacgtagagttcgccagtctgtttgaagtcttgttgtattattctatgagcgttttaacacccaatttgtgagatttcagcttttactactcctgaatcttttgaggaacccaacttcttaccggttttctgttattgggaaggaatgcttgtcgtttttatctctttcttagacctcaatctacgaaagaccacagtgtgggccacat

SEQ ID NO: 1495 - DNA, 546 bp, Brassica juncea
cccaaaaccaaaaaccctaagcagagatcgaagcagaaggaaggcgatcccaatcttcgattcatctcttcgcaccccaaaaccaatggctaccataccagttaaccctaagccgttcttgaacaatttgaccgggaagacggttatcgttaagctcaaatggggaatggaatacaaaggtttcctcgcctctgttgactcctacatgaacttgcagctggggaacaccgaggagtatattgatggacagttgacaggaaaccttggagagatcttgatcagatgcaacaacgttttgtatgtccgaggtgtgccagaagatgaagaactcggagatgctgaacaagactagcctgtgccagtggacttagaaatcgccagatcttgttgtattctatgagcatcttaacccaacttgtgagatttcagctttgctgttgactgttgttgaatcttttgataccttgaaactaaagaaagccacaagccgttttagttgtctgagaaaccaaacttcttgccgattttttggtgaatcttcccgcg

SEQ ID NO: 1496 - DNA, 400 bp, Brassica oleracea
aaaaccctaagcagagatcgaagcagaaggaaggcgatcccaatcctcctcgattcatctcttcgctccccccaaaaccaatggctaccataccagttaaccctaagccgttcttgaacaatctgaccgggaagacggttatcgttaagctcaaatggggaatggaatacaaaggtttcctcgcctctgttgactcctacatgaacttgcagctggggaacaccgaggagtatattgatggacagttgacaggaaaccttggagagatcttgatcagatgcaacaacgttttgtacgtccgaggtgtgccagaagatgaagaactcggggacgccgaacaagactagtctgtaccaaggaaagtagaaatcgccagtctgttttaagtcttgttgtattc

SEQ ID NO: 1497 - DNA, 387 bp, Brassica oleracea
gaagctaagaagacaatttgtttcctcccactcttcgatacgtctcttcgttccatcattcatggctaccataccggtaaacccgaagccgttcttgaacaacttaaccggaaagacggttatcgttaagctcaaatggggaatggaatacaaaggtttcctcgcctctgttgactcctacatgaacttgcagcttggaaacactgaagaatacatcgatggacaattgacagggaacctcggagagatcttgatcagatgcaacaacgttttgtatgtccgaggtgtgccagaagatgaagaactcggagacgctgaacaagactagcctgtgcccgtggacttagaaatcgccagatcttgttgtattctatgagcatcttaacc

SEQ ID NO: 1498 - DNA, 557 bp, Brassica rapa
tcatagaaaccgaaaaaccctaagcagagttcgaagctaagaagacaatttgtttcctcccgttcttcgattcgtctcttcgttccatcactcatggctaccataccagtaaacccgaagccgttcttgaacaatttaaccggaaagacggttatcgttaagctcaaatggggaatggaatacaaaggttttctcgcctctgttgactcctacatgaacttgcagcttggaaacactgaagaatacatcgatggacaattgacagggaacctcggagagatcttgatcagatgcaacaacgttttgtatgtccgaggtgtgccagaagatgaagaactcggagatgctgaacaagactagcctgtgcctgtggacttagaaatacccagtcttgttgtattctatgagtatcttaacccaacttgtgagatttcagctttgcttttattgaatcttttgataacctcacaagctgtttagatgtgtgacaaaccaaactccttgtggttttctgtaaatagaatggaatgcgtgtcgttttttaccatcgttttaag

SEQ ID NO: 1499 - DNA, 667 bp, Brassica rapa
ttagcaaagaatcttaaatccccaaaaccaaaaaccctaagcagagatcgaagcagaaggaaggcgatcccaatcttcgattcatctcttcgctccccccaaaaccaatggctaccataccagttaaccctaagcccttcttgaacaatctgaccgggaagacggttatcgttaagctcaaatggggaatggaatacaaaggtttcctcgcctctgttgactcctacatgaacttgcagctggggaacaccgaggagtatattgatggacagttgacaggaaaccttggagagatcttgatcagatgcaacaacgttttgtacgtccgaggtgtgcctgaagatgaagaactcggggacgctgaacaagactagtttgtaccaaggaaagtagaaatcgccagtctgttttaagtcttgttgtattctgtgagcatctttaacccaatttgcagttcttgaatctttgtgagatggttgatacctttaaactaaaacgttgcaagctgtttttctctttatgagaaaccgaacttcttggcgtttttctgttattggaaaggaatgcttgtcggatttttatctttatcagacctcaatccacggccctctatgtggcgctatatgagtgtaatcaactggccactttcatagaaactcgatgaccc

SEQ ID NO: 1500 - DNA, 563 bp, Bupleurum chinense
ggtgaaggtccaaaaacccctaaaacccccaaagtcctctacctttcctctcggcgagcatcaatggctactgtaccagtgaatcctaaaccattcttgaacaatttaactggaaagcgtgtcatggtcaaattgaagtggggaatggaatacaaaggatttcttgtctctgtggattcatacatgaacttgcagcttgcaaactctgaagaatatatcgatggtcagttcacaggaaaccttggagaaatattgatcaggtgtaataatgttctatatatgcgcggggtgccagaggatgacgacctagaggatatagatcgcgactagaagtcgatgcttattcatttctgtgacaagtcaacctgtatttgagtatctgaggtttagatttccttcacaagacctatatgattatcatgtaatgttagttctcatacagttgtagctacttggcagttgtatttgggtttgctcgggtagctgtaagccccgtcagatggagggatggactattgcttttaagtcatgctcaaatattacatgttgcctctatcttatgt

SEQ ID NO: 1501 - DNA, 404 bp, Bupleurum chinense
tacctttcctctcggcgagcatcaatggctactgtaccagtgaatcctaaaccattcttgaacaatttaactggaaagcgtgtcatggtcaaattgaagtggggaatggaatacaaaggatttcttgtctctgtggattcatacatgaacttgcagcttgcaaactctgaagaatatatcgatggtcagttcacaggaaaccttggagaaatattgatcaggtgtaataatgttctatatatgcgcggggtgccagaggatgacgacctagaggatatagatcgcgactagaagtcgatgcttattcatttctgtgacaagtcaacctgtatttgagtatctgagttgtatttgagttgctcgggtagctgtaagccccgtcagatggagggatggactattgc

SEQ ID NO: 1502 - DNA, 612 bp, Theobroma cacao
ttcaagaagacaaaaaccctaaaactctctcgaaaccaaaagcaaaaggctcgaagccccaactctccgcttagcgctgaagcgtcctccccttgtcttcaatggctacaattcccgttaacccgaaacctttcttgaacaatttgactggaaagactgttatagtgaagctcaagtggggaatggaatacaaaggttttctcgcctcagttgattcttacatgaacttgcagcttggcaatgctgaagagtatgttgatgggcaattcactggaaatctgggggagattttgatcagatgtaataatgttctctatcttcgtggggtaccagaagatgaagatatagaagatgctgatagggactagattggttctcttatagtttaggtggaacttttggctgttcaatcaaaagctgctgtagcattttaatatcatgattggaggtcattgtcttacctgacaaacaaactgctatgtagtcaactttgccatgattgaccgcccttactaacattatttggaatatgtatcttttagatttaagctaaatgtcttgtggcgcaaacatggttagccatgtggttaatattgtgtttgaaaaccattt

SEQ ID NO: 1503 - DNA, 521 bp, Brassica napus
gaaaaaccctaagcagagatcgaagctaagaagacaatttgtttcctcccactcttcgatacgtctcttcgttccatcatttatggctaccataccggtaaacccgaagccgttcttgaacaacttaaccggaaagacggttatcgttaagctcaaatggggaatggaatacaaaggtttcctcgcctctgttgactcctacatgaacttgcagcttggaaacactgaagaatacatcgatggacagttgactggaaacctcggagagatcttgatcagatgcaacaacgttttgtatgtccgaggtgtgccagaagatgaagaactcggagacgctgaacaagactagcctgtgcccgtggacttagaaatcgccagatcttgttgtattctatgagcatcttaacccaacttgtgatatttcagctttgctgttgttgaatcttttgatacctcgaaactaaagaaaagccacaagctgtttagatgtttgacaaaccaaactccttgcggttttctgt

SEQ ID NO: 1504 - DNA, 611 bp, Brassica napus
gcagaaggaaggaaggcgatcccaatcctcctcgattcatctcttcgctccccccaaaaccaatggctaccataccagttaaccctaagcccttcttgaacaatctgaccgggaagacggttatcgttaagctcaaatggggaatggaatacaaaggtttcctcgcctctgttgactcctacatgaacttgcagctggggaacaccgaggagtatattgatggacagttgacaggaaaccttggagagatcttgatcagatgcaacaatgttttgtacgtccgaggtgtgccagaagatgaagaactcggtgacgctgaacaagactagtttgtaccaaggaaagtagaaatcgccagtctgttttaagtcttgttgtattctgtgagcatctttaacccaatttgcagttcttgaatctttgtgagatggttgctacctttaaactaaaacgttgcaagctgtttttttctctttatgagaaaccgaactccttggcggttttctgttagtggaaaggaatgcttgtcgtttttttctctttatcagacctcaatccacggccctctatgtggcgctatatgagtgtaatcaactggccacttttcttag

SEQ ID NO: 1505 - DNA, 495 bp, Brassica napus
aaccgaaaaaccctaagcagagatcgaagctaagaagacaatttgtttcctcccactcttcgatacgtctcttcgttccatcattcatggctaccataccggtaaacccgaagccgttcttgaacaacttaaccggaaagacggttatcgtcaagctcaaatggggaatggaatacaaaggtttcctcgcctctgttgactcctacatgaacttgcagcttggaaacactgaagaatacatcgatggacagttgactggaaacctcggagagatcttgatcagatgcaacaacgttttgtatgtccgaggtgtgccagaagatgaagaactcggagacgctgaacaagactagcctgtgcccgtggacttagaaatcgccagatcttgttgtattctatgagtatcttaacccaacttgtgatatttatatttcagctttgctgttactgttgctgaatcttttgatacgtcgaaactaaagaaaagccacaagc

SEQ ID NO: 1506 - DNA, 529 bp, Brassica napus
aggcgatcccaatcctcctcgattcatctcttcgctccccaaaaccaatggctaccataccggttaaccctaagccgttcttgaacaatttgaccgggaagacggttatcgttaagctcaagtggggaatggaatacaaaggtttcctcgcctctgttgactcctacatgaacttgcagctgggaaacaccgaggagtatattgatggacagttgacaggaaaccttggagagatcttgatcagatgcaacaacgttttgtacgtccgaggtgtgccagaagatgaagaactcggggacgccgaacaagactagtctgtaccaaggaaagtagaaatcgccagtctgttttaagtcttgttgtattctatcagcatctttaacccagtatgcagttcttgaatctttttgagatggttgatacctttaaagtttaaactaaaacgtcgcaagctgtttagctcttaatgagtaatcgaacttccttccggtcttctgttattggaaagaaatgcttgtcgtttttttct

SEQ ID NO: 1507 - DNA, 650 bp, Brassica napus
aagcagagatcgaaaagctaagaagacgaagaggagcgatttgtttcctcccactcttcgattcgtctcgtcgttccatcactcatggctaccataccggtaaacccgaagccgttcttgaacaacttaaccggaaagacggttatcgttaagctcaaatggggaatggaatacaaaggttttctcgcctctgttgactcctacatgaacttgcagcttggaaacactgaagaatacatcgatggacaattgacagggaacctcggagagatcttgatcagatgcaacaacgttttgtatgtccgaggtgtgccagaagatgaagaactcggagatgctgaacaagactagcctgtgcccgtggacttagaaatacccagtcttgttgtattctatgagtatcttaaattcttaacccaacttgtgagatttcagctttgctgttgttgaaacttttgataaccttgaaacaaaaaccacaagctgttttgatgtgtgacaaaccaaactccttgccggttttctgtaaatggaatggaatgcgtgtcgttttatactatcgtttccaagcctcaaattgcggcccaaaacagataggagtaatatactggccacattccgagaaactaatgacccttttcgattagtgt

SEQ ID NO: 1508 - DNA, 555 bp, Brassica napus
gatagcaacgaatctagaaaccgaaaaaccctaagcagagatcgaaaagctaagaagacgaagaggagcgatttgtttcctaccactcttcgattcgtctcttcgttccatcactcatggctaccataccggtaaacccgaagccgttcttgaacaatttaaccggaaagacggttatcgttaagctcaaatggggaatggaatacaaaggtttcctcgcctctgttgactcctacatgaacttgcagcttggaaacactgaagaatacatcgatggacaattgacagggaacctcggagagatcttgatcagatgcaacaacgttttgtatgtccgaggtgtgccagaagatgaagaactcggagatgctgaacaagactagcctgtgcccgtggacttagaaatacccagtattgttgtattatatgagcatcttaacccaacttgtgagatttcagctttgcttttattgaatcttttgataaccttgaaactaaagaaagccacaagctgttttagatgtgtgacaaaccaaactccttgcggttttctgt

SEQ ID NO: 1509 - DNA, 708 bp, Gossypium hirsutum
gaaaaaaagcacgcaccgagtagaaagaaaacaacggtaaaccctgtggaaacaagccgactgcaaaacgctgcagctgaagccctaacttttccgctcacctctctgcaccagccgctcctctattcgcatcttccatggctacgataccagttaacccaaaacccttcttgaacaatttgactggaaagactgttatagtgaagctcaaatgggggatggaatacaaaggttttcttgcatctgttgattcatacatgaacttgcagcttggcaatgctgaagagtatgttgatgggcaattcactggaaatttaggggagattttgatcagatgcaataatgttctctatcttcgtggggttccggaagatgaagatatagaagatgctgacaaggactagatggttcacatgtggttgaaatagaacctttggtatttgattagaggtgctgtaacttttgtttatcatggttgaatgtcattatgtcatttagtcgcccggacagacaaaccgcgatgtagttaattgtgcttttgcttgaccgctattgccaacattatttggaatattgcttcttttaatattcaagctgtatgtattatggagagccgaactggtttttagattgttcgcaattgtgtggccaacttatttgagatctatgccgtacgatataaatgccgtggctttcaggttggagatg

SEQ ID NO: 1510 - DNA, 740 bp, Gossypium hirsutum
acaaccattttctcatttgtttatttcttagggaagcacactaaaccctaaaaagaacgtaccgagtagaaagaaaacaacggtaaaccctgtggaaacaagccgactgcaaaacgctgcagctgaaaccctaacttttccgctcacctctctgcaccagccgctcctctattcgcatcttccatggctacgataccagttaacccgaaacccttcttgaacaatttgactggaaagactgttatagtgaagctcaaatgggggatggaatacaaaggttttcttgcatctgttgattcatacatgaacttgcagcttggcaatgctgaagagtatgttgatgggcaattcactggaaatttaggggagattttgatcagatgcaataacgttctctatcttcgtggggttccggaagatgaagatatagaagatgcagacaaggactagatggttcgcatgtggttgaaatagaacctttgatatttgattaggggtgctgttacttttgtttatcatggttgaatgtcattatgtcatttagtcgcccggacagataaaccgcgatgtcgttaattgtgcttttgcttgactgctattgccaacattatttggaatattgcttcttttaatattcaagctgtatgtattatggagagccgaactggtttttagattgttcgcaattgtgtggccaacttatttgagatctatgccgtacgatataaatgccatggctt

SEQ ID NO: 1511 - DNA, 517 bp, Cucurbita pepo
aaagctcacagatattcaacgacgaaaaaggagggaaaacaagccctagagcaagagcgccattttcttcgactccttgttcttttgagctccacagatttcaaacaagcccttgctcgccatttcggaaccatgagcatcccagttaacccgaagccgtttttgaacaatttgactggaaagactgtggtcgtgaaactcaagtgggggatggagtacaaaggctttcttgtctcggtggactcgtacatgaacttacagcttgccaatactgaggaatatatcgacggacaatgtactgggagtttgggagaaatattgatcaggtgtaacaacgttctttaccttcgcggagtaccagaggatgaagagatagaagatgccgagcgtgactagcatgtaaatttttagcagcctttcgatggcgtagcagtagtgaagttttatgatgttattgatactatttatggcatctcaagggacaggaacactccaatttggtggatttcagaacctg

SEQ ID NO: 1512 - DNA, 475 bp, Solanum melongena
cttagctcttttttctcgctcgtgaaaccctaaacctcgaaaagcttcaatggcgacagtacctgttaatccgaaaccttttttgaacaatttgactggaaagcctgtgatggtaaagctaaagtggggattagagtacaaagggtatttggtctctgtggattcatacatgaacttgcagcttgccaatgcagaagaattcactgatggagtaagctctggctcgctcggagagatcttgattagatgtaataacgtcctctatcttcgtggtgtacctgaggatgaagagctggaagatgctgaccgcgactagaaagtgtgttgtattaatagtgtcatggtccattgatcaatgattagaatgattcatctccttgaatgtattatcgaatatgtgttcgtcttaggtgctcccatctgatatatgctgtttgtagtctgggaagatattagagattaatgattttcttgg

SEQ ID NO: 1513 - DNA, 667 bp, Euonymus alatus
gaacattgtaattgtaaactgttcgtatgttctcggttctctcagtcgttgcccttaaaccctagctgcggagagaagcaaagccacacctgctgccccccaacatcgaacttccctgtctcgtcttcaatggctacaataccagttaaccccaagccctttttgaacgacttgactggaaagactgttattgtcaaactcaagtggggaatggaatacaaaggttttcttgggtcggtagattcatacatgaatttacagttgggaaatgctgaagaatatgttgatgggcaattcactggaaatctaggagagattttgatccgatgcaataatgttctttatcttcgtggggtcccagaagatgaggagatagaagatgccgcccaggactagaaactgcactttggcaactattcagtgaagtgtcatatagaacactagcttgttattaattagtttgttcgctgtaaaatgatatattatggtttcggtagggtgtatgactatttaactcacattcactgcccatgttattgctgaggccttggaaagaaagcaaaatcaattggatattctgttgatctattgcagtctgagctgttctttttcagcctcgccatttgtttttgaaactgttctgtcagaaatatagctatgtttcttg

SEQ ID NO: 1514 - DNA, 689 bp, Gossypium raimondii
aaaaagaacgtaccgagtagaaagaaaacaacggtaaaccctgtggaaacaagccgactgcaaaacgctgcagctgaaaccctaacttttccgctcacctctctgcaccagccgctcctctattcgcatcttccatggctacgataccagttaacccgaaacccttcttgaacaatttgactggaaagactgttatagtgaagctcaaatgggggatggaatacaaaggttttcttgcatctgttgattcatacatgaacttgcagcttggcaatgctgaagagtatgttgatgggcaattcactggaaatttaggggagattttgatcagatgcaataatgttctctatcttcgtggggttccggaagatgaagatatagaagatgcagacaaggactagatggttcacatgtggttgaaatagaacctttggtatttgattaggggtgctgttacttttgtttatcatggttgaatgtcattatgtcatttagtcgcccggacagataaaccgcgatgtagttaattgtgcttttgcttgactgctattgccaacattatttggaatattgcttcttttaatattcaagctgtatgtattatggagagccgaactggtttttagattgttcgcaattgtgtggccaacttatttgagatctatgccgtacgatataaatgccatggc

SEQ ID NO: 1515 - DNA, 738 bp, Momordica charantia
gaggagggaaagcaaaccctaaaagaaaccctagggagagcccatcttcttcgtcttcctgttcttttgagcctccacagattccatagaagttctttctggtcatttccgaaccatgagcatcccagttaacccgaagccattcttgaacaatttgaccggaaagactgtggtggtgaaactcaagtgggggatggagtacaaaggctttctcgtctcagtggactcgtacatgaacttacagcttgccaatactgaggaatatattgacggacaatttactgggagtctaggagaaatattgatcaggtgtaataatgttctttaccttcgcggagtaccggaggatgaagaaattgaagatgtggagcgtgagtagcatgtaaatttttagcagctctgccatgccatagtacccgtaaagtattcagttctctagttaactgtttttctttcatctgcggcatcaattgtatcttgttgttattgatactatatatgttatccttaggacagtaacaatctctgcttgggttgatttctaacctctgcaaaaaccatttggtttccattgttgtggtaaaggagattgacgggaaacaaagagaattcttgaatgtatcatctattcttcttgatagctttgaattgctttagttttattatataatatatagtcggaacatgtttacggttttgactgtgatcatagatgttcgagttaaatagatattgttg

SEQ ID NO: 1516 - DNA, 677 bp, Raphanus sativus
gggttgtaatagctacgaatcttgaaacctcgaaaccaaaaaaccctaagcagcagagatcgaagcagaagggaggagcgatttgtttcatcccaatcctcgacgattcaaatctcttcgttccctaaaaccatggctacgatacccgtcaacccgaagccattcttgaacaatttgaccggaaagacggttattgttaagcttaaatggggaatggaatacaaaggtttccttgcctctgttgactcctacatgaacttgcagctgggaaacaccgaggaatatatcgatggacaattgacaggaaaccttggagagatcttgatcagatgcaacaacgttttgtatgtccgaggtgtgccagaagatgaagaactcgcggacgctgaacaagactagcctggtaccaatgacgtagagatcgctagtctgtttgaagtcgtgtcgtgtattctatgagcgttttaaacccattttactcttcttaaatatttttaagttgtttgataccttaaaaccagaacgttacaagcggtttagctctttatgagagaaatcgaacttctttctggctttctgttattgaaaaggcatgcttgtcgttttttaactatctttattagacctcaatctacgacccactatgtggcgctatatgagtaatccattggccacat

SEQ ID NO: 1517 - DNA, 590 bp, Raphanus sativus
ggaaatatcaacgaatctggaaaactcaccgaaccaaaaaccctaagcagagatcgaagctaagaagaacacacagaagagaagcgatttgtttcctctcccactctccgttccatcactcatggctaccataccagtaaacccgaagccgttcttgaacaatttgaccggaaagacggttattgttaagctcaaatggggaatggaatacaaaggtttcctcgcctctgttgactcctacatgaacttgcagcttgggaacactgaagaatacattgatggacagttgacagggaacctcggagagatcttgatcagatgcaacaacgttttgtatgtccgaggtgtgccagaagatgaagaactcggagacgctgaacaagactagcctgtgccggttggatggacttttgtattctatgagcatcttaactcaacttgtgagatttcagcttttttttggctgttgttgaatcttttgatacccttgaaactaaagaaatccccacaagccttttactcttttagatttgttataaaccaaactcctcgccggtttatgagtaatatattgaattgaccaaagtcct

SEQ ID NO: 1518 - DNA, 585 bp, Solanum lycopersicum
tcaccattttcttggaacgattttttcctcgccattttgagaaaccctaaacctcgaaaagcttcaatggcgacagtaccagttaatccgaagccttttttgaacaatttgactggaaagcctgtgatggtaaagctgaagtggggattagagtacaaagggtatctggtctctgtggattcatatatgaacttgcagcttgcaaatgcagaagaattcactgatggagtaagctctggctctctcggagagatcctgattagatgtaacaatgtcctctatcttcgtggtgtacccgaggatgaagaactggaagatgctgaccgcgactaggaagtgtattaatagtgacaaattgatcaacgatttgaatgtatccccgattatgtgttttcttaggtgctcctttctgatatatgctgttggtagtctggtgaaaatattgttgaccaatgatttacggagcaaaatgactagaaagctgtatgatctccagattgctttatttttgttataatcacaagcttcaactcgtatcatatatacatgattgatagattttgtccaaattgaaaccaaattatt

SEQ ID NO: 1519 - DNA, 642 bp, Tripterygium wilfordii
aagcgatacctgcggacctgctgcaccacatccacatctaagctttgctgtctcgtcttcaatggcaacaataccagttaaccccaagccctttttgaacaacttgactggaaagacggttattgtgaaactcaagtggggaatggaatacaaaggttttcttgcctcggtagattcatacatgaatttacagttaggaaatgctgaagaatatgtcgatgggcaattaactggaaatctaggagagattttgatcagatgcaacaatgttctttatcttcgtggggtcccagaagatgaggagatagaagatgctgccgaggactagtaagtgcactttggcaactgttcagttgaagtgtcatatcgaacattggcatgctcttaaatagtttgttcccctaatactgctatattatggtttaggtaggagctctatgacccttctttaccttgcatgtactactaactagtaactacccatgttgctgaggccctgcaaagaaagcaaaatcaattgaatattatctttgactgactacaatctcaactgttatttcgagttagtgcatctttatttgaacccctgttgggctaggacctagggcagagcaaacattaaacagagtaattgagacagcg

SEQ ID NO: 1520 - DNA, 399 bp, Physcomitrella patens
tcttcttattcttctcctctaaattcgaggtgctgctgttccagtcactgcacgtcgtcgtcgtctccaacttcaatttcactgacgctgatctctctcattctgtctcccgtcatggcgacagtgcctgtgaatccgaagccctttctgaacgacttgactgggaagccggtcattgtgaaactcaagtggggcatggagtacaaaggttatctggtatcagttgattcttacatgaacctgcagttagcaagcacggaggagtttgtggatggggcatttactggcaatctgggagaggtcctcatcagatgcaacaatgtcatgtacctgagaggcgttcctgaagacgaagatgctgctgaagatgacgagtgatcattttcggttgctgtggaa

SEQ ID NO: 1521 - DNA, 535 bp, Silene vulgaris
ttaaactgaaaatccctcttttctcttcgagactgcagagaatttccaagtgtgaattttgatggcgactgttccagttaacccgaaacctttcttgaacaacttgactgggaaacaagtcattgttaaattgaagtggggaatggagtacaaaggttatcttgtctctgtggatggctacatgaatttacagttggcagacactgaggagtatattgaaggtgaaatgaccggaaatcttggagagattcttatcaggtgcaacaatgttctatatcttcgaggggtacccgaggatgaagagatggatggcgacagggactgacttaaaagagaagcattgatgcagccgagggttgtggactagtagtacacattcattcttgccaatgactgatgcctaagacagttaatttggcatgatgatcttatgaagtcttcaagtagatgtagaatttgtcatgtaaacaaaccttttgagacttcatcttattttattttgacgatgtacttgtcccggatagttacaggtggc

SEQ ID NO: 1522 - DNA, 964 bp, Hordeum vulgare
actgtatgacttatttcgttggatataatttgctaattgtccatgtttctttactccgctgcagactgtgccagttaaccccaagccattcttacaaaacttaacagggaagatggtcatcgtcaagctgaaatggggcatggagtacaaaggttatcttgtttcagtggactcctacatgaatctgcagctaagtggtaccgaggaattcattgatggacaatgctctggaaatttgggagacatactgataagatgcaacaatgtgatgtacctccgaggtgttccagaggtggacacggagattccagatgcggcctgaagagcacatgaactgttcctggttgatgcttgctgttcaatgctgaaaaagaacttcctagttcgtctctatttgcgcctactcgactgtattacgtacatgcattgaactcatgttgactctagttctgcatcctgaatgaacgaatgattaacttgcatgtttgaaacggctgatcgctgattgctgataggtcctgatcctgccgttgcatatgtatggtttgatgtctgaatcacgatgatcgtatttgtgcaatttgaactgcatttgctgagttcctgagcatggactcgaagtcgcataccaagcatgaaggggtgtttctgccccatttgtccttttcttctagatgttcatgctgagttccaaattccacaagagctcttagctgtgtgccgtacactcggatcattcataggttggtgcatgctgtttaccgctaaagaacaattttgcagttcgtcttttttacgcgtagtgactgtattacattcaagaagtcctggaactcatgttaactctagcggcatagcaccgatatcctgaatgaaggatggtctacttgcatgctttaacagttgattgatgattgctggtaggtactgatggctattgttcgttctaaatgtgatggttgta

SEQ ID NO: 1523 - DNA, 459 bp, Chrysanthemum coronarium
ataccagttaacccgaaacctttcttaaacaacttgactgggaagcctgtcattgtgaagcttaagtggggcatggaatacaaaggatatctggtctcagtggattcgtacatgaacctgcagctggcaaactctgaagaatacgttgatgggcagtgtactggaagccttggagagattctaatcagatgtaataatgttctctatatgcgaggtgtacctgaagatgaagaaatagaggaggcaggttgagactagattggtggacacccttattagatctatcggtttcattttcaatcttttgttcttgtatggaagtacatgtagatgttctgatccaaacgaaactcaatttagaaacctgaacctttgattggccgcaagtttcactaggtggatgtggacccctttgatctttagtccgagtatattggacaatgttgtatggtacttgct

SEQ ID NO: 1524 - DNA, 471 bp, Arachis hypogaea
agtggtatcaacgcagatacgggggacatcagcaattagttgtacttatcgtcgtagcacaagaagaaaaagaattcagctatttcaaaatatttagttatttactatattgatcagaatttatttgagtttaaatgttgtgtcgtcactgaaccctaactacagcttcagcagctgctgctttagagtgcagagagaactatcgttgcgatctcctcctccaatggcgactataccagtgaatccgaagcctttcttgaacaatttgactgggaaacaagttattgtcaaatcgaagtggggaatggaatacaaaggttatctagtctcagctgattcctatatgaatttgcagctggctaatactgaagaatacattgagggacaatttaccggaaacttgggagaaattttaatcagatgcaacaatgttctctacctttgaggtgtgcctgaagatgcgctctatca

SEQ ID NO: 1525 - DNA, 668 bp, Carpinus betulus
ctcgctcctctaaaacccaactcatttagtgagctgcctctttgtttgttcacctctgagggttttctgaagcagcgcagacgtcaattcttcgccatgtctatcccagttaacccaaaacctttcttgaacaatttgactgggaagcctgtcattgtgaaactcaagtggggaatggagtacaaaggttttctagcctcaatggattcatacatgaacttgcagctagctaacactgaagaatacattgatgggcaattcactggaaatttgggagagattttgatcagatgcaacaatgttctgtatcttcgtggagtaccggaggatgaagaaattgaagatgctgatcgtgatcaagactaagaagttggattccagtatttaatattgctttgttgagccatataacctgtattgtacctgtaatccaatgtagaggtaaggtgttctggatgttggatgtgcatgctaaccatatatgcatgctttaactgtaccccaactaaaaacgggtccttacctttaactgttacaccaacaccttattgagggacaagaattaacaatttcttactagactaacataatgactagtaaattttgttattatattaaattattagtaaaaggtttaaacaaaaaaaaaaaaaaaactaaagtaaaac

SEQ ID NO: 1526 - DNA, 350 bp, Cleome gynandra
cacagggcgcgggattgtcttctccgatcttctaagcgcttcttcgttcgctaatcaatggcaacaatacctgtaaaccccaaaccattcttgaacaacttgaccggcaagacagtcattgtgaagcttaaatggggaatggaatacaaaggatttctggcatctgtggactcttacatgaacttacagctgggaaatgctgaagaatacattgatggccaattaactggaaacctgggagagatcttaatcaggtgcaacaatgtgttatatatgcgtggtgtgcccgaggatgaggaacttgaggatgctgatcaagattaagagtaccgagatgtctgcaaattgac

SEQ ID NO: 1527 - DNA, 699 bp, Cucurbita pepo
ctccccgttcttttgagcctccgttgatcccagagaagcacttttagatcattcggaaccatgagtattccagttaacccgaaaccgttcttgaacaatttgactggaaagactgttgttgtgaaactgaagtgggggatggagtacaaaggctttctggtctctgtagactcgtacatgaacttgcagcttgccaataccgaggaatatattgatgggcaatgtactgggagtctcggagaaatattgatcaggtgtaataatgttctttaccttcgcggagtaccagaggacgaagagcttgaagatgccgagcgcgactaacatgtaaatttgtagcagccagctctgccatgccatagtagcagctaagttttccgccttctagtttcctagttttcctttcatctgctgcttaagttgcatctcgttgctattggtactaccttataggacaggatcattctctggttttagtcgatttcgaacctgcacgatcattctagggagattgaatggtagaaaaagaattcatgaatgtaacatctttatgtctatagcattgaaatgcttcatttttcaacataagataagctagagcgttacataaatctttcatgtggaatgcaatgcaatgacatataatatcattagttttggtattggagctcactttattactaaaataaataatcatag

SEQ ID NO: 1528 - DNA, 649 bp, Nicotiana benthamiana
gccaggggttttccgagcttcagtagcagcttacccgtctcaccagcaaatcaaccgaagccatgtcagtaccagttaaccccaagccttatttgaacaatttgacgggaaagcctgtgatggtaaagcttaaatggggaatggagtacaaagggtatttggtctccgtggattcatacatgaacttgcagcttgcaaacgcagaagaatacattgatggacagtgcactggttctctcggagagatcctgattagatgtaataatgtcctctatcttcgtggtgtacccgaggatgaagaattggaagatgctgatcgcgactagaaactatgttgtattagtaatgtaattgttcttccagtgcaatccgatttttggttgttgatcgtgatggaacaacatattcgtctccttgtatgtattatcaattctctgagaaacttttctagattgctatctaatgtatactgatagatagttgaggaagaggctggtgaccttagtgatttactggagcaaaatgaacaagatatatgacctgaaagacacgatcttcagatttttttgtaagatggtttatgcttagcaagagtagaacaaatgatttggtaattaaacaattttcactaatcaccaaaatgtatata

SEQ ID NO: 1529 - DNA, 512 bp, Solanum tuberosum
ccctaaacctcgaaaagcttcaatggcgacagtaccagttaatccgaagccttttttgaacaatttgactggaaagcatgtgatggtaaagctaaagtggggattagagtacaaagggtatttggtctctgtggattcatacatgaacttgcagcttgctaatgcagaagaattcactgatggagtaagctctggctctcttggagagatcctgattagatgtaataatgtcctctatcttcgtggtgtacccgaggatgaagaactggaagatgctgaccgcgactagaaagtggtgttgtattaatagtgacatggttcattgatcaaagattggaacgatttgaatgtgttttcttagttgctcctgtctgatatatgttgttggtagtcgggagaaaatattagtgactcatgatttaccggagcaaaatgactagaaagctgtatgatcttggatcgcgtttatttttatcatcacaatcttcaacccgtatcattgacaaaagtat

SEQ ID NO: 1530 - DNA, 534 bp, Solanum phureja
tttttttctcgcctttcttgtgaaaccctaaacctcgaaaagcttcaatggcgacagtaccagttaatccgaagccttttttgaacaatttgactggaaagcatgtgatggtaaagctaaagtggggattagagtacaaagggtatttggtctctgtggattcatacatgaacttgcagcttgctaatgcagaagaattcactgatggagtaagctctggctctcttggagagatcctgattagatgtaataatgtcctctatcttcgtggtgtacccgaggatgaagaactggaagatgctgaccgcgactagaaagtgtgttgtatttagtgacatggttcattgatcaatgattggaacgacttgaatgtgttttcttagttgctcctgtctgatatatgttgttggtagttgggagaaaatattagtgactattgatttaccggagcaaattgactagaaagctgtatgatctcggatcgcgtttatttttatcatcacaagcttcaacccgtatcagtgacaaaagtat

SEQ ID NO: 1531 - DNA, 726 bp, Nicotiana tabacum
gctaggggttttctcgagcttcagtagcagcttagccgtctcaccagcaaatcaccgaagccatgtcagtaccagttaatcccaagccttatttgaacaatttgacgggaaagcctgtgatggtaaagcttaaatggggaatggagtacaaagggtatctggtctccgtggattcatacatgaacttgcagcttgcaaacgcagaagaatacattgatggacaatgcactggttctctcggagagatcctgattagatgtaataatgtcctctatcttcgtggtgtacctgaggatgaagaattggaagatgctgatcgcgactagaaactatgttgttttcgtagtgtcatcgttcttcaagtgcaatccgatttctggttcattggccgtgatggaacaacgtatccgtctccttgtatgtattatcaattatgtgataaactttcctagattgctatctaatgtatgctgatagatagctgaggaagaggttggtgaccttaatgatttactggagcaaaatgaaaccagatatatgacttgaaagccatatgatcttcagattatttttgtatattggtttatgtttagcaagaatagaacaaattgatcgggagacatggcattattcactttcttcaattttcattaatcaccaaaatgtatttacaagtcaaacttctcaataacggtcacatttgttctgatattttttggatgctat

SEQ ID NO: 1532 - DNA, 486 bp, Tripterygium wilfordii
gtggaggcccgataaagcttccccgtctagttttcaatggctactatacccgttaaccctaagccttttctgaacaacttgactggcaagactgtaattgtgaaactgaagtggggaatggaatacaaaggttttcttgcttccgtggattcgtacatgaatttacagttaggcaatgctgaagaatatgttgatggggaattgacagggaacctaggagagattttgatcagatgcaacaatgttctctatcttcgtggtgttccagaagatgaggagattgaagatgctgaccgcgactaaagaactcgactttcgctactgttcagtggcatttgattattacgcttgctctttgttgctagttttttggacttgtattgtactttagtggagcggtatgccatgagacttggcttatagtgccctatgtcatctattgagcaaacctgagttaaaacaaatcttttccattgcaaatctcat

SEQ ID NO: 1533 - DNA, 683 bp, Ceratodon purpureus
atcctcgcatcgccatcgccatcgctgtggccattgctgttgctattggcatcgcgccatcatctcctcatcatggcgactgttccggtgaatccgaagccgtttttgaatgacctgacagggaagccggtcatcgtgaagctcaagtgggggatggagtacaaaggttatttggtgtccgtggactcgtacatgaatctgcagctagcaagcacggaggagttcgtagacggagctttcactggcaacttgggcgaagtccttatcagatgtaacaatgtcatgtacctgaggggtgttcccgaagacgaagatgctgccgaagacgatgattgacaattttccataaggctacggtagatgtatgataatgtgggtgcaaaacttctccagtaaacttcctcaagaaggtccataggtatcaggtactcaagttctagattgctaggaccgtctggaccctgcacattactgcaaacatgttcccatctattttgtgaagtcaatcagatggacgattgggaagcttcatacacctcatgcatgtagaagccacgttttgaatcatatgaagttgcggtatagaagttgtactttaagggacataatccagcatcaaaattcctgctttcagtttgcgagtatccccttccaagagcacaagcacttgtccagatgtctgc

SEQ ID NO: 1534 - DNA, 609 bp, Plantago ovata
tttggtgattaaattaaaacctcaatcccttccaccaaaaccctagaagcgccagctccaccactcctcggcgattcctcaacctaacaccgctgcaataatggcgaccgtaccagttaatccaaagcctttcttgaacaacttgactgggaagactgtcatggtgaaactcaaatggggaatggagtacaaagggtttcttgtctcggttgattcatacatgaacctacagcttgcaaatgctgaagagtatattgatggacaatgcactgggagcctcggagagatcttgatcagatgcaacaacgttctttatctccgtggtgttccagaggatgaggagattgcagaagcagatgccgatcgtgattagtttgtgatatctttgtaccgtgactagtatgtgttacatatgctcgtgggcctttgattaactgcaaaatatttgcaccgtagtcaaacattcagtattattgttgttagattgaatgttcataccacctctattgcttaaaatgctcgacaaaaattgattttgtaggataagcttctgcaccatgatttgtaatgcaattctctgattttagatattcaggtgatattgatgtg

SEQ ID NO: 1535 - DNA, 580 bp, Lippia dulcis
cagtcccatccaccaatacccggacgacgacgttttggctccaaatcgctctccaaaaccctaaacccccataggaatcattggctttctccttcgaagcaacgctccaatggctactgtaccggttaacccgaagccgttcttgcagactttgactgggaagccagtcatggtgaaactcaaatggggaatggaatacaaaggttttcttgtctctgttgattcatacatgaacttgcagctcgcaaatgctgaagaatatgtagatgggcagtgcactggaagtcttggagaaattttgatcagatgcaataatgttttgtatcttcgtggagtgcccgaagatgaagaaatagaggaggcagatcgcgacgactaggtggtgttggtatcttgtatatctgttgccttaatctatgttaacttgacccgagatcttctttacccttcttttgtaggcttctattgtttgcaagattgttgtacttgattgagattgccatgtttttgtcaagtttgagctcgatatttgtgcttatgagctctatgaatggcagtattatttttcagttaaaaagaa

SEQ ID NO: 1536 - DNA, 497 bp, Utricularia gibba
gcgccggcgcccgttttgtttgagcaagtgtgaacgattgaaaaccctaacgttggagaaaatcgttcatttcagttcacatccacgcaatggctactgtgcctgttaatccgaagcccttcttgaacaacttaacggggaaacccgtgatggtaaaactgaaatggggaatggaatataaggggtttcttgtctctgtggactcttacatgaacctgcagcttgctaatgctgaagaatacatcgatgggcagtgcactggaagtctgggtgaaattttagtcaggtgcaacaatgttctgtatctccggggagtcccagaggatgaagacatggaggaggcaccggatcgtgactaatcatctgactacgttccatgcaacttgttttgtgtagcatattccgtcctccccatttcatgacctggactttggttttataaatatttgctttgtttgaagccctttcatttgtcaaatgtgatacagaatggtaac

SEQ ID NO: 1537 - DNA, 304 bp, Aquilegia formosa
tggtgtttaattatttgatatcacagactgtaccagtcaaccccaagcctttcttgaacaatctgacgggaaagcctgttatggttaagctcaagtggggaatggaatacaaaggtttccttgtctcagtggactcatacatgaatttgcagctggccaacactgaggaatatatagatggacagttcactgggaacctaggggaaattttgataagatgcaataacgttctctatcttcggggtgttccggaagatgaagaaattgaagaagctgatcgagactaaatggagcattattatgc

SEQ ID NO: 1538 - DNA, 301 bp, Aquilegia formosa
gcttaatgtttttctacttgctgttacagacggtaccagtcaacccaaagcctttcttgaacaatctgactggaaagcctgttatggttaagctcaagtggggaatggaatacaaaggattccttgtttcagtggactcctacatgaatctgcagcttgctaacactgaggaatatatagatggacaattcactgggaacctcggagaaattttgattcgttgtaacaatgttctctatcttcgaggcgtaccagaggatgaagaaatagaagatgtcgatcgagattaattggagcatca

SEQ ID NO: 1539 - DNA, 505 bp, Heritiera littoralis
gaaaaagacgaagtcgaaaccccaacttttccgctcaccgctgaagcctcctttttttctcgataatggctacaattcctgttaacccgaaacctttcttgaacaatttgactggaaagactgttatagtgaagctcaagtgggggatggaatacaaaggttttcttgcctcggttgattcatacatgaacttacagcttggcaatgctgaagagtttattgatgggcaattcactggaaatctaggggagattttagtcagatgcaataatgttctctaccttcgtggcgtgccagaagatgaagatttagaagatgccgatagggactagattgcttctcatatggtttatgtagaactttgggctattcgaccaaagctgctgtaacttttctgtatcatgatcggaggtcatgtatctcatttaatgactggacaaacaaactgccgtagttatcagtgctttgatttacttcttttagcaacattttttggaatagtcgt

SEQ ID NO: 1540 - DNA, 1772 bp, Capsicum annuum
gtttatgtaatttaacccaaaatgggctactatttgagaagaaagtccaagtcccatctaattggactttggcccattaaacgttgataagcccaattacctccttcatagcagcacacatagcaaatcaccttttttttttaagctcacattttttcctaacaaaccctaaaccctcaaaaatcttcaatggcgacagtaccagttaatccgaagccttttttgaacaatttgactggaaagcctgtgatggtaaagctaaagtggggactggagtacaaagggtttctggtctccgtggattcatacatgaacttgcagcttgcaaatgcagaagaattcactgatggagtaagcactggttctctcggagagatcctgattagatgtaataatgtcctctatcttcgtggcgtacccgaggatgaagaactggaagatgctgatcgcgactagaaagtgtattgtattaatagtgacatggtgttcggccagttcaaccagatttctggttcattgatcatgatttggacatttgtcttcttcaatgtattatcaattatgtattttcttaggtgctcctatctgataatatgatttatagtttggggaaatgattggtgactaatgatttaccggagaaaaatgaaccagctatgactagaaagctatatgatctccagattgagttttatttttgttaatcgtagactcgaaacagtatcatatagacataaatctccttgaaaataggatgaaatgaaaattagataataattgctagcttttatggatagtaatggataaatatttaacatatatctataaaagtagatttttatggcaaaaaatttggcctgttttaaactttagaaatcatggccatgaatactgcagcctttagcaagaggaaaatgaggtcttggagaaaatcactatcaattccctatgaaataactttccacatattgtcacatcttcccgtcaagtctttaatgcgtttcaagtgcatttcccaatttcataactcccttgtatccgataaagatttcgtgaataaacatcaatccctctctatgactcgccctggtagaatcaaattgactaacaaattgaagatggtgaatcctccctttttcatattgagcatcttgataaactctattgatcacaaccctatcacttccaacgactttttggagtttgttaatggtctattttgcttatcaacattgcaccaacctcctgtaatttgcaatcccagtacaagagaaataacatctcttcccaacatacatgtcgatcgctatagtcaatgttcattaggttatgaaccagaagaaaaaatctacaaagttctcttcgtgcaacttgaaaacacgagaatatattcagagacatatgcaagaaactgggttttcactctaggagtagataagtcatggaagaacatagataatgttctccattttcgtcgattgaaggagggagtttgcattaatggagttatctatatgttgaatgattatatttgggagaaaactgtagttgaatttgatttgaaagtgcatatgggataccagaagatttacatgagattttagattcttgtaatctgatagaagtgaagggaaaattagcagtcgttgaagaaaatataatggatggggagtttagtttgtggattttagatgatgatcatttttcactatggcagagaaatttcattattaaatttccaggaatgaagttttgttcccagacatatgggg

SEQ ID NO: 1541 - DNA, 674 bp, Cannabis sativa
atatatcttgacttttttgcagagcataccagttaacccaaaacctttcttgaacaatttgaccggaaagactgtttttgtaaagctaaaatggggaatggagtacaaaggttttctggtctctgtggactcgtacatgaatttacagttggccaatactgaagagtacattgatggacaattcactggaaatcttggtgaaattttgatccgatgtaacaatgttctttatcttcgtggagtaccggaggatgaagaaattgaagatgctgagcgagaatgaatagcagctcgtttagctctgtgatttatgtcgaaggtcagttcttaactatttcttttcattaatctttactggttgttctggaattgtgctagacttcacaacaaagctggattcctgtagaccaatgaaaatatgcatgttttaatttaaaaaacgttgtggtttagtccctttctaaatgacttccaaaagtttgtattagttctattgaagtataaataggccatttactatagctaaaaaaccatcaaactagataagctaatcgttgtaatattaatatgtgctattatatagtgagtgatgaatatcatatgaatactgtgaactttaaatattgtaattaatatatttttgagaaataaagtggcgtttatgttggcataaa

SEQ ID NO: 1542 - DNA, 507 bp, Ipomoea nil
gcttcaatggctacagtaccagtgaatcccaaccctttcctgaaccacttgactggaaagcctgtcatggtgaaactgaagtggggaatggagtacaaaggatttttggtttctgtggattcatatatgcacttgcagctggcaaatgcagaagaatacattgatggacaaagccctggaacacttggagcaatcctcatcagacgtaacaatgtcctttaccttcgtggggtacccgaggatgaagaggtggaagatgctgctgagtagaactaggaagtccccttcgtgctgtagtcatcatttggcgaggcaacccgagtacaagctcacgtccaacgatgcttcagcctatcctcagaattgcatcacgtattgggttattcacccccttgtgtgtaactagctaatgaccctaatcttttctaaggctgccttttgctgtaaaagattgtcggactatttctttcagggatggatggatgactaaggcgccaaaatatccca

SEQ ID NO: 1543 - DNA, 800 bp, Physcomitrella patens
aggtttgtgagtgtgagagtgagagagtgctgccgccagcttttgcttcagcgctgctgctgcagattgtttcgcaccattctacatcatcatcgtcgcagaagggcactcgttccctttacttggcttctcgtcatggcgaccatccccgtgaatccgaaaccctttttgaacgacttgacagggaagccggtgatcgtgaaactgaagtgggggatggaatacaaaggttatttggtgtcggtcgactcatatatgaatctccaactcgcaagcacggaagagtttgtggatggggcattcacgggcaacttgggagaagtcctcatcagatgcaacaatgtcatgtatctgagaggtgttcctgaggacgaagatgctgctgaagacgatgattgataattcttgatgaggcactgttttagggcctgttctgctccgaagctcaagatgaagctgtccatttagttactcgttgtaatgagttaagcgtagcttgtgctagtgagcatgaaccaccggcgagcattaatggaatcattgttgcaaaggacttggtgagcgttatgtgctctgtcttttatcaaacgtgtcagtggttctggatttttcgcggtctcaggtgcgacagtcctttcggtccttttggtagcatggtagaagtgtgaggattagtatggatatccacctcgacaaaatggtccataattttgtgatgcattgcgtattttactgaagggcctcagttgaatcttacaaatatgctcttgttcatttttttggatttttaagaaagtttc

SEQ ID NO: 1544 - DNA, 728 bp, Euphorbia peplus
gccgcctctctctcttcccggacctaactctcgttttctgtatatcccaaactttgatttcgtgttctgaataacttttggttgatcaacccctctgctgcttctatctatggcgacgattccagttaaccctaagccattcttgaacaacctgactggcaaaactgttattgtaaaactcaagtggggaatggaatacaaaggttttcttgcatcagttgattcatacatgaatctacagctcggcaacacagaagaatttattgatggacaatttactggaaatcttggagagattttaatcagatgcaacaatgttctttaccttcgtggtgtcccagaagacgaagacattgaagatggagatggtgatcaagcggactgaagaacaattaagcagaagtgcggtagtttaaactttctgcgaattaatgatgttgaatgcaaatgttggtatgatctaggaaggagatgttctgccctaattttctcttatgtttgtataacctgaaaatatgtagtagattgagtgatgtttttgaacatgctaagcatatattgttctcattgtcttgaagcagtaaacaatattatttgcttcttgatgcaaaagacttgcaattcttaactgaggctcctttggtaatatttattatgtaacttgtttatttgtagtgacacactcttatcccaagggtgcctgttttcttaagattgatattcaatgg

SEQ ID NO: 1545 - DNA, 409 bp, Nicotiana benthamiana
tttaatatgtggtcattgcagacggtaccagttaatcccaagccttttttgaacaatttgactggaaagcctgtgatggtaaagctaaagtggggaatggagtacaaagggtatttggtctccgtggattcatacatgaacttgcagcttgcaaacgcagaagaatacattgatggacaatgcactggttctcttggagagatcctgattagatgtaataatgtcctctatcttcgtggtgtacctgaggatgaagaactggacgatgccgaccgcgactaggaagtgttttgtattagtgtgatcgttcttttagtgcaatcagatgtctggttcatcgatcatgatggaacaacatattcgtctccttgaatgtattatcaattatgtgtaaaatttcctagatgat

SEQ ID NO: 1546 - DNA, 293 bp, Fragaria vesca
tgattgcttcttaattaccaatggcttcaataccagttaaccccaaaccattcttgaacaatctgaccggaaagtctgtgcttgtgaagcttaaatggggaatggaatacaaaggtttccttgtcactgtggattcctatatgaacttgcagcttgccaatactgaagagtttatcgatggacaattcactggaaatctcggagagattttgatcagatgcaacaatgttctctatcttcgcggggtgccggaggacgaaggaattgttgatgctcatcagcaacaggattga

SEQ ID NO: 1547 - DNA, 411 bp, Cleome spinosa
agggcggaaacaggcgcgcggtttgtcttctccgatcggcgaagcacttcttcgctcgctaatcaatggcgacgataccggtaaacccgaaaccattcttgaacaacttgaccgggaagacggtcattgtcaagcttaaatggggaatggaatacaaaggttttctggcatctgtggactcctacatgaacttgcagctcggaaatgccgaagaatacatcgatgggcaattaaccggaaacctgggagagatcttgatcagatgcaacaatgttttatacatgcgaggtgtacctgaagacgaggaactcggagatgctgatcacgacgactaaatgtttaatggagaggtacttagaggcaaatgttatccgttttgtctgaatgttagatattgtatgaacactaaat

SEQ ID NO: 1548 - DNA, 569 bp, Eutrema parvulum
attttttgcagaccataccagtaaacccgaagccattcttgaacaatttgaccggaaagacggttatcgttaagctcaaatggggaatggagtacaaaggtttcctcgcctctgttgactcctacatgaacttgcagctgggaaacactgaagaatacatcgatggacaattgacaggaaaccttggagagatcttgatcagatgcaacaatgttttgtatgtccgaggtgtgccagaagatgaagaactcggggacgctgaacaagactagcctgtaccaaggacttagaaatcgccagtctgtttgaagtcatattgtattctatgagcattttaacgcaatttgtgagatttcagctttgccgttcttgaatcttttcagatgttgagaccttaaaactaaaaagtcacaagcctttagctcaatgagaaactgaacttcttgccgtctttgtctttcggatggaattcttgtcgtttctaaccgtctttaacaggcctcagtctacggcccagaatatgtcgctatgagtaatccactcgtcacattcagaaaaccaaatgaccc

SEQ ID NO: 1549 - DNA, 463 bp, Valeriana officinalis
ctttttctttcgcctacttccgtcgtctcgatcctccagccagcatctgctcagagctgcaacctcttcgagaagagtgaactacctcgtacaatggcgaccgtaccagttaacccgaaaccatttctgaacaacttgaccgggaaagccgttattgtgaagttaaaatggggcatggagtacaaaggtttccttgttgccattgattcttacatgaaccttcagcttgcaaactcggaagagtttattgatggagaatcgactggcaatctcggagagattcttatcagatgcaacaacgtgctctacattcgtggtgttccagaagatgaagacatagaggaagcggatcgtgattagttcaaagtgtacttaattggccaagtaaagattctgttactaatatttggcagcattatctgtttaaactttgaacttcaagtaccatgtattttctgttctc

SEQ ID NO: 1550 - DNA, 458 bp, Euphorbia esula
tcaatctcactgcttctatctgttaccctatggcgaccattccagttaacccaaagccattcttgaacaacttgaccgggaaaactgttattgtaaaactcaagtggggaatggaatacaaaggttttcttgcatcagttgattcatacatgaatctacagctgggcaacacagaagaatttattgatggacaatttactggaaatcttggagagattttgatcagatgcaacaatgttctttacctgcgtggtgtcccagaagatgaagacattgaagatgcagatggtgatggtgatcaagcagactgaacttacttgagcaaataattaaggacaagtgtttatgcgaattaatgataatgttgaattcaaatgctgcctattttattatatatacacttctggtagatgtttttttctttttttgtgaaagaaaatatacgatgccctaatttg

SEQ ID NO: 1551 - DNA, 221 bp, Glycyrrhiza uralensis
actataccagttaatcccaagccttttttgaacaatttgaccgggaagcctgttattgtgaagctaaagtggggaatggagtacaagggatatcttgtttcagttgattcctatatgaacttgcagctggccaacactgaagagtacatcgagggacagtttactggaaatttaggagagattttaatcagatgtaacaatgtcctttaccttcgtggagt

SEQ ID NO: 1552 - DNA, 1130 bp, Festuca arundinacea
ttgtcatcatttcacgatgtcggctctgcctctgaaccctaaaccatttctgaacggtctgacaggaaagccggtgatggtgaagctaaaatggggcatggagtacaagggctacctcgtatctgtcgatggttacatgaaccttcagttggctaacacagaggagtacattgatggatgcctgtctggaaatctgggtgaaattctcatcagatgtaacaacgtgctgtacatccgtggtgttgaagatgataatgaagatggagaaatgagagaataaagaacaagtgtaacggctatatctcagaactatgatgataattaagtaatgctaattaagactgatagcggactgtggctaaataaccgaatgaaagaaagtaatgactgaaatagttacttttgtacttacgctgataggaacataacttttatagctaattagaattataaacttgtactttcaattgatagttgtgttgatgttgaatttagttgaaaatcgactcctcagtaattaaaaatattctttaacttaattgagtagagttaagaatttggtttgcatctaggccactacagttttctttcgctattgctagaggctaaaattctttgtactgtaggccactggctgtcctagaaaatcaaggtacctaaatacgctaagataattaaattttttgagccgctatcgatttagggatctgtacgaaatggttcagcacgactcgtaaattagttaattgtttaggctctattctcggcattgaattgaaaactttaacttagttttcttattaaatataattagttgtaaaggtaggtaaaattattttgtctgtcagagagatgagctgcaagaaatggcctcaagtttgatttgttttgtcaaaacgactgcaaagtctgtgttgaggcagtgtgtccaaagatgtggcaatcttgttaaaattatcaatcgtgttttaaaatagttagagatttatttctttctacttagatcaaaatgttgaatgtttgctagttgttaagttactgtgagtgtttccctcaagttatcatttatatgtttgtgtgtggatattatgatggctaatatagatttagataaaaaaaaaaaaaaaaaa

SEQ ID NO: 1553 - DNA, 533 bp, Arachis hypogaea
cctttcttgaacaatttgactgggaaacaagttattgtcaaattgaagtggggaatggaatacaaaggttatctagtctcagttgattcctatatgaatttgcagctggctaatactgaagaatacattgagggacaatttaccggaaacttgggagaaattttaatcagatgcaacaatgttctctaccttcgaggtgtgcctgaagatgaagaaatagatgctgctgcagaagactagaatgatgaaagcatctcagtgtaataacatcattagacctctaagattcaggttgtgtatttacatgtggatatttgggccaatggtaatcatcatttataacgttacattagagagtatattaacaggtggttactcaatgaagacattatttgaagatgtctttatggaagtaaccaccatattaacattgtggagctcagttgagacttgaaaatgtcattaatatcgtattcaatccatgcatcatccaaaaaaaagaaaaaaaacaaaagtactctgcgttgatacca

SEQ ID NO: 1554 - DNA, 499 bp, Epimedium sagittatum
tagcgcgcgtttgcaaagagagagagaaaagggcggagcttctgcacgaaaccctaaccatccatcgatctcgaacgacaatgagtgtaccagtgaacccgaaacctttcttgaacaatctgacaggaaagactgtcgtggtaaagctcaaatggggaatggaatataaagggtaccttgtttcggtggattcatacatgaacctgcagctggctgatactgaagaatttgttgatggacaggcaactggaaagattggagaaatattaattagatgcaacaatgttttgtatcttaggggtttgccagaggatgaagaaattgaggatgctccacaagattaataggaacgtcgaagtcctttcaattgtcggtttgtttgaagtcaaggagctgttggtatggtgtaatcggtaggatcattggtgcaagtagtatcatagactctggcattaaggtgttgtaatttggtttgtgcagaaatcgtgcagtgctatca

SEQ ID NO: 1555 - DNA, 599 bp, Nuphar advena
ctgcatcagagctcgtctgaagaggaggatcgtcggaggcgcaacgatggctgtgccagttaatccgaagccctttttgaacaatcttacagggaaccccgtcatagtgaagctaaagtgggggatggaataccaaggctatcttgcttcagtagactcttacatgaatttacagctagctaatgccgaggagataattgatgggcagaatgccggtcagctcggtgagattctcatcagatgcaataatgttctctatattcgtggtgtacccgaagatgaagatatggaaaatgctgggggtggctgacaatcattagatttagtgacttgtagctcattttgcattgcgttactcctttctgactatatctgtcagtactcgaaagatatttctcttacgcatttctgctaatcttcatgcttgttttaagctgttgatgactcgggcttagggttcatatgatggtgacaaattgaaatggctgtacattatataactgtgttgtttctggtcctaaactcaattttctttttcctctagttacaagctggaacgaagaaaatcaaatatagaaaatggcataacattttgggtt

SEQ ID NO: 1556 - DNA, 455 bp, Vinca minor
agctgatatccgagagaatctacaatggcgactgttcctgtgaatcccaaacctttcttgaataatcttattgggaagacagtgatggttaaactgaagtggggaatggaatacaaaggtaatcttgtgtctgtggactcatacatgaacttacagttgacaaatgctgaagaatatgttgaaggacaattcactggaagtctgggagagatactgatcagatgcaacaacgttctttatttgcgcggggttgaagatgaagaggtagaagacgttgatgaggattagagaatagctccattgtagtactacttgcccatcaagaaagattctcatttttcgtatcccatgtttctgtcaagatttagaaattacatattgtatcctaacatatctttgggtgtcattgttcctaaaatcgcattaacctctttcgtgtataatgtctcagataa

SEQ ID NO: 1557 - DNA, 488 bp, Nicotiana benthamiana
tttaatttgcggtcattgcagacagttccagttaatcccaagccttttttgaacaatttgactggaaagcctgtgatggtaaagctgaagtggggaatggagtacaaagggtatctggtctctgtggattcatacatgaacttgcagcttgcaaacgcagaagaatacattgatggacaatgcactggttctcttggagagatcctgattagatgtaataatgtcctctatcttcgtggtgtacctgaggatgaagaactggacgatgccgaccgcgactagaaaatgttttgtattagtgtgatcgttcttttagtgaaatcagatgtctggttcattgatcatggtggaacaacatattcatctccttgaatgtattatcaattatgtgtaaaatttcctagatgctgaccttaatgattactggtgcaaaatgaaccagctctatgactactgactaggaatgccatatggtcaagtttattttt

SEQ ID NO: 1558 - DNA, 613 bp, Hordeum vulgare
tgtttctttactccgctgcagactgtgccagttaaccccaagccattcttacaaaacttaacagggaagatggtcatcgtcaagctgaaatggggcatggagtacaaaggttatcttgtttcagtggactcctacatgaatctgcagctaagtggtaccgaggaattcattgatggacaatgctctggaaatttgggagacatactgataagatgcaacaatgtgatgtacctccgaggtgttccagaggtggacacggagattccagatgcggcctgaagagcacatgaactgttcctggttgatgcttgctgttcaatgctgaaaaagaacttcctagttcgtctctatttgcgcctactcgactgtattacgtacatgcattgaactcatgttgactctagttctgcatcctgaatgaacgaatgattaacttgcatgtttgaaacggctgatcgctgattgctgataggtcctgatcctgccgttgcatatgtatggtttgatgtctgaatcacgatgatcgtatttgtgcaatttgaactgcatttgctgagttcctgagcatggactcgaagtcgcataccaagcatgaaggggtgtttctgcccca

SEQ ID NO: 1559 - DNA, 804 bp, Chlamydomonas reinhardtii
acttggtactgacggtaactccattgtagtttacgcttctatcatacattacaccgctccttggcttgcgcaacctcagattgtcgcgttgctagcccttctccaggggcactcagactgcaggtcaaagcacttagttcaagacatacgcatttgctaagtacatagactttatcgacaatggcggctttcgtgccggtgaacccgaagccgttcttgcaagacctgaccggcaagcaggtcatcgtcaagcttaaatggggcatggagtacaagggctacctggtgtccacggactcgtacatgaacctgcagcttgcgagcacggaggagtacattgacggccagttcaccggccagctcggagaggtgctcattcgttgcaacaacgtgatgtacttacgaggagtgccagaggaggacgagcccatgtcatagcgctcgcgatcggctttggcggcattcaaggttgaggctggtttgtttcggacccgaacgaacgtttcgagggttggaatgcttgcgaaactgcaccgtggtagaagcaccaggccatggttgcggcccggttgcggtgggatggtggggatagtcaccaccaacacggccaggcacacgggtgggtgtcgctggtgacaggttcaagcgactgtgtgcgcctgttcactctggttgataagtgggaggtagggggattaatccagggttcagggttattgactggggcaattgcatggtcgaaacagagtctgggcgcgtgccctgtgctgctatgctcagtgcttgtaacgtgttctggtgatg

SEQ ID NO: 1560 - DNA, 319 bp, Avena sativa
gggaagccagtcatcgtgaagctgaagtggggcatggagtacaaaggatatcttgtttcagtggactcttacatgaatctgcagcttgctaatactgaggaatacattgatgggcaattctctggaaatttgggtgagatactgataagatgcaacaatgttatgtacctccgaggtgttccagaggacacagagattgaagatgctgagtgaagagtacatggccggttcctaggttgatgcatgttgttatttcactgctgaaaaaacacctccgtagtttgtctcatttgcgcacggtgactgtaaacaagcattg

SEQ ID NO: 1561 - DNA, 321 bp, Selaginella moellendorffii
ctaggagctcggtgagcgatggcgaccgtgcctgtgaatcccaagccgtttctcaatgagctcacggggaaggccgtcatggttaagctcaagtggggcatggagtacaaagggttcttgatctcggtcgattcttacatgaatttgcagctgggcaatacggaagagttcatcgatgggcagttcgcaggaaatctgggcgaagtgctgataaggtgtaacaatgtactctatcttcgtggaattccggaagaggaagaaggctctcagtgagaatggaagatggtgtaagaattttgcttgacaaaatttttccaagct

SEQ ID NO: 1562 - DNA, 1845 bp, Brachypodium distachyon
ggtgtcgctgccggccgcgaaatcccaaaaccctagccacgaccgcgcgctgccctcccgcgccgctcccgtctttgccgcgcggcgtgaccggcgggcagagaggagagcaccgaggccgcctagctgagcgggggcgatggcttcaactgtgctggaggccacgcgcgcggcgcatgaggacctggagaggctagagcggctggctgtgcgcgagctgcagcgcgacccggccaatgcccgcgaccgcctcttccagtcccaccgcgtccgccacatgatcgacctcgtcgtttccacctccgagaagctcgtggagatctatgatgacaaggatagtgccaggaaggatgagatctccactcatcttactgccccggtgcaagatgacatcttcaacaagttttatgataggctcaaagagatccgtaactaccacaggcgaaatcagtctgcccgttttgtcagtgaaactgatgattatgaagagctactaaaggaggagccggctattgaattcactggcgaggaagcgtttggtcggtacctggacttacatgaactctacaacgagttcataaattccaagtttggatcacgaatggaatactcagcatatgttggtacttttgcccagacggaaaagatcacacatagtctgaaagctaccaggcagtacaaagagtatttggagcatgttttggaatatctgacatcatttttgtatcgcacagagccattgcaagacctcgagaagatttttacaaagttggaaagtgaatttgaagaacagtgggccaatggcgaagtgcctggctgggaaaataagggcacggagaaagaaaccgcgtcacaagagtctgcgatagaccttgattactatagcactgttgaagaacttgtagagcttggtccagaaaagttgaaagaggctttagctgctcgtggattgaagagtggtggaactgttcaacagcgtgcggagcgacttttcttgctgaagcataaagccttggaactattggaccgtaagcattttgccaaaggttcgcgtagttctgtctcaaacgcacctaatggcaacaatttcaaggatgatttgaagaaagaaattgctttgctcgaaattaagatgaggcgcctatgtgagattctcgatgaggtcattgtacggacaaaggaaaatgcagagaagaagttgacattgacatatgaagaaatggaagcagaacgggaagaggaagaagtacaagctgatagtgaaagtgatgacgaagaccaacaaatctataaccctctcaagttaccaatgggttgggatgggaaacctatcccctattggctttataagcttcatggtcttggtcaggaattcaagtgcgagatatgtggcaaccatagttactgggggcgaagggcttatgagcgccatttcaaggaatggcgccatcaacatgggatgcggtgtcttggtattcctaatactaagaacttcaatgaaatcacatccatcgatgaggcgaaagcactctgggatagaatacaatccaagcaagggctgaataagtggcggccagacttagaagaagagtatgaagatcaggatggtaacatttacaacaaaaagacctacactgacctgcagcgccaaggcctgatatagaattctagatgtgattctagtgcttttgccactcgaaaggactgctgcgtgctaaaatggtcggtctactcttatgttgaaatttattgacctggatgattgttgtaaactctatcagcatacgttctatgtaaacaagagatgactgttcttttccccaagttagagtctattatgctcat

SEQ ID NO: 1563 - DNA, 1825 bp, Echinochloa colona
cccccgcgaaatcgaattccccccaaaccgtagctacccagcgcggctccccttcccgcctctctgcggcgcgagtagcgtccctctgctagcaagtagcgcggtgagtctagcgtccgggcgatggcgtcgacggtgctggaggcgacgcgggcggcgcacgaggacctggagaggctggagcggctcgcggtgcgcgagctgcagcgggacccggccaacgcgcgcgaccgcctcttccagtcccaccgcgtccgccacatgctcgacctcgtcgtctccacctccgacaagctcgtggaaatctacgaggacaaggacaatgcaaggaaggatgagattaacacacatcttactgcgcccacacaaaatgtactgtttagcaagtactatgaaaggcttaaagagatccgtgattatcataggcggaacccttctgcccgtttcgtcagtacaactgatgattacgaagagcttttgaaggaggaaccagctattgaattcactggcgaggaagcttttggccgttacctagacttgcatgagctttataatgagttcataaattccaagtttggaacaccaatggaatattcggcttacgttggcagtttcgcccagatggagaagatctcgcagagtcataaagctacaaggcaatacagggaatacttggaacacatcctggaatatcttacgtcatttctgtatcgtacagagccattgcaagatattgagaagatttttgcaaagttggaaagcgaatttgaggaacgatgggccaatggggaagtacctggttgggggaaacaatctgcgccagaagagtctgatattgaccttgattactacagcactgttgaagaacttgttgagcttggtccggagaagttgaaacaggctttagctgctcgtggtttgaagagcggcggtactgttcaacagcgcgcggaacggcttttcttgttgaagcatacacctttggaacaattggaccggaagcattttgctaaagttccacgtactaaagatgtctcaagcacagcttccgatggaaacaatttcaaggatgatttgaagaaggaaatcgctttgatggaagtaaagatgaggcgtctttgtgagctgttagatgaggtctttgtacgaacaaaggaaaatgctgagaagaaactcactttgacatatgaagagatggaagcagaacgggaagaggaggaggtacaggctgacactgagagtgatgacgaagagcaacaaatctacaaccctctcaaactaccgatgggttgggatggcaaacctatcccttattggctatacaagctacacggccttgggcaggaatttaagtgtgagatatgtggaaaccagagttattgggggcgacgggcttatgagcgtcatttcaaggagtggcgtcatcagcatgggatgagatgccttggtattcctaatacaaagaatttcaatgaaatcacatccatccaggaggcaaaaggtctgtgggagaaaatacaagcacgtcaaggtctgaacaagtggcggccagacctggaagaagagtatgaagatcaggaaggcaacatctacaacaagaagacctacactgacctgcagcggcaaggcctgatctagaattataggggcttctgctcaaaagttctggatttgtttggaactctctttatcaggatagctgttgtatctcccgaatgcattggttgtttgccatacattttatgtagaaagactttggagcttatgcgcatttcctagttgacacggtagattgtacaatgctagccttgagcaggttctcatg

SEQ ID NO: 1564 - DNA, 1906 bp, Setaria italica
acccagcgcggcttcccccttcccgcctccccgcagcgcagcttcccccttcccgcctccccgcagcgcggctcgagtgacgcgcggcccctgctagcagctgccggaggaaggtgtagcctagcgggtggcggatggcgtccacggtgctggaggctacgcgggcggcgcacgaagacctggagaggctggagcggctcgcggtgcgcgagctgcagcgggaccccgccaacgcccgcgaccgcctcttccagtcgcaccgcgtccgccacatgctcgatctcgtcgtctccacctccgacaagctcgtggaaatctacgaggacaacgacaatgcaagaaaggatgagatcaacacacatcttactgcacccacgcaaagtctactgtttagcaagtactatgaaaggctcaaagagatccgcgactatcataggcggaacccttcagcccgcttcgtcagtacaactgatgattacgaagagcttctgaaggaggaaccagttattgaattcaccggcgaggaagcttttggccgttacctagatttgcatgagctttataatgagttcataaattccaagttcggagcaccaatggaatactcggcttatgttggcagtttctcccagatggagaagatctcgcagagtcataaagctacaaggcaatacagagaatacttggaacacattctggaatatctgacatcatttctttatcgcacagagccattgcaggacattgagaagatttttgcaaagttggaaagtgaatttgaggaacgatgggccaacgaagaagtacctggatggggaaataaaagcacggaagagtctgaaatagaccttgattattacagcacagttgaagaactcgttgagcttggtccagaaaagttgaaacatgctttagccgctcgtggtttgaagagcggcggtactgttcaacagcgtgcagaacgtcttttcttgttgaagcatacacctttggagcaactggaccggaagcattttgctaaagttccacgtactaaagatgtctcagacgcatcttccaatggcaaccatttcaaggatgatttgaagaaggaaattgcgctgatggaagtaaagatgaggcgcctttgtgagctgctagatgaggtctttgtgcgaacaaaggaaaatgctgagaagaaactcactttgacatatgaagagatggaagcagaacgggaagaggaggaggtacaggctgacactgagagtgatgatgatgaacaacaaatctacaaccctctcaaattgccgatgggttgggacggcaagcctatcccctattggttatacaagctacatggccttgggcaggaatttaagtgtgagatatgtgggaaccacagttattgggggcgaagggcatatgagcgtcatttcaaggaatggcgtcatcaacatgggatgcgatgccttggtatccctaatactaagaatttcaatgaaatcacatccatcgaggaggcgagaggactctgggagaaaatacaagcacgtcaagggctgaacaagtggcggccagacctggaagaagagtatgaagatcaagaaggcaacatctacaacaagaagacctacactgacctgcagcggcaaggcttgatctaaaattctagttcaaggggctcctgctactgaaatgttcaggctgtttggaacaatatttaccaggatagttgctgtcttcaggtgtattggccgttggtttggcatacactgacattgtagatcgtacaatatcggaatgcccccctcctcttgagcagttctctggaatgtatccggtatcgtgtcatgaattaaaataccattacgtctgctctcccgcgtttgcatgatctgtttgtcaaacttaccataagaaaaac

SEQ ID NO: 1565 - DNA, 1909 bp, Sorghum bicolor
gtgctgcagtgcgccgcccctcaaccaggccagagcacacgcgcctcacctgccgccgcgccgcgtcgtctcgtcgtcctcctcgaaccgcgaaattgaaatccccaaaaccctagctgcccggcgcagctcccccctcccgcctctccgcggacacccggcctcttgtacagagcaccggaggcggctgtagcctagcaggcgggccatggcgtcgacggtgctggaggcgacgcgggcggcgcatgaggacctggagaggctggagcggctcgcggtacgcgaactgcagcgggagcccgccaacccgcgcgaccgcctctttcagtcccaccgcgtccgccacatgctcgacctcgtcgtctccacctccgacaagctcgtggaaatctatgaagacaaggacaatgctaggaaggatgagatcaacactcatcttactgctcccacgcaaagtggactgtttagcaagtactatgaaaggctcaaagagatccgtgaatatcatcggcggaacctatctgcccgttttgtcagtacaactgatgactttgaagagcttctaaaggaggaaccagttattgaattcactggcgaggaaacttttggccgttacctagacttgcatgagctttataacgagttcataaattccaagtttggaacaccgatggaatactcggcttatgttggctgtttctcccagacggacaagatctcacatagtcataaggctaccagacaatacagagaatacttggaacacgttttggaatatctgacatcatttctgtatcgcacagagccattgcaagacattgagaagatttttctaaagctggagagtgaatttgaggaacgatgggccaatggagaaatacctggatggggaaataaaggcacagaaaaggaatctgaaatagatcttgattactacagcacagttgaagaacttgttgagcttggcccagaaaagttaaaacaggctttagctgctcgtggtttgaagagtggtggtactgttcaacagcgcgcggagcggcttttcttgctgaagcatacaccgttggaacaactggacaggaagcattttgccaaagttccacgtactaaagatggctcaaacacatcttctaacgacaacaatgttaaggatgatacgaagaaggaaattgcattgatggaagtaaagatgaggcgcctttgtgagctgctagatgaggcctttgtaaggacaaaggaaaatgcggagaagaagcttacactaacgtatgaagagatggaagcagaacgggaggaggaggaggtacaagctgacaccgagagtgatgatgaagaacaacaaatctacaatcctctcaagttgccaatgggttgggatggcaagcctatcccctattggctatacaagctacatggccttgggcaggaattcaagtgtgagatatgtggaaaccatagctattgggggcgaagggcttatgagcgtcatttcaaggaatggcgtcatcagcatgggatgcgatgccttggcattcctaatactaagaatttcaatgaaatcacatccattgatgaggcgaaagcactctgggagaaaattcaagcacgacaaggagtgaacaagtggcggccagacctagaagaagagtacgaagatcaggaaggcaacatctacaacaagaagacctacactgacctgcagcgtcaaggcctgatctaaaattctagttctaggggctcctgctggttaaattttcaggatcagaactctgtttcgatatttgttgcaactctggatatattggctcatttggcatacattttgcgtagtaagatgatatgatgatactccagagtgaaatctcatgttcggctgcctttgctttcaatctcacgttgctcatgc

SEQ ID NO: 1566 - DNA, 1814 bp, Avena sativa
cacccagccgttcgtttccgctcgtcctcccgaagtcccgaccgcggaatccccaaaccctagccgcgactctgccgcgcggcgtcacccgcgggatctgctaaccagcagaggaggggacagggttgccctagctgaagcggcggcaatggcgtcgtcggtgctagaggccacgcgggcggcgcacgaggacctggagcggctagagcgcctggcggtgcgcgagctgcagcgcgacccggccaacgcgcgcgaccgtctcttccagtcccaccgcgtccgcaacatcatcgacctcgtcgtcaccacttccgacaggctggtggaaatctatgaagacaaggacggtgctaggaaagaagagatctctaaccatttgactgctccggtgcaagatgacatcttccacaagttctttgataggctcaaagatatccgtgaatcccataggcggaatcactctgctcgttttgtcagcgaaactgacgatcatgaagagctactaaaggaggaaccggctattgaattctctggcgaggaagcatttggtcggtacctggatttgcatgagctctacaacgagttcataaattccaagtttggatcgctcatggaatactcggcatatgttggcaccttttctcagacagagaagatcacacatagtctaaaagctaccaggcaatacaaagaatatttggagcatattttggaatatttgacatattttcttgcgtcgcacagagccattgcaagatcttcagaagatctttacaaagttggaaagtgagtttgaagaacagtgggccaatggcgaagtacctggctgggagaataagggcacagaaaaagaatctgtgatgcaagagtctgaagtagaccttgatttctataattcggttgaagaacttgtagagcttggtcctgaaaagttgaaagaggctctagctgctcgtggactgaaagctggtggcactgttcaacagcgtgcggagcgacttttcttgctgaagcatacaccattggaacaattggaccgcaagcattttgcaaaaggttcacgtagttctgtctcaaatgtgccttctaatggcaacaattccaaggatgatctgaagaaggaaattgctttgattgaattaaagatgaggcgcctgtgtgagattctcgatgaggtcattgtaagaacaaaggaaaatgcggagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggtcaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcaaaggcactctgggagaaaatacaatcaaagcaagggctgaacaagtggcggccagacttggaagaagagtacgaggatacagatggcaacatctacaacagaaagacttacactgacctgcagcgccaaggcctgatatagaattgtagatgtgatcctagtgcactgttgtggcgtgctaaaatggttggtatactgtcctatgcagatctgttgactttgctggtcgttgtaaccttgtattgccttgcatacatttgtaatgatggtacttcggag

SEQ ID NO: 1567 - DNA, 1836 bp, Sorghum bicolor
aaaccctagctacccggcgcaactcctcccccttcccgcctcactgcggcgctgcgcgacacccggcctccgccggaacaccggaggcgggtgtagcctagcgggcgggccatggcgtcaacggtgctggaggcgacgcgggcggcccatgaggacctggagaggctggagcggctcgcggtgcgcgagctgcaaagggatcccgctaatccgcgcgaccgcctctttcagtctcaccgcgtccgccatatgctcgacctcgtcgtctccacctccggcaagctcgtggaaatctacgaggacaaggacaatgctaggaaggatgagatcaatactcatcttactgcgcccacgcaaagtggactgtttagcaagtactatgaaaggctcaaagagatccgtgaatatcatcggcggaacccatctgcccgttttgtcagtacaactgatgactatgaagagcttctaaaggaggaaccaattattgaattcactggcgaggaatcttttggtcgttaccttgacttgcatgagctttataatgagttcataaattccaagtttggaacgccaatggaatactcggcttatgttggctgtttctcccagacggacaagatctcacatagtcataaagctaccagacaatacagagaatacttggaacacattttggaatatctgacgtcatttctgtatcgcacagaaccattgcaagacattgataagatttttttaaagctggagagtgaattcgaggaacgatgggccaatggagaaatacctggatggggaaataaaggcgcagaaaaagagtctgaaatagatcttgattactacagcacagttgaagaacttgttgagcttggcccagaaaaattaaaacaggctttagctgctcgaggtttgaagagtggtggtactgttcaacagcgtgcggatcggcttttcttgctgaagcttacaccattggagcaactggataggaagcattttgccaaagttccacatactaaagatggctcaaacacagcttctaatggcaacactttgaaggatgatatgaagaaagaaattgcattgatggaagtaaagatgaagcgtctttgtgagctgctagatgaggcctttgtgaggacaaaggaaaatgcggagaagaagcttactttgacgtatgaagagatggaagcagaacgggaggaggaggaggtgcaagctgactccgagagtgatgatgaagagcaacaaatctacaatcctctcaagttgccaatgggttgggatggcaagcctatcccctattggctgtacaagctacatggccttgggcaggaattcaagtgtgagatatgtggaaaccatagctattgggggcgaagggcttatgagcgtcatttcaaggaatggcgtcatcagcatgggatgcgatgccttggcattcccaatactaagaatttcaatgaaattacatccatcgatgaagcgaaagcgctctgggagaaaattcaagcacgacaaggggtgaacaagtggcggccagacctagaggaagagtacgaggatcaagaaggcaacatctacaacaagaagacatacactgacctgcagcgtcaaggcctgatctagggctccagctggttaagttgttgggatttgttcagaactctatctcatatggttgtaattgtaactctggatatattgtgccatttggcatacggtttatatgtagtaagataatactccggagctcgtgtgaattttcctggtcgtccataactatgttatgttttacattttactagcaaacatgtctgttgcaatgcaaagaaccca

SEQ ID NO: 1568 - DNA, 1763 bp, Avena sativa
ccagccggtccgctcgtcctcccgagtccccagtccccaatcccgaccgtggaatccctaaaccctagaccgtgtgtgccctagctgaagcggcggcgatggcgtcgtcggtgctggaggccacgcgggcggcgcacgaggacctggagcggctagagcgcctggcggtgcgcgagctgcagcgtgacccggccaacacgcgcgaccgtctcttccagtcccaccgcgtccgcaacatcatcgacctcgtcgtcaccacttccgacaggctggtggaaatctatgaagacaaggatggtgctaggaaagaagagatctctaaccatttgactgctccggtgcaagatgacatcttccacaagttctttgataggctcaaagatatccgtgaatcccataggcggaatcactccgctcgttttgtcagcgaaactgacgatcatgaggagctactaaaggaggaaccggctattgaattctctggcgaggaagcatttggtcggtacctggatttgcatgagctctacaacgagttcataaattccaagtttggatcgctcatggaatactcggcatatgttggcactttttctcagacagagaagataacgcatagtctaaaagctaccaggcaatacaaagaatatttggagcatattttggaatatctgacatattttctgcgtcgcacagagccattgcaagatcttcagaagatctttacaaagttggaaagtgagtttgaagaacagtgggccaatggcgaagtacctggctgggagaataagggcacagaaaaagaatctgtggtgcaagagtctgaagtagaccttgattactataattctgttgaagaacttgtagagcttggtccagaaaagttgaaagaggctctagctgctcgtggactgaaagctggtggcactgttcaacagcgtgcggagcgacttttcttgctgaagcatacaccattggaacaattggaccgcaagcattttgcaaaaggttcacgtagttctgtctcaaatgtgccttctaatggcaacaattccaaggatgatttgaagaaggaaattgctttgatcgaattaaagatgaggcgcctgtgtgagattctcgatgaggtcattgtaagaacaaaggaaaatgcggagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggtcaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcgaaggcactctgggagagaatacaatcaaagcaagggctgaacaagtggcggccagacttggaagaagagtacgaggatacagatggcaacatctacaacagaaagacttacactgacctgcagcgccaaggcctgatatagaattgtagatctgttcctagtgcactgttgtgacgtgctaaaatggttggtatactgtcctatgcagatctgttgactttgctggtcgttgtaaccttgtattgccttgcatacatttatagtgatggtacttcggag

SEQ ID NO: 1569 - DNA, 1909 bp, Festuca arundinacea
ggcacgagggtcctcccgagtcccgaccgcggaatccccaaaaccctagccacgaccccgccggacccagcagaggagcggaccggggctgccctagctagccgaagcggcggcgatggcgtcgtcggtgctggaggccacgcgcgcggcgcacgaggacctggagcggctcgagcgcctggcggtgcgcgagctgcagcgcgaccccgccaacgcgcgcgaccgcctcttccagtcccaccgcgtccgcaacatcatcgacctcgtcgtcaccacctccgacaggctcgtggaaatctatgaagacaaggacggtgctaggaaggaagagatctccaaccatttgactgctccggcgcaagacgacatcttccacaagttctttgacaggctcaaagatatccgtgaatcccataggcggaatcactctgctcgttttgtcagtgatactgacgatcatgaagagctactaagggaggaaccggctattgaattctctggcgaggaagcatttggtcggtacctggatttgcatgagctgtacaacgagttcataaattccaagtttggatcgctcatggaatactcggcatatgtcggcaccttttctcagacggagaagatcacacatagtctaaaagctaccaggcaatacaaagaatatttggagcatattttggaatatctgacatattttctgcgtcgcacagagccattgcaagatcttcagaagatatttacaaagttggaaagtgattttgaagaacagtgggccaatggtgaagtacctggctgggagaataagggcacagaaaaagaatctgtgctgcaagagtctgaagtagaccttgattactatagctctgttgaagaacttgtagagcttggtccggaaaagttgaaagaggctttagctgctcgtggactgaaaggtggtggcactgttcaacagcgtgcggagcgactcttcttgctgaagcatacaccattggaacaattggaccgtaagcattttgtaaaaggttcacgtagttctgtctcaaatgtgccttctaatggcaacaattccaaggatgatttgaagaaggaaattgccttgatcgaagtaaagatgaggcgcctgtgtgagattcttgatgaggtcattgtaagaacaaaggaaaatgcggagaagaaactgactttgacctatgaagaaatggaagcagaacgagaagaggaagaagtacaagctgatagtgaaagtgatgacgaagaccaacaaatctacaaccctctcaagttaccaatgggctgggatggaaaacctatcccctattggctctataagcttcacggtcttggtcaggaattcaagtgcgagatatgtggcaaccacagttactgggggagaagggcttatgagcgccatttcaaggagtggcgccaccagcatgggatgcgatgccttggtattcctaataccaagaacttcaatgaaatcacatccattgaggaggcgaaggcactctgggagagaatacaatcaaagcaagggctgaacaagtggcggccagacttggaagaagagtacgaggatacagatggcaatatctacaacaagaagacttacactgacctgcagcgccaaggcctgatatagaattgtagctgtgatcctagtgcactgctgccgcgtgctaaaatggttggtctactgttccatggaaatctgttgacttaccctgctgtcgtaaccttgtattgacatacattatttctagcaacatggtacttcggagatgactgttttcttcctgttacattgtcaaatgtgctctagccgccacttttgctcggcttgctttgcgttttatctgcgtgacgggtaattgtgtgatgtggatggacaaaaaaaaaaaaaaaaaaa

SEQ ID NO: 1570 - DNA, 2257 bp, Triticum aestivum
cgagggagaaatagacgagcccgagccgttcctctccgctcgtcttcccgacagtcggtccctggccgcgaaatctcaaaaccctagccacgacgctctcccctcccgacgcccctcgccgctcccagactctgcgcgcagcgtgacccccgggctctgttggtaccacacggggtaccggcagaggagagggttagggcgccctagctgaagcggcagccatggcgtcgtctgtgctggaggccacgcgggcggcgcacgaggacctcgagcggttagagcgcctggcggtgcgcgagctgcagcgcgaccccgccaacgcgcgcgaccgcctcttccagtcccaccgcgtccgccacatgctcgatctcgtcgtctccacttccgacaagctggtggaaatctatgaagacaaggacggtgctaggaaggatgagatctccacccatcttaccgcgccggtgcaaagtgacatcttccccaagtactatgaaaggctgaaagagattcgtgattaccatagacggaatcactctgcccgtttcgtcagtgaaactgatgattatgaggagctactaaaggaggaaccagctattgaattcactggcgaggaagcatttggccggtacttggacctacatgagctctacaacgagttcataaattccaagtttggatcactaatggaatactcagcatacgttggcacttttgctcagactgaaaaaatcgcacataatctaaaagctaccaggccatacaaagaatatttggagcatattttggaatatctgatgtcatttctgtatcgtacagaaccgttgcaagatattgagaagatttttacaaagttggaaagtgagtttgaagaacagtggatcaatggcgaagttcctggatgggagaataagggcacagagaaagaatctgtgttgcaagagtctgcagtagaccttgattactacagtactgttgaagagcttgtagagcttggtccggaaaagttgaaggaggctttaactgctcgtggattgaagggtggtggcactgttcaacagcgtgctgagcgacttttcttgctgaagcatacacccttggaaaagctggatcgtaagcattttgccaaaggtgatgatttgaagaaggaaattgctttgattgaaatgaagatgaagcgcttatgtgagattctcgatgaggtcattgtaagaacaaaggaaaatgcggagaagaagctgaccttgacctatgaagaaatggaagcagagcgggaagaggaagaagtacaagctgatagtgaaagtgatgatgaagaccaacaaatctacaaccccctcaagttaccaatgggctgggacgggaaacctatcccttattggctctataagcttcacggtcttggtcaggaattcaagtgtgaaatatgtggtaaccacagttactgggggcgaagggcttatgagcgccatttcaaggagtggcgccatcagcatgggatgcgatgccttggcattcctaatactaagaacttcaatgaaattacatccatcaaggaagcgacagcactctgggagagaatacaagcaaagcaagggcagaacaagtggcggccagacttggaagaagagtatgaagataaggatggaaacatctacaacaaaaagacctatactgatctgcagcgccaaggcctgatatagaattctggatgtgattctagtgctttggaaggaacgcgacgctaaaatcgttggtctactgttatattgatacttgctgaacttgttggtcgttgtgactttttattagcttgcattatatgtagccagatggcacctcggagttacaatttctttcttcgggttacattgcatattatgctttactggtcaatcttagtcagcggtttttgtttattcgaccaaatctcctatctcattatgcttactttatagtgtcaacctggagaaagcaatattctgtatgtaacagtgacagtttgatgcttaagcgctcagtggggtgggctgaaagttgcgagctgttcgatcgaagtatgaatctgcatcgatcgtagtatgaatctgcaaaccgaggcaaacggaagcaaaggcggtttagtgtacccattttctctctctaagaagcctggtaaaatctcgaactatggcgttttggtgggctcagcctttgaagcttaaaatcatttgtattatacttattttactaaaataagctgacgccccaggcaggtaag

SEQ ID NO: 1571 - DNA, 1731 bp, Avena sativa
ccagccggtccgctcgtcctcccgagtccccagtccccaatcccgaccgtggaatccctaaaccctagaccgtgtgtgccctagctgaagcggcggcgatggcgtcgtcggtgctggaggccacgcgggcggcgcacgaggacctggagcggctagagcgcctggcggtgcgcgagctgcagcgcgaccccgccaacgcgcgcgaccgcctgttccagtctcaccgtgtccgcaacatcatcgacctcgtcatcaccacttccgacaggctggttgaaatctatgaagacaaggacggtgctaggaaagaagagatctccaaccatttgactgctccggtgcaagatgacatcttccacaagttctttgataggctcaaagatatccgtgaatcccataggcggaatcactctgctcattttgtcagcgaaactgatgatcatgaagagctactaaaggaggaaccggctattgaattctctggcgaggaagcatttggtcggtacctggatttgcatgagctctacaacgagttcataaattccaagtttggatcgctcatggaatactcggcatatgttggcaccttttctcagacagagaagatcacacatagtctaaaagctaccaggcaatacaaagaatatttggagcatattttggaatatttgacatattttctgcgtcgcacagagccattgcaagatcttcagaagatttttacaaagttggaaagtgagtttgaagaacagtgggccaatggcgaagtacctggctgggagaataagggcacagaaaaagaatctgtcgtgcaagagtctgaagttgaccttgatttctataattctgttgaagaacttgtagtgcttggtccagaaaagttgaaagaggctctagctgctcgtggactgaaagctggtggcactgttcaacagcgtgcggagcgacttttcttgctgaagcatacaccattggaacaattggaccgcaagcattttgcaaaaggttcacgttgttctgtctcaaatgtgccttctaatggcaacaattccaaggatgatttgaagaaggaaattgctttgatcgaattaaagatgaggcgcctgtgtgagattctcgatgaggtcattgtaagaacaaaggaaaatgcagagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggtcaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcgaaggcactctgggagagaatacaatcaaagcaagggctgaacaagtggcggccagacttggaagaagagtacgaggatacggatggcaacatctacaacagaaagacttacaccgacctgcagcgccaaggcctgatatagaattgtagacgtgatcctagtgcactgttgtggcgtgctaaaatggttggtctactctgttctatgcagatctgttgactttcctggtcgttgtaacctcgtattg

SEQ ID NO: 1572 - DNA, 1762 bp, Avena sativa
ccagccggtccgctcgtcctcccgagtccccagtccccaatcccgaccgtggaatccctaaaccctagaccgtgtgtgccctagctgaagcggcggcgatggcgtcgtcggtgctggaggccacgcgggcggcgcacgaggacctggagcggctagagcgcctggcggtgcgcgagctgcagcgtgacccggccaacacgcgcgaccgtctcttccagtcccaccgcgtccgcaacatcatcgacctcgtcgtcaccacttccgacaggctggtggaaatctatgaagacaaggacggtgctaggaaagaagagatctctaaccatttgactgctccggtgcaagatgacatcttccacaagttctttgataggctcaaagatatccgtgaatcccataggcggaatcactccgctcgttttgtcagcgaaactgacgatcatgaagagctactaaaggaggaaccggctattgaattctctggcgaggaagcatttggtcggtacctggatttgcatgagctctacaacgagttcataaattccaagtttggatcgctcatggaatactcggcatatgttggcaccttttctcagacagagaagatcacacatagtctaaaagctaccaggcaatacaaagaatatttggagcatattttggaatatctgacatattttctgcgtcgcacagagccattgcaagatcttcagaagatttttacaaagttggaaagtgagtttgaagaacagtgggccaatggcgaagtacctggctgggagaataagggcacagaaaaagaatctgtcgtgcaagagtctgaagttgaccttgatttctataattctgttgaagaacttgtagtgcttggtccagaaaagttgaaagaggctctagctgctcgtggactgaaagctggtggcactgttcaacagcgtgcggagcgacttttcttgctgaagcatacaccattggaacaattggaccgcaagcattttgcaaaaggttcacgtagttctgtctcaaatgggccttctaatggcaacaattccaaggatgatttgaagaaggaaattgctttgatcgaattaaagatgaggcgcctgtgtgagattctcgatgaggtcattgtaagaacaaaggaaaatgcggagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggtcaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcgaaggcactctgggagagaatacaatcaaagcaagggctgaacaagtggcggccagacttggaagaagagtacgaggatacggatggcaacatctacaacagaaagacttacaccgacctgcagcgccaaggcctgatatagaattgtagacgtgatcctagtgcactgttgtggcgtgctaaaatgcttggtatactgttctatgcagatctgttgactttcctgctggttgtaaccttgtattgacatgcatacatttgtagcgatggtactccgga

SEQ ID NO: 1573 - DNA, 1812 bp, Avena sativa
cacccagccgttcgtttccgctcgtcctcccgaagtcccgaccgcggaatccccaaaccctagccgcgactctgccgcgcggcgtcacccgcgggatctgctaaccagcagaggaggggacaggggtgcccttgctgaagcggcggcaatggcgtcgtcggtgctagaggccacgcgggcggcgcacgaggacctggagcggctagagcgcctggcggtgcgcgagctgcagcgcgaccccgccaacgcgcgcgaccgcctgttccagtctcaccgtgtccgcaacatcatcgacctcgtcatcaccacttccgacaggctggttgaaatctatgaagacaaggacggtgctaggaaagaagagatctccaaccatttgactgctccggtgcaagatgacatcttccacaagttctttgataggctcaaagatatccgtgaatcccataggcgaaatcactccgcttgttttgtcagcgaaactgacgatcatgaggagctactaaaggaggaaccggctgttgaattctctggcgaggaagcatttggtcggtacctggatttgcatgagctctacaacgagttcataaattccaagtttggatcgctcatggaatactcggcatatgttggcattttttctcagacagagaagataacgcatagtctaaaagctaccaggcaatacaaagaatatttggagcatattttggaatatctgacatattttctgcgccgcacagagccattgcaagatcttcagaagatttttacaaagttggaaagtgagtttgaagaacagtgggccaatggcgaagtacctggctgggagaataagggcacagaaaaagaatctgtggtgcaagagtctgaagtagaccttgattactataattctgttgaagaacttgtagagcttggtccagaaaagttgaaagaggctctagctgctcgtggactgaaagctggtggcactgttcaacagcgtgcggagcgacttttcttgctgaagcatacaccattggaacaattggaccgcaagcattttgcaaaaggttcacgtagttctgtctcaaatgtgccttctaatggcaacaattccaaggatgatctgaagaaggaaattgctttgattgaattaaagatgaggcgcctgtgtgagattctcgatgaggtcgttgtaagaacaaaggaaaatgcagagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggccaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcgaaggcactctgggagagaatacaatcaaagcaagggctgaacaagtggcggccagacttggaagaagagtacgaggatacggatggcaacatctacaacagaaagacttacaccgacctgcagcgccaaggcctgatatagaattgtagacgtgatcctagtgcactgttgtggcgtgctaaaatgcttggtatactgttctatgcagatctgttgactttcctgctggttgtaaccttgtattgacatgcatacatttgtagcgatggtactccggg

SEQ ID NO: 1574 - DNA, 1940 bp, Saccharum officinarum
cccaaatctatcccaaacagggccctcgtctcgtcctcgtcctcgtcccgcgaaaacgaaatccccaaaaccctaactacccggcgcaactcccacctttccgcctctccgcggcgctgcgcgacacccggcctccgctacgaagcaccggaggcgggtgtagcctagcgggcgggccatggcgtcaacggtgctggaggcgacgcgggcggcccatgaggacctggagaggctggagcggctcgcggtgcgcgagctgcaacgggagcccgctaacccgcgcgaccgcctctttcagtcccaccgcgtccgccacatgctcgacctcgtcgtctccacctccggcaagctcgtggagatctatgaggacaaggacaatgctaggaaggatgagatcaatactcatcttactgcgcccacgcaaagtggactgtttagcaagtactatgaaaggctcaaagagatccgtgaatatcatcggcggaacccatctgcccgttttgtcagtacaactgatgactatgaagagcttctaaaggaggaacttgttattgaattcactggcgaggaaacttttggccgttaccttgacttgcatgagctttataacaagttcataaattccaagtttggaacgccgatggaatactcggcttatgttggctgtttctcccagacggacaagatctcacatagtcataaagctaccagacaatacagagaatacttggaacacattttggaatacctgacatcatttctgtatcgcacagagccattgcaagacattgataagatttttttaaagctggagagtgaatttgaggaacgatgggccaatggagaaatacctggatggggaaataaaggcgcagaaagggagtctgaaatagatcttgattactacagcacagttgaagaacttgttgagctcggcccagaaaaattaaaacaggctttagctgctcgaggtttgaagagtggtggtactgttcaacagcgtgcggatcggcttttcttgctgaagcttacaccgttggagcaactggataggaagcattttgccaaagttccacatactaaagatggctcaaacacagcttctaatggcaacacttttagggatgatatgaagaaagaaattgcattgatggaagtaaagatgaagcgtctttgtgagctgctagatgaggcctttgtaaggacaaaggaaaatgcggagaagaagcttactttgacgtatgaagagatggaagcagaacgggaggaggaggaggtacaagctgacactgagagtgatgatgaagagcaacaaatctacaatcctctcaagttgccaatgggttgggatggcaagcctatcccctattggctgtacaagctacatggccttgggcaggaattcaagtgtgagatatgtggaaaccatagctattgggggcgaagggcttatgagcgtcatttcaaggaatggcgtcatcagcatgggatgcgatgccttggcattcccaatactaagaatttcaatgaaattacatccatcgatgaggcgaaagcgctctgggagaaaattcaagcacgacaaggggtgaacaagtggcggccagacctagaagaagagtacgaagatcaagaaggcaacatctacaacaagaagacctacactgacctgcagcgtcaaggcctgatctagggctcctgctggttaagtttcgggatttgttcagaactctatctcatatagttgtaactctgaatatattgtgccatttggcatacgttttatgtagtaagatgatactcaggagctcgtgtgctcttcctggttgtcatggtagtcttttcctgtgtttgcccagcctggtcgtccgtaactatgttgtgttttacattttactagcaaacatgtcagtgtgttgcaaagcaaagaacccaatata

SEQ ID NO: 1575 - DNA, 2051 bp, Triticum aestivum
ggagggagaaatagacgagcccgagccgttcctctccgctcgtcttcccgacagtcggtccctggccgcgaaatctcaaaaccctagccacgacgcgctcccctcccgacgcccctcgccgctcccaggatctgcgcgcagcgtgacccccgggctctgttggtaccacacggggtaccggcagaggagagggttagggcgccctagctgaagcggcagccatggcgtcgtctgtgctggaggccacgcgggcggcgcacgaggacctcgagcggttagagcgcctggcggtgcgcgagctgcagcgcgaccccgccaacgcgcgcgaccgcctcttccagtcccaccgcgtccgccacatgctcgatctcgtcgtctccacttccgacaagctggtggaaatctatgaagacaaggacggtgctaggaaggatgagatctccacccatcttaccgcgccggtgcaaagtgacatcttccccaagtactatgaaaggctgaaagagattcgtgattaccatagacggaatcactctgcccgtttcgtcagtgaaactgatgattatgaggagctactaaaggaggaaccagctattgaattcactggcgaggaagcatttggccggtacttggacctacatgagctctacaacgagttcataaattccaagtttggatcactaatggaatactcggcatacgttggcacttttgctcagactgaaaaaatcgcacataatctaaaagctaccaggccatacaaagaatatttggagcatattttggaatatctgatgtcgtttctgtatcgtacagaaccgttgcaagatattgagaagatttttacaaagttggaaagtgagtttgaagaacagtggaccaatggcgaagttcctggatgggagaataagggcacagagaaagaatctgtgttgcaagagtctgcagtagaccttgattactatagtactgttgaagagcttgtagagcttggtccggaaaagttgaaggaggctttaactgctcgtgggttgaagggtggcggcactgttcaacagcgtgctgagcgacttttcttgctgaagcatacacccttggaaaaactggatcgcaagcattttgccaaaggtgatgatctgaagaaggaaattgctttgattgaaatgaagatgaagcgcttatgtgagattctcgatgaggtcattgtaagaacaaaggaaaacgcggagaagaagctgaccttgacctatgaagaaatggaagcagagcgggaagaggaagaagtacaagctgatagtgaaagtgatgatgaagaccaacaaatctacaaccccctcaagttaccaatgggctgggacgggaaacctatcccttattggctctataagcttcacggtcttggtcaggaattcaagtgtgaaatatgtggtaaccacagttactgggggcgaagagcttatgagcgccatttcaaggagtggcgccatcagcatgggatgcgatgccttggcattcctaatactaagaatttcaatgaaattacatccatcaaggaggcgacggcactctgggagagaatacaagcaaagcaagggcagaacaagtggcggccagacttggaagaagagtacgaagataaggatggaaacatctacaacaaaaagacctatactgatctgcagcgccaaggcctgatatagaattctgcatgtgattctcgtgctttggaaggaacgcgacgctaaaatcgttggtctactgttctattgatacctgctgaacttgatggtcgttgtgactttttattagcttacattatatgtaaccagatgtcacctcggagttaatttccttctttgggttacattgcatattatgctttattggttgatcttcctcagcggtctttgtttattcgccaaatctcctgtctcatattatgcttactttgtagtgtcaacctggagaaagcaacattctggatgtaacattgacagtttgatgcttaagagctcagtggggtgggctgaaagttgcctgctgttcgatcg

SEQ ID NO: 1576 - DNA, 1810 bp, Avena sativa
acccagccgttcggttctgctcgccctcccgaagtcccgaccgcggaatccccaaaccctagccgcgactctgccgcgcggcgtcacccgcgggatctgctaaccagcagaggaggggacaggggtgcccttgctgaagcggcggcaatggcgtcgtcggtgctagaggccacgcgggcggcgcacgaggacctggagcggctagagcgcctggcggtgcgcgagctgcagcgtgacccggccaacacgcgcgaccgtctcttccagtcccaccgcgtccgcaacatcatcgacctcgtcgtcaccacttccgacaggctggtggaaatctatgaagacaaggacggtgctaggaaagaagagatctccaaccatttgactgctccggtgcaagatgacatcttccacaagttctttgataggctcaaagatatccgtgaatcccataggcggaatcactctgctcattttgtcagcgaaactgacgatcatgaagagctactaaaggatgaaccagctattgaattctctggcgaggaagcatttggtcggtacctggatttgcatgagctctacaacgagttcataaattccaagtttggatcgctcatggaatactcggcatatgttggcaccttttctcagacagagaagataacgcatagtctaaaagctaccaggcaatacaaagaatatttggagcatattttggaatatctgacatattttctgcgtcgcacagagccattgcaagatcttcagaagatttttacaaagttggaaagtgagtttgaagaacagtgggccaatggcgaagtacctggctgggagaataagggcacagaaaaagaatctgtcgtgcaagagtctgaagttgaccttgatttctataattctgttgaagaacttgtagtgcttggtccagaaaagttgaaagaggctctagctgctcgtggactgaaagctggtggcactgttcaacagcgtgcggagcgacttttcttgctgaagcatacaccattggaacaattggaccgcaagcattttgcaaaaggttcacgtagttctgtctcaaatgtgccttctaatggcaacaattccaaggatgatctgaagaaggaaattgctttgatcgaattaaagatgaggcgcctgtgtgagattctcgatgaggtcattgtaagaacaaaggaaaatgcggagaagaaactgactttgacttatgaagaaatggaagcagaacgagaagaggaagaagtacaagctgatagtgaaagtgatgacgaagaccaacaaatatacaaccctctcaagttaccaatgggttgggacggaaaacctatcccctattggctctataagcttcatggtcttggtcaggaattcaagtgcgagatatgtggcaaccacagttactgggggagaagggcttatgagcgccatttcaaggagtggcgccaccagcatgggatgcgatgccttggtattcctaatactaagaacttcaatgaaatcacatccatcgaggaggcaaaggcactctgggagaaaatacaatcaaagcaagggctgaacaagtggcggccagacttggaagaagagtacgaggatacggatggcaacatctacaacagaaagacttacaccgacctgcagcgccaaggcctgatatagaattgtagacgtgatcctagtgcactgttgtggcgtgctaaaatggttggtatactgtcctatgcagatctgttgactttgctggtcgttgtaaccttgtattgccttgcatacatttgtaatgatggtacttcgg

SEQ ID NO: 1577 - DNA, 1850 bp, Triticum aestivum
gcgtcgtctgtgctggaggccacgcgggcggcgcacgaggacctcgagcggttggagcgcctggcggtgcgcgagctccagcgcgacccggccaacgcccgcgaccgcctcttccagtcccaccgcgtccgccacatgctcgatctcgtcgtctccacttccgacaagctggtggaaatctatgaagacaaggacggtgctaggaaggatgagatctccacccatcttaccgcgccggtgcaaagtgacatcttccccaagtactatgaaaggctgaaagagattcgtgattaccatagacggaatcactctgcccgtttcgtcagtgaaactgatgattatgaggagctactaaaggaggaaccagctattgaattcactggcgaggaagcatttggccggtacttggacctacatgagctctacaacgagttcataaattccaagtttggatcactaatggaatactcagcatacgttggcacttttgctcagactgaaaaaatcgcacataatctaaaagctaccaggccttacaaagaatatttggagcatattttggaatatctgatgtcatttctgtatcgtacagaaccgttgcaagatattgagaagatttttacaaagttggaaagtgagtttgaagaacagtggaccaatggcgaagttcctggatgggagaataagggcacagagaaagaatctgtgttgcaagagtctgcagtagaccttgattactacagtactgttgaagagcttgtagagcttggtccggaaaagttgaaggaggctttaactgctcgtggattgaagggtggcggcactgttcaacagcgtgctgagcggcttttcttgctgaagcatacacccttggaaaaactggatcgtaagcattttgccaaaggtgatgatttgaagaaggaaattgctttgactgaaatgaagatgaagcgcttatgtgagattctcgatgaggtcattgtaagaacaaaggaaaacgcggagaagaagctgaccttgacctatgaagaaatggaagcagagcgggaagaggaagaagtgcaagctgatagtgaaagtgatgatgaagaccaacaaatctacaaccccctcaagttaccaatgggctgggacgggaaacctatcccttattggctctataagcttcacggtcttggtcaggaattcaagtgtgaaatatgtggtaaccacagttactgggggcgaagggcttatgagcgccatttcaaggagtggcgccatcagcatgggatgcgatgccttggcattcctaatactaagaacttcaatgaaattacatccatcaaggaggcgacgacactctgggagagaatacaagcaaagcaagggcagaacaagtggcggccagacttggaagaagagtatgaagataaggatggaaacatctacaacaaaaagacctatactgatctgcagcgccaaggcctgatatagaattctggatgtgattctagtgctttgaaggaacgcgacgctaaaatcgttggtctactgttctattgatacctgctgaacttgatggtcgttgtgactttttattagattacattatatgtagccagatggcacctcggagttacaatttccttctttgggttgcattgcatattatgctttactggtcaatcttagtcagcggtctttgtttattcgaccaaatctcctatctcattatgcttactttatagtgtcaacctggagaaagcaatcttagtcagtgacagtttgatgcttaagcgctcagtggggtgggctgaaagttgtgtgctgttcgatcgaagtataaatctgcatcgaagtatgaatct

SEQ ID NO: 1578 - DNA, 1836 bp, Secale cereale
ccactacgctctcctctcccgacccccctcgcggctcccagactctgcgagcagcgtgacccgcgggctctgttggtaccacacggggtaccagcagaggagagggctagggcgccctagctgaagcggcagccatggcgtcgtctgtgctggaggccacgcgggcggcgcacgaggacctcgagcggttagagcgcctggcggtgcgcgagcttcagcgcgaccccgtcaacgcgcgcgaccgcctcttccagtcccaccgcgtccgtcacatgctcgatctcgtcgtctccacttccgacaagctggtggaaatctatgaagacaaggacggtgctaggaaggatgagatctccacccatcttaccgcgccggtgcaaagtgacatcttccctaagtactatgaaaggctgaaagagattcgtgattatcatagacggaatcactctgcccgtttcgtcagtgaaactgatgattatgaggagctactaaaggaggaaccggctattgaattcactggcgaggaagcatttggccggtacttggacttacatgagctctacaacgagttcataaattccaagtttggatcactaatggaatactcagcatatgttggcacttttgctcagactgaaaaaatcgcacataatctaaaagctaccaggccatacaaagaatatttggagcacattttggaatatctgatgtcatttctgtatcgtacagagccattgcaagatattgagaagatttttacaaagttggaaagtgagtttgaagaacagtggaccaatggcgaagttcctggatgggagaacaagggcacagagaaagattctgtgttgcaagagtctacagtagaccttgattactacagtactgttgaagagcttgtagagcttggtccggaaaagttgaaggaggctttaactgctcgtggattgaagggtggcggcactgttcaacagcgtgctgagcgacttttcttgctgaagcatacacccttggaaaaactggatcgtaagcattttgccaaaggtgatgatttgaagaaggaaattgctttgattgaagtgaagctgaagcgcttatgtgagattctcgatgaggtcattgtaagaacaaaggaaaatgcggagaagaagctgactttgacctatgaagaaatggaagcagagcgggaagaggaagaagtacaagctgatagtgaaagtgatgatgaagaccaacaaatctacaaccccctcaagttaccaatgggctgggacgggaaacctatcccttattggctctataagcttcacggtcttggtcaggaatttaagtgcgaaatatgtggtaaccacagttactgggggcgaagggcttatgagcgccatttcaaggagtggcgccatcagcatgggatgcgatgccttggcattcctaatactaagaacttcaatgaaattacatccattaaggaggcgacggcactctgggagagaatacaagcaaagcaagggcagaacaagtggcggccagacttggaagaagagtacgaagataaggatggaaacatctacaacaagaagacctatactgacctgcagcgccaaggcctgatatagaattctggatgtgattctagtgctttggaaggaacgcgacgctgaaatcgttggcctactgttctattgatacctgttgaacttgatggtcattgtgactttttagtagcttacattatatatgtagccagatggcacctgggagttacaatttccttcttcgggttacattgcatattatgctttactggtcaatcttactaagcggtcttagtttatttag

SEQ ID NO: 1579 - DNA, 1584 bp, Echinochloa colona
cccccgcgaaatcgaattccccccaaaccgtagctacccagcgcggctccccttcccgcctctctgcggcgcggcgcggggcgagtgacacgcgccctctggtagcaagtagcggggcgagtctagcgtcccggcgatggcgtcgacggtgctggaggcgacgcgggcggcgcacgaggacctggagaggctggagcggctcgcggtgcgcgagctgcagcgggacccggccaacgcgcgcgaccgcctcttccagtcccaccgcgtcggccacatgctcgacctcgtcgtctccacctccgacaagctcgtggaaatctacgaggacaaggacaatgctaggaaggatgagattaacacacatcttactgcgcccacacaaaatgtactgtttagcaagtactatgaaaggcttaaagagatccgtgattatcataggcggaacccttctgcccgtttcgtcagtacaactgatgattacgaagagcttttgaaggaggaaccagctattgaattcactggcgaggaagcttttggccgttacctagacttgcatgagctttataatgagttcataaattccaagtttggaacaccaatggaatattcggcttacgttggcagtttcgcccagatggagaagatctcgcagagtcataaagctacaaggcaatacagagaatacttggaacacatccttgaatatcttacgtcatttctgtatcgtacagagccattgcaagatattgagaagatttttgcaaagttggaaagcgaatttgaggaacgatgggccaatggggaagtacctggttgggggaaacaatctgcgccagaagagtctgatattgaccttgattactacagcactgttgaagaacttgttgagcttggtccagagaagttgaaacaggctttagccgctcgtggtttgaagagcggcggtactgttcaacagcgtgcagagcggcttttcttgttaaagcatacacctttggaacaactggaccggaagcattttgctaaagttccacgtactaaagatgtctcaagcacagcttccgatggaaacaatttcaaggatgatttgaagaaggaaatcgctttgatggaagtaaagatgaggcgcctttgtgagctgttagatgaggtctttgtacgaacaaaggaaaatgctgagaagaaactcactttgacatatgaagagatggaagcagaacgggaagaggaggaggtacaggctgacactgagagtgatgacgaagagcaacaaatctacaaccctctcaaattacctatgggttgggatggcaagcctatcccctattggctatataagctacatggccttgggcaggaattcaagtgtgagatatgtggaaaccacagttactgggggcgaagagcttatgagcgtcatttcaaggagtggcgtcatcagcacgggatgagatgccttggtattccaaatacaaagaatttcaatgaaatcacatccatcgaggaggcaaaaggtctgtgggagaaaatacaagcacgtcaagggctgaacaagtggcggccagacctggaagaagagtacga

SEQ ID NO: 1580 - DNA, 1711 bp, Pennisetum glaucum
gcggtgcgcgagctgcagcgggaccccgccaacgcccgcgaccgcctcttccagtcccaccgcgtccgccacatgctcgacctcgtcgtctccacctccgacaagctagtggaaatctacgaggataaagacaattcaaggaaggatgaaatcaacacgcatcttactgcacccacgcaaagtctactgtttagcaagtactatgaaaggctcaaagagatccgtgactatcataggcggaacccatcagcacgcttcgtcagtacaactgatgattacgaagagcttctgaaggaggaaccagttattgaattcaccggcgaggaagcttttggccgttacctagatttgcatgagctttataatgagttcataaattccaagttcggaacaccaatggaatactcggcttatgttggctgtttctcccagacggagaagatctcgcagagtcataaaactacaaggcaattcaaagaatacctggaacacattctggagtatctgacatcatttctttatcgcacagagccattgcaggacattgagaagatttttgcaaagttggaaactgaatttgaggaacgatgggccaacggagaagtacctggatggggaaataaaagcatggaagagtctgacatagaccttgattattacagcacagttgaagaactcgttgagcttggtccagaaaagttgaaacatgctttagctgctcgtggtttgaagagcggtggtactgttcaacagcgtgcagaacggcttttcttgttgaagcatacacctttggagcaactggaccggaagcattttgctaaagtcccacgtactaaagatgtctcagatgcagcttccaatggcaacaatttcaaggatgatatgaagaaggaaattgcgctgatggaactaaagatgaagcgcctttgtgagctgttagatgagttctttgtgcgaacaaaagaaaatgctgagaagaaactcactttgacatatgaagagatggaagcagaacgggaagaggaggaggtacaggctgacactgatagtgatgatgaagaacaacaaatctacaaccctctcaaattgccgatgggttgggacggcaagcctatcccctattggttatacaagctacatggtcttgggcaggaatttaagtgtgagatatgtggaaaccacagttattgggggcgaagggcatatgagcgccatttcaaggaatggcgtcatcagcacgggatgcgatgccttggtatccctaacacaaagaatttcaatgaaatcacatccatcgaggaggcgcgaggactctgggggaaaatacaagcacgtcaagggctgaacaagtggcggccagacctggaagaagagtacgaagatcaggaaggcaacatttacaacaagaagacctacgctgacctgcagcggcaaggcttgatctagaattctagttcgaggggcatctgctactgaaattttcaggctgtctggaactctgatagttgctgtcttcaggtgtattggccgttggtttggtatacactgatagtttagatcgtacagtaccggaatgccccctcttgagcagtcctctggaatgtatccaatatcgtgtcatggattaaaaattagcattacgtctgcaactctcccgtgtttgcatgatctgtttgtcaaacttatcgtaagaacaaatctaaacttgctt

SEQ ID NO: 1581 - DNA, 1534 bp, Secale cereale
gctgaagcagcagcgatggcatcgtcagtgctggagaccacgcgggcggcgcacgaggacctcgagcggctagaccgcctggtggtgcgcgagctgcagcgagatcccgccaatgcccgcgaccgccttttccagtcccaccgcgtccgccacatgctcgacctcgtcatctccacttctgacaagctcgttgaaatctacgaagacaaggacggtgctaggaaggatgagatctcttcccatcttaccgcgccggtgcaaagcgacatcttccccaagtactatgaaaggctcaaagagatccgtgattaccataggcggaatcactctgcccgtttcattagcgaaactgacgattatgaggagctactaaaggaggaaccggctattgaattcactggcgagggttgtttgattcctcttgtagaatcacggtgctatgaatggaggcatttggccggtacttggacttacatgagctctacaatgagttcataaattccaagtttggatcgctaatggaatactcagcatacgttggcacttttgctcagactgaaaaaatctcgcatagtctaaaagctaccaggcaatgcaaagaatattttgagcatattttggaatacctgacgtcatttatctatcgtacagagccattgcaagatattgataagatttttacaaagttgcaaagtgagttcgaagaacagttggtcaatggtgaagtacctggatgggagaataagggcacagagaaaaaatctgagtcgcaagagtctgcagtagacctcgattactacaatactgttgaagagcttgtagagcttggtccggaaaagttgaaagaggctttaactgctcgtgcattgaagggtggcggcactgttcaacagcgtgctgagcgccttttcttgctgaagcatacacccttggaacaattggatcgtaagcattttgccaaaggtgatgatttgaagaaggaaattgctttggttgaagtgaagatgaagcgcttatgtgagattctcgatgaggtcattgtaagaacaaaggaaaacgcggagaagaagctgactttgacctatgaagaaatggaagcagaacgggaagaagaagaagtacaagttgatagtgaaagtgatgacgaagaccaacaaatctacaaccctctcaagttaccaatgggttgggacgggaaacctatcccctattggctctataagcttcacgggcttggtcaggaattcaagtgcgagatatgtggtaaccacagttactgggggcgaagggattatgagcgccatttcaaggagtggcgccatcagcatgggatgcgatgccttggtattcctaataccaagaacttcaacgaaattacattcattgaggaggcgaaagcactgtgggagaggatacaagcaaagcaagggctgaacagtggcggccagacttggaagaggagtacgagacaaggatggcaacatctacaacaaaaagacgtacactgacctgcagcgccaaggcctgatataga

SEQ ID NO: 1582 - DNA, 2268 bp, Zea mays
ggcgagaccaccgctacacaaggagcgaatcaggactgctcttccgacggcggtcactgtgcgcgtgacagccaccatcgaccgagatggcggacgctcaccacttcaacaacatctccctcggcggccgtggcggcggtcaccctgggcagttcaaactttactcaggaggcttggcgtggaagaagcaaggaggaggaaagatcattgaggttgataaaggtgatatcactaatgtggcttggatgaggattcctaaatcctaccagctcagcgttgggaccaaggagggcctctgttacagattttttggcttccgcgaacaggatgttagtaacttgactaatttcatagagaagagcactggaatcacaccggaagagaagcagctttctgttagtggccaaaactggggcgggatacaaataaacgggaatatgctttgctttaacgttggttcaaaggaagcttttgaagtctctctagcagatgtggcacagactcagatgcaagggaaaacagatgttgtcctagagttccatgtagatgatactactggggctaatgagaaagattcattgatggatttaagttttcatgttccgacttcgaatactcaattcattggagatgagcatcgtacttcagcacagatgttatggcaggctatctcggttgaaattgatggtggtggctcctcagagatggcggttgtcacatttgacggaattgcaattcttacaccgaggggtcggtacagtgtggagcttcatcagtcattcttgcgactccaaggacaagctaatgatttcaaaatccagtatagtagtattctccgcctatttgttttaccaaagtcacacaatccacatacctttgtggttatcacacttgatccaccaattcgcaaaggacaaactttgtatcctcacattgttattcagtttgagacagaggcagttgttgaaagggaactgacattaagtggggagattttggctgagaagtacaaggataggcttgagagctcttataggggtctaatacatgaggtattctccaaggtccttcgtggcctgtctagtgctaaagtgacacggccaagtacattccgcagttgcctagatggatatgcagtcaaatcatcacttaaagctgaagatggtttgctttatccactcgaaaagggcttcttctttctgccaaagcccccaacactaattcctcatgaagagattgagtatgttgagttcgagcgtcatggtgctggaggtgcaagtatatcatctcattactttgaccttttggtcaagctgacaaatgatcaagaacttctcttcagaaacatccaaaggaatgaataccataacctcttcaacttcatcagcggtaagcatttgaaaattctgaatcttggagatggacaaggtagaactagtggtgttactgctgttcttcagagcactgatgatgattctgttgatccacatctggagcggataaaaaatcaggccggtaatgaggaaagtgatgaagaggatgaagattttgtggcagacaaggatgatagtggatctccaaccgatgattctgatgcagaaggctctgatgctagtatgagtggaggagaaaaggagaaaccttccaagaaggaagctagtagctcaaagccgcctgtgaagaagaagcagaagagtgggccagatgaaggttctcaaaaaaagaagccaaagaagaagaaagatcccaatgcccctaagagagctatagctccattcatgtacttctcaaaggctgagcgagctaatatcaagagcagcaatcctgaactggcgaccacagagattgcaaagaagctcggagaaaggtggcaaaagatgacagcggaggagaggcagccatatgtggagcagtctcaggtcgacaagcaacgctatgcagaagagtctgcagcctaccgtggtgcagccgctcagcagggctctggtgctggatcggaatgaaggtttaatcgtctcgacagttaacttgcaaggctggatgattgagtcgtcagaataaagctggaatacccaaaaacctaagctgaatgtcatcgtttgacctgttgggttgttccggaattcaaccaggattcattctagttcatcaatgcttatattaattaggcaagcaatctggtctggaatcgatcgaggccgttccctggaaccgaacatacccctaagcaaatcctgccaggtaggacaaaatgtagcagcaggttta

SEQ ID NO: 1583 - DNA, 2506 bp, Sorghum bicolor
cgcacctcatgcatatggccaatcgcaaccccgcattggagccgcatcaaatagagccacaccgaggcgacgcgcgcagacccgggcgaggcgacgcgcagtgagaccacgtcgggattttctctcgacggcgatcgctgtgcgcgtgacaatcagcgagcgagatatggcggacggccaccacttcaacaatatctcactcggcggccgtggcggcggcaaccctgggcagttcaaactttactccggaggcttggcatggaagaagcaaggaggaggaaagatcattgaggttgataaaggtgatatcacttctgtggcttggatgaggattcctaaatcttatcagcttagcgttggaacaaaggagggcctctgttacagattttttggctttcgtgaacaggatgttagtagcctgactaatttcatagagaagagcactggaatcacaccagaagagaagcaactttctgttactgggcataattggggcggaatagaaataaatgggagtatgctttgctttaatgttggttcaaaggaagcgtttgaagtctctctagcagatgtggcacagactcagatgcaagggaaaacagatgttgtcctagagttccatgtagatgatactactggggcaaatgagaaagattctttgatggatttaagtttccatgttccgacttcaaatacgcaattcgttggagatgagcatcgtacttcagctcagatgttatggcaggctatctcggttgaaattgatggtggtggctcatcagagatggctgttgttacatttgatggaattgcaattcttacaccaaggggtcgatacagtgttgagcttcatcagtcattcttgcgactccaaggacaagctaatgatttcaaaatccaatatagtagtattcttcgcctatttgttttaccaaagtcacacaatccacatacctttgtggttatcacacttgatccaccaattcggaaagggcaaactttatatcctcacattgttattcagtttgagacagaggcagtggttgaaagggaactggcattaagtggtgaggttttggctgagaagtacaaggataggcttgagagctcttacaggggtctaatacatgaggtattctccaaggtccttcgtggcttatctggtgctaaagtgacaaggccaagtacattccgcagttgccaagatggatatgcagtcaaatcatcacttaaagctgaagatggtttgctttatccactcgaaaagggcttcttctttctgccaaagcccccaacactaattcctcatgatgagattgagtatgttgagtttgagcgtcatggtgctggaggtgcaagcatatcatctcattacttcgaccttttggttaagctcacaaatgatcaagaacatctcttcagaaacatccaaaggaatgaataccataacctcttcaacttcatcagtggtaagcatttgaaaattctgaatcttggagatggccaaggtagaactagtggtgttactgctgttcttcagagcacggatgatgattctgttgatccacatctggagcggataaaaaatcaggctggtaatgatgaaagcgatgaagaggatgaagattttgtggcagacaaggacgatagtggatctccaacggatgattctgatgcggatggctctgatgctagtatgagtggaggagacaaggagaaaccttccaagaaggaagctagtagctcaaaggaagctagtagctcaaagccgcctgtgaagaagaagcagaagagtgggcctgatgaaggttctcaaaaaaagaggccaaagaagaagaaagatcccaatgcccctaagagagctatagccccattcatgtacttctcaaaggctgagcgagctaatatcaagagcagcaatcctgaactggctaccacagagattgcaaagaagctcggagaaaggtggcaaaagatgacagctgaggagaggcagccatatgtggagcagtcccaagtcgacaagcaacgctatgcagaagagtctgcagcttaccgtggtgcagccgctcagcagggctctggtgctggatcggaatgaaggttcagtcatttcgacagttagctgcagggctggattgttgagttatcagaatgggcgggaatttttaccttagcttttgaatcatgcatccaatctatcttagcttgtgtcactattaatatttattgactagaataccctaaagtcgaagctgaatggcgtcctttgacattaggtttagaaattttctgctggcttgcccaagaattcccctctcttgatgctctgttcagtgagggggagggttggtcaacagttaagcaaatcccgcgggataggaaaaaatgcagccaaatttcagagaagtacaactattttggcataaaaactacaaaattataactattttgacatgtatcatagaagtacaattattttcccatttggtaccatgaaaataca

SEQ ID NO: 1584 - DNA, 2435 bp, Panicum virgatum
cggagccgtcttctcctcctcgcggagagcagagctccgcgatcacacaaacgacgaacgaggcgatcggcgagaggacgagaccacgcgagagcgaatcgagacggctctagcgccagcggctgcgcgcgcggcgcgggcgagcgagatgacggaaggccatcacttcaacaacatctcccttggaggccgcggcggcggcaaccctgggcagttcaaactttattcaggaggactggcatggaagaagcaagggggaggaaagatcattgaggttgataaagctgatatcacatctgtgacatggatgaaaattcctaaatcctatcagcttagtgttgggacaagggacggtctctgttacaggttctttggcttccgtgaacaggatgttagcggcctgactaacttcatacaaaaaagcacgggaatcacaccagaggagaagcagctttccattagtgggcataactggggtggagttgcaataaatgggaatatgctttgctttaatgtcggttcaaaggaagcatttgaagtctctctagcagatgtgtcacagagtcagatgcaagggaaaacagatgtcgtcctagagttccatgtcgatgatactactggggctaatgagaaagattcgctgatggatttaagttttcatgtaccaacttcaaatactcaattcgttggagatgagcatcgtacttcagctcagatgctatggcaggctatatcagttcaaattgacggtgggggctcctcagagactgctgttgctacattcgatggaattgcaattcttacaccaagaggtcgatacagtgttgagcttcatcagtcatttttgcgactccaaggacaagctaatgatttcaagatacagtatagcagtattcttcgcctctttgttttaccaaagtcacacaaccctcatactttcgtggttatcacgcttgacccaccaattcgcaaaggacaaacattatatcctcacattgttatccagtttgagacagagaccgtggttgaaagggaactgacattaagtgaggaggttttggctgaaaaatacaaggataggctagagagctcttacaggggtctaatacatgaggtattctccatggtccttcgtggcttatctggtgctaaagtgacaaggccaagtacattccgcagttgccaagatggatatgcagtcaaatcatcacttaaagctgaagacggtttactttatccacttgaaaagggctttttctttctgccaaaaccccctaccctcattcctcatgaggagattgaatatgttgaatttgagcgtcatggtgctggcggtgctagtatttcatctcattattttgacctcctggtaaagctgaaaaatgatcaagaacatctcttcagaaacatccaaaggaacgaatatcataacctgttcaacttcatcagtggtaagcacataaaaattctgaatcttggagatggtcaaggtagagctggtggtgtcactgctgttcttcagagtactgatgatgattctgtcgatccacatctggagaggataaaaaatcaggctgggaatgaggaaagtgacgaagaggatgaagattttgtggcagacaaggatgatagtggatctcctactgatgattctgatgaggatggctctgatgctagtttgaccgggggagaaaaggagaagtcttccaagaaggaagcaagtagctcaaagccacctgtgaagaagaagcagaagagtgtgcctgatgaaggttctcagaaaaagaagccaaagaagaagaaagatccgaatgcccctaaaagagccatagctccattcatgtacttctcaaaggctgagcgagctaatattaagagcagtaatcctgaactggctaccacagagatcgcgaaaaagctcggggagaggtggcaaaagatgtcagctgaggagaggcaaccatacattgaacagtcccaggtcgacaagcaacgatatgcggaagagtctgccgcctatcgcggtgcaaccactcagcagggctccggcgatgggtcggaatgaaggtggcctcgttttgatagttaagtgcaggggaggattattgagccatcaatataaactgagcgagaaactttacagtagctttgaatcttccaggttccacccagtctagtatcttagctgctagttctgccatttatgtctggaagtgccatataatcttttcgctatcaacttttaatgtgccaaggtaaaacattctgtgctgccaacatgtgtggaaaacatagctagttgtttcctcttaatgaaatatggtggggttgtcgtacccctccagtcgattttttaatataattatagattcaattatatcctgagcacaccagtgattgatgcgtaacaaactgccactatcgcggctggtcat

SEQ ID NO: 1585 - DNA, 2138 bp, Setaria italica
agacggcactagcggcggcgggcgaccgagatgatggacggccaccacttcaacaacatctccctcggaggccgcggcggcggcaaccctgggcagttcaaactttattcaggaggactggcgtggaagaagcaagggggaggaaagatcatcgaggttgataaagctgatatcacatctgtgacatggatgagaattcctaaatcttatcagcttagtgttgggacaaaggagggcctctgttacaggttctttggcttccgtgaacaggatgttagtagcctgactaactacattcaaaagagcacaggaatcacaccacaggagaagcagctttccatcagtgggcagaactggggtggaattgaaataaatgggaatgtgctttgctttaatgtcggttcaaaggaagcatttgaagtctctctagcggatgtttcactaagtcagatgcaaggaaaaacagatgttgtccttgagttccatgtagatgatacaactggggctaatgagaaagattcactcatggatttaagtttccatgtaccaacttcaaatactcaattcattggagatgagcatcgtacgtcagctcagatgctatggcaagctatctcggttcaaattgacggaggtggctcctcagaggcggctgttgctacatttgatggaattgcaattcttacaccaagaggtcgatatagtgtcgagcttcatcagtcattcttgcgactccaaggacaagctaatgatttcaaaatacagtacagcagtattcttcgtctctttgttttaccaaagtcacacaaccctcatactttcgtggttatcacacttgatccacctattcgcaaaggacaaacattatatcctcacatcgttattcagttcgagacagagacaattgttgaaagggaactgacattaagtgaggaggttttggctgaaaagtacaaggatagacttcagagctcttataggggtctaatacatgaggtattctccatggtccttcgtggcttatctggtgctaaagtgacaaggccaagtacgttccgcagttgccaagatggatatgctgtcaagtcatcacttaaagctgaagatggtttgctttatccacttgaaaaggccttcttctttctgccaaagccccctacactcatttctcatgatgagattgagtacgttgagtttgagcgtcatggtgctggtggtgctagtatatcatctcattattttgacctcctagtaaagcttaaaaacgatcaagaacatctcttcagaaacatccaaaggaatgaataccataacctgttcaatttcatcagcggtaagcacttgaaaattctaaatcttggagatggtcaaggtagagctggtggtgttactgctgttcttcagagcaccgatgatgattcagttgatccacatctagagaggattaaaaatcaggctggtaatgaggaaagtgatgaagaggatgaagattttgtggcggagaaggatgatagtggatctcctactgatgattctgatgaggatggctctgatgctagtttgagcggggaagaaaaggagaaatcttccaagaaggaagctagtacatcaaagccacctgtgaagaagaagcagaagagtgtgcctgatgaaggttctcagaaaaagaagcctaagaagaagaaagatccaaatgcccctaaaagagccatagctccattcatgtacttctcaaaggctgagcgacctaatattaagagcagcaaccctgaactagctactacagagatcgcgaagaagcttggggagcggtggcaaaagatgtcagctgaggagaggcagccatacattgagcagtcccaggtcgacaagcaacgctatgcagaagagtctgctgcctaccgtggtgcaagtactcagcagggctccggaggtgggtcggactgaatgtggcatcgttttgacagttaactgctggggaggattattgagccatcagtgtaaactgagcgataaattttacctagcttttgaatcttctatccaatctggtatcttagctagtgctaccattaatatctgttgcctggaagtactatagaatctattcgctatcaacttttaatgtgacattcagg

SEQ ID NO: 1586 - DNA, 2340 bp, Triticum aestivum
aagccacttcctcctcgccgcagagctcccaaatcccgcacccgaggaggcgactctcccgcgcgcgagagagcgggtcacgagtcctgcagcggcggcggctgcggtcaccggccgcagagccagcgggcgacatgacggacggccacctcttcaacaacatctccctcggcggccgcgtcggcaacaaccctggtcagtttaggctttattcgggagggcttgcatggaagaagcaaggtggaggaaagacaattgaggttgataaagctgatataatttctgtgacgtggatgaaaatccccagatcttatcagcttagtgttgggaccaaagagggcattcggtacgtgttcaaaggcttccgtgaacaggatgttagtaaccttactaacttcatacaaaagaacacgggaaccacaccagaggagaagcagctttctgttagtggccataattggggcgcggtcgacatcaatggcaatatgcttagctttaatgttggctcaaaggaagcatttgaagtctctctatcagatgtatcacaaactcagttgcaaggaaaaacagatgttgttcttgagttccatgttgatgatactacaggggctaatgagaaagattcgctgatggatttaagttttcatgtaccaacttcaaatactcaattcctcggtgatgaggaacgtccctcggctcatattttttggcagaaaatcttggctatagctgacgttggctcatcagaagaggctgttgtctcattggagggaattgccattcttaccccaagaggtcgatacactgttgagcttcatatgtcattcttgcgactccaaggacaagctaatgatttcaaaatccagtatagcagtattcttcggctctttgttttgccaaagtcaaacaaccctcatacatttgtggtcatcacacttgatccgccaattcgcaaaggacaaacattatatccccacattgttattcagtttgtgacagagaatgtagttgagaaggagctgtcattaagtgaggaggttttggctgaaaagtacaaggacaggctgcagagttcttacaatggtctagaacatgaggtattctccaaaattcttcgtggcctgtctggtgctaaagtgacgaggccaagcacattccgcagttgtcaagatggatatgccgtgaaatcatcacttaaagctgaagatggattgctgtatcctcttgaaaaaggctttttctttttgccaaagcccccgacactcattctgcatgaggagattgagtatgttgaatttgagcgccatggtgctggtggtgctagtatgtcatctcactattttgatctcctggtcaagctaaagaatgaccaagaacatctcttcagaaatatacaaaggaatgaataccataacctcttcaacttcgtcagtggtaagaatttgaaaatcctgaatcttggagaagatggccaagatagaactggtgctgttgcggctgctcttcagagcactgatgatgaccctgttgatccacatctggagcgaattaaaaatcaggccggtgatgaagaaagtgatgaagaggacgaagattttgtggcggacaaggacgacagcggatcccctagtgatgattctgaagagggttctgatgccagcataagcgatggagaaaaggagaaatcttccaaaaaggaagctagtagctcaaagccacctgcgaagaggaaaccaaagaatgtggacgtggaaggttcagagaagagaaagccgaagaagaagcagaagaaagatcccaatgcccctaaaagagcaatagcaccattcatgtatttctcaaaggctgagcgagctaatttgaagaacatcaaccctgaactcagcaccacggatattgcaaagaagcttggagagaagtggcaaaagatgtcagctgaggagaagcagccatacgttgagcagtcccaagtggataagaaacgctatgcagaggagtctgctgcctaccgcggcgctggtgcggctcctgtagacgtggactctgcagatggatcgtccgattgaattggaagattggccgttgtcgaaaggagcatactttcgagtcatggtacaagtaggcatccgatctatcttggctgtagtgactgttgaggtgtgatccctacgtttctgagttaacaaagaacagttaggatatgtaggttccaaggtaatgtttgctttgctacgagctgtcagcacatgtgacaggtgttttattcgcaccctgcttgtgcaactttttttctgcaaaatactcaaatcttcatcggaattacaaagcatacaaaacata

SEQ ID NO: 1587 - DNA, 2472 bp, Oryza sativa
gcatcccctttcttcctttctctttccctcctcgccgcgccgcctccgcagcagcagagcctctcgaaattttgggcctcgccgcggagcgcgaagagagatcgagggcggcggagctgcgcgtgggtagcaagcggcggcggaggcggaggcggcggagatgacggacggccatctcttcaacaacatcctcctcggcggccgcgccggctcgaatcctggccagtttaaagtgtattctggaggtcttgcatggaagagacagggtggaggaaagaccattgagattgagaaatctgatttaacgtcggtgacatggatgaaagtccccagggcctatcagcttggagtcaggaccaaagatggcctgttttacaagtttattggcttccgtgaacaggatgtaagcagtctgaccaatttcatgcaaaagaatatgggcctctcaccagatgaaaaacagctttctgttagtggtcaaaactggggagggattgatataaatggaaatatgcttaccttcatggttggttcaaagcaagcatttgaagtgtcgctggcagatgtctcacaaacccaaatgcaaggcaaaacagatgttctcttagagtttcatgttgatgatactactgggggcaatgagaaagattcgcttatggatttaagctttcatgtacctacttcaaatactcagtttcttggagatgagaatcgcactgcagcccaggtcctatgggaaacaataatgggtgttgctgatgttgattcttctgaagaggcagttgtcacctttgaaggaattgctattcttacaccaagaggacgttatagtgttgagcttcatctgtcatttttgcgtctccaaggacaagctaatgattttaaaatccaatatagcagcattgttcgcctttttcttttgccaaagtcaaacaaccctcatacatttgtggttgtcactcttgatccaccaatccgtaaaggacaaacactgtatcctcacattgtcattcagtttgagacagaggcagtagttgaaagaaatctggcattaactaaagaggttctggctgaaaaatacaaggacaggctggaggaatcttacaagggtctgatacatgaggtattcaccaaagttcttcgtggtctatctggtgctaaagttacaaggccaggttctttcagaagttgccaagatgggtatgcagttaaatcgtctctcaaagctgaagatggactgttgtatccacttgaaaagggcttcttctttctgccaaagcctcccaccctcattctacatgaagagattgagtttgttgaatttgaacgtcatggtgctgggggtgccagtatttcatcacactatttcgacctcctagtcaagctgaaaaatgatcaagaacatctcttcagaaatattcaaaggagtgaataccataacctcttcaactttatcaatggaaaacacttgaaaataatgaaccttggagatggtcaaggcgcaactggtggggttacagctgttctacgagacactgatgatgatgctgttgatccacatctagaacgaattaaaaatcaggctggggatgaggaaagtgatgaagaggatgaagattttgttgcggataaggatgatagtggatcacctactgatgattctggtggggaggattcagatgctagtgaaagtgggggtgaaaaagagaaattatccaaaaaggaagctagtagttcaaagccacctgtgaagaggaagcctaagggaagggatgaagaaggttcagagaaaagaaagccgaagaagaaaaaggatcctaatgcccccaaaagagcaatgacaccattcatgtacttctcaatggctgagcgaggaaatatgaagaataacaatcctgatttgcctacaaccgagattgcaaagaagctcggggagatgtggcaaaagatgacaggcgaagagaagcaaccttacatccaacagtctcaagtcgacaagaaacgatacgagaaggaatctgctgtctaccgtggcgcagccgccatggacgtggactctggctccggcggcaacgagtctgactagagccacacactgacactttggcggttggcgtaatgaagaaatttgttaatccctggaaccactgatgcagtttgggcactgaaatcttctcagctattaaccttgcattgcgctggatgatccgatccatgtgtttgcgtacgatggtatcggctgttctcgccgtggggtgactcgatcacaaaccgttactgtctgtgtacgcctacacgagcgatatccctcggaagcatcgtgctgttaagaagtgcttaatttggcgtagcatctatctcgaatgcaagactctgttagcctatgagcttttgtaaaacaggaagaatgatttgtataacaaaaatttaccatggattggttatgttataacatagtgatttaagaactaa

SEQ ID NO: 1588 - DNA, 2277 bp, Secale cereale
tgcagcgacggcggctgcggtcaccggccgcataggcagcgggcgacatgacggacggccacctcttcaacaacatctccctcggcggccgcgtcggcaacaaccctggtcagtttaggctttattcgggagggcttgcatggaagaagcaaggtggaggaaagacaattgaggttgataaagctgatataatttctgtgacgtggatgaaaatccccagatcttatcagcttagtgttgggaccaaagagggcattcggtatgtgttcaaaggcttccgtgaacaggatgtgagtaaccttactaacttcatacaaaagaatacgggaaccacaccagaggagaagcagctttctgttagtggccataattggggcgcggtcgacatcaatggcaatatgcttagctttaatgttggctcaaaggaagcatttgaagtctctctatcagatgtatcacaaactcagttgcaaggaaaaacagatgttgttcttgagttccatgttgatgatactacaggggctaatgagaaagattcgctgatggatttaagttttcatgtaccaacttcaaatactcaattcctcggtgatgaggagcgtccctcggctcatattttttggcagaaaatcttggctatagctgacgttggctcatcagaagaggctgttgtctcattggagggaattgctattcttaccccaagaggtcgatacactgttgagcttcatatgtcattcttgcgactccaaggacaagctaatgatttcaaaatccagtatagcagtattcttcggctctttgttttgccaaagtcaaacaaccctcatacctttgtggtcatcacacttgatccgccaattcgcaaaggacaaacattatatccccatattgttattcagtttgtgacagagaatgtagtcgagaaggagctgtcattaagcgaggaggttttggctgaaaagtacaaggacaggctgcagagttcttacaatggtctagaacatgaggtattctccaaaatccttcgtggcctgtctggtgctaaagtgacgaggccaagcacattccgcagttgtcaagatggatatgctgtgaaatcatcacttaaagctgaagatggattgctgtatcctcttgaaaaaggcttttcctttttgccaaagcccccaacactcattctgcatgaggagattgagtatgttgaatttgagcgccatggtgctggtggtgctagtatgtcatctcactattttgatctcctggtcaagctaaagaatgaccaagaacatctcttcagaaatatacaaaggaacgaataccataacctcttcaacttcgtcagtggtaagaatttgaaaatcctgaatcttggagaagatggccaagatagaactggtgccgttgcggctgctcttcagagcactgatgatgaccctgttgatccacatctggagcgaattaaaaatcaggccggtgatgaagaaagtgatgaagaggacgaagattttgtggcggacaaggatgacagcggatcccctagtgatgattctgaagagggttctgatgccagcataagcgacggagaaaaggagaaatcttccaaaaaggaagctagtagctcaaagccacctgcgaagaggaaaccaaagaatgtggacgtggaaggttcagagaagagaaagccgaagaagaagaacaagaaagatcccaatgcccctaaaagagcaatagcaccattcatgtacttctcaaaggctgagcgagctaatttgaagaacatcaaccctgaactcagcaccactgatattgcaaagaagcttggagagaagtggcaaaagatgtcagctgaggagaagcagccatacgttgagcagtcccaggtggataagaaacgctatgcagaggagactgctgcctaccgcggcgctggtgcggctcctgtagacgtggactctgcagatggatcgtccgattgaattggaagattgcccgtttgtcgaaaggagcatactttcgagtcatgatacaagtagtaggcatccgttctatcttggttgtagtgactgttgaggtgtgatccctacgtttctgagttaacaaagaacagttaggatatgtactgtaggttccaaggtaatgttgctttgctacgaactgtcagcacgtgtgacaggtgttttattcgcaccctgcttgtgcaacttcttttttgcaaaatacccaaatcttcattggaattacaaagcatacaaaacataataaaaattacattga

SEQ ID NO: 1589 - DNA, 2462 bp, Oryza sativa
tttcttcctttctctttccctcctcgccgcgccgcctccgcagcagcagagcctctcgaaattttgggcctcgccgcggagcgcgaagagagatcgagggcggcggagctgcgcgtgggtagcaagcggcggcggaggcggaggcggcggagatgacggacggccatctcttcaacaacatcctcctcggcggccgcgccggctcgaatcctggccagtttaaagtgtattctggaggtcttgcatggaagagacagggtggaggaaagaccattgagattgagaaatctgatttaacgtcggtgacatggatgaaagtccccagggcctatcagcttggagtcaggaccaaagatggcctgttttacaagtttattggcttccgtgaacaggatgtaagcagtctgaccaatttcatgcaaaagaatatgggcctctcaccagatgaaaaacagctttctgttagtggtcaaaactggggagggatcgatataaatggaaatatgcttacctttatggttggttcaaagcaagcatttgaagtgtcgctggcagatgtctcacaaacacaaatgcaaggcaaaacagatgttctcttagagtttcatgttgatgatactactgggggcaatgagaaagattcgcttatggatttaagctttcatgtacctacttcaaatactcagtttcttggagatgagaatcgcactgcagcccaggtcctatgggaaacaataatgggtgttgctgatgttgattcttctgaagaggcagttgtcacctttgaaggaattgctattcttacaccaagaggacgttatagtgttgagcttcatctgtcatttttgcgtctccaaggacaagctaatgattttaaaatccaatatagcagcattgttcgcctttttcttttgccaaagtcaaacaaccctcatacatttgtggttgtcactcttgatccaccaatccgtaaaggacaaacactgtatcctcacattgtcattcagtttgagacagaggcagtagttgaaagaaatctggcattaactaaagaggttctggctgaaaaatacaaggacaggctggaggaatcttacaagggtctgatacatgaggtattcaccaaagttcttcgtggtctatctggtgctaaagttacaaggccaggttctttcagaagttgccaagatgggtatgcagttaaatcgtctctcaaagctgaagatggactgttgtatccacttgaaaagggcttcttctttctgccaaagcctcccaccctcattctacatgaagagattgagtttgttgaatttgaacgtcatggtgctgggggtgccagtatttcatcacactatttcgacctcctagtcaagctgaaaaatgatcaagaacatctcttcagaaatattcaaaggagtgaataccataacctcttcaactttatcaatggaaaacacttgaaaataatgaaccttggagatggtcaaggcgcaactggtggggttacagctgttctacgagacactgatgatgatgctgttgatccacatctagaacgaattaaaaatcaggctggggatgaggaaagtgatgaagaggatgaagattttgttgcggataaggatgatagtggatcacctactgatgattctggtggggaggattcagatgctagtgaaagtgggggtgaaaaagagaaattatccaaaaaggaagctagtagttcaaagccacctgtgaagaggaagcctaagggaagggatgaagaaggttcagacaaaagaaagccgaagaagaaaaaggatcctaatgcccccaaaagagcaatgacaccattcatgtacttctcaatggctgagcgaggaaatatgaagaataacaatcctgatttgcctacaaccgagattgcaaagaagctcggggagatgtggcaaaagatgacaggcgaagagaagcaaccttacatccaacagtctcaagtcgacaagaaacgatacgagaaggaatctgctgtctaccgtggcgcagccgccatggacgtggactctggctccggcggcaacgagtctgactagagccacacactgacactttggcggttggcgtaatgaagaaatttgttaatccctggaaccactgatgcagtttgggcactgaaatcttctcagctattaaccttgcattgcgctggatgatccgatccatgtgtttgcgtacgatggtatcggctgttctcgccgtggggtgactcgatcacaaaccgttactgtctgtgtacgccgacacgagcgatatccctcggaagcatcgtgctgttaagaagtgcttaatttggcgtagcatctatctcgaatgcaagactctgttagcctatgagcttttgtaaaacaggaagaatgatttgtataacaaaaatttaccatggattggttatgttataacatagtgatttaagaact

SEQ ID NO: 1590 - DNA, 2352 bp, Sorghum bicolor
tccgcaccgcagagccgcagcgaagcaagctgcgcccctcgacttggcctcgccggagaagcggagctcgagcagaggcggcgcgcgggagatagcaagcagtcggccgcaggtgccgcgtcggcggagatgacggacggccaccacttcaacaatatcctcctcggggggcgcggtggcacgaaccctggtcagtttaaagtgtattctggtggacttgcatggaagagacaaggtggaggaaagaccattgagattgacaaagctgatgtaaccgcagttacttggatgaaagtccccagagcatatcagcttggagtcaggattaaggatggcctgttctaccgatttattggcttccgtgaacaggatgtgagcagcttgaccaacttcatacaaaagaatatgggtgtcacaccagatgaaaaacagctttctgttagtggccacaattggggagggattgatatagatggaaacatgctaacctttatggttggttcaaagcaagcatttgaagtatccctagcagatgttgcacaaacccagatgcaaggaaaaacagatgttctcttagagcttcatgttgatgatactactggagccaatgagaaagactccctcatggatttaagttttcatgtgcctacttcgaatactcagtttgttggggatgagaatcgccctccagctcacattttatgggagactatattgaaatttgctgatgttggttcttctgaagaaccagttgtcacatttgacggaattgcgattcttacaccaagaggacgttatagtgttgagcttcatctgtcatttctgcgactccaaggacaagctaatgatttcaaaatccaatacagcagcatcgttcgcctctttcttttgccaaagtcaaacaatcctcatacatttgttgttatcactcttgatccaccaatccgtaaaggacaaacattgtatcctcacattgttattcagtttgagacagaggcggtagttgaaagagacctggcattgagtaaagagctgttggttgacaaatacaaggacaggcttgaggaatcttacaagggtctaatacatgaggtatttaccaaagtcctccgtggtctatctggtgctaaagtcacaaggccaggttctttcagaagttgccaagatggatatgcagttaaatcatcactcaaagccgaagatggactgttatatccacttgaaaagggtttcttcttcttgccaaagccacctacactcattcttcatgaggagattgagtttgttgaatttgaacgtcatggtgctgggggtgccagtatatcatctcactattttgacctccttgtcaaactgaaaaatgaccaagagcatctcttcagaaatattcaaaggaatgagtaccacaacctcttcaacttcatcaatggaaagaacattaaaataatgaaccttggaggagatggtcaaggtgcaagtggtgtagttacagatgttctacgagacactgatgatgatgctgttgatccacatctagagcgtattaagaatcaggctggggatgatgaaagtgatgaagaggatgaagattttgttgcagataaggatgatagtggatctcctactgatgactcgggtgatgaggattcagatgctagtgatagtggtggtgaaaaagagaaatcatccaagaaggaagcaagcagttcaaagccagttcagaaaaggaagcctaagggcagggatgacgaaggacatgagaagaaaaaggcaaagaagaaaaaagatcctaatgcccccaaaagagcaatgacaccgttcatgtatttctcaatggctgaacgaggaaacatgaagagcagcaacccagatttgccgacgactgagattgcaaagaagcttggggagatgtggcaaaagatgtcaagcgaagagaagcagccttacatccagcaggcccaggtcgacaagaaacgttatgaaaaagagtcggccgtctatcgtggtgaagctacagctgatgtggattctggcaacgagtctgactagattcaagctcttggagatggtggcactgaatgaaattctagtggcatgtactattattacgtcggcaactgttgccgctaggtgaaattgctagcatgcgtgtgtgtgcgcgcgccctacggtgccggcactagtagtttgcctccagcattgctgacagtaaagaggtgatttcttgtagcatacctctgcagggcagaagattgtatgagtgtagtctagtgacttttgtcgaaaaaccaacatacgtggtttatgagacatggtatttgtgttgaagcttctttattttttccccaaggg

SEQ ID NO: 1591 - DNA, 2298 bp, Brachypodium distachyon
aaagcgaaagccacctcctcgccgcaaagctcccaaatcccgcaggctcgtccgcaagcgagagagcgaatcgaggatcttgtagcagcggcggcggccaccggccgcaggggcagtgcgcgagatgacggacggccacctcttcaacaacatctcactcggcggccgcgttggcaacaaccctggtcagtttaagcttcattcgggaggccttgcatggaagaagcagggtggaggaaagaccattgaggttgataaagctgatataatttccatgacatggatgaaaatccccagatcatatcagcttagcgtcgggaccaaagaggggatccggtacatgttcaaaggcttccgtgaacaggatgttagcaatcttgctaactttatacaaaagagcacgggagtcgcaccagaggagaagcagctttctgttagcggccataattggggcggagttgaaattactggcaatatgcttagctttaacgttggttcaaaggaagcatttgaagtttctctagcagatgtatcacaaactcaaatgcaaggaaaaacagacgttgttcttgagttccatgttgatgatactaccggggctaacgagaaagattcactgatggatataagttttcatataccaactacaaatactcaatttcctggagatgaggatcgtccttcagctcatatcttctggcagaagatcttggctatagctgatgttggctcatcagaagaggctgttgttacatttgaaggaattgccattcttactccaagaggtcgatatagtgttgagcttcacatgtcattcttacgactccaaggacaagctaatgattttaaaattcagtacagcagtattcttcgcctgtttgttttgccgaagtcaaacaatcctcatacctttgtggttattacacttgatccgccaattcggaaaggacagacattatatcctcacattgttattcagtttcaaacagaggtagtagctgaaatggacctgaaactaagtgaggaggttttggctgaaaagtacaaggataggctgcaaggctcttacaatggtctagaacatgaggtattctccaaaatcctccgtggcctgtctggtgctaaagtaacaaggccaagcacattccgcagttgtcaagatggatatgctgtgaaatcatcacttaaagctgaagatggattgctctatcctcttgaaaagggttttttctttctaccaaagcctccaacactcattctgcatgaggagattgagtatgttgaatttgagcgtcatggtgctgggggtgctagtatgtcatctcactatttcgatctccttgtcaagctaaaaaatgaccaagaacatcttttcagaaatatccaaaggaatgaataccataacctcttcgacttcgtcagtggtaaaaatttgaaaatcatgaatcttggagaagatggccaaggtagaactggtgccgttgcagctgctcttgacagcactgatgacagccttcacgatccacatctggagcgaataaagaatcaggctggtgatgaagaaagtgatgaagaggatgaggattttgtggcagacaaggacgacagcggatcccccagtgatgattctgatgaaggttctgatgctagcttaagtggaggagaaagcgagaaatcttcaaaaaaggaagctagtagttcaaagccaccggtgaagaggaagccaaagagtggggacacagaaggttcagagaaaagaaagccgaagaagaagaagaaagatcccaatgcccctaaaagagcattagcaccattcatgtacttctcgaaggctgagcgagcgaatttgaagagcagcaatcccgtactgggtacaacagacatagcgaagaagcttggggagaagtggcaaaagatgtcagctgaggagaagcagccatacgttgagcagcatctagtggataaaaaacgataccaggaggagactgccgcataccgcgacaacgcaggcgcggctccagttgacgttgagtccgacgatcaattatctgactgagtagctactggcgaagttgcgtgctttgagagttcatggtataattaggcatccgttctgtcttggctgtagtaaccagtgagatgttccctccgtctccaagtttactaagaactgtcgtaaggattttgtagctaagcttttctcaggtaatgttgaatgctagtgaatgtcagatggttatttgctccttgcgtgtgcaatatgcagtcatggcgacctggcagactatcattgcgcgg

SEQ ID NO: 1592 - DNA, 2326 bp, Saccharum officinarum
ctccgcaccgcagagccgcagcgaagcaagctgcgcctcttgacttggcctcgccggagaagcggagctcgaggagaggcggcgcgcgggagatagcaagcagtcggtcccaggtgccgcgtcggcggagatgacggacggccaccacttcaacaacatcctcctcggagggcgcggtggcacgaaccctggtcagtttaaagtgtattctggtggacttgcatggaagagacaaggtggaggaaagaccattgagattgacaaagctgatgtaaccgcagttacttggatgaaagtccccagagcatatcagcttggagtcaggattaaggatggcctgttctacagatttattggcttccgtgaacaggatgtgagcagcttgaccaacttcatacaaaagaatatgggcgtcacaccagatgaaaaacagctttctgttagtggccacaattggggagggattgatatagatggaaacatgctgacctttatggttggttcaaagcaagcatttgaagtatccctagcagatgttgcacaaacccagatgcaaggaaaaacagatgttctcttagagcttcatgttgatgatactactggagccaatgagaaagactccctcatggatttaagttttcatgtgcctacttcgaatactcagtttgttggggatgagaatcgccctccggctcacattttatgggagactatattgaaatttgctgatgttggttcttctgaagaaccagttgtcacatttgacggaattgcaattcttacaccaagaggacgttatagtgttgagcttcatctgtcatttctgcgactccaaggacaagctaatgatttcaaaatccaatacagcagcatcgttcgcctctttcttttgccaaagtcaaacaatcctcatacgtttgttgttatcactcttgatccaccaatccgtaaaggacaaacattgtatcctcacattgttattcagtttgagacagaggcagtagttgaaagagacctggcattgagtaaagagctgttggttgacaaatacaaggacaggcttgaagaatcttacaagggtctaatacatgaggtatttaccaaagtccttcgtggtctatctggtgctaaagtcacaaggccaggttctttcagaagttgccaagatggatatgcagttaaatcatcactcaaagctgaagatggactgttgtatccacttgaaaagggtttcttcttcctgccaaagccacctacactaattcttcatgaggagattgagtttgttgaatttgaacgtcatggtgctgggggtgccagtatatcatctcactattttgacctccttgtcaaactgaaaaatgatcaagagcatctcttcagaaatattcaaaggaatgagtaccacaacctcttcaacttcatcaatggaaagaacattaaaataatgaaccttggaggagatggtcaaggtgcaagtggtgtagttacagatgttctacgagacactgatgatgatgctgttgatccacatctagagcgtattaagaatcaggctggggatgatgaaagtgatgaagaggatgaagattttgttgcggataaggatgatagtggatctcctactgatgactcgggtgatgaggaatcagatgctagtgatagtggtggtgaaaaggagaaatcatccaagaaggaagcaagcagttcaaagccagttcagaaaaggaagcctaagggcagggatgacgaaggacatgagaagaaaaaggcaaagaagaaaaaagatcctaatgcccccaaaagagcaatgacaccgttcatgtatttctcaatggctgagcgaggaaacatgaagagcagcaacccagatttgcctacgactgagattgcaaagaagcttggggagatgtggcaaaagatgtcaagcgaagagaagcagccttacatccagcaggcccagatcgacaagaaacgttatgaaaaagagtccgccgtctatcgtggtgaagctacagctgatgtggattctggcaacgagtctgactagattcaagctcttgggctggcatggtggcactaaatgaaattctagtggcatgtacggcaactgttgccgtttggtgaaattgctagaatgcgtgtgcgtgtgcctacggtgccggcactagtagtttgcctccagcattgctgacagtaaagagggggtttcttgtagcgtacctctgcagggcaaaagattgtacgagtgtagtctagtgacttttgtgtaaaaaccaacatacgtggtttatgagagatggtattgcgttgaagcttatttatt

SEQ ID NO: 1593 - DNA, 2390 bp, Echinochloa colona
acgtgtgctcttccgacctcccccctctaccgcctccgcagcagagccgcaccgaagcaaagcagagcaaaacccccaccggagaagcggagctcgaggggaggcggcgcgcgcgaggtatcaagcggcggccgcaggcgcctcgtcggcggagatgacggacggccaccacttcaacaacatcctcctcggagggcgcggcggcacgaaccctggtcagtttaaagtgcattctggtggacttgcatggaagagacaaggtggaggaaagaccattgaaattgacaaagctgatgtaacctcagttacatggatgaaagtccccagagcatatcaacttggagtcaggattaaagatggcctgttctacaggtttattggcttccgtgaacaggatgtaagcagtttgaccaacttcatacaaaagaatatgggcgtcacaccagatgaaaaacagctttctgttagtggtcacaactggggagggatcgatatagatggaaatatgcttacctttatggttggttcaaagcaagcgtttgaagtgtccctaccagatgttgcacaaacccagatgcaaggaaaaacagatgttctcttagagtttcatcatgatgatactactggggccaatgagaaagattcgctcatggatctaagttttcatgtgcctacttcaaatactcagtttatcggggatgagaatcgccctccggctcacattctatgggagactatattgaaatttgctgatgttggttcatctgaagagccagttgtcacctttgaaggaattgcgatccttacaccaagaggacgttatagtgttgagcttcatctgtcatttctacgactccaaggacaagctaatgattttaaaatccaatacagcagcattgttcgcctctttcttttgccaaagtcaaacaatcctcatacctttgttgttatcactcttgatccaccgatccgtaaagggcaaacattgtatcctcacattgttattcagtttgagactgaggcagtagttgaaagagacctggcattgagtaaagaggttctggctgaaaaatacaaagacaggcttgaggaatcttacaagggtctaatacatgaggtatttaccaaagtccttcgtggtctatctggtgctaaagtcacaagaccaggttctttcagaagttgccaagatggatatgcagttaaatcttcactcaaagctgaagatggactgttgtatccacttgaaaagggtttcttctttctgccaaagcctcctacactcattctgcatgaggagattgagttcgttgaatttgaacggcatggtgctgggggtgccagtatgtcatctcactattttgacctcctcgtcaaactgaaaaatgaccaagaacatctcttcagaaatattcaaaggaatgaataccacaacctcttcaacttcatcaatggaaagaacatgaaaataatgaaccttgggggagatggtcaaggtacaagtggtgtagttacagatgttctacgggacactgatgatgatgctgttgacccacatctagagcgtattaaaaatcaggctggggatgaggaaagtgatgaagaggatgaagattttgttgcggataaggatgacagtggatctcctactgatgactctggtgatgaggattcggacgctagtgatagtggtggtgaaaaagagaaatcatccaagaaggaagcaagcagttcaaagccagttcagaaaaggaaacctaagggcaaggatgaggatggtccagagaagaaaaaggcaaagaagaaaaaagatcctaatgctcccaaaagagcaatgacgccattcatgtatttctcaatggctgagcgaggaaacatgaagagcaacaacccagatttgcctacgactgagattgcaaagaagcttggggagatgtggcaaaaaatgtcaagcgaagagaagcagccttatatccagcaggcccaggttgacaagaaacgctatgaaaaggaatccgctgtctatcgtggtgaagcaccagttgatgtggattccggcaatgagtctgactagagtgacactcctgcgttttaggcatgagaggaaatcgctgaccgttggtgcagtttgtggcctgaaactatctcagctcttgacttggcatagtgggcactgaatgaaattctgctgatatatgtaatactacatcggcagctgttgccgtccggtgaaattgctgtgtatgccgacaccacttgtccggagcattgctaagcggtgttgcgtgtagctcacctatgcagtgcaaaggattgtaccagtgtagtctagtgagttttctgtaaaaccaacagacctggtttatgagagtcgattcattctgttccca

SEQ ID NO: 1594 - DNA, 2178 bp, Echinochloa colona
cctcccccctctaccgcctccgcagcagagccgcaccgaagcaaagcagagcaaaacccccaccggagaagcggagctcgaggggaggcggcgcgcgcgagatagcaagcggcggccgagggcgcctcgtcggcggagatgacggacggccaccacttcaacaacatcctcctaggagggcgtggcggcacgaaccctggtcagtttaaagtgcattctggtggacttgcatggaagagacaaggtggaggaaagaccattgaaattgacaagactgatgtaacctcagttacatggatgaaagtccccagagcatatcaacttggagtcaggattaaagatggcctgttctacaggtttattggcttccgtgaacaggatgtaagcagtttgaccaacttcatacaaaagaatatgggcgtcacaccagatgaaaaacagctttctgttagtggtcacaattggggagggattgatatagatggaaatatgcttacctttatggttggtccaaagcaagcgtttgaagtgtctctaccagatgttgcacaaacccagatgcaaggaaaaacagatgttctcttagagtttcatcatgatgatactactggggccaatgagaaagattcgctcatggatttaagttttcatgtgcctacttcaaatactcagtttatcggggatgagaatcgccctccggctcacattctatgggagactatattgaaatttgctgatgtcggttcatctgaagagccagttgtcacctttgaaggaattgcgatccttacaccaagaggacgttatagtgttgagcttcatctgtcatttctacgtctccaaggacaagctaatgattttaaaatccaatacagcagcattgttcgcctctttcttttgccaaagtcaaacaatcctcatacatttgttgttatcactcttgatccaccgatccgtaaagggcaaacattgtatcctcacattgttattcagtttgagactgaggcagtagttgaaagagacctggcattgagtaaagaggttctggctgaaaaatacaaagacaggcttgaggaatcttacaagggtctaatacatgaggtatttaccaaagtccttcgtggtctatctggtgctaaagtcacaagaccaggttctttcagaagttgccaagatggatatgcagttaaatcttcactcaaagctgaagatggactgctgtatccacttgaaaagggtttcttctttctgccaaagcctcctacactcattctgcatgaggagattgagttcgttgaatttgaacggcatggtgctgggggtgccagtatgtcatctcactattttgacctcctcgtcaaactgaaaaatgaccaagaacatctcttcagaaatattcaaaggaatgaataccacaacctcttcaacttcatcaatggaaagaacatgaaaataatgaaccttgggggagatggtcaaggtacaagtggtgtagttacagatgttctacgtgacactgatgatgatgctgttgacccacatctagagcgtattaaaaatcaggctggggatgaggaaagtgatgaagaggatgaagattttgttgcggataaggatgacagtggatctcctactgatgactctggtgatgaggattcggacgctagtgatagtggtggtgaaaaagagaaatcatccaagaaggaagcaagcagttccaagccagttcagaaaaggaaacctaagggcaaggatgaggatggtccagagaagaaaaaggcaaagaagaaaaaagatcctaatgctcccaaaagagcaatgacgccattcatgtatttctcaatggctgagcgaggaaacatgaagagcaacaacccagatttgcctacgactgagattgcaaagaagcttggggagatgtggcaaaagatgtcaagcgaagagaagcagccttatatccagcaggcccaggttgacaagaaacgctatgaaaaggaatccgctgtctatcgtggtgaagcaccagttgatgtggattccggcaatgagtctgactagagtgacactcctgcgttttaggcatgggagaaaatcgaggactggtgcagtttgtggtctgaaattatctcagctcttgacctggcatagtgggcactgaatgagattctgctgatatat

SEQ ID NO: 1595 - DNA, 2425 bp, Setaria italica
ctctaggcctctaccgcctccgcacttccgcagagccgcaccgaagcaagcgagcctctcgacttggccgcccgccggagaagcggagctcgaggggaggcggcgcgcgcgaaatagcaagcggcggccgcaggcgcctcgtcggcagagatgacggacgggcaccacttcaacaacatcctcctcggggggcgcggcggcacgaaccccggtcagtttaaagtgcattcaggtggacttgcatggaagagacaaggtggaggaaagaccattgagattgacaaagctgatgtaacctcagttacatggatgaaagtccccagagcatatcaacttggagtcaggattaaagatggcctgttctacaggtttattggcttccgtgaacaggatgtaagcagtttgaccaacttcatacaaaagaatatgggcgtcacaccagatgaaaagcagctttctgttagtggtcacaattggggagggattgatatcgatggaaacatgcttacctttatggttggtacaaagcaagcatttgaagtgtctctaccagatgttgcacaaacccagatgcaaggaaaaacagatgttctcttagagtttcatgttgatgatactactggggccaatgagaaagattcgctcatggatttaagttttcatgtgcctacttcaaatactcagtttgtcggggatgagaatcgccctccggctcatattctatgggagactatattgaaatttgctgatgttggatcctctgaagagccagttgtcacctttgaaggaattgcgattcttacaccaagaggacgctatagtgttgagcttcatctgtcatttctacgactccaagggcaagctaatgattttaaaatccaatacagcagcattgttcgcctctttcttttgccaaagtcaaataatcctcatacatttgttgttatcactcttgatccaccaatccgtaaaggacaaacattgtatcctcacattgttattcagtttgagacggaggtagtagttgaaagggatctggcattgagtaaagaggttctggctgacaaatacaaagacaggcttgaggaatcttacaagggtctaatacatgaggtatttaccaaagtccttcgtgggctatctggtgctaaagtcacaagaccaggttctttcagaagttgccaagatggatatgcagttaaatcttcactcaaagctgaagatggactgttgtatccacttgaaaagggtttcttctttctgccaaagcctcctacactcattctgcatgaggagattgagttcgtcgaatttgaacggcatggtgctgggggtgccagtatgtcatctcactattttgatctccttgtcaaactgaaaaatgaccaagagcatctcttcagaaatattcaaaggaatgaataccacaacctcttcaacttcatcaatggaaagaacataaaaataatgaaccttggaggagatggtcaaggtacgagtggtgtagttacagatgttctaagggacactgatgatgatgctgttgacccacatctagagcgcattaaaaatcaggccggggatgaggaaagtgatgaagaggatgaagattttgtcgcggataaggatgacagtggatctcctactgatgattctggtgatgaggattcagacgctagtgacagcggtggtgaaaaagagaaatcatccaagaaggaagcaagcagttcaaagcctgttcagaaaaggaagcctaagggcagggatgaggatggtccagagaagaaaaaggcaaagaagaaaaaagatcctaatgctccgaaaagagcaatgacgccgttcatgtatttctcaatggctgagcgaggaaacatgaagagcagcaacccggatttgcctacgaccgagattgcgaagaagcttggggagatgtggcaaaagatgtcaagcgaggagaagcagccttatattcagcaggcccaggttgacaagaaacgctatgaaaaggaatccgctgtctatcgtggtgaagcaccagttgatgtggattccggcaatgactctgactagagtcacaccctcctgcaccggagacatgggaggaaattgctgactgttgttgcagtttgtggcctgaaattatctcagctcttgatctggtacagtgggcactgaatgaaattctagtgacgcatgtaaacggtagttgccatcatgtgaaattgctgtaccatgtaaacggtaggtgccatcatgtgaaattgctgtaccatgtgtatgccggcggcactacttgcctggagcattgctaagaggcgtttcttgttgcgtacctatgcagtgcaaagatcgtacgagtgtagtctaagtgagttttctgtataaccttcatgcctggtttatgagagttgattttattttgaag

SEQ ID NO: 1596 - DNA, 2306 bp, Zea mays
accgcctccgcaccgcagagccgcagccaagcaagctgcgcccctggacttggcctcaccggtgaagcggagcttgaggataggcggtgctcgggagataccaagcggtcggccgcaggcgccacgtcggcggagatgacggacggtcaccacttcaacaacatcctcctcggagggcgcggcggcacaaaccctggtcagtttaaagtgcattctggtggacttgcatggaagagacaaggtggaggaaagaccattgagatcgacaaagctgatgtaactgcagttacttggatgaaagtccccagagcatatcagcttggagtcaggattaaggctggcctgttctacagatttattggcttccgtgaacaggatgtaagcaacttgaccaacttcatacaaaagaatatgggtgtcacaccagatgaaaaacagctttctgttagtggccagaattggggagggattgatatagatggaaacatgctaacctttatggttggttcaaagcaagcatttgaggtgtccctaccagatgttgcacaaacccagatgcaaggaaaaacagatgttctcttagagcttcatgttgatgatactactggagccaatgagaaagactccctcatggatttgagttttcatgtgcctacttcgaatactcagtttgttggggatgagagtcgccctccggctcatattttatgggagaccatattgaaatttgctgatgttggttcttctgaagaaccagttgtcacatttgaaggaattgcgatccttacaccaagaggacgttatagtgttgaacttcatctgtcatttctgcgactccaaggacaagctaacgattttaaaatccaatacagcagtattgttcgcctctttcttttgccgaagtcaaacaatcctcatacatttgttgttatcactcttgatccaccaatccgtaaaggacaaacattgtatcctcacattgttattcagtttgagacagaggcagtagtggaaagagatctggcattgagtaaagaactgttggttgaaaaatacaaggacaggcttgaggaatcttacaagggtctaatacatgaggtatttaccaaagtccttcgtggtctatctggtgctaaagtcacaaggccaggttctttcagaagttgccaagatggatatgcagttaaatcatctctcaaagctgaagatggactgttgtatccactggaaaagggtttcttcttcctgccaaagccacctacactcattcttcatgaggagattgagtttgttgagtttgaacgtcatggtgctgggggtgccagtatatcatctcactattttgacctccttgtcaaactgaaaaatgaccaagagcatctcttcagaaacattcaaaggaatgaataccacaacctcttcaatttcatcaatggaaagaacattaaaataatgaaccttggaggagatggtcaaggtgcaagtggtgtagttacagatgttctacgagacactgatgatgatgctgttgatccacatctagagcgtattaagaatcaggccggggatgaggaaagcgatgaagaggatgaagatttcgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataagggcagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaagaatccgctgtctatcgcggtgaagctacagtcgatgtggattctgggaacgagtctgactagagatccaagctcttgggctggcatggtggcacgggatgaaagtctagtgccatgtgtgctattgttatgtcagcaaccgttgcctccaacattgctgacagtaaagagagtttctctcgcagcgtacctctgcagggcaaaagaatgtacgagtgtagtctagtgattttgtgtaaaacaaccaacatacgtggttttctgagagatggtaagacgtcagtttaactgttgtcgattggctgttttgcctc

SEQ ID NO: 1597 - DNA, 2415 bp, Panicum virgatum
ctcttcccctctcgacctcctccgcagagccgcaccgcagcaagcgaagcctctggacttggcccccagctcggggaagcggagctcgagcggaggcggggcgcgggaggtagcaagcggcggccgcaaggcgcctcgtcggcggagatgacggacggcccccacttcaacaacatcctcctcggagggcgcggcggcacgaaccccggtcaatttaaagtgcattctggtggacttgcatggaagagacaaggtggaggaaagaccattgaaattgacaaagctgatgtaacctcagttacatggatgaaagtcccaagagcatatcaacttggagtcaggattaaagatggcctgttctacaggtttattggcttccgtgaacaggatgtaagcagtttgaccaacttcatacaaaagaatatgggcgtcacaccagatgaaaagcagctttctgttagtggtcacaattggggagggattgatatagatgaaaacatgcttaccttcatggttggttcaaagcaagcatttgaagtgtctctaccagatgttgcccaaacccagatgcaaggaaaaacagatgttctcttagagtttcatcatgatgatactactggggccaatgagaaagattcgctcatggatataagttttcatgtgcctacttcaaatactcaatttgtcggggatgagaatcgccctccggctcatattctttgggagactatactgaagtttgccgatgttggttcctctgaagagccagttgtcacctttgaaggaattgcgattcttacaccaagaggacgttatagtgttgagcttcatctgtcatttctgcgactccaaggacaagctaatgactttaaaatccaatacagcagcattgttcgcctctttcttttgccaaagtcaaacaatcctcatacgtttgttgttatcactcttgatccaccaatccgtaaagggcaaacattgtatcctcacattgttattcagtttgagacagaggcggtagttgaaagagacctggcattgagtaaagagattctggctgaaaaatacaaagataagcttgaggaatcttacaagggtttaatacatgaggtgtttaccaaagtccttcgtgggttatctggtgctaaagtcacaagaccaggttctttcagaagttgccaagatggatatgcagttaaatcttcactcaaagctgaagatggacttttgtatccacttgagaagggtttcttcttcctgccaaagcctcctacactcattctgcatgaggagattgaattcgttgaatttgaacggcatggtgctgggggtgccagtatgtcatctcactattttgacctccttgtcaaactgaaaaatgaccaagaacatctgttcagaaatatccaaaggaatgaatatcacaacctcttcaacttcatcaatggaaagaacatgaaaataatgaaccttggaggagatggacaaggtacaagtggtgtagttacagatgttctacgggacactgatgatgatgctgttgacccacatctagagcgtattaaaaatcaggccggggatgaggaaagtgatgaagaggacgaagattttgttgcggataaggatgacagtgggtctcctactgatgactctggtgatgaggactcagacgctagtgatagcggtggtgaaaaagagaaatcatccaagaaggaagcaagcagttcaaagcctgttcagaaaaggaagcctaaaggccgggatgaggatggtccagagaagaaaaaaacaaagaagaaaaaagatcctaatgcccccaaaagggcaatgacgccattcatgtatttctcaatggccgagcgaggaaacatgaagaacagcaaccctgatttgcctacaactgagattgcaaagaagcttggggaaatgtggcaaaagatgtcaagtgaagagaagcagccttacattcagcaggcccaggttgacaagaaacgctatgaaaaggaatccgctgtctatcgtggtgaggcaccagttgatgtggattccggcaatgagtctgactagagtcacactcatgcgcctgagacgtgggaggaaatcgctgactgttggtgcagttcgtgacctgaaactatctcatctgatctgacagtgggcactgactgaaattagagtgatatatatgtaaacagcagttggctttgttgccgtcagacgaaattgctgtaccatgtgtacgccggtgggcactactcagcattgctaggtgtttcttgtagcgtacctatgcagtgcaaatattgtacgggtatattctagtgagttttgtgtaaaatcagcatacctggtttatgagagttgattttgttttgaaggtttttcatttgcacttttccaatatttaggtgaaaa

SEQ ID NO: 1598 - DNA, 2434 bp, Lolium multiflorum
ggcggcggcggccaccggtcgcgaaggcagccggcgagatgacggacggccacctcttcagcaacatctccctcggcggccgcgtcggcaacaaccctggtcagtttaggcttcattcaggaggggttgcatggaagaagcaaggtggaggaaagaccattgatgttgataaagctgatataatttccatgacatggatgaaaatccccagatcttatcagcttagtgttgggaccaaagagggcatccggtacatgttcaaaggcttccgtgaacaggatgttagtaaccttactaacttcatacaaaagaacacgggaatcgcaccagaggagaagcagctttctgttagcggacataattggggcgcggttgatatcaatggcaatatgcttagttttaacgttggctcaaaggaggcatttgaagtctctctggcagatgtttctcaaactcagttgcaaggaaaaactgatgttgttcttgagttccacgtcgatgatactacaggggctaatgagaaagattcgctgatggatatgagttttcatgtaccaacatcaaatactcaattcattggggatgaggaacggccttcagctcatattttttggcagaagatcttggccatagctgatgttggctcatcagaggaggctgttgctgcctttgagggaattggaattcttactccaagaggtcggtacactgttgagcttcatatgtcattcttacgactccaaggacaagccaatgatttcaaaatccagtatagcagtattcttcgcctctttgttttgccaaagtcaaacaaccctcatacctttttggtcattacacttgatccaccaattcgcaaaggacaaacattatatcctcacattgttattcagtttatgacagaggcagtacttacaacggagctgtcattaagtgaggaggttttggctgaaaagtacaaggatagactgcagagttcttacaatggtctagaacatgaggtattctccaaaatcctccgtggcctgtctggtgctaaagtgacaagaccaagcacgttccgcagttgtcaagatggatatgctgtgaaatcatcacttaaagctgaagatgggttgctctatcctcttgaaaagggctttttctttctgcccaagcccccaacactcattctgcatgaggagattgactatgttgaatttgagcgtcatggtgctggtggtgctagtatgtcgtcccactattttgatctcctggtcaagctaaaaaatgatcaagaacatctcttcagaaatatccaaaggaatgaatatcataaccttttcaactttgtcagtgctaagaatttgaaaatcatgaatcttggagaagatggcgttgaaggaagtggtgccgttgcagctgctcttcagagcactatagacgaccctgatccatatctgaatgggattaaaaatcaggctggtgatgaagaaagtgatgaagaggacgaggattttgtggcggacaaggatgacagtggatcccctagtgatgattctgaagaggagggttctgatgctagcttaagtggaggagaaaaggagaaatcttccaaaaaggaagttagtagctcaaagccacctgcgaagaggaagccaaagagtgtggatgcggaaggttcagagaaaaaaaaggcgaagaagaagaagaaagatccaaatgcccctaaaagagcaatagcgccgttcatgtacttctcaaagactgagcgagttaatttgaagaacagcaatcccgaactgggtgtcacagatatagcaaagaagcttggggagaaatggcaaaagatgtcagctgaggagaggcagccatatgtcgagcagtccatagtggataaaaaacgctatgcagaggagactgctgtctaccgcggtgcggctgcagctcctgtggacgtggactctggtgatgacttgtcggactgaattggaggattggcagttgactgaaggagttattttaagttcccagtataagtaggtatccgttcttagctctagtacctggtgaggtggtcactcagtttcctgagtttacaaaggacatagtagaggacgcaggaacaatgtcactagctttcccgaggtaacattgttttgctacgaagtacgaattctcagtgattgtttatggtacttgcttgttcgctaccagaatgtgtaaggcaaccttggtgaggctgaggcggagtggtgctaaagttgccgatggcaaatctatgctatttttaatgtacgaaggttttataactgataagtctagaaagataatgcggagactatgaaattcatccatatattgatgtgaacttgctaatgtgtcaagttgtagcctaaatcagcgtcaagttgtattcgttccatattaccgatgtcctagcatgtactcttgt

SEQ ID NO: 1599 - DNA, 2522 bp, Avena sativa
acaccaaagcgaaagccacttcctcctcgccgcaaagctcccaaatcccgcccccgaggaggcgactcgcccgcgcgcgagggagcgagtcgagaaactcgcagcacggtgccggcggtcgccggttgcgggttcaaagggcgagatggcggacggccacctcttcagcaacatctccctcggcggccgcgtcggcaacaaccctggtcagtttaggcttcattcgggaggagttgcatggaagaagcaaggtggaggaaaaaccattgatgttgataaagctgatataatctccatgtcatggatgaaaatccccagatcttatcagcttagtgttgggaccaaagagggcatccgatacatgttcaaaggcttccgtgaacaggatgttagtaaccttactaacttcatacaaaagaacacgggaatcacaccagaggagaagcagctttctgttagcggccataattggggagcggttgatatcaatggcaatatgcttagcttcaacgttggctcaaaggaggcatttgaagtctctctagcagatgtatctcaaactcagttgcaaggaaaaactgatgttgttcttgagttccatgtcgatgatactacaggggctaatgagaaagattcgctgatggacctaagttttcatgtaccaacttcaaatactcaatttgtcggagatgaggaacggccttcagctcatattttttggcagaagatcttggcgatagctgatgttggctcatcagaggaggctgttgctacatttgagggaattggaattcttactccaagaggtcgatacgttgtcgagcttcatatgtcattcttaagactccaaggacaagctaatgatttcaaaatccagtatagcagtattcttcgcctctttgttttgccaaagtcaaacaatcctcatacctttttggttatcacacttgatccaccaattcgcaaagggcaaacattatatcctcacattgttattcagtttatgacagagtctgtagctaccacggagctgtcattaagcgaggaagttttggctgaaaagtacaaggatagactgcagagttcttacaatggtctagaacatgaggtattctccaaaatccttcgtggcctgtctggtgctaaagtgacaagaccaagcacattccgcagttgtcaagatggatatgccgtgaaatcatcacttaaagctgaagatgggttgctctatcctcttgaaaagggctttttctttctgccaaagcccccaacactcattctgcatgaggagattgactatgttgaatttgaacgtcatggtgctggtggtgctagtatgtcgtcccactatttcgatctcctggtcaagctaaaaaatgatcaagaacatctcttcagaaatatccaaaggaatgaatatcacaacctcttcaactttgtcagtgctaagaatttgaaaatcatgaatcttggagaagatggccttgatggaagtggtgctgttgcagctgctcttcagagcaccgatgacgacccccttgatccatatctgaatgggattaaaaatcaggctggtgatgaagaaagtgatgaagaggacgaggatttcgtggcagacaaggatgacagcggatcccctagtgacgcttctgaagaggagggttctgatgctagcctaagtggaggagaaaaggagaaatcttccaaaaaggaagttagtagctcgaagccacctgtgaagaggaagccgaagagtggggacgtggaaggttcagagaaaaaaaaggcaaagaagaagaagaaagatcccaatgcccctaaaagagcaatagcaccgttcatgtacttctcaaaggctgagcgagttaatctgaagaacagtaatcctgaactgagcaccacagatatagcaaagaagcttggggagaagtggcaaaagatgtcagctgaggagaggcagccgtatgttgatcagtccctagtggataaaaaacgctacgcagaggagacagcaaagtaccgtggtgcagccgcagctctagtggacgtggagtctgccgatgaatcgtcggactgaattggaagatcctcagttgactgaaggagcgtactttcgagttcccagtataagtaggtatctgatccttgctgtagtaactagtgagatgttcactccgtttccaagttcacaaagaacagagtagaggatgcaggaaccgtgtgtctagcttttccgatgcaacattttgctttgttacggagtacgaatggtcagtgattatggtctgtcagcttgtttattcgctcccagtgtgtagcgcaaccatggcggggtggagtatgttgctaacctgttgtgcagaacgaccctgaagctttttgtgcagagtttgcacttgtagtcttgcactccggttgttgtagatggcaaatctttgctctttttaatatgtgacggctttgagcggatgggtctagtactctagttatctttgtaaaagttcgccaaatgaaaacttagt

SEQ ID NO: 1600 - DNA, 2334 bp, Avena sativa
ccccgacaccaaagcgaaagccacttcctcctcgccgcaaagctcccaaatcccgcccccgaggaggcgactcgaccgcgcgcgagggagcgagtcgagaaactcgcagcacggtgccggcggtcgccggttgcgggttcaaagggcgagatggcggacggccacctcttcagcaacatctccctcggcggccgcgtcggcaacaaccctggtcagtttaggcttcattcgggaggagttgcatggaagaagcaaggtggaggaaaaaccattgaggttgataaagctgatataatctcaatgtcatggatgaaaatccccagatcttatcaacttagtgttgggaccaaagagggcatccgatacatgttcaaaggcttccgtgaacaggatgttagtaaccttactaacttcatacaaaagaacacgggaatcacaccagaggagaagcagctttctgttagcggccataattggggagcggttgatatcaatggcaatatgcttagcttcaacgttggctcaaaggaggcatttgaagtctctctagcagatgtatctcaaactcagttgcaaggaaaaactgatgttgttcttgagttccatgtcgatgatactacaggggctaatgagaaagattcgctgatggacctaagttttcatgtaccaacttcaaatactcaatttgtcggagatgaggaacggccttcagctcatattttttggcagaagatcttggcgatagctgatgttggctcatcagaggaggctgttgctacatttgagggaattggaattcttactccaagaggccgatacgttgtcgagcttcatatgtcattcttaagactccaaggacaagctaatgatttcaaaatccagtatagcagtattcttcgcctctttgttttgccaaagtcaaacaatcctcatacctttttggttatcacacttgatccaccaattcgcaaagggcaaacattatatcctcacattgttattcagtttatgacagagtctgtagctaccacggagctgtcattaagcgaggaagttttggctgaaaagtacaaggatagactgcagagttcttacaatggtctagaacatgaggtattctccaaaatccttcgtggcctgtctggtgctaaagtgacaagaccaagcacattccgcagttgtcaagatggatatgccgtgaaatcatcacttaaagctgaagatgggttgctctatcctcttgaaaagggctttttctttctgccaaagcccccaacactcattctgcatgaggagattgactatgttgaatttgaacgtcatggtgctggtggtgctagtatgtcgtcccactatttcgatctcctggtcaagctaaaaaatgatcaagaacatctcttcagaaatatccaaaggaatgaatatcacaacctcttcaactttgtcagtgctaagaatttgaaaatcatgaatcttggagaagatggccttgatggaagtggtgctgttgcagctgctcttcaaagcaccgacgacgacccccttgatccatatctgaatgggattaaaaatcaggctggtgatgaagaaagtgatgaagaggacgaggatttcgtggcagacaaggatgacagcggatcccctagtgacgcttctgaagaggagggttctgatgctagcctaagtggaggagaaaaggagaaatcttccaaaaaggaagttagtagctcgaagccacctgtgaagaggaagccgaagagtggggacgtggaaggttcagagaaaaaaaaggcaaagaagaagaagaaagatcccaatgcccctaaaagagcaatagcaccgttcatgtacttctcaaaggctgagcgagttaatctgaagaacagtaatcctgaactgagcaccacagatatagcaaagaagcttggggagaagtggcaaaagatgtcaactgaggagaggcagccatatgtggagcagtccctagtggataaaaaacgctacgccgaggagacagccgtgtaccgtggtgcagccaccgcggctccagtggatgtggagtctggggatgaatcgtcggactgaattggaagatccgcagttgactaaaggagcgtactttcgagttcccagtataagtaggcatccgatctttgctgtagtaactagtgaagtgttcactccgtttccaagttcacaaagaacagagtagaggatgcaggaaccgtgtgtctagcttttccgatgcaacattttgctttgttacggagtacgaatggtcagtgattatggtctgtcagcttgtttattcgctcccagtgtgtagcgcaacca

SEQ ID NO: 1601 - DNA, 2594 bp, Avena sativa
gacaccaaagcgaaagccagttcctcctcgccgcaaagctcccgaatcccgcccccgaggaggcgactcgaccgcgcgcgagggagcgagtcgagaaactcgcagcacggtgccggcggtcgccggttgcgggttcaaagggcgagatggcggacggccacctcttcagcaacatctccctcggcggccgcgtcggcaacaaccctggtcagtttaggcttcattcgggaggagttgcatggaagaagcaaggtggaggaaaaaccattgaggttgataaagctgatataatctcaatgtcatggatgaaaatccccagatcttatcaacttagtgttgggaccaaagagggcatccgatacatgttcaaaggcttccgtgaacaggatgttagtaaccttactaacttcatacaaaagaacacgggagtcacaccagaggagaagcagctttctgttagcggccataattggggagcggttgatatcaatggcaatatgcttagcttcaacgttggctcaaaggaggcatttgaagtctctctagcagatgtatctcaaactcagttgcaaggaaaaactgatgttgttcttgagttccacgtcgatgatactacaggggctaatgagaaagattctctgatggacctaagttttcatgtaccaactacaaatactcaatttgtcggagatgaggaacggccttcagctcatattttttggcagaagatcttggcgatagctgatgttggctcatcagaggaggctgttgctacatttgagggaattggaattcttactccaagaggtcgatacgttgtcgagcttcatatgtcattcttaagactccaaggacaagctaatgatttcaaaatccagtatagcagtattcttcgcctctttgttttgccaaagtcaaacaatcctcatacctttttggttatcacacttgatccaccaattcgcaaagggcaaacattatatcctcacattgttattcagtttatgacagagtctgtagctaccacggagctgtcattaagcgaggaagttttggctgaaaagtacaaggatagactgcagagttcttacaatggtctagaacatgaggtattctccaaaatccttcgtggcctgtctggtgctaaagtgacaagaccaagcacattccgcagttgtcaagatggatatgccgtgaaatcatcacttaaagctgaagatgggttgctctatcctcttgaaaagggctttttctttctgccaaagcccccaacactcattctgcatgaggagattgactatgttgaatttgaacgtcatggtgctggtggtgctagtatgtcgtcccactatttcgatctcctggtcaagctaaaaaatgatcaagaacatctcttcagaaatatccaaaggaatgaatatcacaacctcttcaactttgtcagtgctaagaatttgaaaatcatgaatcttggagaagatggccttgatggaagtggtgctgttgcagctgctcttcagagcaccgatgacgacccccttgatccatatctgaatgggattaaaaatcaggctggtgatgaagaaagtgatgaagaggacgaggatttcgtggcagacaaggatgacagcggatcccctagtgacgcttctgaagaggagggttctgatgctagcctaagtggaggagaaaaggagaaatcttccaaaaaggaagttagtagctcgaagccacctgtgaagaggaagccgaagagtggggacgtggaaggttcagagaaaaaaaaggcaaagaagaagaagaaagatcccaatgcccctaaaagagcaatagcaccgttcatgtacttctcaaaggctgagcgagttaatctgaagaacagtaatcctgaactgagcaccacagatatagcaaagaagcttggggagaagtggcaaaagatgtcaactgaggagaggcagccatacgtggagcagtccctagtggataaaaaacgctacgcggaggagacagccgtgtaccgtggtgcagccaccgcggctccagtggatgtggagtctggggatgaatcgtcggactgaattggaagatccgcagttgactaaaggagcgtactttcgagttcccagtataagtaggtatctgatctttgctgtagtaactagtgaagtgttcactccgtttccaagttcacaaagaacagagtagaggatgcaggaaccgtgtgtctagcttttccgatgcaacattttgctttgttacggagtacgaatggtcagtgattatggtctgtcagcttgtttattcgctcccagtgtgtagtgcaaccatggcggggtggagtatgttgctaacctgttgtgcagaacgaccctgaagctttttgtgcagagtttgcacttgtagtcttgcgctccggttgttgtagatggcaaatcgttgctctttttaatatgtgacggcttgagcggatgggtctagtactctagttatctttgtaaaagttcgccaaatgaaaacttagtctctatggcgtgataacattccaacacgatgaagatcgtgttgacactaatttttaacggtaaaaaact

SEQ ID NO: 1602 - DNA, 2177 bp, Pennisetum glaucum
gcgcggcggcacgaaccctggtcagtttaaagtgcattcaggtggacttgcatggaagagacaaggtggaggaaagaccattgagattgacaaagctgatgtaacctcagttacatggatgaaagtacccagagcatatcagcttggggtcaggattaaagatggcctgttctacaggtttattggcttccgcgaacaggatgtaagcagtttgaccaacttcatacaaaagaatatgggtgtcacaccagatgaaaagcagctttctgttagtggacacaattggggagggatcgatatagatggaaacatgcttagctttatggttggttcaaagcaagcatttgaagtgtctctaccagatgttgcacaaacccagatgcaaggaaaaacagatgttctcttagagtttcatgttgatgatactactggggccaatgagaaagattcgctcatggatttaagcttccatgtgcctacttcaaatactcagtttgtcggggatgagaatcgccctccggctcatattctatgggagactatattgaaatttgctgatgttggttcctctgaagagcccgctgtcacctttgaaggaattgggattcttacaccaagaggacgttatagtgttgagcttcatctgtcatttctacgactccaagggcaagctaatgattttaaaatccaatacagcagcattgttcgcctctttctgttgcctaagtcaaataatcctcatacatttgttgtcatcactcttgatccgccaatccgtaaaggacagacattgtatcctcacattgttattcagtttgagacggaggcggtggttgaaaaggatctggcattgagtaaagaggttctggctgacaaatacaaagataggcttgaggaatcttacaagggtctagtacatgaggtatttaccaaagtccttcgtgggctatctggtgctaaggtcacaagaccaggttctttcagaagttgccaagatggatatgcagttaaatcttcactcaaagctgaagatggactgttgtatccacttgaaaaggggttcttctttctgccaaagcctcctacactcattctgcatgaggagattgaattcgttgaatttgaacgtcatggtgctgggggtgccagtatatcagctcactattttgatctccttgtcaaactgaaaaatgaccaagaacatctcttcagaaatattcaaaggaatgaataccacaacctcttcaacttcatcaatggaaagaacataaaaataatgaaccttggaggagatggtcaaggtgcgagtgtagttacagatgttctaagggacactgatgatgatgctgttgacccgcatctagagcgcattaaaaatcaggccggggatgaggaaagtgatgaagaggacgaagattttgtcgcagataaggatgacagtggatctcctactgatgattctggtgatgaggattcagatgccagtgacagtggtggtgaaaaagagaaatcatccaagaaggaagcaagcagttcaaagcctgttcagaaacggaaacctaagggcagggatgaggatggtccagagaagaaaaaggcaaagaagaaaaaagatcctaacgctccgaaaagagcaatgacgccgttcatgtatttctcaatggctgagcgaggaaacatgaagagcagcaacccggatttgcctacgactgagattgcgaagaagcttggggagatgtggcaaaagatgtcaagcgaagagaagcagccttatattcagcaggcccaggttgacaagaaacgctatgaaaaggaatccgctgtctatcgtggtgaagcaccagttgatgtggattccggcaatgagtctgactagagtcacaccctactgcacacgagacatgggaggaaatcactgactgtcggggcaggcctgtgaaattatctcagcccttgatctggtatattgggcacggaatgaatctagggatatatgtaaatggcagttgttgccttcatgtgaaattgttgtaccatgtgtatgctagcggcactacttgcctggagcatggctaagaggcgtttcgtgtagcgtgtctatgcagtggttgtagacttgtagtctactgagttttctgtaaaaccttaatatctggtttatgagagttgtttttgta

SEQ ID NO: 1603 - DNA, 2712 bp, Setaria italica
tgtccgtgtccggcccctcgtctcagctcacgcctcccacgctccgacacctagcccgtctcgtcggagctacgccgcaatacagccgagatggcgaccgccagcgacggaggcaaggggccgggagcggcggcggtgccgccgcagcttgagtcgtttctggccatcgggctcgaccagcgcacggcggagaacgcccttgccaaccgcaaggtcacagccaacctcaccgccgtcatcgccgaggctggtgttactgagtgccacaaatctgtggggaatctcctttacactgttgcgaccaagtatccggcaaatgcgctagtgcaccgaccagatctcattaagtacattctttcagaaaagatcaagaattctgcacaattggatgctgctctgtcatttctttctaccttaggtcctgattccttggatccagtgaagtttgaagaggcttgtggtgtgggggtagttgtttcgtttgaagagattcagtcaacagtcaatgatgttctaaatgaaaatatggaggccatactggaacagcgatatcgtataaatgttggcagcttatgtggactggttaggaagaggcaaccctggggtgatgctaagttggtcaaggaggaaattgagaaaaggcttgtggaaattttaggtccaaagacagaagcagataatgctaagcctattaaaaagaaaaaggagaagcctgccaaagttgaggaggagaaaactgttgctgctccaccttctgaggaggaactaaatccgtactccatatttcctcaaccagaggaaaacttcaaggtccatacagaaatatttttcagtgatggaaatatatggagagcacataacacaaagagcattttagagaaacatcttaaagtaactggaggaaaagtgatgacccgctttccccctgagcctaatggataccttcatattggtcatgccaaggctatgttcattgattttggacttgctaaagagcgcaatggccattgttaccttaggtttgatgatacgaacccggaggctgagaagaaagaatacatagaccatattcaagaaattgtcacatggatgggctgggaaccttacaaagttacatacacgagtgactatttccaagatctatatgaacttgctatttgtttgatacagaagggactagcctatgtcgatcaccagaccccagaagaaattaaggagtatagagaaaagaagatgaatagtccatggagagataggcccattgaggagtcgctgaagttatttgaagatatgagacatgggttgattgctgagggaaaggctactctccgaatgaagcaggacatgcagaatgacaacaagaacatggctgacttaatagcatatagaataaagtttacacctcatccacatgctggagacaaatggttcatctacccaagctatgactatgctcattgtttggtagattctcttgagaatattacacactcgttgtgcactctagaatttgatatacgtcgtccgtcatactactggctgcttgtagccttgggccaataccagccatatgtctgggaatattcaaggctaaacatatcaaacaatgttatgtccaaaagaaagctgaatcgacttgtcacggacaagtgggtagatgggtgggatgatcctcgactattgacactagcaggactaagaaggagaggggtatcatcaacagcaattaactctttcattcgtggaatgggaataacaagaagtgataatagcttgattcaagttgaacgccttgaataccatattagagaagagcttaacaaagtagcccctcgagctttggttgttttgcatcctctaaaggttgtcataactaatttagattacggaacgataatgaaccttgatgccaaaatgtggcctaatgctcctgacagtgatgcttcagcccactataaggttccattttcaagaacactctacattgaagaatctgatttccgcctaaaggattcgaaagatttctatgggcttgctcctggtaaatcagtaatgctgaggcacgcattcccaataaaatgtgcggaggttatctatggagacaatccggatagtattgttgaaatccaagctgagtatgacccttccaaggctacaaaaccgaagggcgtgttacactgggttgccgagccttcccctggggttgagccactcaaggttgaagtgagattgtttgagaaactgtttctttcagagaaccctgcagagctcgaggattggctgggtgatctcaacccgcagtcaaaagaggtgataaagggagcatatgctgtaccatcacttgcaaatgccgtgctgggtgacaaattccagtttgaacgccttggttacttcgccgtggattcagactcgacgcctgaggggctggtgttcaacagaacggttaccctaaaagactcctttggaaaagctggacccaagtgatcgactcaccatctgccgaggaagagacttgctcgcttggcttggcgaaaaagattttgttgtaatactgttagtggtttctaaatagttgtagcacactgccctgcatgagattctgtgggggtacccaattttgcagcgatgtcaccaacactgaactgttgttttcattaatggtaactcaaattatgtttacttgatagtgagttttatttaacatcccgagat

SEQ ID NO: 1604 - DNA, 2349 bp, Echinochloa colona
tcgggctcgaccagcgcacggcggagaacgccctcgccaatcgcaaggtcacagccaacctcaccgccgttatcgccgaggccggtgttactgggtgcgacaaatctgtggggaatctcctctacactgttgcgacgaagtatccagcaaatgccctagtgcaccgccccaacctcatcaaatacattctgtcagaaaagataaaaaactccgcacaattggatgctgctctgtcgtttctttctaacttgggtcctgattccttggactcagtgaagtttgaagaggcttgcggtgtgggggtagttgtttcgtttgaagagattcagtcgacagtctctgatgttctaaatcaaaatatggaagccatagtggaacaacgatatcgtataaatgttggcagcttatgtggacaagttaggaagaggcacccctggggtgatgctaagtttgtcaaggaggaaattgagaaaaggcttgtggagattttaggtccaaagacagaagcagataacgctaagccgatgaaaaagaaaaaggagaagcctgccaaagttgaggaggaaaaaactgttgctgctccgccttctgaggaggaactaaatccctactccatatttcctcaaccagaggaaaacttcaaggtccatacagaaatatttttcagcgacggaaacatatggagagcacacaacacaaagaacattttggagaaacatcttaaagttactggaggaaaagtgatgacccgatttcccccagagcctaatggataccttcatattggtcatgccaaggctatgttcattgattttggactagctaaagagcgcaatggccactgttaccttaggtttgatgatacaaacccggaggccgagaagaaagaatacatagatcatattcaagaaattgtcacatggatgggctgggagccttacaaaattacatatacgagtgactatttccaagatttatatgaacttgctatttgtttgatacagaagggactagcctatgtcgatcaccagaccccagaagaaattaaggagtatagagaaaagaagatgaatagtccatggagagataggcccattgaagagtcgctgaagttatttgaagatatgagacatggattgattgctgagggaaaggctactcttcggatgaagcaagacatgcagaatgacaacaagaacatggctgacttaatagcatatagaataaagtttacacctcatccacatgctggagacaagtggttcatctacccaagctatgactatgctcactgtttggtagattctcttgagaacattacacactcgttgtgcactctagaatttgacatacgtcgtccgtcatactactggctgcttgtagccttgggccagtaccagccatatgtctgggaatattcaagattaaacatatcaaacaatgttatgtccaaaagaaagctgaatcgacttgtcacggacaagtgggtagatgggtgggatgatcctcgattgttgacactagcagggttaagaaggagaggagtctcatcaacggcgattaactcattcattcgtggaatgggaataacaagaagtgacaacagcttaattcgcattgaacgccttgaataccatattagagaagagctcaacaaagtagcccctcgagctttggtcgttttgcatcctctaaagattgttataactaatttagatcatggcacaataattaaccttgatgccaaaatgtggcctaatgctcctgatgatgacgcttcagcccactataaggttccattctcaagaattgtctacattgagcaatctgatttccgcctaaaggattcaaaagatttctatgggcttgctcctggtaaatcagtaatgctgagacatgcattcccgataaaatgtacggaggttatctatggaaacaatcctgacagtatagttgaaatccgagccgagtatgacccttctaaggctacaaaaccgaagggcgtattgcactgggttgcggagccttctcctggggttgagccactcaaggttgaagtcagattgtttgagaaattgtttctttcagagaaccctgcggagctcgaggattggctgggtgatctcaacccgcagtcgaaggaagtgataaagggcgcatatgctgtaccttcacttgcaaatgccgtgctggggggcaaattccagtttgaacgccttggttactttgctgtggattcagactcgacggccgaggcgctggtattcaacagaacggttaccctaaaagactcctatggaaaagctggacccaagtgatcttgtcaccttttgctgaggaagacatttt

SEQ ID NO: 1605 - DNA, 2784 bp, Sorghum bicolor
ctgttgtccccaggctcctcgcacgcctccgacgctccgacacctcgctctctcgcctagtcgcctctccggagctgcgccgcaaacccagggaagatggcgactgccagcgacggagacaaggagtcggcggccccggcgtcgcccccgccgcagctggagtcgtttctttccatcggactcgaccagcgcacggcggagaacgccctcgctaaccgcaaggtcaccgccaacctcaccgccgtcatcgctgaggctggtgttactaggtgcgacaaatctgtggggaatctcctttacactgtcgcgacgaaatatcccacgaatgcgctagtccaccgccctgatctcattaagtacattctgtcagaaaagataaaaaactctgcacaactggatgctgccttgacgtttctttctacattgggtcctgattctttggattcagtgaagtttgaagaggcttgtggtgtcggagtggttgttttgtttgaagagattcagtcaacagtcacggatgttttaaatgaaaatatggaagccatagtagagcagcgataccgtataaatgttggcagcttatgtggacaagttaggaagaggcatccctggggtgatgctaagtcaatcaaggaggaaattgagaaaaggcttgtggaaattttaggtccaaaaacagaagaagataatgctaaaccaatgaaaaagaagaaggagaagcctgttaaagtcgaggaagagaagactgcagtagcagttgctactcctgaggaggaagtaaatccctactccatatttcctcagccagaggaaaacttgaaggtccatacagaaatatttttcagtgatggaaatatatggagagcacacaacacaaagagcattttagagaaacatcttgaagcaactggtggaaaagtgatgacacgctttcccccagaacccaatggataccttcatattggtcatgccaaggctatgttcattgattttgggttggctaaagagcgtaatgggcactgttaccttaggtttgatgatacaaaccctgaggccgagaagaaagaatacatagatcatattcaagaaattgtcacatggataggctgggaaccttacaaagttacctatacgagtgactatttccaagatttgtatgaacttgccatttgtttgatacagaagggactagcctatgtcgatcaccagagcccagaagaaattaaggagtatagagaaaagaagatgaatagtccatggagagagaggccctttgaagagtcactgaagttatttgaagatatgagacgcgggttgattgctgagggaaaggctactctccggatgaagcaggacatgcagaatgacaacaagaacatggctgacttcatagcttatagaataaagtttacacctcatccacatgctggagacaagtggttcatttacccaagctatgactatgctcattgtttggtagattctcttgagaacattacacactcgttatgctcactagaatttggcatacgtcgtccgtcatactactggctgcttgcagccttgggccagtatcagccatatgtatgggaatattcaaggctaaacataacaaacaatgttatgtccaaaagaaagctgaatcaactcgtcacggacaagtgggtagatgggtgggatgatcctcgacttttgacgctagcaggcctacggaggagaggaatatcagcagcagctattaattcattcattcgtggaatgggaataacaagaagtgacaatagcttgatacgcatcgaacgccttgaataccatattagagaagaacttaacaatgtttgccctcgagctttggttgttttgcatcctctaaaggttgttataactaatttggattatggaatggttattaaccttgatgccaaaatgtggcctaatgctcctgacagtgatgggtcagcccactataaggttccattctcaagaatcatctacattgagaaatctgatttccgtctgaaggattcaaaagatttctatgggcttgctcctggtaaatcagtattgctgagacatgcattcccaataaaatgtatggaagttatctatggagacaatgcagatagtattgttgaaatccgagccgtgtatgatgcttcaaaggctacaaaaccgaagggtgtcctgcattgggttgctgagccttctcctggggttgaaccactcaaagttgaagtcagattgtttgagaaattgtttctttcagaaaatcctgcagaacttgacgactggctgggtgatctcaacccacagtcgaaggaggtgataaagggagcatatgctgtaccttcacttgcaagtgccgtactgggggacaaattccagtttgaacgccttggatactttgctgtggattcagactcgacgcccgaggaactggtgttcaacagaactgttacccttaaggactcctatggaaaggctggacctaagtgatctcactttgttaaagcgagttgctcacagtttgtcagagatttggtggaatactgatagtgtttctaaagagttgtaggacaatggtcttagaccggtctcaatggagtttcattaaaatttcatgcacattaaatatgttaatgttgcattgtattaatgaagagagagatgataagagtttcatggaagcagagagagttttatcatcataaaacttttttgcactgtttccaaaatatggatgtgttgaaaactgtgttatgaaatttacactgaggatgacct

SEQ ID NO: 1606 - DNA, 2794 bp, Oryza sativa
aaaaaaaggaaaaaaatccgcacacagcaaaagcctctccactacctctccctccacctgtcgcctaaaccctagatcgcatctcgaggcatctcgcttcacctcgtcgtcgcggtcgccggagccggagccggaggcggcggaggagatgggcaccggaggcggcgagggggacaagtcggccgcgctgccgctggaggcgctgctggcgctggggctcgaccagcgcacggcggagaacgctctggtcaacagcaaggtcaccgccaacctcgccgccgtcatagccgaggctggtataagtggatgtgataagacggttgggaacctcctgtacacggttgccactaaatacccaaccaatgcgcttgtccatcgtcctgtactcattgactatattgtgtcaacgaagataaagaatcctgcacaactagatgctgctctgtcattccttactaatactggccctgactctttagatactgggaagtttgaagaagcctgtggtgtaggtgtggttgtttcaattgaagagattaaatcaacagtcaatgaggtattaaagcataatatggaggctatattggagcagcgatatcatattaatgttggtaacctatgcggacaggttaggaagatgcacccctggggtgatgctaaggcgaccaaggatgaaattgacaagaagcttgcagagatattaggtccaaagacagatgctgacaatgtaaaaccagtgaaaaagaaaaaggaaaaagcagcaaaagttgaggagaaaaaagctgcagtagtcactgctgcatcgccatctgaggaggaattgaatccatactctatatttcctcagccagaggaaaattttaaggttcatacagaaatattctatagtgatgggaacatatggagagcgcataacagtaaggagattttagagaaacaccttaaggcaactggtggaaaagtgatgacccgtttcccaccagaacctaatggatatcttcatattggtcatgccaaggctatgtttattgattttggactggcgaaagagagaaatggtcattgttaccttaggtttgatgacacaaatccagaagccgaaaagaaagagtatattgaccacattcaggaaatcgtacactggatgggatgggagccctacaaagttacatatacaagtgattatttccaggctttatatgagcatgcagttgagttaatacgaaaagggctagcctatgtggatcaccagaccgcagaagaaatcaaggaatacagggaaaagaaaatgaatagtccatggagggatagacccattgaagaatcactgaaactatttgaagacatgagacgtgggttgattgctgaaggtgcagcaacactccgaatgaaacaagatatgcagaatgataacaagaatatgtctgatttaatagcatatagaataaaattcactcctcatccacatgctggtgataagtggtgcatctatccaagctatgactatgctcactgcatggtggattctcttgagaacattacacattcgctgtgcacgctcgagtttgacatacgtcgcccgtcatactactggctacttgttgccttgggcctgtaccagccatatgtttgggagtattcgaggctaaacatatcgaatactgtgatgtctaaaagaaagttgaatcgacttgtgacagaaaagtgggtagatgggtgggatgaccctcgtttgttgacactagcaggattgcggcgacgtggagtgtcatcaactgcaattaattcgtttattcgtggaattggaataacaagaagtgacaatagcttaattcgggttgaccgtcttgaatatcatatcagagaagagcttaataaaacagcttcccgtgccatggttgtgttgaatcctctaaaggttgtaataactaacttggaggatgaaaaagtcatagaccttgatggaaaaatgtggcctgatgctcctgcagacgatgcttcatcctactacaaggttcctttctcaagaatcgtctacatcgaaaaaacagattttcgtctaaaggactcgaaagattactacgggctagctcctggtaaatctgccctgctaagatatgcattccccattaaatgtaccgaggttgtttatggtgacaatccagatgagatcattgaaattcgagctgaatatgacccttcaaagactactaaacctaagggtgttctgcactgggttgctcagccagcacctggagttgaaccacttaaggtggaagtaagattatttgataaattattcctctctgagaatcctgctgaactggaggattggctgggtgatcttaacccgaactcaaaagaggtgatcaagggtgcctacgccgtgccatcgcttgcgactgcggttcttggtgacaagttccagttcgagcggctaggctacttcgcagtggacacagactcgacacctgagaacattgtgttcaacaggacggttaccctgcgtgattcgtatgggaaagctgggccaaagtgattgccaacttactgaatttccagtaagtttctttacctgggtgcactgaggttacacagtgggaagaaaactgcagtgtgatacataaccatagtgaaaaaaaagggccctttcttgtaaaatggacttgtttgacttgttatatgtttccatcaaattgtgcatgattgagtatgttctcatgtcaatgaggtttggtgatttgacttctagcatttataaatggtgcaaaccaacattataaacagaaaccac

SEQ ID NO: 1607 - DNA, 2787 bp, Oryza sativa
aaaaaaaggaaaaaaatccgcacacagcaaaagcctctccactacctctccctccacctgtcgcctaaaccctagctcgcatctcgaggcatctcgcttcacctcgtcgtcgcggtcgccggagccggagccggaggcggcggaggagatgggcaccggaggcggcgagggggacaagtcggccgtgctgccgctggaggcgctgctggcgctggggctcgaccagcgcacggcggagaacgctctggtcaacagcaaggtcaccgccaacctcgccgccgtcatagccgaggctggtataagtggatgtgataagacggttgggaacctcctgtacacggttgccactaaatacccaaccaatgcgcttgtccatcgtcctgtactcattgactatattgtgtcaacgaagataaagaatcctgcacaactagatgctgctctgtcattccttactaatactggccctgactctttagatactgggaagtttgaagaagcctgtggtgtaggtgtggttgtttcaattgaagagattaaatcaacagtcaatgaggtattaaagcataatatggaggctatattggagcagcgatatcatattaatgttggtaacctatgcggacaggttaggaagaggcacccctggggtgatgctaaggcgaccaaggatgaaattgacaagaagcttgcagagatattaggtccaaagacagatgctgacaatgtaaaaccagtgaaaaagaaaaaggaaaaagcagcaaaagttgaggagaaaaaagctgcagtagtcactgctgcaccgccatctgaggaggaattgaatccatactctatatttcctcagccagaggaaaattttaaggttcatacagaaatattctatagtgatgggaacatatggagagcgcataacagtaaggagattttagagaaacaccttaaggcaaccggtggaaaagtgatgacccgtttcccaccagaacctaatggatatcttcatattggtcatgccaaggctatgtttattgattttggactggcgaaagagagaaatggtcattgttaccttaggtttgatgacacaaatccagaagccgaaaagaaagagtatattgaccacattcaggaaatcgtacactggatgggatgggagccctacaaagttacatatacaagtgattatttccaggctttatatgagcatgcagttgagttaatacgaaaagggctagcctatgtggatcaccagaccgcagaagaaatcaaggaatacagggaaaagaaaatgaatagtccatggagggatagacccattgaagaatcactgaaactatttgaagacatgagacgtgggttgattgctgaaggtgcagcaacactccgaatgaaacaagatatgcagaatgataacaagaatatgtctgatttaatagcatatagaataaaattcactcctcatccacatgctggtgataagtggtgcatctatccaagctatgactatgctcactgcatggtggattctcttgagaacattacacattcgctgtgcacgctcgagtttgacatacgtcgcccgtcatactactggctacttgttgccttgggcctgtaccagccatatgtttgggagtattcgaggctaaacatatcgaatactgtgatgtctaaaagaaagttgaatcgacttgtgacagaaaagtgggtagatgggtgggatgaccctcgtttgttgacactagcaggattgcggcgacgtggagtgtcatcaactgcaattaattcgtttatttgtggaattggaataacaagaagtgacaatagcttaattcgggttgaccgtcttgaatatcatatcagagaagagcttaataaaacagcttcccgtgccatggttgtgttgaatcctctaaaggttgtaataactaacttggaggatgaaaaagtcatagaccttgatggaaaaatgtggcctgatgctcctgcagacgatgcttcatcctactacaaggttcctttctcaagaatcgtttacatcgaaaaaactgattttcgtctaaaggactcgaaagattactacgggctagctcctggtaaatctgccctgctaagatatgcattccccattaaatgtaccgaggttgtttatggtgacaatccagatgacatcattgaaattcgagctgaatatgacccttcaaagactactaaacctaagggtgttctgcactgggttgctcagccagcacctggagttgaaccacttaaggtggaagtaagattatttgataaattattcctctctgagaatcctgctgaactggaggattggctgggtgatcttaacccgaactcaaaagaggtgatcaagggtgcctacgccgtgccatcgcttgcgactgcggttcttggtgacaagttccagttcgagcggctaggctacttcgcagtggacacagactcgacacctgagaacattgtgttcaacaggacggttaccctgcgtgattcgtatgggaaagctgggccaaagtgattgccaacttactgaattttcagtaagtttctttacctgggtgcactgaggttacacagtgggaagaaaactgcagtgtgatacataacgatagtgaaaaaaaagggccctttcttgtaaaatggacttgtttgacttgttatatgtttccatcaaattgtgcatgattgagtatgttctcatgtcaatgaggtttggtgatttgacttctagcatttataaatggtgcaaaccaacattataaacag

SEQ ID NO: 1608 - DNA, 2739 bp, Brachypodium distachyon
ccgtgcaccacatttccccttctccactcgccggacggcctaaaaccctagcgcgcgccacaccacccgcacgtgcatctcgaggcttcccgccggagccggagcaggaggaggcgccgtcagcagtagcgatggtgaccggagtcgacggggagaaggccccggccctgcagctggagacgctgctggctctcggcctcgaccagcgcacggcggagaacgcgctcgtcaacagcaaggtcaccgccaacctagccgccgtcatagcagaggctgggataagtggatgcgacaagtcagttggaaaccttctgtatgcagttgccactaaatacccaacaaatgcacttgtccatcgtcctgctctcattaactatattgtgtcaacgaagataaagaaccctgcacaactagatgccgctctattatttcttaacaatattggttcggattctttggatgttggaaagtttgaagaagtgtgtggtgtaggcgtggttgtttctattgaagagattcaatcaactgtcactgagattctgaaggaaaacatggaagctatcttggagcagcggtaccacataaatgttggtaacctttgcggacaggtcaggaagaggcacccttggggtgatgctaaggcgacaaaggaggagattgagaagaggcttgcagagatactaggtccgaagacggaagctgacaatgcaaaaccagtgaagaagaagaaggagaaaccagcaaaagttgaggagaaaaaagctgcagtagccacttctgccccaccatctgaggaggaactgaatccatactctatatttcctcagccagcagaaaacaataaggttcatacagaaatatttttcagcgatgggaacatatggagggctcataatacaaaggagattttagagaaacaccttaagcaaactggtggaaaagtgatgacccgtttccccccagaacctaatggatatcttcatatcggccatgccaaggctatgtttattgattttggcctggctaaggagcggaatggtcattgctaccttaggtttgacgatacaaatccagaagctgaaaagaaagaatatatagaccacattcaggagatagtccagtggatgggatgggagccctacaaagttacatatacaagtgactatttccaagctttacatgagcatgcagttgagttaattcggaaaggactagcctatgtggatcaccagactgcagaccaaatcaaagaatacagggaaaagaagatggatagtccatggaggaataggcctattgaagagtctttgcaattatttgaagatatgcgacgtgggttgattgctgagggtgcagcaactctccgaatgaagcaggacatgcagaatgataacaaaaacatgtctgacttgatagcatatagaataaaattcactcctcacccacatgctggcgacaaatggtgtatctatccaagctatgactatgcccattgcatggtggattcacttgaaaacattacacattcattgtgcacacttgagtttgacatacgtcgcccgtcatactactgggtacttgttgccttgggcttgtaccagccacatgtttgggagtattcgagactaaacatatcaaacactgtgatgtctaaaagaaagttgaatcggcttgtgacagagaagtgggtagatgggtgggatgatcctcgtttgttgacactggcaggactgcggcgacggggagtgtcatcaactgcaattaatacatttattcgtggaattgggataacaagaagtgacaatagcttaattcgtgtcgaccgtcttgaatatcatatcagagaagaacttaataaaacagcttctcgaaccatggttgttttgcatcctctaaaggttgtaataactaacttggaagatggaaaagtcatagaccttgatgggaaaaagtggcctgatgctcctgctgatgaagcttcatcctactacaaggtccctttctcaaaaactgtctacattgaaaaaacggactttcgtgtaaaggactcgaaggattactatgggctagctcctggtaaatctgccctgctaaggtatgcattcccaataaaatgcaccgaggttatctatggtgataatcctgatgatattgttgaaattcgagctgagtatgacccctcaaagacttctaagcctaagggtgttctgcactgggtcgcccagccagcacctggagttgagccgctaaaggtcgaaataagattatttgagaaattattcctatcggagaatcctgctgaattggaggattggttgggtgatcttaacccgcactcgaaagaggtgataaagggagcctatgctgtaccttcactcgctaccgcggttctgggtgacaaattccagtttgagcggctgggctactttgctgtggacacggactcgacgcctgagaagcttgtcttcaacaggactgttaccctgcgtgattcatatgggaaggctggacccaagtgaccggtaatttagaagaaagctttggttttgctcgactgcagaggcgataatggagaaaacaaagttatgtgatacataatgataaccaaaagaccgtttgtatactggactgacgactttggtgtctgcttcaatcaaattttgaatgatcaagtggtgctctggttacattactgttaaaaacaaatgctcaatgcaatcaggggaacagatgtcgcac

SEQ ID NO: 1609 - DNA, 2675 bp, Avena sativa
cgcaccactctcctccccattctcctgtcgccggaaacgcctaaaaccctaggcgtgtgtgccgcacgtgcgtctcgaggccggagcgggagggagatggtcgacggggagaaggccccggccctgcagctggagacgctgctggcgctcggcctcgaccagcgcacggcggagaacgccctcgtcaacagcaaggtcaccgccaacctagccgccgtcatagcagaggctggtataagtggatgtgacaagtcagttggaaatcttctctatgcagttgccactaaatacccaaacaatgcacttgtccatcgtcctgctctcatcaactatattgtgtcaacaaagataaagagtcctgcacagctagatgctgccctgtcatttcttgcaaatgttggccctgaacctttggatattgggaagtttgaagaagcctgtggtgtaggtgtggttgtttcgattgaagagattcactcaactgttgctgaggttctaaagggaaatatggaagctatactggagcagcggtatcacataaatgttggtagcctatgcggacaggttaggaagaagcacccctggggcgatgctaaggcgacaaaggacgagattgagaagaggcttgcagagattctaggtccaaagacggaagctgataatgtaaaaccagtgaaaaagaagaaggaaaagccagcgaaagttgaggagaaaaaagttgcagtagccactgctgctccaccatctgaggaggaactgaatccatacactatatttcctcagccagcagaaaacaataaggttcatacagaaatattcttcagcgatgggaacatctggagggcacataacacaaaggagatactagagaaacatcttatggcaactggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagtgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaacatggctgacttaattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactactggctacttgttgccttgggattgtaccagcctcatgtctgggagtattcaaggctgaacatatcaaatacagtgatgtctaaaagaaagttgaaccggcttgtaacagagaagtgggtagatggatgggatgatcctcgtctgttaacactggcaggactgcgacgacggggagtgtcagcaaccgcaattaattcatttatccgtggaattgggataacaagaagtgacaatagcttgattcgtgttgaccgtcttgaatatcatatcagagaagaactcaataaaacagcttctcgaaccatggttgttctgcatcctctaaaggttgttataactaacttggaagatggaaaagtcatagaccttgatggaaagaagtggcctgatgctcctgctgatgatgcttcatcctactacaaggttcctttctcaagaactgtctacattgagaaaactgattttcgccttaaggactcgaaagattactatgggctagctcctggtaaatctgccctgctaaggtatgcattcccgataaagtgcacagaggttgtttatggtgataatccagatgaaattgtcgaaattcgagctgagtatgacccctcaaagacttctaaacctaagggtgttctgcactgggtcgccgagccagcacctggagttgagccattaaaggttgaaataagattatttgagaaattattcctatcggagaatccggccgaattggaagattggctgggtgaccttaaccccaactcgaaagagattgtaaagggcgcctacgctgtaccatcacttgcaaccgcagttctaggtgacaagttccagttcgagcggcttgggtactttgctgtggacaccgactcgacgcccgagaagcttgtgttcaacaggactgttaccctgcgcgactcttatgggaaggctggacccaagtgacatttaatttagtgaaaaagcttgattttgcttggttacagtggcgctaataggagaaaacgttgtaatgccatacaacataccaatagccaggtggcctttttgatttgcgtactgggcttgtgatgactattaccatgtgtttggttctatcaaattttgaatgatcagatgctagaaaaaatgtgtagtcagtgttc

SEQ ID NO: 1610 - DNA, 2790 bp, Secale cereale
ctcgctcgcagcccttcccggtccggacacgcctgaaccccagctgcggcgcgcgcacgcctgcggacactcgaccccggagccggagcgggaggcgccggcggcggagatggtcgacggggagaaggccccggccccggccccgccccctgccctgctgcagctggagacgctgctggcactcggcctcgaccagcgcacggccgagaacgcgctggtcaacagcaaggtcaccgccaacctagccgccgtcgtagccgaggctggtataactggatgcgacaagtccgttgggaatcttctgtatgcagttgccacgaaatacccaaccaatgcgctggtccatcgtcctgctctcattaactatatcgtttcgaccaagattaagaaccctgcacagctagatgctgctctgtcgtttcttactaatactggtcctgaaactttggatgttgggaagtttgaagaagcctgtggtgtaggtgtggttgtttctattgaagagattcagtcaactgtcgctgaggttctaaaagaaaacatggaagctatattggagcagcggtatcacataaatgttggtggcctatgtggacaggtcaggaagcgtcacccctggggcgatgctaaggcaacaaaggaggagattgagaagaagcttgcagagatactaggtccgaagacggaagctgacaatgtaaaaccagtgaaaaagaagaaggaaaaaccagcaaaagttgaggagaaaaaggttgcagtagccactgctgccccaccatctgaggaggaactgaatccttatacaatatttccccagccagcggaaaacaataaggttcatacagaaatattcttcagcgatgggaacatatggagggcgcataacacgaaggagatattagagaaacatctcaaggcaactggtgggaaagtgatgacccgtttcccgccagaacctaatggatatcttcatatcggtcatgctaaggctatgtttattgattttggattggctaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagatttatatgagcatgcagttgagttaatacggaaagggctagcctatgtggatcaccagactgcagaacaaatcaaggaatacagggaaaagaagatggatagtccatggagggataggcccattgaagagtctttgcagttatttgaagacatgcgatgcgggttgattgctgagggtgcagcaactctccgaatgaagcaggacatgcagaatgataacaaaaacatgtctgatttaatagcatatagaataaaattcactcctcatccgcatgctggcgacaaatggtgtatctatccaagctatgactatgctcattgcatggtggattcacttgaaaacattacacattctttgtgcactcttgagttcgacatacgtcgcccgtcatactactggctacttgttgccttaggcttgtaccagccacatgtttgggagtattcgaggctaaacatatcacatactatgatgtccaaaagaaagttgaatcggcttgtgacagagaagtgggtagatgggtgggatgatcctcgtttgttgactttggcaggattgaggcgacggggtgtatcagcaaatgcgatcaattcatttatccgtggaattgggataacgagaagcgacaatagcttaattcgtgttgaccgtcttgaatatcatatcagagaagaactgaataaaactgcttctcgaaccatggttgttttgcaccctctaaaggttgtaataactaatttggaagatggaaaagtcatagaccttgatggaaaaaagtggcctgatgctcctgctgatgaagcttcatcctactacaaggttcctttctcaaaaaccgtctacattgaaaaaactgattttcgcgtgaaggactcgaaagattactatggactggctcctggtaaatctgccctgctgaggtatgcattcccgataaaatgcacagaggttatttatggtgataatccagatgatattgttgaaattcgagccgagtatgacccctcaaagacctctaaacctaagggtgttctgcactgggttgccgagccagcacctggagttgagccgttaaaggttgaaataagattatttgagaaattattcctatcggagaatcccgccgaattggaagactggctgggtgatcttaacccgcactcaaaggaggtagtaaagaacgcctatgctgtaccgtcactcgccaccgcggttctgggcgacaagttccagtttgagcggcttggctactttgctgtggacacggactcgacgcccgagaagcttgtgttcaacaggactgtaaccctgcgtgactcttatgggaaggctggacccaagtgactgcaaatctagtgaaaaagctttgttttttcttgggtcaagagacgctaatgtggggaaacatagtaatgacatccaacatgctaatggctaagaggccttttttgttttgtttttcatactgggcttgtgatgactattatgttttgtttcaaactttcaatcgatcaaaatttggatgatcatatgctaaaaaaaaaaaaaaaaaaaaaaaaaaaaaaaaaaaaaaaaaaactagaaaagacacgaccaaaggcaactaacgagggtagtacgggagg

SEQ ID NO: 1611 - DNA, 2684 bp, Secale cereale
tgcggcgcgcgaccccggagccggagcgggaggcgccggcggcggagatggtcgacggagagaagtcccaggccccggccctgctgcggctggagacgctgctggcgctcggcctcgaccagcgcacggctgagaacgcgctggtcaacagcaaggtcaccgccaacctagcagccgtcgtagccgaggctggtataactggatgcgacaagtccgttgggaatctcctgtatgcagttgccacgaaatacccaaataatgcactcgtccatcgtcctgctctcattagctatatcgtttcgaccaagattaagaaccctgcacagctagatgctgctctgtcgtttcttactaatactggtcctgaaactttggatgttgggaagtttgaagaagcctgcggtgtaggtgtggttgtttctattgaagagattcagtcaactgtcgctgaggttctaaaagaaaacatggaagctatattggagcagcggtatcacataaatgttggtggcctatgcggacaggtcaggaagcgtcacccctggggcgatgctaaggcaacaaaggaggagattgagaagaagcttgctgagatactaggtccgaagacagaagctgacaatgtaaaaccagtgaaaaagaagaaggaaaaaccagcaaaagttgaggagaaaaaggttgcagtagccactgttgccccaccatctgaggaggaactgaatccttatacaatatttccccagccagcggaaaacaataaggttcatactgaaatattcttcagcgatggcaacatatggagggcgcataacacgaaggagatattagagaaacatcttaaggcaactggtggaaaagtgatgacccgtttcccgccagaacctaatggatatcttcatatcggtcatgctaaggctatgtttattgattttggattggctaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagctttatatgagcatgcagttgagttaatacggaaagggctagcctatgtggatcaccagactgcagaacaaatcaaggaatacagggaaaagaagatggatagtccatggagggataggcccattgaagagtctctgcagttatttgaagacatgcgacgtgggttgattgctgagggtgcagcaactctccgaatgaagcaggacatgcagaatgataacaagaacatgtctgatttaatagcatatagaataaaattcactcctcatccgcatgctggcgacaaatggtgtatctatccaagctatgactatgctcattgcatggtggattcacttgaaaacattacacattctttgtgcactcttgagttcgacatacgccgcccgtcatactactggctacttgttgcattaggcttgtaccagccacatgtttgggagtattcgaggctaaacatatcacatactatgatgtccaaaagaaagttgaatcggcttgtgacagagaagtgggtagatgggtgggatgatcctcgtttgttgactttggcaggactgaggcgacggggagtatcagcaactgcgatcaattcatttatccgtggaattgggataacgagaagtgacaatagcttaattcgtgttgaccgtcttgaatatcatatcagagaagaactgaataaaacagcttctcgaaccatggttgttttgcatcctctaaaggttgtaataactaacttggaagatggaaaagtcatagaccttgatggaaaaaagtggcctgatgctcctgctgatgaagcttcgtcctactacaaggttcctttctcaaaaaccgtctacattgaaaaaactgattttcgcgtgaaggactccaaagattactatggactggctcctggtaaatctgccctgctgaggtatgcattcccgataaaatgcacagaggttatttatggtgataatccagatgatattgttgaaattcgagccgagtatgacccttcaaagacctctaaacctaagggcgttctgcactgggttgccgagccagcacctggagttgagccgttaaaggttgaaataagattatttgagaaattattcttatcggagaatcctgccgaattggaagattggctgggtgatcttaacccgcactcaaaggaggtagtgaaggacgcctatgctgtaccgtcactggccaccgcagttctgggtgacaagttccagtttgagcggcttggctactttgctgtggacacggactcaacgcccgagaggcttgtgttcaacaggactgtaaccctgcgcgactcttatgggaaggctggacccaagtgactgcaaatgtagtgaaaatgatccggtttttcttggtcagagagacgctaatgtgagaaaacatagtaccttcatgccaaaggcaaaggggccttttttgtttttgtttttgttttgcatactgggcttgtgatgagtattatactagtatgttttgtttcagtcaatcaaaatttggatgatcgtatgcttcaaatagctaactaacaaaaaaaaaaaaaagaaaagtcgtagggacgacgaaggcaa

SEQ ID NO: 1612 - DNA, 2776 bp, Secale cereale
ctcgctcgcagtccttccctgtccggagacgcctgaaccccagctgcggcgcgcgaccccggagccggagcgggaggcgccggcggcggagatggtcgacggagagaagtcccaggccccggccctgctgcggctggagacgctgctggcgctcggcctcgaccagcgcacggctgagaacgcgctggtcaacagcaaggtcaccgccaacctagcagccgtcgtagccgaggctggtataactggatgcgacaagtccgttgggaatctcctgtatgcagttgccacgaaatacccaaataatgcactcgtccatcgtcctgctctcattagctatatcgtttcgaccaagattaagaaccctgcacagctagatgctgctctgtcgtttcttactaatactggtcctgaatctttggatgttgggaagtttgaagaagcctgcggtgtaggtgtggttgtttctattgaagagattcagtcaactgtcgctgaggttctaaaagaaaacatggaagctatattggagcagcggtatcacataaatgttggtggcctatgcggacaggtcaggaagcgtcacccctggggcgatgctaaggcaacaaaggaggagattgagaagaagctttctgagatactaggtccgaagacggaagctgacaatgtaaaaccagtgaaaaagaagaaggaaaaaccagcaaaagttgaggagaaaaaggttgcagtagccactgctgccccaccatctgaggaggaactgaatccttatacaatatttccccagccagcggaaaacaataaggttcatacagaaatattcttcagcgatggcaacatatggagggcgcataacacgaaggagatattagagaaacatcttaaggcaactggtggaaaagtgatgacccgtttcccgccagaacctaatggatatcttcatatcggtcatgctaaggctatgtttattgattttggattggccaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagctttatatgagcatgcagttgagttaatacggaaagggctagcctatgtggatcaccagactgcagaacaaatcaaggattacagggaaaagaagatggatagtccatggagggataggcccattgaagagtctctgcagttatttgaagacatgcgacgtgggttgattgctgagggtgcagcaactctccgaatgaagcaggacatgcagaatgataacaagaacatgtctgatttaatagcatatagaataaaattcactcctcatccgcatgctggcgacaaatggtgtatctatccaagctatgactatgctcattgcatggtggattcacttgaaaacataacacattctttgtgcactcttgagttcgacatacgccgcccgtcatactactggctacttgttgccttaggcttgtaccaaccacatgtttgggagtattcgaggctaaacatatcacatactatgatgtccaaaagaaagttgaatcggcttgtgacagagaagtgggtagatgggtgggatgatcctcgtttgttgactttggcaggactgaggcgacggggagtatcagcaactgcgatcaattcatttatccgtggaattgggataacgagaagtgacaatagcttaattcgtgttgaccgtcttgaatatcatatcagagaagaactgaataaaacagcttctcgaaccatggttgttttgcatcctctaaaggttgtaataactaacttggaagatggaaaagtcatagaccttgatggaaaaaagtggcctgatgctcctgctgatgaagcttcgtcctactacaaggttcctttctcaaaaaccgtctacattgaaaaaactgattttcgcgtgaaggactccaaagattactatggactggctcctggtaaatctgccctgctgaggtatgcattcccgataaaatgcacagaggttatttatggtgataatccagatgatattgttgaaattcgagccgagtatgacccttcaaagacctctaaacctaagggcgttctgcactgggttgccgagccagcacctggagttgagccgttaaaggttgaaataagattatttgagaaattattcttatcggagaatcctgccgaattggaagattggctgggtgatcttaacccgcagtcaaaggaggtagtgaaggacgcctatgctgtaccgtcactggccaccgcggttctgggtgacaagttccagtttgagcggcttggctactttgctgtggacacagactcaacacccgagaggcttgtgttcaacaggactgtaaccttgcgcgactcttatgggaaggctggacccaagtgactgcaaatgtagtgaaaacggtttttcttggtcagagagacgttaatgtgagaaaacatagtaccatcatgccaaaggcaaaggggccttttttgtttttgttttgcatactgggcttgtgatgagtattatactagtatgttttgtttcagtcaatcaaaatttggatgatcgtatgctcaaatagttactcagatgacctgcctgtactggtgcggtaataccttcagccggagctttccgtttcttcatgaccccctccccccttctatataattctaaaaaaacacttatcgc

SEQ ID NO: 1613 - DNA, 2802 bp, Setaria italica
ccacctccctcctgaatcccaatccctccagcgcgaggcacgagctcctctccgccgctccgctgcctttcctctcgccggaatcctaaaccctagcgcccccccgcgcgcgtcgagagtcgagaccactcgcccggacccgggaggagatgggcaccgggggagacggggagaaggcggccccggcgctgccgctggaggcgctgctggcgctcgggctcgaccagcgcaccgcggagaacgcgctcgtcaacagcaaggtcaccgccaacctcgccgccgtcatagccgaggctggcataaaggaatgtgacaagtcagttggcaatcttctctatgcagtcgccactaagtacccaactaatgcacttgttcatcgtcctgtccttattaaatatgtcttgtcaataaagataaagaaccctgcacagctagatgctgctttgtcatttcttaccaatacaggtcctgattctctggatgtcgagaagtttgaggaagcatgtggtgtaggtgtggttgtttctattgaggagattaaatcaactgttactgatgttcttgaggagaatatggaagctataaaggagcagcggtatcacataaatgttggtaccctatgcggacaggttaggaagagacacccatggggtgatgctaaggcgataaaggaggaaattgacaagaggcttgcagaaatactaggtccgaagacagaagctgacaatataaaaccagtgaaaaagaagaaggaaaaaccggcaaaagttgaggagaaaaaagttgcagttgccacttctgccccaccatctgaggaggaattaaacccgtatactatatttcctcagccagaggaaaactttaaggttcacacagaaatattcttcagcaatgggaacatatggagagcgcataacacaaaggaaattttagaaaaacatctgaaggcaactggaggaaaagtgatgacccgttttccaccagaacccaatggatatcttcatattggtcatgccaaggctatgtttattgattttgggctggctaaggagcgaaatggtcattgctaccttaggtttgatgacacaaatccagaagctgaaaagaaagaatacatagatcacatccaggaaatcgtccattggatgggatgggagccctacaaagtaacatacacaagtgactatttccaagctttgtacgagcatgcagttgagttaatacggagagggctagcctatgtagatcaccagaccgcagaagaaatcaaggagtacagggaaaagaagatgaatagtccatggagggataggccaattgaagagtcgctgaaattatttgaagacatgaggcgtgggttgattgctgagggcgcggcaactctccgaatgaagcaggacatgcagaatgacaacaaaaacatgtctgacttaatagcatatagaataaaattcacccctcatccacatgctggcgacaagtggtgtatctatccaagctatgactatgctcattgcatggttgattctcttgaaaacatcacacattcgttgtgcacacttgaatttgatatacgtcgcccttcatactactggctgcttgttgccttggacctctatcagccatatgtgtgggaatattcgaggctaaacatatcaaatactgtgatgtctaaaagaaagttgaatcgacttgtgacagagaagtgggtagatgggtgggatgatccccgcttgttgacattggcaggactccggcgacggggagtatcatcaaccgcgattaattcgtttatccgtggaattgggataactagaagtgacaatagcttaattcgtgttgaccgtctggaatatcacatcagggaagagcttaataaaacagctcctcgatcgatggttgttttgcgccctctaaaggttgtaataactaacttggaagaaggaaaagtaatggatcttgatgggaaaatgtggcctgatgcttctgatactgatgcttcctcccactacaaggttcctttctcaagaactgtctacattgagagtactgattttcgcctaaaggactcaaaagattactatgggctagcccctggtaaatctgtcatgctaaggtatgcattccccataaaatgcacagatgttatctacggtaatagccctgatgatatcgttgaaattcgagctgaatatgatcctttgaagacttctaaacttaagggtgttctgcactgggttgccgagccagcacctggtattgaaccattaaaggtggaagttagattgttcgagaaattgttcatgtcagagaatcctgctgaattggaggactggctgggggatcttaacccgcactcaaaagaggtgataaaggacgcctatgctgtaccgtcacttgccactgcggttctgggtgacaagttccagtttgagcgcctcggctactttgcggtagataccgactccacgcctgagaagctggtgttcaacagaacagttaccctccgcgattcatttggtaaagctggacccaagtgaccgcgtcggttttgtttgggtgcagaggcgcacctgaactatacagtttgtgaagaaaatgatagtttaatccatgacaacagtttaaaggccttccaccctgtaaaatgtgcatgtgactgctgtttgcttgctttgattgaatctgattttgtatgatctttttagtggtagggtacccaatttgtgtcaaaagctacatatgcatgatttgggatgtccgcaatcaaaagctgcatatactatcattatttggagctta

SEQ ID NO: 1614 - DNA, 2655 bp, Avena sativa
ccaagctcaatcgacacagcaagcctcgcaccactctcctccccattctcctgtcgccggggaaacgcctaaaaccctaggtgtgtgccgcacgtgcgtctcagaggccggagcgggaggcgtcggcggagatggtcaccggagtcgacggggagaaggccccggccctgcagctggagacgctgctggcgctcggcctcgaccagcgcacggcggagaacgccctcgtcaacagcaaggtcaccgccaacctagccgccgtcatagcagaggctggtataagtggatgtgacaagtcagttggaaatcttctctatgcagttgccactaaatacccaaacaatgcacttgtccatcgtcctgctctcatcaactatattgtgtcaacaaagataaagagtcctgcacagctagatgctgccctgtcatttcttgcaaatgttggccctgaatctttggatattgggaagtttgaagaagcctgtggtgtaggtgtggttgtttcgattgaagagattcactcaactgttgctgaggttctaaagggaaatatggaagctatactggagcagcggtatcacataaatgttggtagcctatgcggacaggttaggaagaagcacccctggggcgatgcgaaggcgacaaaggacgagattgagaagaggcttgcagagatgctaggtccaaagacggaagctgataatgtaaaaccagtgaaaaagaagaaggaaaagccagcgaaagttgaggagaaaaaagttgcagtagccactgctgccccaccatctgaggaggaactgaatccatacactatatttcctcagccagcagaaaacaataaggttcatacggaaatattcttcagcgatgggaacatttggagggcacataacacaaaggagatattagagaaacatcttatggcaactggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagtgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaatatggctgacttaattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactactggctacttgttgccttgggattgtaccagcctcatgtctgggagtattcaaggctgaacatatcaaatacagtgatgtctaaaagaaagttgaaccggcttgtaacagagaagtgggtagatggatgggatgatcctcgtctgttaacactggcaggactgcgacgacggggagtgtcagcaaccgcaattaattcatttatccgtggaattgggataacaagaagtgacaatagcttgattcgtgttgaccgtcttgaatatcatatcagagaagaactcaataaaacagcttctcgaaccatggttgttctgcatcctctaaaggttgttataactaacttggaagatggaaaagtcatagaccttgatggaaagaagtggcctgatgctcctgctgatgatgcttcatcctactacaaggttcctttctcaagaactgtctacattgagaaaactgactttcgccttaaggactcgaaagattactatgggctagctcctggtaaatctgccctgctaaggtatgcattcccgataaagtgcacagaggttgtttatggtgataatccagatgaaattgtcgaaattcgagctgagtatgacccctcaaagacttctaaacctaagggtgttctgcactgggtcgccgagccagcacctggagttgagccattaaaggttgaaataagattatttgagaaattattcctatcggagaatcctgccgaattggaagattggctgggcgaccttaaccccaactcgaaagagattgtgaagggtgcctatgctgtaccatcacttgccaccgcagttctaggtgacaagttccagttcgagcggcttgggtactttgctgtggacaccgactcgacgcccgagaagctcgtgttcaacaggactgttaccctgcgcgactcttatgggaaggctggacccaagtgacatttaatttagtgaaaaagcttgattttgcttggttacagtggcgctaataggagaaaacgttgtaatgccatacaacataccaatagccaggtggcctttttgatttgcatactgggcttgtgatgattattac

SEQ ID NO: 1615 - DNA, 2626 bp, Avena sativa
ctcctccccattctccgacgccggaaacgcctaaaaccctaggggtgtgtgtgtgccgcacgtgcgtctcgaggccggagcgggagaggcgtcggcgcggagatggtcaccggagtcgacggggagaaggccccggccctgcagctggagacgctgctggcgctcggcctcgaccagcgcacggcggagaacgccctcgtcaacagcaaggtcaccgccaacctagccgccgtcatagcagaggctggtataagtggatgtgacaagtcagttggaaatcttctctatgcagttgccactaaatacccaaacaatgcacttgtccatcgtcctgctctcatcaactatattgtgtcaacaaagataaagagtcctgcacagctagatgctgccctgtcatttcttgcaaatgttggccctgaatatttggatattgggaagtttgaagaagcctgtggtgtaggtgtggttgtttcgattgaagagattcactcaactgttgctgaggttctaaagggaaatatggaagctatactggagcagcggtatcacataaatgttggtagcctatgcggacaggttaggaagaagcacccctggggcgatgcgaaggcgacaaaggacgagattgagaagaggcttgcagagattctaggtccaaagacggaagctgataatgtaaaaccagtgaaaaagaagaaggaaaagccagcgaaagttgaggagaaaaaagttgcagtagccactgctgccccaccatctgaggaggaactgaatccatacactatatttcctcagccagcagaaaacaataaggttcatacagaaatattcttcagcgatgggaacatctggagggcacataacacaaaggagatactagagaaacatcttatggcaactggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagtgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaacatgtctgacttgattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactactggctacttgttgccttgggattgtaccagcctcatgtctgggagtattcaaggctgaacatatcaaatacagtgatgtctaaaagaaagttgaaccggcttgtaacagagaagtgggtagatggatgggatgatcctcgtctgttaacactggcaggactgcgacgacggggagtgtcagcaaccgcaattaattcatttatccgtggaattgggataacaagaagtgacaatagcttgattcgtgttgaccgtcttgaatatcatatcagagaagaactcaataaaacagcttctcgaaccatggttgttctgcatcctctaaaggttgttataactaacttggaagatggaaaagtcatagaccttgatggaaagaagtggcctgatgctcctgctgatgatgcttcatcctactacaaggttcctttctcaagaactgtctacattgagaaaactgactttcgccttaaggactcgaaagattactatgggctagctcctggtaaatctgccctgctaaggtatgcattcccgataaagtgcacagaggttgtttatggtgataatccagatgaaattgtcgaaattcgagctgagtatgacccctcaaagacttctaaacctaagggtgttctgcactgggtcgccgagccagcacctggagttgagccattaaaggttgaaataagattatttgagaaattattcctatcggagaatccggccgaattggaagattggctgggcgaccttaaccccaactcgaaagagattgtgaagggtgcctatgctgtaccatcacttgccaccgcagttctaggtgacaagttccagtttgagcggcttgggtactttgctgtggacaccgactcgacgcccgagaagctcgtgttcaacaggactgttaccctgcgcgactcttatgggaaggctggacccaagtgacatttaatttagtaaaatagcttgattttgcttggttacagtggcgctaataggagaaaacgttgtaatgccatacaacataccaatagccaggtggcctttttgatttgcatactgggcttgtgatgattattac

SEQ ID NO: 1616 - DNA, 2651 bp, Avena sativa
ttcagagctcaatccgacacagcaaagcctcgcacgcacgcaccactctcctccccattctcctgtcgccggaaacgcctaaaaccctaggtgtgtgtgtgccgcacgtgcgcctcgaggccggagcgggaggcgtcggcggagatggtcgacggggagaaggccccggccctgcagctggagacgctgctggcgctcggcctcgaccagtgcacggcggagaacgccctcgtcaacagcaaggtcaccgccaacctagccgccgtcataggagaggctggtataagtggatgtgacaagtcggttggaaatcttctctatgcagttgccactaaatacccaaacaatgcacttgtccatcggcctgctctcatcaactatattgtgtcaacgaagataaagagtcctgcacagctagatgctgccctgtcatttcttgcaaatgttggccctgaatctttggatattgggaagtttgaagaagcctgtggtgtaggtgtggttgtttcgattgaagagattcactcaactgttgctgaggttctaaagggaaatatggaagctatactggagcagcggtatcacataaatgttggtagcctatgcggacaggttaggaagaagcacccctggggcgatgctaaggcgacaaaggacgagattgagaagaggcttgcagagattctaggtccaaagacggaagctgataatgtaaaaccagtgaaaaagaagaaggaaaagccagcaaaagttgaggagaaaaaagtagcagtagccactgctgccccaccatctgaggaggaactgaatccatacactatatttcctcagccagcagaaaacaataaggttcatacagaaatattcttcagcgatgggaatatttggagggcgcataacacaaaggagatattagagaaacatcttatggcaactggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagtgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaacatggctgacttaattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactattggctacttgttgccttgggattgtaccagcctcatgtctgggagtattcaaggctgaacatatcaaatacagtgatgtctaaaagaaagttgaaccggcttgtgacagagaaatgggtagatggatggaatgatcctcgtctgttaacactggcaggactgcgacgacggggagtgtcagcaaccgcaattaattcatttatccgtggaattgggataacaagaagtgacaatagcttgattcgtgttgaccgtcttgaatatcatatcagagaagaactcaataaaacagcttctcgaaccatggttgttctgcatcctttaaaggttgttataactaacttggaagatggaaaagtcatagaccttgatggaaagaagtggcctgatgctcctgctgatgatgcttcatcctactacaaggttcctttctcaagaactgtctacattgagaaaactgattttcgccttaaggactcgaaagattactatgggctagctcctggtaaatctgccctgctaaggtatgcattcccgataaagtgcacagaggttgtttatggtgataatccagatgaaattgtcgaaattcgagctgagtatgacccctcaaagacttctaaacctaagggtgttctgcactgggtcgccgagccagcacctggagttgagccattaaaggttgaaataagattatttgagaaattattcctatcagagaatcctgccgaattggaagattggctgggtgaccttaaccccaactcgaaagagattgtaaagggcgcatatgctgtaccatcacttgccaccgcagttctaggtgacaagttccagttcgagcggcttgggtactttgctgtggacaccgactcgacgcccgagaagctcgtgttcaacaggactgttaccctgcgcgactcttatgggaaggctggacccaagtgacatttaatttagtgaaaaagcttgattttgcttggttacagtggcgctaataggagaaaacatagtaatgccatacaacatacaaatagccaggtggcctttttgatttgcatactgggttgtgatga

SEQ ID NO: 1617 - DNA, 2714 bp, Avena sativa
taggcagtcacgttcgaagctcaacccgacacagcaagcctcgcacgcaccactctcctccccattctcctgtcgccggaaacgcctaaaaccctaggcgtgtgtgccgcacgtgcgtctcgcggccggagcgggaggcgtcggcgcggagatggtcaccggagtcgacggggagaaggccccggccctgcagctggagacgctgctggcgctcggcctcgaccagcgcacggcggagaacgccctcgtcaacagcaaggtcaccgccaacctagccgccgtcatagcagaggctggtataagtggatgtgacaagtcagttggaaatcttctctatgcagttgccactaaatacccaaacaatgcacttgtccatcggcctgctctcatcaactatattgtgtcaacgaagataaagagtcctgcacagctagatgctgccctgtcatttcttgcaaatgttggccctgaatatttggatattgggaagtttgaagaagcctgtggtgtaggtgtggttgtttcgattgaagagattcactcaactgttgctgaggttctaaagggaaatatggaagctatactggagcagcggtatcacataaatgttggtagcctatgcggacaggttaggaagaaacacccctggggcgatgctaaggcaacaaaggacgagattgagaagaggcttgcagagattctaggtccaaagacggaagctgataatgtaaaaccagtgaaaaagaagaaggaaaagccagcgaaagttgaggagaaaaaagttgcagtagccactgctgccccaccaactgaggaggaactgaatccatacactatatttcctcagccagcagaaaacaataaggttcatacggaaatattcttcagcgatgggaacatttggagggcgcataacacaaaagagatattagagaaacatcttgtggcaactggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagtgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaacatgtctgacttgattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactactggctacttgttgccttgggattgtaccagcctcatgtctgggagtattcaaggctgaacatatcaaatacagtgatgtctaaaagaaagttgaaccggcttgtaacagagaagtgggtagatggatgggatgatcctcgtctgttaacactggcaggactgcgacgacggggagtgtcagcaaccgcaattaattcatttatccgtggaattgggataacaagaagtgacaatagcttgattcgtgttgaccgtcttgaatatcatatcagagaagaactcaataaaacagcttctcgaaccatggttgttctgcatcctctaaaggttgttataactaacttggaagatggaaaagtcatagaccttgatggaaagaagtggcctgatgctcctgctgatgatgcttcatcctactacaaggttcctttctcaagaactgtctacattgagaaaactgactttcgccttaaggactcgaaagattactatgggctagctcctggtaaatctgccctgctaaggtatgcattcccaataaagtgcacagaggttgtttatggtgataatccagatgaaattgtcgaaattcgagctgagtatgacccctcaaagacttctaaacctaagggtgttctgcactgggtcgccgagccagcacctggagttgagccattaaaggttgaaataagattatttgagaaattattcctatcggagaatccggccgaattggaagattggctgggtgaccttaaccccaactcgaaagagattgtaaagggcgcatatgctgtaccatcacttgcgaccgcagttctaggtgacaagttccagttcgagcggcttgggtacttcgctgtggacaccgactcgacgcccgagaagctcgtgttcaacaggactgttaccctgcgcgactcctatgggaaggctggacccaagtgacatttaatttagtaaaaaagctttattctgcttggttacagtggcgctaatgggagaaaacatagtaatgccatacaacataccaatagcaaggtggcctttttgatttgcatactgggcttgtgatgactattaccatgtgtttggttctatcaaattttgaatgattagatgc

SEQ ID NO: 1618 - DNA, 3273 bp, Panicum virgatum
ctacgtggtgcactggtggattctggaatccgatcccgtggattccgtggcagccaagtccatgatccggtccgggcggtcttgcttccaaggtcaaccgctcccgcgtagcagtacttatcttggaactcaagtttctccaaactgaaaaggtgatcatggcgcccgcattatattcgaacggcccagatcacacggcggctccacgaaacaccaccagccgacgatcccagccgtcgcctcgcgttaacggaaagcggaagccagcacaacccgtcacacaccgggtgacgcgcatgcccacgcgccccgtgctggtgggcccggcctgcacaagtgggcctcggtatatagccgctagtgggtgtgtgacttgggtttagtccaaacccacgcccctcccctctcctctgaatcccaatcgccccaaaacgaggcacgagctcctctcgccggaatcctaaaccctagctcgctcgggcgcgcgtcgagaccgctcgccggagccgggagcgggagggagggaggaggagatgggcaccgggggagatggggagaagtcggcgcccgcgctgccgctggaggcgctgctggcgctcgggctcgaccagcgcaccgcggagaatgcgctcgtcaacagcaaggtcaccgccaacctcgccgccgtcatagccgaggctggtataaaggaatgtgacaaatcagttggcaatcttctctatgcagttgccactaagtacccaactaatgcacttgttcatcgtcctgtccttattaaatatgtcttgtcaacaaagataaagaaccctgcacaactagatggtgctctatcatttctttctaatactggtcctgattctctggatgtcaagaagtttgaagaagcatgtggtgtaggtgtggttgtttctattgaggagattaagtcaactgttactgatgtacttgaggagaatatggaagctataaaggagcagcggtatcacataaatgttggtaccctatgtggacaggttaggaagagacacccgtggggtgatgctaaggcaataaaggaggaaattgacaagaggcttgcagaaatactaggcccgaagacagaagctgacaatataaaaccagtgaaaaagaagaaggaaaaaccggcaaaagttgaggagaaaaaagatgcagttgccacttctgctccaccatctgaggaggaattgaacccatatactatatttccccagccagaagagaactttaaggttcatacagaaatatttttcagcagtggaaatatatggagagcacataacacaaaagaaattttagaaaaacatctgaaggcaactggaggaaaagtgatgacccgtttcccaccagaacctaatggatatctacatattggtcatgccaaggccatgtttattgattttgggctggcgaaggagcgaaatggtcactgctaccttaggtttgatgacacaaatccagaagctgaaaagaaagagtatatagatcacattcaggaaattgtccattggatgggatgggagccctacaaagtaacatacacgagtgactatttccaagctttgtatgagcatgctattgagttaatacggaaagggctagcctatgtggaccaccagactgctgaagaaatcaaggagtatagggataagaagatgaatagtccatggagggataggccaattgaagagtcactgaaattgtttgaagacatgaggcgtgggttgattgctgagggcgcagcaactctccgaatgaagcaggacatgcagaatgagaacaaaaatatgtctgacttaatagcatatagaataaaattcacccctcatccacatgctggcgacaagtggtgtatctatccaagttatgactacgctcattgcatggtggattctcttgaaaacatcacacattcgttgtgcacgcttgagtttgacatacgtcgcccttcatactactggctacttgttgccttgggcctctatcagccatatgtgtgggaatattcaaggctaaacatatcaaatactgtgatgtctaaaagaaagttgaatcgacttgtgacagagaaatgggtagatgggtgggatgatccccgtttgttgacattggccggactccggcgacggggagtatcatcaactgcgattaattcgtttatccgtggaattgggataacaagaagtgacaatagcttaattcgagttgaccgcctggaatatcacatcagggaagagcttaacaaaacagctccccgaacgatggttgttttgcgccctctaaaggttgtaataaccaacttggaagaaggaaaagtactggatctagatgggaaaatgtggcctgatgcttctgatactgatgcttcctcccactataaggttcctttctcaagaactgtctacattgagaaaactgattttcgcctaaaggactcgaaagattactatggtctagcccctggtaaatctgtcatgctaaggtatgcattccccataaaatgcacagatgttatctatggtgatagtcctgatgatattgtcgaaattcgagctgaatatgaccctttgaagacttctaaacttaagggtgttctgcactgggttgctgagccgacacctggcgtcgaaccgttaaaggtggaagttagattgttcgagaagctgttcatgtcagagaatcccgctgaattggaggattggctgggggatcttaacccgaactcaaaagaggtgataaaggacgcttatgctgtaccgtcacttgccactgcagttctgggtgacaagttccagtttgagcgccttggctactttgctgtggataccgactccacgccggagaagcttgtgttcaacagaacagttaccctccgtgattcgtttgggaaggctggacccaagtgacttctatctaattttgagagcgtcggttttgattgggtgcagactgcagaggcgcacctgaatcacctgatccatacaatttgtgaagcaaaatgatagtgtaatccatgatcacagttttttgcctctctccttgtgaaatgtgcatgtgaatgcagcttgtttgcttcgattgaaatctgattttgtatgatcgtattagtgctggtgtacccaatttgtgcaaaaagctacaaatacatatgatttgggatgtcagcaatcaaaagctacatatatcataatctgggacatcaaggttagttttttaattgttaattgaaaattaatttggattgtttctttttct

SEQ ID NO: 1619 - DNA, 2598 bp, Triticum aestivum
tggagacgctgctggcgctcggcctcgaccagcgcacggccgagaacgcgctggtcaatagcaaggtcaccgccaacctagccgccgtcgtagccgaggctggtataactggatgcgacaagtccgttgggaatcttctgtatgcagttgccacgaaatacccaaataatgcacttgtccatcgtcccgctctcattaactacatcgtttcgacgaagatcaagaaccctgcacagctagatgctgctctgtcgtttcttaccaacactggtcctgaatctttggatattgggaagtttgaagaagcctgtggtgtaggtgtggttgtttctattgaagagattcagtcaactgttgctgaggttctaaaggaaaacatggaagctatattggagcagcggtatcacataaatgttggtggcctatgcggacaggtcaggaagcggcacccctggggcgatgctaaggcaacaaaggaggagattgagaagaagcttgctgagatactaggtccaaagacggaagctgacaatgtaaaaccagtgaaaaagaagaaggaaaaaccagcaaaagttgaggagaaaaaggttgcagtagccactgctgcaccaccatctgaggaggaactgaatccttatacaatatttccccagccagtggaaaacaataaggttcatacagaaatattcttcagcgacgggaacatatggagggcacataacacgaaggagatattagagaaacatcttaaggcaactggtggaaaagtgatgacccgtttcccgccagaacctaatggatatcttcatatcggtcatgctaaggctatgtttattgattttggattggctaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagatttatatgagcatgcagttgagttaatacggaaagggctagcctatgtggatcaccagactgcagaacaaatcaaggaatacagggaaaagaagatggatagtccatggagggataggcccattgaagagtctttgcagttatttgaagacatgcgacgcgggttgattgctgaaggtgcagcaactctccgaatgaagcaggacatgcagaatgataacaagaacatgtctgatttaatagcatatagaataaaattcactcctcatccgcatgctggcgacaaatggtgtatctatccaagctatgactatgctcattgcatggtggattcacttgaaaacattacacattctttgtgcacgctcgagttcgacattcgtcgcccgtcatactactggctacttgttgccttgggcttgtaccagccatatgtttgggagtattcaaggctaaacatatcacatactatgatgtccaaaagaaagttgaatcggcttgtgacagagaagtgggtagatgggtgggatgatcctcgtttgttgactttggcaggactgaggcgacgaggagtatcagcaactgcgatcaattcatttatccgtggaattgggataacgagaagtgataatagcttaattcgtgttgaccgtcttgaatatcatatcagagaagaactgaataaaacagcttctcgaaccatggtggttttgcatcctttaaaggttgtaataactaacttggaagatggaaaagtcatagaccttgatggaaaaaagtggcctgatgctcctgctgatgaagcttcgtcctactacaaggttcctttctcaaaaaccgtctacattgaaaaaactgattttcgcgtgaaggactcgaaagattactatggactggctcctggtaaatctgccctgctgaggtatgcattcccgataaaatgcacagaggttatttatggtgataatccagatgatattgttgaaattcgagccgagtatgacccctcaaagacctctaaacctaagggtgttctgcactgggttgcccagccagcacctggagttgagccgttaaaggttgaaataagattgtttgagaaattattcctatcggagaatcctgccgaattggaagattggctgggcgatctgaacccgcactcgaaagaggttgtaaaggatgcatatgctgtaccgtcactcgcgactgcagttctgggcgacaagttccagtttgagcggctcggctactttgctgtggacacggactcgacgcccgagaagcttgtgttcaacaggactgtgaccctgcgcgactcttatgggaaggctggacccaagtgactgcaaatttagtgaagaagctccgttttttcttggtcagagagacgctaatgggagaaaacatagtcatgacatacaacatgaaaatggccaagaggccctttttgtttttgttttgcatactgggcttgtgatgagtattatagcatgttttgtttcaatcgatcaaaacttggatgatcatatgctcaaatagttactcagatgacctgcctggtgcggtaatgccttcagccggagctttccgtttctt

SEQ ID NO: 1620 - DNA, 2694 bp, Festuca arundinacea
agtggtatcaacgcagagtacggggggggcacggagggacggaggaggctaggttagccgaaagatggttataggtcctgcagctggagacgctgctggcgctcggcctcgaccagcgcacggcggagaatgcgctcgtcaacagcaaggtcaccgccaacctagccgccgtcatagcagaggctggtataagtggatgtgacaagtcagttggaaatcttctctacgcagttgccactaaatacccaaacaatgcacttgtccatcgtcctgctctcattaactacatcgtgtcaacaaagataaagagccctgcacagctagatgctgccctgtcatttcttactaatgttggccctgagtctttggatattgggaaatttgaagaagcctgtggtgtaggtgtggttgtttcgattgaagagattcactcaactgttgctgatgttctaaagggaaatatggaagctatattggagcaacggtatcacataaatgttggtagcctatgcgggcaggttaggaagaagcacccctggggcgatgctaaggcgacaaaggaggagattgagaagaggcttgcagagatactaggtccgaagacagaagctgacaatgtaaaaccagtgaaaaagaagaaggaaaagccagcaaaagttgaggagaaagaagttgcagtagccactgctgccccgccatctgaggaggaactgaatccgtacactatatttcctcagccagcagaaaacaataaggttcatacagaaatattcttcagcgatgggaacatttggagggcgcataacacaaaggagatcttagagaaacatcttattgaaactggtggaaaagtgatgacccgtttcccaccagaacctaatggatatcttcatattggtcatgccaaggctatgtttattgattttggactggctaaagagcgcaatggtcattgttaccttaggtttgatgatacaaatccagaagctgaaaagaaggaatacattgaccacatccaggagatagtccagtggatgggatgggagccctacaaagttacatatacaagtgattattttcaagcgttatacgagcatgcagttgaattaatacggaaaggactagcctatgtggatcaccagactggagaacaaatcaaggaatacagggaaaagaagatggatagtccatggagggataggcccattgaagagtcactgcgattatttgaagacatgcgatgtgggttgattgctgagggcgcagcaactctccgaatgaagcaggacatgcagaatgataacaaaaacatgtctgacttaattgcatatagaataaaattcactcctcatccacatgctggcgacaaatggtgtatctatccaagctatgattatgcccattgcatggtggactcatttgaaaacattacacactcattgtgcacgcttgagtttgacatacgccgcccgtcatactattggctacttgttgccttgggcttgtaccagcctcatgtctgggagtattcaaggctgaacatatcaaatacagtgatgtctaaaagaaagttgaaccggcttgtgacagagaagtgggtagatgggtgggatgatcctcgtctgttaacactagcaggactgcggcgacggggtgtgtcagcaactgcaattaattcattcatccgtggaattgggataacaagaagtgacaatagcttgattcgtgttgaccgtcttgaatatcatatcagagaagaacttaataaaacagcatctcgaaccatggttgttctgcatcctctaaaggttgtaataactaacttggaagaaggaaaagttatagaccttgatggaaaaaagtggcctgatgctcctgctgatgatgcttcatcctactacaaggttcctttttcaagagttgtctacattgaaaaaactgattttcgccttaaggactcgaaagattactatgggctagctcctggtaaatctgccctgctaaggtatgcattcccgataaaatgcacagaggttatttatggtgataatccagatgaaattgttgaaatccgagctgagtatgacccctcaaagacttctaaacctaagggcgttctgcactgggttgctgagccagcacctggagttgagccgttgaaggttgaaataagattatttgagaaactattcctatcagagaatcctgctgaattggaagattggcttggtgacctcaaccctaactcgaaagagattgtaaagggcgcctatgctgtaccgtcacttgcgaccgcagttttgggtgacaagttccagttcgagcggcttggctacttcgctgtggacacggattcgacgcccgagaagcttgtgttcaacaggacagttactctgcgtgactcttatggaaaggctggacccaagtgactttccatttagtgaaaaagccttaattttgattgattacagagaggcttatgggaggaaactgccgtacaaacatacccatagccaaatggcctttttgttgcatatactttgtttgtgatgattacctatacatccaaaaaggatgtcttagatttgtctaaaatttggatgtataagtagtacaacatatcaatagcgaattgtcccttttttttgtggcaaaaaaaaaaaaaaagaaaaagaaaacaaaaaaaaaaaaaaa

SEQ ID NO: 1621 - DNA, 2614 bp, Triticum aestivum
ccacgcacacttttccccaatccccacatctctctcgctcccaggccttccctgtctggagacgctgctggcgctcggcctcgaccagcgcacggccgagaacgcgctggtcaatagcaaggtcaccgccaacctagccgccgtcgtagccgaggctggtataactggatgcgacaagtccgttgggaatcttctgtacgcagttgccacgaaatacccaaataatgcacttgtccatcgtcccgctctcattaactacatcgtttcgacgaagatcaagaaccctgcacagctagatgctgctctgtcgtttcttaccaacactggtcctgaatctttggatattgggaagtttgaagaagcctgtggtgtaggtgtggttgtttctattgaagagattcagtcaactgttgctgaggttctaaaggaaaacatggaagctatattagagcagcggtatcacataaatgttggtggcctatgcggacaggtcaggaagcggcacccctggggcgatgctaaggcaacaaaggaggagattgagaagaagcttgctgagatactaggtccgaagacggaagctgacaatgtaaaaccagtgaaaaagaagaaggaaaaaccagcaaaagttgaggagaaaaaggttgcagtagccactgctgccccaccatctgaggaggaactgaatccttatacaatatttccccagccagtggaaaacaataaggttcatacagaaatattcttcagtgatgggaacatatggagggcgcataacacgaaggagatattagagaaacatcttaaggcaactggtggaaaagtgatgacccgtttcccgccagaacctaatggatatcttcatatcggtcatgctaaggctatgtttattgattttggattggctaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagctttatatgagcatgcagttgagttaatacggaaagggctagcctatgtggatcaccagactgcagaacaaatcaaggaatacagggaaaagaagatgaatagtccatggagggataggcccattgaagaatctctgcagttatttgaagacatgcgacgtgggttgattgctgagggtgcagcaactctccgaatgaagcaggacatgcagaatgataacaagaacatgtctgatttaatagcatatagaataaaattcactcctcatccgcatgctggtgacaaatggtgtatctatccaagctatgactatgctcattgcatggtggattcacttgaaaacattacacattctttgtgcactcttgagttcgacatacgccgcccgtcatactactggctacttgttgccttaggcttgtaccagccacatgtttgggagtattcgaggctaaacatatcacatactatgatgtccaaaagaaagttgaaccggcttgtgacagagaagtgggtagatgggtgggatgatcctcgcttgttgactttggcaggactgaggcgacggggagtatcagcaaatgcgatcaattcatttatccgtggaattgggataacgagagtgacaatagcttaattcgtgttgaccgtcttgaatatcatatcagagaagaactgaataaaacagcttctcgaaccatggttgttttgcatcctctaaaggttgtaataactaacttggaagatggaaaagtcatagaccttgatggaaaaaagtggcctgatgctcctgctgatgaagcttcgtcctactacaaggttcctttctcaaaaatcatctacattgaaaaaactgattttcgcgtgaaggactccaaagattactatggactggctcctggtaaatctgccctgctgaggtatgcattcccgataaaatgcacagaggttatttatggtgataatccagatgatattgttgaaattcgagccgagtatgacccttcaaagacctctaaacctaagggtgttctgcactgggttgcccagccagcacctggagttgatccgttaaaggttgaaataagattatttgagaaattattcctatctgagaatcccgccgaattggaagactggctgggtgatcttaacccgcactcaaaggaggtagtaaaggacgcctatgctgtaccttcactggccaccgcggttctgggcgacaagttccagtttgagcgacttggctacttcgctgtggacacggactcgacgcccgagaagcttgtgttcaacaggactgtaaccctgcgcgactcttatgggaaggctggacccaagtgactgcaaatttagtgaaaatgttccggtttttcttggtcacagagacgctaatgtgagaaaacatagtgtaatgcatacatcatgccaaaggccaagaggccttttttgtttttgtttttgttttgcatactgggcttgtgatgagtattatagcatgttttgtttcaatcgatcaaaacttggatgatcatatgctcaaatagttactcagatg

SEQ ID NO: 1622 - DNA, 2955 bp, Zea mays
caccacaccaccctgctcttcacgagctcctccactctgttcttccccgccgctccactgcgcccttcctcccgccgggatcctaaaccctagcccctagggagcgggagaggctgctgctgctgctgctaccgcggcggcgccggaggggatgggcaccgggggagacgggagcaaggcgggcccggcgctgccgctcgaggcgctgctggcgctcggcctcgaccagcgcaccgccgagaacgcgctcgtcaacgccaaggtcaccgccaacctcgcctccgtcatagccgaggctggtataaaggaatgcgacaagtcagtcggcaatcttctgtatgcagtcgccaccaagtacccaactaatgcacttgttcaccgtcctgtccttattagctatgtcttgtcaacaaagataaagaaccccgcacagctagatgctgctctgtcatttcttactaatactggtcctgattctctagatgtggtcaaatttgaagaagcatgtggtgtaggtgtggttgtttctattgaggaaattaaatctactgttactgatgtgcttgaggagaatatggaagctataaaggagcagcgatatcacataaatgttggtacactatgcggacaggtcaggaagagacacccctggggtgatgctaaggcgataaaggaggaaattgacaagaggcttgcagaaatcctaggtcccaagacagaagctgacaatataaaaccagtgaaaaagaagaaggaaaaaccagcaaaagttgaggagaaaaaagttgcagttgccactgctgccccaccatctgaggaggaattgaacccgtacactatatttccccaaccagaggaaaacttcaaggttcatacagaaatatttttcagtgatgggaacatatggagagcgcataacacaaaggaaattttagaaaaacatcttaaagcaactggaggaaaagtgatgacccgttttccaccagaacctaatggatatcttcatattggtcatgccaaggctatgtttattgattttggtctggctaaggagcgaaatggccattgctaccttagatttgatgacacaaatccagaagctgaaaagaaagaatacatagatcacattcaggaaatcgtccattggatgggatgggagccctacaaagtaacatacacgagtgactatttccaagctttgtatgaacatgccgttgagttaatacagaaagggctagcatatgtggatcaccagactgcagaagaaatcaaggaatacagggaaaagaagatggatagtccatggaggggtaggccaattgaagagtctctgaaattatttgaagacatgaggcgtgggttgattgcagagggtgcagcaactctccgtatgaagcaggatatgcaaaatgagaacaaaaatatgtctgacttaatagcatatagaataaaattcaccccccatccacatgctggcgacaagtggtgtgtctatccgagctatgactacgctcattgcatggtggattctcttgaaaacatcacacattcgctgtgcacacttgagtttgacatacgtcgcccttcatactactggctacttgttgccttgggcctttatcaaccatatgtgtgggaatattcgaggctaaacatatcaaatactgtgatgtctaaaagaaagttgaatcgacttgtgacagagaagtgggtagatgggtgggatgatccccgcttgttgacactggctggtctccggcgacggggagtatcatcaactgcaataaattcctttattcgtggaatcgggataacgagaagtgacaatagcttaattcgtgttgatcgtctagaatatcacatcagggaggagcttaacaaaacagcccctcgaaccatggttgttttgcgacctctaaaggtggtaataactaacttggaagaaggaaaagtactagaccttgatggcaaaatgtggcctgatgcttctgatactgatgcttcctcccactataaggttccgttctcaagaactgtctacattgagaaaactgattttcgcctaaaggactcaaaagactactatgggctagcccctggtaaatctgtcatgctaaggtatgcgttccccataaaatgcacagatgttatctctggtgatagtcctgatgatattgttgaaattcgagctgaatatgatcctttgaagacttctaaactgaagggtgttcttcactggattgctgagccagcacctggtgtagagccattgaaggtggaagtaagattattcgagaaattgttcatgtcagagaatcctgctgaattggaagattggcttggcgatcttaacccacactcgaaagaggtgataaaggatgcttatgctgtaccatcacttgccactgcggttctgggtgacaagttccagtttgagcggcttggttacttcgccgtggatactgactccacacctgagaaactcgtgttcaacagaactgttaccctccgtgattcgttcgggaaagctggacccaagtgactgttcagtgtaatttagggagggcgctggttttgatcggttgcagaggcgcacctgaactatacagtttgtgaagaaaatggtcgtctaatacagaacagtttaaaggccttactctttataaaatttagggttttttaatctggtgccctcagttttggtgatgtgttcatgtgactgtagcttgtttacttcgaatcagattttgtatgatagtgttagtgtcccgattctaccgtctgtaaccgaaaggtcccgggttcgagccccagcctctgcatattatgcgggtaaggcttggcgcttaaagatacaattcccaagaccccgcacagtgcgggaagcctacagcactgggtacgcctagtgttggtgtcccgattcccattctgtttgatgtcatactatcgtga

SEQ ID NO: 1623 - DNA, 2632 bp, Zea mays
ctgcggccggacgaggggatgggcacagggggagacggggacaaggcggggccggcgctgccgctggaggcgcttttggcgctcgggctcgaccagcgcaccgccgagaacgcgctcgtcaacgccaaggtcaccgccaacctcgccgccgtcatagctgaggctggtataaaggaatgtgacaagtcaattggtaatcttctatatgcagtcgccaccaagtacccaactaatgcacttgttcatcgccctgtccttattagctatgtcttgtcaacaaagataaagagccctgcacagctagatgctgccctctcatttcttactaatactggtcctgattctctagatgtggacaagtttgaagaagcatgtggtgtaggcgtggttgtttctattgaggaaattaaatctactgttactgacattcttgaggagaatatggaagctataaaggagcagcggtatcacataaatgttggtatgctatgtggacaggttaggaagagacacccctggggtgatgctaaggcagtaaaggaggaaattgacaagaggcttgcagaaatcctaggtccaaagacagaagctgacagtataaaaccagtgaaaaagaagaaggaaaaaacagcaaaagttgaggagaaaaaagttgcagttgccactactgccccaccatctgaggaggaattgaacccgtatactatatttccccaaccagaggaaaactttaaggttcatacagaaatatttttcagtgatgggaacatatggagagcacataacacaaaggaaattttggaaaaacatctcaaggcaactggaggaaaagtgatgacccgttttccaccagaacctaatggatatcttcatattggtcatgccaaggctatgtttatcgattttggtctggctaaggagcgaaatggccattgctaccttaggtttgacgacacaaatccggaagctgaaaagaaagaatacatagatcacattcaagaaattgtccattggatgggatgggaaccctacaaagtaacatacacgagtgattatttccaacctttgtatgagcatgctgttgagttaattcggaaagggctagcctatgtggatcatcagaccgcagaagaaattaaggagtacagggaaaagaagatgaatagtccatggagggataggccaattgaagagtcattgaatttatttgaagacatgaggcgtgggttgattgcggagggtgcagcaactctccgaatgaagcaggatatgcaaaatgagaacaaaaatatgtctgacttaatagcatatagaataaaattcacccctcatccacatgctggtgataattggtgtatctatccgagctatgactatgctcattgcatggtggattctcttgaaaacatcacgcattcgctgtgcacacttgagtttgacatacgccgcccttcatactactggctacttgttgccttgggtctttatcaaccatatgtgtgggaatattcgaggctaaacatatcaaatactgtgatgtctaaaagaaagttgaatcgacttgtgacagagaactgggtagatgggtgggatgatccccgcttgttgacactggctggactccggcggcggggagtatcatcaaccgcaataaattcctttatccgtggaatcgggataacaagaagtgacaacagcttaattcgtgttgatcgtctagaataccacatcagggaagagcttaacaaaacagcccctcgaaccatggttgttttgcgtcctctaaaggtggtaataactaacttggaagaaggaaaagtactagaccttgatgggaaaatgtggccagatgcttctgatactgatgcttcctctcactataagcttccgttctcaagaactgtctacattgagaaaactgattttcgccttaaggactcaaaagactactatgggctggcccctggtaaatctgtcatgctaaggtatgcgttccccataaaatgcacagacgttatctatggtgatactcctgatgatattgttgaaattcgagcagaatatgatcctttgaagacttctaaacttaagggtgttctgcactgggttgctgagccagcacctggtgtcgaaccattgaaggtggaagtaagactattcgagaaattgttcatgtcagagaatcctgctgaattggaggattggcttggtgatcttaacccgcactcgaaagaggtgataaaggacgcttatgctgtaccatcgcttgccactgcagttctgggcgacaagttccagtttgagcggcttggttacttcgccgtggacacggactccactcctgagaagctcgtgttcaacagaactgtcaccctccgtgattcattcggtaaagctggaccaaagtgacttccagtgtaatgtaggtagggcgtgggtgctcggttgcataggcgcacctgagctatacttttttttgaagaagaaaatgatcttgtaatacagaacagcctaaaggcctcaatctttgtaaaatttacatgtgactgcagtgcagcttgtttgcttcgaaggaatcagattttgtatggtagtgttagtgttagtgcgccggttcccagtctggtttgat

SEQ ID NO: 1624 - DNA, 2525 bp, Avena sativa
gctggagacgctgctggcgctcggcctcgaccagcgcacggcggagaacgccctcgtcaacagcaaggtcaccgccaacctagccgccgtcatagcagaggctggtataagtggatgtgacaagtcagttggaaatcttctctatgcagttgccactaaatacccaaacaatgcacttgtccatcggcctgctctcatcaactatattgtgtcaacgaagataaagagtcctgcacagctagatgctgccctgtcatttcttacgaatgttggccctgaacctttggatattgggaagtttgaagaagcctgtggtgtaggtgtggttgtttcgattgaagagattcactcaactgttgctgaggttctaaaggcaaatatggaagctataatggagcagcggtatcacataaatgttggtagcctatgcggacaggttaggaagaagcacccctggggcgatgcgaaggcaacaaaggacgagattgagaagaggcttgcagagatgctaggtccaaagacggaagctgataatgtaaaaccagtgaaaaagaagaaggaaaagccagcgaaagttgaggagaaaaaagttgcagtagccactgctgccccaccaactgaggaggaactgaatccatacactatatttcctcagccagcagaaaacaataaggttcatacggaaatattcttcagcgatgggaacatttggagggcacataacacaaaggagatattagagaaacatcttatggcaaccggtggaaaagtgatgacccgtttcccaccagaacctaatggatatcttcatattgggcatgccaaggctatgtttattgattttggactggctaaagagcgcaatggtcattgttaccttaggtttgatgatacaaacccagaagctgaaaagaaggaatatattgaccacatccaggagatagtccagtggatgggatgggagccctacaaagttacatatacaagcgactattttcaagctttatatgagcatgcagttgagctaatacggaaaggactagcctatgtggatcaccagaccggagaacaaatcaaggaatgcagggaaaagaagatggacagtccatggaggaataggcccattgaagagtcactgcaattatttgaagacatgcgacgtgggatgattgctgagggtgcagcaactctccgaatgaagcaggacatgcagaatgataacaaaaacatgtctgacttgattgcttatagaataaaattcactcctcatccacatgctggcgacaaatggtgtatctatccaagctatgattatgcccattgcatggtggactcatttgaaaacattacacactcattgtgcacgcttgagtttgacatacgtcgcccgtcatactactggctacttgttgccttgggattgtaccagcctcatgtctgggaatattcaaggctgaacatatcaaatacagtgatgtctaaaagaaagttgaaccggcttgtgacagagaagtgggtagatggatgggatgatcctcgtctgctaacactggcaggactgcggcgacggggagtgtcagcaaccgcaattaattcatttatccgtggaattgggataacaagaagtgacaatagcttgattcgtgttgaccgtcttgaatatcatatcagagaagaacttaataaaactgcttcccgaaccatggttgttctgcatcctctaaaggttgttataactaacttggaagatggaaaagtcatagaccttgatggaaagaagtggcctgatgctcctgctgatgatgcttcatcctactacaaggttcctttctcaagaactgtctacattgagaaaactgattttcgccttaaggactcgaaagattactatgggctagctcctggtaaatctgccctgctaaggtatgcattcccgataaagtgcacagaggttgtttatggtgataatccagataaaattgtcgaaattcgagctgagtatgacccctcaaagacttctaaacctaagggtgttctgcactgggtcaccgagccagcacctggagttgagccattaaaggttgaaataagattatttgagaaattattcttatcggagaatcctgccgaattggaagattggctgggtgaccttaaccccaactcgaaagagattgtaaagggtgcctatgctgtaccatcacttgccaccgcagttctaggtgacaagttccagtttgagcggcttgggtactttgctgtggacactgactcgacgcccgagaagcttgtgttcaacaggactgttaccctgcgcgactcttatgggaaggctggacccaagtgacatttaatttagtaaaatagctttattttgcttggttacagtggcgctaataggagaaaacgttgtaatgccatacaacataccaatagccaggtggcctttttgatttgcatactgggcttgtgatgattattaccatgtgtttggttctatcaaattttgaatgatcagatgctgg

SEQ ID NO: 1625 - DNA, 2726 bp, Sorghum bicolor
cctccaccgccgctccgctgcgcctttcctcccgccggaatcctaaaccctagggagcgcgaggcggcggctgcggacgaggacgaggggaggatgggcaccgggggagacggggacaaggcgggcccggcgctgccgctggaggcgctgctggcgctcgggctcgaccagcgcaccgccgagaacgcgctcgtcaacagcaaggtcaccgccaacctcgccgcagtcatagccgaggctggtataaaggaatgcgacaagtctgttggcaatcttctatatgcagttgccaccaagtacccaactaatgcgcttgttcatcgtcctgtccttattagctatgtcttgtcaacaaagataaagaaccctgcacagctagatgctgctctgtcatttcttactaatactggtcctgattctctagatgtgggcaaatttgaagaagcatgtggtgtaggtgtggttgtttctattgaggaaattaaatctactgttactgacattcttgaggagaatatggaagcgataaaggagcagcggtatcacataaatgttggtatgctatgtggactggttaggaagagacacccctggggtgatgctaaggcgataaaggaggaaattgacaagaggcttgtagaaatcctaggtccgaagacagaagctgacaatataaaaccagtgaaaaagaagaaggaaaaaccagcaaaagttgaggagaaaaaagttgcagtggccactgctgcaccaccaactgaggaggaattgaacccatatactatatttcctcaaccagaggagaactttaaggttcatacagaaatattttacagcgatgggaacatatggagagcacataacacaaaagaaattctagaaaaacatcttaaggcaactggaggaaaagtgatgacccgttttccaccggaacctaatggatatcttcatattggtcatgccaaggctatgtttattgattttggtctggctaaggagcgaaatggccattgctaccttaggtttgatgacacaaatccggaagctgaaaagaaagaatacatagaccacattcaggaaattgtccattggatgggatgggagccctacaaagtaacatacacgagtgactatttccaagctttgtatgagcatgctgttgaattaatacggaaagggctagcctatgtggatcaccagaccgcagaagaaatcaaggagtacagggaaaagaagatgaatagtccatggagggataggccaattgaagagtcactgaaactatttgaagacatgaggcgtgggttgattgcggagggtacagcaactctccgaatgaagcaggacatgcagaatgagaacaaaaatatgtctgatttgatagcatatagaataaaattcacccctcatccacatgctggtgacaagtggtgtatctatccgagctacgactatgctcattgcatggtggattctcttgaaaacatcacacattcgctgtgcacacttgagtttgacatacgtcgcccttcatactattggctactcgttgccttgggcctttatcaaccatatgtgtgggagtattcaaggctaaacatatcaaataccgtgatgtctaaaagaaagttgaatcgacttgtgacagagaagtgggtagatgggtgggatgatccccgcttgttgacattggcaggactccggcgacggggagtatcatcaactgcaattaattcgtttatccgtggaattggcataacaagaagtgacaatagtttaattcgcgttgatcgtctagaataccacatcagggaagagcttaacaaaacagcccctcgaaccatggctgttttgcgccctctaaaggttgtaataactaacttggaagaaggaaaagtactagaccttgatgggaaaatgtggcctgatgcttctgatactgatgcttcctcccactataaggttccgttctcaagaactgtctacattgagaaaactgattttcgcctgaaggactcaaaagactactatgggctagcccctggcaaatctgtcatgctaaggtatgcattccccataaaatgcacagatgttatctatggtgatagtcctgatgatgttgttgaaattcgagctgaatatgatcctttgaagacttctaaacttaagggtgttctgcactgggtttctgagccagcacctggtgtcgaaccattgaaggtggaagtaagattatttgagaaattgttcatgtcagagaatcctgctgaattggaggattggcttggtgatcttaaccctcactccaaagaggtgataagggatgcttatgctgtaccatcactcgccagtgcagttctgggtgacaagttccagtttgagcggcttggctacttcgccgtggatacggactccactcctgagaagctcgtgttcaacagaactgttaccctccgtgattcgtttgggaaagctggacccaagtgatgactccagtgtaatttagggagggcatgatgttttgatcggttgcagaggcacacctgagctatacactctgaagaaaatgatcagtttaaaggccttactctttgtaaaatttacatgtgactgcagcttgtttgctttgaatgaatcagattttgtatgatatagtgttaatgtccaggttcgcaatcaggtttgatgatgtcaagggctactcgtattgtcatgatggtagttctgtt

SEQ ID NO: 1626 - DNA, 2714 bp, Triticum aestivum
cgctcggcctcgaccagcgcacggccgagaacgcgctggtcaatagcaaggtcaccgccaacctagccgccgtcgtagccgaggctggtataactggatgcgacaagtccgttgggaatcttctgtatgcagttgccacgaaatacccaaataatgcacttgtccatcgtcctgctctcattaactacatcgtttcgaccaagattaagaaccctgcacagctagatgctgccctgtcgtttcttactaacactggtcctgaatctttggatattgggaagtttgaagaagcctgtggtgtaggtgtggttgtttctattgaagagattcagtcaactgtcgctgaggttctaaaggaaaacatggaagctatattggagcagcggtatcacataaatgttggtggcctatgcggacaggtcaggaagcggcacccctggggcgatgctaaggcaacaaaggaggagattgagaagaagcttgctgagatactaggtccgaagacagaagccgacaatgtaaaaccagtgaaaaagaagaaggaaaaaccagcaaaagttgaggagaaaaaggttgcagtagccactgctgccccaccatctgaggaggaactgaatccttatacaatatttccccagccagcggaaaacaataaggttcatacagaaatattcttcagcgatgggaacatatggagggcacacaacacaaaggagatattagagaaacatcttaaggcaactggtggaaaagtgatgacccgtttcccgccagaacctaatggatatcttcatatcggtcatgctaaggctatgtttattgattttggattggctaaagagcgaaatggtcactgttatctcaggtttgatgacacaaatccagaagctgaaaagaaagaatatatagaccacattcaggagatagtcaagtggatgggatgggagccctataaagttacatatacaagtgattatttccaagatttatatgagcatgcagttgagttaatacggaaagggctagcctatgtggatcaccagactgcagaacaaatcaaggaatacagggaaaagaagatggatagtccatggagggataggcccattgaagagtctcttcagttatttgaagacatgcgacgtgggttgatcgctgagggtgcagcaactctccgaatgaagcaggacatgcagaatgataacaaaaacatgtctgatttaatagcatatagaataaaattcactcctcatccgcatgctggcgacaaatggtgtatctatccaagctatgactatgctcattgcatggtggattcacttgaaaacattacacattctttgtgcacgctcgagttcgacattcgtcgcccgtcatactactggctacttgttgccttgggcttgtaccagccatatgtttgggagtattcgaggctaaacatatcacatactatgatgtccaaaagaaagttgaatcggcttgtgacagagaagtgggtagatgggtgggatgaccctcgtttgttgactttggcaggactgaggcgacggggagtatcagcaactgcgatcaattcatttatccgtggaattgggataacgagaagtgacaatagcttaatccgtgttgaccgtcttgaatatcatatcagagaagaactgaataaaacagcttctcggaccatggttgttttgcatcctctgaaggttgtaataactaatttggaagatggaaaagtcatagaccttgatggaaaaaagtggcctgatgctcctgctgatgaagcttcgtcctactacaaggttcctttctcaaaaaccgtctacattgaaaaaactgattttcgcgtgaaggactccaaagattactatggattggctcctggtaaatctgccctgctgaggtatgcattcccgataaaatgcacagaggttatttatggtgataatccagatgatattgttgaaattcgagccgagtatgacccttcaaagacctctaaacctaagggtgttctgcactgggttgccgagccagcacctggagttgagccgttaaaggttgaaataagattatttgagaaattattcctctcggagaatcccgccgaattgaaagactggctgggtgatattaacccgcactcaaaggaggtagtcaagggcgcctacgctgtaccgtcactcgccaccgcggttctgggcgacaagttccagtttgagcggcttggctactttgctgtggacacggactcgacgcccgagaaccttgtgttgaacaggactgtgaccctgcgcgactcttatgggaaggctggacccaagtgactgcaaatttagtgaagaagctccgtttttcttggtcagagagacgctaatgggagaaaacatagtcatgacatacaacatgaaatggccaagaggccctttttgttttgttttgcatactgggcttgtgatgactattatagtatgttttgtttcagtcgatcaaaatttggatcatcatatgctcaaatagttacccagattacctgctcgtactggtgtggtaatataccttcagccggagctttctgtttcttcatggatcagccctcccccttccaaaagaaccagctttttccttggttttctccttgggcttcgtgttttcttcggtattcattttttgtctctattgccccaccacaaccacatggtattacaccc

SEQ ID NO: 1627 - DNA, 2686 bp, Pennisetum glaucum
ctgggaggagatgggcaccgggggagacggggagaaggcggcgctgccgctggaggcgctgctggccctcgggctcgaccagcgcaccgcggagaacgcgctcgtcaacagcaaggtcaccgccaacctcgccgccgtcatagccgaggctggcataaaggaatgtgacaagtcagttggcaatcttctctatgcagttgccactaagtacccaactaatgcactagtccaccgtcctgtccttattaaatatgtcttgtcaacaaagataaagaaccctgcacagctcgatgctgctctgtcatttcttaccaatacaggtcctgattctctggatatcgagaagtttgaggaagcgtgtggtgtaggtgttgttgtttctattgaggagattaaatcaactgttactgatgttcttgaggagaatatgaatgctataaaggagcagcggtatcacataaatgttggtaccctatgcggacaggtcaggaagagacacccatggggtgatgctaaggccataaaggaggagattgacaagaggcttgcagaaatactaggtcctaagacagaggctgacagtataaaaccagtgaaaaagaagaaggaaaaaccggcaaaagttgaggagaaaaaagttgcagttgcctcttctgccccaccatctgaggaggaaatgaacccgtatactatatttcctcagccagaggaaaactttaaggttcacacagaaatattcttcagcaatgggaacatatggagagcgcataacacaaaggaaattttagaaaaacatctgaaggcaactggaggaaaagtgatgacccgttttccaccagaacccaatggatatcttcatattggtcatgccaaggctatgtttatagattttgggctggctaaggagcgaaatggtcattgctaccttaggtttgatgacacaaatccagaagctgaaaagaaagaatacatagatcacattcaggaaatcgttcgttggatgggatgggagccctacaaagtaacatacacaagtgactatttccaagctttgtacgatcatgccgttgagttaataaggagagggctagcctatgtagatcaccagaccgcagaagagatcaaggagtacagggaaaagaagatgaatagtccatggagggataggccaattgaagagtcactgaaattatttgaagacatgaggcgtgggttgattgctgagggtgcggcaactctccgaatgaagcaggacatgcagaatgacaacaaaaacatgtctgacttaatagcatacagaataaaattcaccccgcatccacatgctggcgacaagtggtgtatctatccaagctatgactatgctcattgcatggttgattctcttgaaaacatcacacattcgttgtgcacacttgaatttgatatacgtcgtccttcatactactggctgcttgttgccttggacctttatcagccatatgtgtgggagtattcgaggctaaacgtatcaaatactatgatgtctaaaagaaagttgaatcgtcttgtgacggagaagtgggtagatgggtgggatgatccccgcttgttgacattggcaggactccggcgacggggcgtatcggcaaccgcgattaattcgtttatccgtggaattgggataactagaagtgacaatagcttaattcgtgttgaccgtctggaatatcacatcagggaagagcttaataaaacagctcctcgaacgatggttgttttgcgtcctctaaaggttgtaataactaacttggaagaaggaaaagtaatgaatcttgacgggaaaatgtggcctgatggttctgatactgatgcttcctcccactacaaggttcctttctcaagaactgtctacattgagaaaactgattttcgcctcaaggactcgaaagattactatgggctagcccctggaaaatctgtcatgctaaggtatgcattccccataaaatgcacagatgttatctacggtaatagtcctgatgatattgtcgaaatccgagctgaatatgatcctttaaagacttctaaacttaagggtgttctgcactgggttgctgagccagcacctggtgttgaaccattaaaggtggaagttagattgtttgagaaattgttcatgtcagagaatcctgctgaattggaggattggctgggggatcttaacccgcactcaaaagaggtggtaaaggacgcatatgctgtaccgtcacttgctactgcggttctgggtgacaagttccagtttgagcgccttggctactttgcagtggatactgactccatgcccgagaagctggtgttcaacagaacagttaccctgcgggattcatttggcaaagctggacccaagtgacttatatctaatcttgagagcgctggtttttgattgggtgcagactgcagactgcagaggagcacttgaagtatacagtttgtgaagaaaatgatagatgacaacagtttaaaggcctttctccctgtaaaatgtgcatgtgactgcactttgtttgctccgattgaatatgttctttatgatcgtattagtgctggtgtacccattttgtgttaagagctacctatgcatgattgggatgtctgcgtactatctggaaattagtctggtttattatttctccttttgaga

SEQ ID NO: 1628 - DNA, 648 bp, Cynodon dactylon
ggcgcagcagacacacccaagcacacacccggcggtgaaggaggcgcgtcagagatggtgaagtttctgaagcccgggaaggccgtgatcctgctgcagggccggttcgccggtcgcaaggcggtgatcgtgcgcgtgttcgaggagggcacccgcgaccgcccctacgggcactgcctcgtcgccggcctggccaagtaccccaagaaggtgatccgcaaggactcggccaagaagacggccaagaagtcccgcgtcaagtgcttcatgaagctcgtcaacttcacccacctcatgcccacccgctacaccctcgacgtcgacctcaaggacgtcgccgccggccccgacgcgctctccaccagggacaagaaggtggccgcctgcaaggccgccaaggcgcgcctcgaggagaggttcaagaccggcaagaacaggtggttcttcaccaagctccgcttctaagcttccggctgctgcggaagcgagatggtcatttcttttcaaacctcgtgtttactttctgactagcagcttgttgggattttgatatatccaagtatccagatgtaggggtactcactgtaacctgcttgtcagtcagagtatctttatattagtgtggatctgttaaagaagcttattatc

SEQ ID NO: 1629 - DNA, 764 bp, Leymus cinereus x Leymus triticoides
ccaaaccctcacaagacacaacccactcggcggcggcggcggaggccccggagcacgcgaagatggtgaaattcctgaagcccggcaaggcggtgatccttctccagggtcgtttcgccggccggaaggcggtcattgtgcgcgttttcgaggagggcacacgcgaccgcccctacggccactgcctcgtcgccggcctagccaagtaccccaagaaggtgatccgcaaggactcggccaagaagacggcgaagaagtcgcgcgtgaagtgcttcctgaagctggtcaacttcacccacctcatgcccacccgctacaccctcgacgtcgacttcaaggacgttgcttccggcgggcccgacgccctcgccacacgcgacaagaaggtcgcctcctgcaaggctgccaaggcacgtctcgaggagaggttcaagaccggcaagaacaggtggttcttcaccaagctccgcttctaggagcagagcgtctttacaataccagtagttccttgttcttgcaaccaaacgcacactgagctatctctatcactgtttttgtattgtccatgaagactttgtggttagtatggatctcggagaggagtttaattaaggcatgatgatgatgatgtttcatgtgtttcatcatactaaggatgcacatggttgcaattttgttggaacttaccccctgagctgtttatttccccaattcttagtactatattgtttagtcttgttcgtgattgatatgcgacgcatcca

SEQ ID NO: 1630 - DNA, 728 bp, Oryza sativa
ccatccggcggcggcgcagcagcagcagaggtgagctcggcggcggcggcggcggcggcgaccaaccacaccggcgaaggagaaggagatccgtaccaagccgccgcgatggtgaagttcctgaagccggggaaggcggtgatcctgctgcaggggcggtacgcggggcggaaggcggtgatcgtgcgcgtgttcgaggagggcacccgtgaccgcccctacggccactgcctcgtcgccggcctcgccaagtacccgaagaaggtgatccgcaaggactcggcgaagaagacggcgaagaagtcgagggtcaagtgcttcctcaagctcgtcaacttcacccacatcatgcccacccgctacaccctcgacgtcgacttcaaggacgtggcctccgggggacccgacgccctcgccacccgcgacaagaaggtggccgcctgcaaggccgccaaggctcgcctcgaggagaggttcaagaccggcaagaacaggtggttcttcaccaagctccgcttctaggcgcgccttcttgttcttgctatcatccgttaatctatatctgctttttttggtatctgtgtccatgaagacttggttgttagtattgagtttaaaattaagacatgatgatgctcatgtgttatgaagtcatgccaaggatagatctggttgaagttttgtttgggaattacactgcttcagatgcgatttgttttccatgttcc

SEQ ID NO: 1631 - DNA, 970 bp, Brachypodium distachyon
ccgccgaattccccacaagtccccaaaccttccacaacctccaggcggcggcgcagctcggacgcgaagatggtgaagttcctgaagcccggcaaggccgtgatcctcctgcagggccgctacgccggccggaaggcggtcatcgtgcgcgtgttcgaggagggcacccgcgaccgcccctacggccactgcctcgtcgccggcctcgccaagtaccccaagaaggtgattcgcaaggactccgccaagaagacggccaagaagtcgcgcgtcaagtgcttcctcaagctcgtcaacttcacccacctcatgcccacccgctacacgctcgacgtggacctcaaggacgtggcctccggcgggcccgacgccctcgcctcctccgacaagaaggtcgccgccgccaagtctgccaaggcccgcctcgaggagaggttcaagaccggcaagaacaggtggttcttcaccaagctccgcttctaggctgcgaggctgcctgtttcttctgctagtatcgcccgtttattactttttagttggtatcaagtattgctgcactaagctatctctgttttggtattgtccatggagactttgtggatggatcttggagaggtgtttgtttgagacataatgacgtttcctctgttaaatcgtgccaaccatagttactgttgaaatttggtgatgattacttgtcacattatcttgctatatctgtatggtttagtgttgtgtttgatgcagttcacctctggtagtgtgtggtctgttggttaggttcattatattcatattagttggatcgagcattgctcagcatgttgtggttgtttcggctagggtcacttatgattgatcagtaacgatcaggcttactgtattagtttctcggtaacaattatcacactgcttagtatgcttgtagcaccgtgttacacagtgatggcgtccaatgctagttctgggt

SEQ ID NO: 1632 - DNA, 830 bp, Echinochloa colona
atcccaaccgcgctttgcaaacccatgtctgacatcctgacccaacccaacattacaagccgcagcgaggagccaccgtccgatcccaaatccaacaaccgaaatccgtccgccccacatcgaaaccctagcgccgccaccttatttaacccttctcgatctcatttccctcatccaccaagccctacccacccatccacccccggcggcggcgcagaagcagcagaacccgaagatggtgaagttcctaaagcccggcaaggccgtgatcctcctccagggccggttcgccggccggaaggcggtgatcgtgcgcgtgttcgaggagggcacccgcgaccgcccctacgggcactgcctcgtcgccggcctcgccaagtacccgaagaaggtgatccgcaaggactccgccaagaagacggccaagaagtcccgggtcaagtgcttcatcaagctcgtcaacttcacccacctcatgcccacccgctacaccctcgacgtcgacttcaaggacgtcgcgtctggcgggcctgacgcgctctccacccgggacaagaaggtcgccgcctgcaaggccgcgaaggcccgcctcgaggagaggttcaagactggcaagaacaggtggttctttaccaagctccgcttctagatgccgggcgtccagcatagtgcttgctttagttgtcaatttcctgtatcggacaccctttatgctatctctgttttggtgttgccatgaagacttagtgtttactattatggatcctggagaggatgacatgtcgatgatgtgttaaatgatgtcaaatcatatatctgcctcaattttg

SEQ ID NO: 1633 - DNA, 654 bp, Echinochloa colona
gcccccacctctcgaaccctcctcccacctcagcggcggcggcgcagcagcagcgcaggacctgaagatggtgaagttcctcaagccaggtaaggctgtgatcctcctccagggccggttcgccggccggaaggcggtgatcgtgcgcgtgttcgaggagggcacccgcgaccgcccctacgggcactgcctcgtcgccggcctcgccaagtacccgaagaaggtgatccgcaaggactccgccaagaagacggccaagaagtcccgggtcaagtgcttcatcaagctcgtcaacttcacccacctcatgcccacccgctacaccctcgacgtcgacttcaaggacgtcgcgtctggcgggcctgacgcgctctccacccgggacaagaaggtcgccgcctgcaaggccgcgaaggcccgcctcgaggagaggttcaagacaggcaagaacaggtggttctttaccaagctccgcttctaggtgccgggcgcccagcatagtgcttgctttagttgtcaatttcctgtatcggacaccctttatgctatctctgttttggtgttgccatgaagacttagtgtttactattatggatcctggagaggatgacatgtcgatgatgtgttaaatgatatcaatcatatatctgcctc

SEQ ID NO: 1634 - DNA, 729 bp, Oryza sativa
atccggcggcggcgcagcagcagcagaggtgagctcggcggcggcggcggcggcggcgaccaaccacaccggcgaaggagaaggagatccgtaccaagccgccgcgatggtgaagttcctgaagccggggaaggcggtgatcctgctgcaggggcggtacgcggggcggaaggcggtgatcgtgcgcgtgttcgaggagggcacccgtgaccgcccctacggccactgcctcgtcgccggcctcgccaagtacccgaagaaggtgatccgcaaggactcggcgaagaagacggcgaagaagtcgagggtcaagtgcttcctcaagctcgtcaacttcacccacatcatgcccacccgctacaccctcgacgtcgacttcaaggacgtggcctccgggggacccgacgccctcgccacccgcgacaagaaggtggccgcctgcaaggccgccaaggctcgcctcgaggagaggttcaagaccggcaagaacaggtggttcttcaccaagctccgcttctaggcgcgccttcttgttcttgctatcatccgttaatctatatctgctttttttggtatctgtgtccatgaagacttggttgttagtattgagtttaaaattaagacatgatgatgctcatgtgttatgaagtcatgccaaggatagatctggttgaagttttgtttgggaattacactgcttcagatgcgatttgttttccatgttcctcc

SEQ ID NO: 1635 - DNA, 728 bp, Secale cereale
cccacacaacccactcggcggcggcggagcacgcgaagatggtgaagttcctgaagcccggcaaggcggtgatccttctccagggtcggttcgccggccggaaggcggtaattgtgcgcgttttcgaggagggcacacgcgaccgcccctacggacactgcctcgttgccggcctagccaagtaccccaagaaggtgatccgcaaggactcggccaagaagacggcgaagaagtcgcgcgtgaagtgcttcctgaagttggtcaacttcacccacatcatgcccacccgctacaccctcgacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcttctttacaatactagtagttccttgttcttgcaagcaatagcacactgagctatctctatcactgtttttgtattgtccatgaggattttgtggttagtatggatctcggagagagtttaattaaggcatgatgatgattgtgttccatgtgttaaatcatgctaaaggatgcacattgttgcaattttgttggagcttactccctgagctgtttatttccccaattcttgttcgtgagtaatatctgatgcaacctttctcctga

SEQ ID NO: 1636 - DNA, 763 bp, Secale cereale
acccacacaacccactcggcggcggcggagcacgcgaagatggtgaagttcctgaagcccggcaaggcggtgatccttctccagggtcggttcgccggccggaaggcggtaattgtgcgcgttttcgaggagggcacacgcgaccgcccctacggacactgcctcgttgccggcctagccaagtaccccaagaaggtgatccgcaaggactcggccaagaagacggcgaagaagtcgcgcgtgaagtgcttcctgaagctggtcaacttcacccacatcatgcccacccgctacaccctcgacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatactagtagttccttgttcttgcaatcaatagcacactgagctatctctatcactgtttttgtattgtcctgtccatgaggattttgtggttagtatggatctcggagagaatttaattaaggcatgatgatgattgtgttccatgtgttaaatcatgctaaaggatgcacatggttgcaattttgttggagcttactccctgagctgtttatttccccaattcttataactatgttgtttagtcttgtttgtgagttatatctgacgcatcctttctctcaaaaaaaaaa

SEQ ID NO: 1637 - DNA, 2258 bp, Sorghum bicolor
atttgatccacctctcaaacctacccttcccggcggcggcggcggcggcggcgcaggagcagcagcagcacgcgaagatggtgaagttcctcaagcccggcaaggccgtgatcctactccagggccggttcgccggcaggaaggcggtgatcgtgcgcgtgttcgaggagggcacccgcgaccgcccctacggccactgcctcgtcgccgggctcgccaagtaccccaagaaggtgatccgcaaggactccgccaagaagacggccaagaagtcgcgcgtcaagtgcttcatcaagctcgtcaacttcacccacctcatgcccacccgctacaccctcgacgtcgacttcaaggacgtcgccaccggcgggcccgacgcgctctccacccgcgacaagaaggtcgccgcctgcaagaccgccaaggctcgcctcgaggagaggttcaagacaggcaagaacaggtggttctttaccaagctccgcttctagatgcttggcgtccccaatagtgcctgctttagttgccgatttcttgtattggacactctctaagcttatctctgttttcgtattaccatgaagacttcgtgtttagacccggggctctcagagataattttactaagatgtgctattgatgtgttaaatgttgtcatggatagatctggttttaattttgtttgaaatcacggcttgcgtgttcttaaaatatttggtcttgtcggtgccagagctgcatcttgttaccgttacacaactgtttatcaagtatggtcctttgtttatacttgagtcaatgattaattattatcttacttcaatattaggcgaattgagctagtggccgatgaattgttgaatgttcaatttatttcttcagtattcattggttcatcaaatagatgtcaacgaatattgtttagtcttatttgtcctgttgattagttagttgttcaacttctaatgtttgaactgtcatagcagcctaagaaagtaatatattgctgataaatgttattagacttccagtgaaattctttttttttttactttgatgtagtaacagcttgcttggatttgcccactgaagtaggcattcatttcaaggattttgctacatttgggtcatgtatgccattctctttaataaatatttgactctgttaaaagaaaaaattttggtggtacttgacacatttgactccctgtttgggtagccattccttaccaaatattgatgagtaacattactgaaattttgataagtttgaattgaaacattagtgtattgcaggcttcattcttggtcccttggcttattgatgagctggtagttttagttttgtgtttgtttgttgatcatgcttgttgcgtctggttatcctgtttgggtagccattccttaccaaatattgatgagtaacattactgaaattttgataagtttgaattgaaacattagtgtattggaggcttcattcttggtcccttggcttattgatgagctggtagttttagttttgtgtttgtttgttgatcatgcttgttgcgtctggttatcctttatttactcctggtatactaggaattagaaaataaactgggtagtaaagcaaatgcatgcaaccccctgaaattattggagttccatatttgggttggtgatgtgttaatgttaactgaatcacctggaatttcttataatttgtcattttgaatgctgacactttatattttaggatggatgaactatatttgttcttttgctgctgttactgctgtagtgttttatctgcctgtgttagtaaatttatcattgcacttaatagtgtaacacttgcacatcaaatgttttggatggaaactgtatttaccagcagcttaggtgctacagttcagtcatctgcccagcagatcattgattttgtgaagatcgccttttcttttttgctcatcagaaatgtcaacagatagtttcatcttgttcggctattgaaatcttaaaagcaggataaaccactcttttgctgctatgcgagatctgtatgctgttactctgatacagacatgaaacagcataggaaagaaatagcatgattttgtagcatagtaacattgaaaaaatagcaagcgcaatggtaatatgctgtggctgattgaagtgcggttttggcagccatggtacagtatcttgctctcacaaacacagcagcagccgcagaaccgtcttgatcagcagcttcacaagcagcagcc

SEQ ID NO: 1638 - DNA, 759 bp, Saccharum officinarum
cccgaaccctaccctcccggcgtcggcggcgcaggagcagcagcagcacgcgaagatggtgaagttcctcaagcccggcaaggccgtgatcctcctccagggccggttcgccggcaggaaggcggtgatcgtgcgcgtgttcgaggagggcacccgcgaccgcccctacggccactgcctcgtcgccgggcttgccaagtacccaaagaaggtgatccgcaaggactccgccaagaagacggccaaaaagtcgcgcgtcaagtgcttcatcaagctcgtcaacttcacccacctcatgcccacccgctacaccctcgacgtcgacttcaaggacgtcgccaccggcgggcccgacgcgctctccacccgcgacaagaaggtcgccgcctgcaagaccgccaaggcgcgcctcgaggagaggttcaagacaggcaagaacaggtggttctttaccaagctccgcttctagatgcttggcgtcccgaatagtgcttgctttagttgtcggtgtcgatttcttgtatcggacactctctaagctatctctgttttcgtattaccatgaagacttcgtgtttagacttggggctctcagagataattttactaagatgtgccattgatgtgttaaatgttgtcatggatagatctggttgaaattttgtttgaaatcacggctttaaaatatttggtcttgcgggtgccagacatttggatgcatttggttactggtacaaaactggtttaataaagaatggg

SEQ ID NO: 1639 - DNA, 915 bp, Panicum virgatum
gacccatcccaacccgtgaaggcccagtgccgcagcaccgtccgatcacgtatccaacagccgatatccgctcaccctcctcgaaaccctagcgccgccaccctatttaatcctcgcccctccctctgccaccattttcctccacctcctgagccctccccacttcaccccggcggcggcgcagcagcagcagcagcagctgaagatggtgaagttcctgaagcccggcaaggccgtgatcctccttcagggccggttcgccggccggaaggcggtgatcgtgcgcgtgttcgaggagggcacccgcgaccgcccctacgggcactgcctcgtcgccggcctcgccaaataccccaagaaggtgatccgcaaggactccgccaagaagacggccaagaagtcccgtgtcaagtgcttcatcaagctcgtaaacttcacccacctcatgcccacccgctacacccttgacgttgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccgggcgtccagcatagtacctgctttagttgtcaatttcatgtatcgcaaacccttatctatgttttggtattgccatgaagacttcgtgcttactgttatggatcttggagaggttgacatgtcgatgatgttttaaatgatgtcaatcatagaccttgtccaaattttgttcagaatcattgcgtggaatgtgctgttttcaatcttacgggtgttaggtattcgagatgcatcacctaagccttattactacgacttcatggtccttgttttacatgcgagttctgttt

SEQ ID NO: 1640 - DNA, 913 bp, Panicum virgatum
gtccctccctcgcccaccatttttgtccacctcctgagccctccccaccctccaaccccggcggcggcagcggcggcggcggcgcagcagcagcagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatgcccacccgctacacccttgacgtcgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccaggcgtccagcatagtacctgctttagttgtcaatttcatgtatcggacacccttatctctgttttggtattgccgtgaagacttcgtgcttactgttatggatcttggagaggttgacatgtcgatgatgttttaaatgatgtcaatcgtagaccttgtccaaattttgttcagaatcattgcgtggaatgtgctgatttcaatcttacgggtgttaggtattcgagatgcatcacctaagccttattactacgacttcatggtccttgttttacatgcgagttctgtttgatatggtttcctattgtttcaactttcactattaggcaattctctttgtagcgttgcagtcaaattaaattgttgaatagtgaatttaagttgttatgcc

SEQ ID NO: 1641 - DNA, 1291 bp, Triticum aestivum
cggcggcggcggagcacgcgaagatggtgaagttcctgaagcccggcaaggcggtgatccttctccagggtcggttcgccggccggaaggcggtcattgtgcgcgttttcgaggagggcacacgcgaccgcccctacggccactgcctcgtcgccggcctagccaagtaccccaagaaggtgatccgcaaggactcggccaagaagacggcgaagaagtcgcgcgtgaagtgcttcctgaagctggtcaacttcacccacatcatgcccacccgctacaccctggacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatactagtagttccttgttcttgcaatcaatagcacactgagctatctctatcactgtttttgtattgtccatgaggattttgtggttagtatggatctcggagagagtttaattaaggcatgatgatgatgatgttccatgtgttaaatcatgctaaaggatgcacatggttgcaattttgttagagcttactccctgagctgtttattcccccaattcttgtaactatattgtttggtcttgtttgtgagtaatatctgacgcaacctttctcttaaatagtgcgttgtttaggactaacatggattctgttctttcggtgtttattagctatccagtatattcagttagcccttaactgtctaataattaccgcactgcttgatatgcttgtaacttccacacgttgaccatctcactgccttgcatgctccactgatccaccctcaacatgttgtgttgggtttaatactgttttggtatgcttgtagcttcttcatgtcgacccttttcactgtcttgcatagcatcttcatacagttatatgcaagacattaccgttatatgcagtgccaagacagtaaatggtcccacattatcattttgattatataccctttttgattaaaatgcattacttgtttttctcaattgaacatagtatcagagccttataaagttatcatgtggataccatgttcacccttggaagaaactatgatatatttgatgaaaatgggaatatgagacaatgatgcagtgaaacagtctgttgatcatgtcatacaacatacaacgttcacagtgcaacatgatctcaaagattgagttcctg

SEQ ID NO: 1642 - DNA, 802 bp, Oryza sativa
tgtccgcaaaacactgttgggcacatcgcaatgaatcaccgctggaaatggaggaacatggaaaacaaatcgcatctgaagcagtgtaattcccaaacaaaacttcaaccagatctatccttggcatgacttcataacacatgagcatcatcatgtcttaattttaaactcaatactaacaaccaagtcttcatggacacagataccaaaaaaagcagatatagattaacggatgatagcaagaacaagaaggcgcgcctagaagcggagcttggtgaagaaccacctgttcttgccggtcttgaacctctcctcgaggcgagccttggcggccttgcaggcggccaccttcttgtcgcgggtggcgagggcgtcgggtcccccggaggccacgtccttgaagtcgacgtcgagggtgtagcgggtgggcatgatgtgggtgaagttgacgagcttgaggaagcacttgaccctcgacttcttcgccgtcttcttcgccgagtccttgcggatcaccttcttcgggtacttggcgaggccggcgacgaggcagtggccgtaggggcggtcacgggtgccctcctcgaacacgcgcacgatcaccgccttccgccccgcgtaccgcccctgcagcaggatcaccgccttccccggcttcaggaacttcaccatcgcggcggcttggtacggatctccttctccttcgccggtgtggttggtcgccgccgccgccgccgccgccgagctcacctctgctgctgctgcgccgccgccggatggtgttagggttcgcggagagggg

SEQ ID NO: 1643 - DNA, 655 bp, Brachypodium distachyon
caccaaatttcaacagtaactatggttggcacgatttaacagaggaaacgtcattatgtctcaaacaaacacctctccaagatccatccacaaagtctccatggacaataccaaaacagagatagcttagtgcagcaatacttgataccaactaaaaagtaataaacgggcgatactagcagaagaaacaggcagcctcgcagcctagaagcggagcttggtgaagaaccacctgttcttgccggtcttgaacctctcctcgaggcgggccttggcagacttggcggcggcgaccttcttgtcggaggaggcgagggcgtcgggcccgccggaggccacgtccttgaggtccacgtcgagcgtgtagcgggtgggcatgaggtgggtgaagttgacgagcttgaggaagcacttgacgcgcgacttcttggccgtcttcttggcggagtccttgcgaatcaccttcttggggtacttggcgaggccggcgacgaggcagtggccgtaggggcggtcgcgggtgccctcctcgaacacgcgcacgatgaccgccttccggccggcgtagcggccctgcaggaggatcacggccttgccgggcttcaggaacttcaccatcttcgcgtccgagctgcgccgccgcctggaggttgtg

SEQ ID NO: 1644 - DNA, 632 bp, Cenchrus ciliaris
gccctacccccatcctccgcggcggcggcgcagcatcagcaaccgaagatggtgaagttcctgaagcccggtaaggccgtgatcctcctccagggccggtttgccggccgcaaggcggtgatcgtgcgcgtgttcgaggagggcacccgcgaccgcccctatgggcactgcctcgtcgccggcctcgccaagtaccccaagaaggtgatccgcaaggactccgccaaaaagacggccaagaagtcccgtgtcaagtgcttcatcaagctcgtcaacttcacccacatcatgcccacccgctacaccctcgacgtcgacttcaaggatgtcgcctcaggcgggcccgacgccctctccacacgggacaagaaggttgccgcctgcaaggccgccaaggcgcgcctcgaggagaggttcaagaccggcaagaacaggtggttctttaccaagctccgtttctagataccgggcgtcctgcatagtgccctgctttagttttcagtttcttgtaccggatactcttttaagctatctctgctttggtattgccatggagacttggtgcttagtattacggatctcggagagatttttattaagacatgtcgatgacgtgttaaatattgtcgcat

SEQ ID NO: 1645 - DNA, 730 bp, Echinochloa colona
cccccacctcccgaaccctaccctcccacaccggcggcggcggcgcagcagcagcgcaggaccaagatggtgaagttcctcaagccaggtaaggccgtgatcctcctccagggccggttcgccggccggaaggcggtgatcgtgcgcgtgttcgaggagggcacccgcgaccgcccctacgggcactgcctcgtcgccggcctcgccaagtacccgaagaaggtgatccgcaaggactccgccaagaagacggccaagaagtcccgtgtcaagtgcttcatcaagctcgtcaacttcacccacatcatgcccacccgctacacccttgacgtcgacttcaaggacgtcgcgtctggcgggcctgacgcgctctccacccgggacaagaaggtcgccgcctgcaaggccgcgaaggcccgcctcgaggagaggttcaagaccggcaagaacaggtggttctttaccaagctccgcttctagatgccgggcgtccagcatagtgcttgctttagttgtcaatttcctgtatcggacaccctttaagctatcatatatctgcctcaattttgttccgagtcattgcttggtttgtgctgttctcggattatttaatcttgcctgtgttatttgagatgcatgatgcatcttatatctattacaatcctatatgtaatcttgtgcgtgttatttgagatgcatggcccttggtttacatgtgagttatatctag

SEQ ID NO: 1646 - DNA, 785 bp, Setaria italica
cctatttaatcctcgctccacccacgcgatgccatttcctcagccgaccgagccctacccacccatcctccccggcggcggcgctgcagcagcaaccgaagatggtgaagttcctgaagcccggcaaggccgtgatcctcctccagggccggttcgccggccgcaaggcggtgattgtgcgcgtgttcgaggagggcacccgcgaccgcccctacgggcactgcctcgtcgccggcctcgccaagtacccgaagaaggtgatccgcaaggactccgccaagaagacggccaagaagtcccgggttaagtgcttcatcaagctcgtcaacttcacccacatcatgcccacccgctacaccctcgacgtcgacttcaaggacgtcgcctcgggcgggcccgacgcgctctccacccgggacaagaaggtcgccgcctgcaaggccgccaaggcgcgcctcgaggagaggttcaagaccggcaagaacaggtggttctttaccaagctccgcttctagatgccgggcgtcctgcatagtgccctgctttagttgtcagtttcttgtatcggatactcttttaagctatctctgctttggtattgccatggagacttcgcttagtattacggatctcggaaagaattttattaagacatcgatgatgtgttaaatgttgtcgcatagatctggctgagattttgctcagaatcgctgcttgggatgtactgctgtttttctcctgcattgtgctctaaatgtttggtcttggtagtgacagatatttgt

SEQ ID NO: 1647 - DNA, 680 bp, Setaria italica
cccaaaccctccccaccctcccaccccggcggcggcggcgcagcagcagctcaagatggtgaagttcctcaagccaggtaaggccgtgatcctcctccagggccggttcgccggccggaaggcggtgatcgtgcgcgtgttcgaggagggcacccgcgaccgcccctacggccactgcctcgtcgccggcctcgccaagtaccccaagaaggtgatccgcaaggattccgccaagaagacggccaagaagtcccgtgtcaagtgcttcatcaagctcgtcaacttcacccacatcatgcccacccgctacaccctcgacgtcgacttcaaggacgtcgcctcgggcgggcccgacgcgctctccacccgggacaagaaggtcgccgcctgcaaggccgccaaagcgcgcctcgaggagaggttcaagacaggcaagaacaggtggttctttaccaagctccgcttctagatgccgggcgtccagcatagtcctgctttagttgtcaatttcttgtatcggacaccctttatgctatctctgttttggtgttgccatgaagactttgtgcttactattatggatcttggagaagatgacatgtcgatgatgtgttaaatgatgtcaatcataggtcttgtccaaattttgttcagagtcattgcttgttatgtgttctcaa

SEQ ID NO: 1648 - DNA, 759 bp, Zea mays
gacacacctcccaaaccctacactcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatcggacacactccatctctgttttcgtattaccatgaatatttcgtgtttagtcctggggctctcagagataaatttgctaagatatgccgttgttgtgttacatgttttcgtgataggtctggttaaaattttgttctgttttacggcttgcgggtttcttgttggtgccagacatttgtgatgcatcttgttagtagtgtttcatcaagtatgctcttttgtttct

SEQ ID NO: 1649 - DNA, 700 bp, Zea mays
ccaccctattaatcctcgtccctctcgcgctgagcgctccaatttcctccacttcccaaaccctaccggcggcgcagcagcatcacaaccaccgcccgaagatggtgaagtttctcaagcccggcaaggccgtaatcctcctccagggcaggttcgccggccggaaggcggtgatcgtgcgcgtgttcgaggagggcacccgcgaccgtccctatgggcactgcctcgtcgccggcctggccaagtaccccaagaaggtgatccgcaaggactccgccaagaagacggccaagaagtcccgcgtcaagtgtttcatcaagctcgtcaatttcactcacctcatgcccacccgctacaccctcgacgtcgatttcaaagacgtcgcctcgggcgggcccgacgcgctctccacccgggacaagaaggtcgaagcctgcaaggccgccaaggcgcgcctcgaggagaggttcaagaccggcaagaacaggtggttctttaccaagctccgcttctaggcgccgggcaccccgcatagtgactactttagttgtcaatttgttgtatcggaaaccatttaagctatttctgttttggtattgcgcttgttatggatctcggagaagattttgttaaaaacatgtcgatgatgtgttaaatgatgcccaaaggaaacgtctcgttgaacttttgctgagaatca

SEQ ID NO: 1650 - DNA, 1070 bp, Zea mays
tccctcttccccccactacccaaacccaacaggcggcgcagcagcatcgccaccaccgtccaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgacttcaaggacgtcgcatcgggcgggcccgacgcgctctccacccgggacaagaaggtcgaagcctgcaaggccgccaaggcgcgcctcgaggagaggttcaagaccggcaagaacaggtggttctttaccaaactccgcttctagacgtcgggcgtccctcatagtgtctgatttagttgtcaatttcttgtacctgaaaccctttaaggtatctctgttttgctatttccatgaaggcttcgtgcttggtatggatcttggagaggattttgttaaaaacatgtcgatgatgttaaattatgccaaagcacacatatggttggattttgtggagaatctgcttgtgacgtgctgttaaccttctgtgcagttagtcttgcgggtctcagattttgttgacgcatcttataggcctccatcactgaatgtttcttggtttacagatgtggtttactgccctgtattcattaacacaattgaagttagaaatgcgtctttttagttttagggccttaatctttgagtaatcaacacttcaactatgttaatgtatcaaaagtagtgcattttcctggatggttaccctttcagtttgttgctgtttttgctggtatgtgccgagtgttcataaaatggcaatttaaacattcgtttaatggtggtgaaattgtatagatatgtacaattgtatggattgttggcacagaatcgaagactggtaattgctttgattaa

SEQ ID NO: 1651 - DNA, 725 bp, Pennisetum glaucum
cctcccaaacactcctcaccctcccaccccggcggcggcggcggcgcagcagcagctcaagatggtgaagttcctcaagccaggtaaggccgtgatcctcctccagggtcggttcgccggccggaaggcggtgatcgtgcgcgtgttcgaggagggcacccgcgaccgcccctacggccactgcctcgtcgccggcctcgccaagtaccccaagaaggtgatccgcaaggactccgccaagaagacggcgaagaagtcccgtgtcaagtgcttcatcaagctcgtcaacttcacccacatcatgcccacccgctacaccctcgacgtcgacttcaaggacgtcgcctcgggcgggcccgacgcgctctccacccgcgacaagaaggtcgccgcctgcaaggccgccaaggctcgcctcgaggagaggttcaagacaggcaagaacaggtggttctttaccaagctccgcttctagatgccgggcatccagcatagtccctgctttagctctcaaaatttgtaccggacacctttaagctagctctgttttggtattgccatgaagactccgtgcttactattatggatcttggagaggatcataatgagatgtcgatggtgtgtcaaatgatgtcaatcctagatcttgttgaaattttgtttcagagattgcttgttatgtgttctcacatgtttaatcttgcttgtgttatttgagaattgag

SEQ ID NO: 1652 - DNA, 625 bp, Avena sativa
aagatggtgaagttcctgaagcccggcaaggcggtgatcctgctgcagggccggttcgccggcaagaaggcggtgatcgtgcgcgtgttcgaggagggcacccgggaccgcccctacggccactgcctcgtcgccggcctcgccaaataccccaagaaggtgatccgcaaggactcggcgaagaagacggccaagaagtcccgcgtcaagtgcttcctcaagctcgtcaacttcacccacctcatgcccacccgctacaccctcgacgtcgacctcaaggacgtcgccaccggcgggccggacgccctcgccacaaaagacaagaagatcgcctctgccaagtccgccaaggcacgtctcgaggagaggttcaagaccggcaagaacaggtggttcttcaccaagcttcgcttctaggatcgacgcatcttcactagtaccctttagttgcctgttctttctatcaatcactacactaaacttcctatgttttggtatcttccataagatggttagtgtggctctcggagaggagtttaattaagacatgataatgttttgtgtgttaaatcattctacagatacatctggttgcaattttgaagtacttcctgtgctaaagttt

SEQ ID NO: 1653 - DNA, 1104 bp, Panicum virgatum
cgagccaagatcagacccaaggccgacccaccaccacccctgaaggcccagcgcagaagcaccgtccaatcctgaatccaaccgtcaaaacgcgtccgccctccgcgaaccctagcgccgccaccctatttaatcctctctctccatcaacgcagagtggccatttcctcaaccgaagccctacccacccatccaccccggcggcggcggcggcgtagcagcagcagaagcacccgaagatggtgaagttcctgaagcccggcaaggccgtgatcctcctccagggccggttcgccggccgcaaggcggtgatcgtgcgcgtgttcgaagagggtacccgcgaccgcccctacggccactgcctcgtcgccggcctggccaagtaccccaagaaggtgatccgcaaggactccgccaagaagaccgccaagaagtcccgcgtcaagtgcttcatcaagctcgtcaacttcacccacatcatgcccacccgctacacgctcgacgtcgacttcaaggacgtcgcctcgggcgggcccgacgcgctctctacccgggacaagaaggtcgccgcttgcaaggccgccaaggcgcgcctcgaggagaggttcaagaccggcaagaacaggtggttctttaccaagctccgcttctagatgcttggcgtcccgcatagtgcctgctttaggtgtcagtttcttgtatcggacactctttaagctatctctgctttggtattgccatgaagacttcgtgcttagtattacggatctcggagataattttattaagacatgtcgttgatgtgctaaatgttgtcaatcatagatctggctgaaattttgttccgaattgctgcttgagatgggctgattttcaccttcacttgtttggtcctgctgctgtcagatatttgtgatgcatcgtattatagctattacaactcttcattaatgtatgtccttggtttgcatataagctgctgatatggttgacagtcttggttccatgtatgttctgcattttaattgtactttaatgttaggcgaattgttctaggagccttggaatcaaactaaacagttgaatgatcaatttatgtctgta

SEQ ID NO: 1654 - DNA, 718 bp, Cenchrus ciliaris
gcgatggtgaagttcctcaagcccgggaaggcggtgatccttctgcaggggcggttcgcggggcgcaaggcggtgatcgtgcgcgtgttcgaggagggcacccgcgaccgcccctacggccactgcctcgtcgccgggctcgccaggtaccccaagaaggtcatccgcaaggactccgccaagaagacggccaagaagtcccgcgtcaagtgcttcatcaagctcgtcaacttcacccacatcatgcccacccgctacaccctcgacgtcgacttcaaggacgtcgcctctggcgggccagacgcgctctccacccgggacaagaaggtcgccgcctgcaaggccgccaaagcccgccttgaggagaggttcaagacaggcaagaacaggtggttctttaccaagcttcgcttttagatgccgggcatccagcgtagttcctgctttagctgtcaatgtatcggacaccctttaagctatgtctgttttgatattgccatgaagactccctgcttactattatggatcttggaaaggatcacatgtcgatgatgtgtcaaatgatgtcaatcatagatcttgttgaattttgtttcagagattgcttgttatgtgttctcacatgtttaatcttgcgcgttatttgagaattgagatgcctggtgcaacttattgtttttcccatcttattcctattattacaagtcttcattaattt

SEQ ID NO: 1655 - DNA, 769 bp, Zea mays
gatttgacccatctcccaacccctacactcccggcggcggcgcaggagcagcagcaccagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcatgcaaggccgccaaggcgcgcctcgaggagaggttcaagaccggcaagaacaggtggttctttaccaagctccgcttctagatggtcggcgtcccgaatggtgaccgtcggtttcttgtatgggacacactccaagccatgtctcttttcgtattgccatgaagacttcttcgtgtttagtcctggggctctcaggtatattgtgcgtgtgtacttcgaatgtttggtcttggagtcctactgaattgatgaatgttcaatttatgtcttcaggattaacagcgaatatcatttacaatcttatttatcccattggttagtttgtaaacttttaatattgagttgatcgtgaactgttatagtagcc

SEQ ID NO: 1656 - DNA, 777 bp, Sorghum bicolor
cgcgctgcgctcccatttccgcagcctcccaaaccctaccggcggcgcagcagcatcaccaccaccgcccgaagatggtgaagttcctcaagcccggcaaggccgtgatcctcctccagggccggttcgccggccggaaggcggtgatcgtgcgcgtgttcgaggagggcacccgcgaccgcccctacggtcactgcctcgtcgccggcctcgccaagtaccccaagaaggtgatccgcaaggactccgccaagaagacggccaagaagtcccgcgtcaagtgcttcatcaagctcgtcaacttcacccacctcatgcccacccgctacaccctcgacgtcgacttgaaggacgtcgcctcgggcgggcccgacgcgctctccacccgcgacaagaaggtcgaggcctgcaagaccgccaagtaccgtctcgaggagaggttcaagagcggcaagaacaggtggttctttaccaagctccgcttctagatgccgggcgtcccgcatagtgtctgctttagttgtcaatttactgtattgggaactccttaagctatctctgttttgctattgccatgaaggcttcgtgcttggtatggatctcggagaagattttgttaaaaacatgtcgatgatgtgttaaatgatgccaaaggatacatctggttgaaattttgttcagaatcactgcttgtgatgtgctgttaatcttcttgttgagaatcactgcttgcgatgtgctgttaatcttctgcgttcttagtcatccgggtctcag

SEQ ID NO: 1657 - DNA, 418 bp, Avena sativa
attttggtgaagttcctgaagaccggcaaggcggtgatccttctccagggccggttcgccggccggaaggcggtcattgtgcgcgttttcgaggagggcacacgcgaccgcccctacgggccacgtgcctcgtcgccggcctagccaagtacccaaagaaggtgatccgcaaggactcggccaagaagacggccaagaagtcgcgcgtgaagtgcttcctgaagctggtcaacttcacccacatcatgcccacccgctacaccctcgacgtcgacttcaaggacgtcgcctccggcgggcccgacgccctcgccacccgcgacaagaaggtcgcctcctgcaaggccgccaaggcacgtctcgagagaggttcaagaccggcaagaacaggtggttcttcaccaagctccgcttctag

SEQ ID NO: 1658 - DNA, 707 bp, Cenchrus ciliaris
aagatggtgaagttcctcaagcccggtaaggccgtgctcctcctccagggccgtttcgctggccggaaggcggtgatcgtgcgcgtgttcgaggagggcacccgcgaccgcccctacggccactgcctcgtcgccggcctcgccaagtaccccaagaaggtgatccgcaaggactccgccaagaagacggccaagaagtcccgcgtcaagtgcttcatcaagctcgtcaacttcacccacatcatgcccacccgctacaccctcgacgtcgacttcaaggacgtcgcctctggcgggccagacgcgctctccacccgggacaagaaggttgccgcctgcaaggcggtcaaggcgcgcctcgaggagaggttcaagacaggcaagaacaggtggttctttaccaaactccgcttctagatgcctggcatccagcatagtgcctgctttagctgtcgatttctgtatcggacaccatttaagctatctctgttttagtattgccatgccatgaagactccgtgcttactattatggatcttggagagatcacatgttgatgatgtgtcaaatgatgtcaatcatagatcttgttgaaattttgtttcagagattgcttgttatgtgttctcacatgtttaatcttgcttgtgttatttgagaattgagatgtctggtgcaacttatttgttttacccatcttattccta

SEQ ID NO: 1659 - DNA, 689 bp, Avena sativa
cacccaaaccctacccaaatccacctgcgtcggcggcggcggagcacgagaagatggtgaagttcctgaagcctggcaaggcggtgatccttctccagggtcggttcgccggcaagaaggcggtgattgtgcgtgtcttcgaggagggcacccgcgaccgcccatacggccactgcctcgtcgccggtctcgccaagtaccccaagaaggtgatccgcaaggactcggccaagaagacggccaagaagtcgcgcgtgaagtgcttcctgaagctcgtcaacttcacccacctcatgcccacccgctacaccctcgacgtcgacctcaaggacgtcgccactggcgggccggacgccctcgccattaaagacaagaagatcgagtctgccaagtcagccaaggcacgtcttgaggagaggttcaagaccggcaagaacaggtggttcttcaccaagcttcgcttctaggagcaacgcaccttcactagtacttttagttgcctgttctttctatcaatccatacactaagctatatctatgttttggtattgcccatgaagatggttagtgtggatctcggagagtttaattaagagatgataatgttttgtgtgttaaatcatgctaaagatacatctggttgcaattttgaagttcatcctgagagtcgtgggaggcaaggcacacga

SEQ ID NO: 1660 - DNA, 599 bp, Avena sativa
acgcgaagatggtgaagttcctgaagcccggcaaggcggtgatcctgctgcagggccggttcgccggcaagaaggcggtgatcgtgcgcgtgttcgaggagggcacccgggaccgcccctacggccactgcctcgtcgccgggctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacctcaaggacgtcgccactggcgggccggacgccctcgccattaaagacaagaagatcgagtctgccaagtcagccaaggcacgtcttgaggagaggttcaagaccggcaagaacaggtggttcttcaccaagctccgcttctagacccgcccgcccgccggtgcagagcagagcagagcaggctcttcgagtactaccaccccccgctttacatttagtttgccttgtccttggtaatcagtcgcctccgctaagatattgttctctgttttgttattgagcatgaagaagactctgtgttttagtgtggatcttgtaatg

SEQ ID NO: 1661 - DNA, 963 bp, Saccharum officinarum
ctcccaaaccctaccggcggcgcaccaccaccaccaccaccaccacccgaagatggtgaagttcctcaagcccggcaaggccgtgatcctcctccagggccggttcgccggccggaaggcggtgatcgtgcgcgtgttcgaggagggcacccgcgaccgcccctacgggcactgcctcgtcgccggcctcgccaagtaccccaagaaggtgatccgcaaggactccgccaagaagacggccaagaagtcccgcgtcaagtgcttcatcaagctcgtcaacttcacccacctcatgcccacccgctacaccctcgacgtcgacttcaaggacgtcgcctcgggcgggcccgacgcgctctccacccgggacaagaaggtcgaggcctgcaagaccgccaagtaccgcctcgaggagaggttcaagagcggcaagaacaggtggttctttaccaagctccgcttctagatgctcggcgtccagcatagtggctgctttagttgtcaattttctgtattggaaaccatttaagctatctctgtgttgctattgccatgaaggcttcgtgcttggtatggatctcggagaagattttgttaaaaacatgtcgatgatgtgttaaatgatgccaaaggatacatctggttgaaattttgttgaaaatccctgcttgggatttgccaaaaaaaaaaaaaaaaaacaaaaaggggggccgtttttaaaggaatccaagttttcgtacaccgtgcttggacacgcaataaactcttttattagggggcctccttaattaagattcactgggtcgtggttttaacaaaccctcgacccgagaaaaaacctgttgtgggcccagatttatatgtgtttgggtacaattctcctttaagtgagggtgggttattataaagaaaagaggccccgtaccgcaatcgtccttattccaacaatttgcgcccaccctc

SEQ ID NO: 1662 - DNA, 1055 bp, Panicum virgatum
aaggcccagtgccgcagcaccgtccgatctcgtatccaacagccgatacccgctcaccctcctcgaaaccctaacgccgccaccctattaattctcgcccctccctcgctcaccatttttctccacctcccgtgccctccccccaccttcccacctctgcggcgcagcagcagcagctgaagatggtgaagttcctgaagcccggcaaggccgtgatcgtccttcagggtcggttcgccggccggaaggcggtgatcgtgcgcgtgttcgaggagggcacccgcgaccgcccctacgggcactgcctcgtcgccggcctcgccaagtaccccaagaaggtgatccgcaaggactctgccaagaagacggccaagaagtcccgggtcaagtgcttcatcaagctcgtaaacttcacccacatcatgcccacccgctacacccttgacgtcgactttaaggacgtcgcctcgggcgggcccgacgcgctctccacccgggacaagaaggtcgccgcctgcaaggccgcgaagtaccgcctcgaggagaggttcaagacaggcaagaacaggtggttctttaccaagctccgcttctagatgccgggcgtccagcatagtacctgctttagttgtcaatttcatgtgtcagacacccttatctctgttttggtattgccattaagacttcgtgcttatggatcttggagagtatgacatgtcgatgatgtgttaaatgatgtcaatcatagatcttgtccaaattttgttcagaatcattgcttggaatgtgctgttctcaaaatttgcaatcttgctggtgttagatattcgagatgcatcacctaagccttcattactacgacttcatggtccttgtttacatgcgagttatggctgatatggtttactattgtttcaacttttactattaggcaattgtgttagtagcgttgcagtcaaattaaattgttgaatggtcaatttaagtagttatgcctatttaaggtgtcagctgtgttagtagcctttcagtctgatatcattgctaattttgtt

SEQ ID NO: 1663 - DNA, 703 bp, Avena sativa
cccgaaccctccccaaccccagcggcggcggcgcagcagcagcaggcaggacgcgaagatggtgaagttcctgaagcccggcaaggcggtgatcctgctgcagggccggttcgccggaaagaaggcggtgatcgtgcgcgtgttcgaggagggcacccgggaccgcccctacggccactgcctcgtcgccggcctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacttcaaggacgtgtccgtcgccgggcccgacgcgctcgcctccaccgacaagaaggtcggcttcgccaagaccgccaaggcacgcctcgaggagaggttcaagaccggcaagaacaggtggttcttcaccaagctccgcttctagacccgcccgcccgccggtgcagagcagagcaggctcttcgagtactaccaccccccgctttacatttagtttgccttgtccttggtaatcagtcgcctgccctaagatattgttctctgttttgttattgagcatgaagaagactctgtgttttagtgtggatcttgtaatggaatatgacttttcatgtgctaaaccatgtgaagaatagatctggttggaattttgttc

SEQ ID NO: 1664 - DNA, 827 bp, Avena sativa
tcccccccacaccaccacccgaaccctccccaaccccagcggcggcggcgcagcagcagcagcagcaggcaggacgcgaagatggtgaagttcctgaagcccggcaaggcggtgatcctgctgcagggccggttcgccggcaagaaggcggtgatcgtccgcgtgttcgaggagggcacccgggaccgcccctacggccactgcctcgtcgccggcctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacttcaaggacgtgtccgtcgccgggcccgacgcgctcgcctccaccgacaagaaggtcggcttcgccaagaccgccaaggcacgcctcgaggagaggttcaagaccggcaagaacaggtggttcttcaccaagctccgcttctagacccgcccgcccgccggtgcagagcagagcaggctcttcgagtactaccaccccccgctttacatttagtttgccttgtccttggtaatcagtcgcctgcgctaagatattgttctctgttttgttattgagcatgaagaagactctgtgttttagtgtggatcttgtaatggaatatgacttttcatgtgctaaaccatgtgaagaatagatctggttggaattttgttcaggattttacgacatgttatatgctgtctagtttctcctaatatttatattgtgtattgttcggtcttggtggttgattatatatcgtgcattccatctct

SEQ ID NO: 1665 - DNA, 766 bp, Avena sativa
acgcgaagatggtgaagttcctgaagcccggcaaggcggtgatcctgctgcagggccggttcgccggcaagaaggcggtgatcgtgcgcgtgttcgaggagggcacccgggaccgcccctacggccactgcctcgtcgccggcctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacttcaaggacgtgtccgtcgccgggcccgacgccctcgccagctccgacaagaaggtcggcctcgccaaggccgccaaggcacgcctcgaggagaggttcaagaccggcaagaacaggtggttcttcaccaagctccgcttctagacccgcccgcccgccggtgcagagcagagcaggctcttcgagtactatcaccccccgctttacatttagtttgccttgtccttggtaatcagtcgcctgcgctaagatattgttctctgttttgttattgagcatgaagaagactctgtgttttagtgtggatcttgtaatggaatatgacttttcatgtgctaaaccatgtgaagaatagatctggttggaattttgttcaggattgcgaactgtgatatgctgcctgtctagtttctcctaatattgttattttgtatgctttaatcttggtggatgattatatatcatgcattccatctctgtttggctag

SEQ ID NO: 1666 - DNA, 700 bp, Avena sativa
cacccaaaccctacccaaacccacctgcggcggcggcggagcacgcgaagatggtgaagttcctgaagcccggcaaggcggtgatcctgctgcagggccggttcgccggcaagaaggcggtgatcgtgcgcgtgttcgaggagggcacccgggaccgcccctacggccactgcctcgtcgccggcctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacttcaaggacgtgtccgtcgccgggcccgacgccctcgccagctccgacaagaaggtcggcctcgccaaggccgccaaggcacgcctcgaggagaggttcaagaccggcaagaacaggtggttcttcaccaagctccgcttctagatacccaccgcccgcagcagagcagtgtctgcgagtactaccacccccgcttttctacatttagtttgccttgtcctcggtaatcagtcccctgcgctaaagatattgttatctgttttgttattgagcatgatgaagaagactctgtgttttagtgtggatcttgtgatggaatatgacgtttcatgtgctaaaccatgtgaagaatagatctggttggaattttgttcaggatt

SEQ ID NO: 1667 - DNA, 607 bp, Cenchrus ciliaris
tgaagttcctcaagcccgggaaggcggtgatccttctgcaggggcggttcgcggggcgcaaggcggtgatcgtgcgcgtgttcgaggagggcacccgcgaccgcccctacggccactgcctcgtcgccgggctcgccaggtaccccaagaaggtcatccgcaaggactccgccaagaagacggccaagaagtcccgcgtcaagtgcttcatcaagctcgtcaacttcacccacctcatgcccacccgctacaccctcgacgtcgacctcaaggacgtcgcggctgggaccgacgcgctcgccagcagggacaggaaggtcgacgcctgcaagaccgccaagtatcgcctacgaggagaggttcaagaccggcaagaacaggtggttctttaccaagctccgtttctagatgccgggcgtcctgcatagtgccctgctttagttgtcagtttcttgtatcagatactgttttaagctatctctgttttggtattgccatggagacttggtacttagtattacggatatgtcggagagaaatttattaagacatgtcaatgatgcgctaaatgttgtcacatagatctggcggaaattttgttcagaat

SEQ ID NO: 1668 - DNA, 504 bp, Hordeum vulgare
gaataacctagaagcggagcttggtgaagaaccacctgttcttgccggtcttgaacctctcctcgagcttggccttggcggacttggcggcggtgagcttcttgtccttggtggtgagggagtcgggggcgccggaggccacctccttgaggtcgacgtcgagggtgtagcgggtgggcatgaggtgggtgaagttgacgagcttgaggaagaccttgacgcgcgacttcttggccgtcttcttcgccgagtccttgcggatcaccttcttggggtacttcgccaggccggcgacgaggcagtggccgtaggggcggtcgcgggtgccctcctcgaagacgcggacgatcaccgccttcttccccgcgtacctgccctgcagcaggatcaccgccttcccgggcttgaggaacttcaccatcttcttcgactcttctcctcgcgcagcggcgccgccggtgggttggaggttgggggaggggttggaggatgtgggcgggggaa

SEQ ID NO: 1669 - DNA, 789 bp, Secale cereale
cccctcccccaacccaccaccggcggcggcgcagcgcgagagaggagaagcgaagatggtgaagttcctgaagcccggcaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtcttcctcaagctcgtcaacttcacccacctcatgcccacccgctacaccctcgacgtcgacctcaaggaggtggcctccggcgcgcccgaccccctcacccaccaaggaccaagaagatcaccgccgccaagtccgccaaggccaagctcgaggagaggttcaagaccggcaagaacaggtggttcttcaccaagctccgcttctaggccgttcttccgtccgcgcagcagccgtccgcttcagggccgtcggtctctgccgttactacccgtttacattttttagctgcttgctcttggtatccgtccctgttttggtattgcccatgaagactctgtgtttagctttggatcttatgagatatgatgatgtttcatgtgttaaatcatgtgaagaatagatcttgtttggaattttgttcagcgttattaccctgcttgctgccgtatgctgtctattgtgtcctaatagtattgttgtatggatttcagtctcggtggtgaattatattgcatctctttgtt

SEQ ID NO: 1670 - DNA, 495 bp, Hordeum vulgare
cccacagcccccaacccctcccccaacctccaacccaccggcggcgccgctgcgcgaggagaagagtcgaagaagatggtgaagttcctcaagcccgggaaggcggtgatcctgctgcagggcaggtacgcggggaagaaggcggtgatcgtccgcgtcttcgaggagggcacccgcgaccgcccctacggccactgcctcgtcgccggcctggcgaagtaccccaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgcttctaggttatt

SEQ ID NO: 1671 - DNA, 499 bp, Hordeum vulgare
cccacccacagcctccaacccctcccccaacctccaacccaccggcggcgccgctgcgcgaggagaagagtcgaagaagatggtgaagttcctcaagcccgggaaggcggtgatcctgctgcagggcaggtacgcggggaagaaggcggtgatcgtccgcgtcttcgaggagggcacccgcgaccgcccctacggccactgcctcgtcgccggcctggcgaagtaccccaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgcttctaggttatt

SEQ ID NO: 1672 - DNA, 579 bp, Festuca arundinacea
gcgaagatggtgaagttcctcaagcccggcaaggcggtgatcctcctccagggtcggttcgccggcaagaaggccgtgattgtgcgcgtcttcgaggagggcacacgcgaccgcccctacggccactgcctcgtcgccggcctcgccaagtaccccaagaaggtgatccgcaaggactcggccaagaagacggccaagaagtcgcgcgtcaagtgcttcctcaagctcgtcaacttcacccacctcatgcccacccgctacaccctcgacgtcgacctcaaggacgtcgcctccggcgggcccgaggccctcgccaccaaagacaagaagatcgaatccgccaaggccgccaaggaacgcctcgaggagaggttcaagaccggaaagaacaggtggttcttcaccaagcttcgcttctaggagcaaagcgtctttacaatacttctagtagttgcttgttctttctatcaatcccctacactaagcaatctatgttttggtattgcccatgaagattggttagtttggatctctcagagaaatttgatttttgtgtgttaaatcacgctaaggatgcct

SEQ ID NO: 1673 - DNA, 456 bp, Lolium multiflorum
caccacccaaactctcccccaacccaccggcggcggcgcagcagcaggtaagatggtgaagtttctcaagcccggcaaggccgtgatcctgctgcagggccggttcgccggcaagaaggcggtgatcgtgcgcgtgttcgaggagggcacacgggaccgcccctacgggcactgcctcgtcgccggcctcgccaagtacccgaagaaggtgatccgcaaggactcggccaagaagacggccaagaagtcgcgcgtcaagtgcttcctcaagctcgtcaacttcacccacctcatgcccacccgctacaccctcgacgtcgacctcaaggacgtcgcctccggcgggcccgacgccctcgccaccaaggacaagaaggtcgagtccgccaaggcagccaaggcgcgtctcgaggagaggttcaagaccgggaagaacaggtggttcttcaccaagct

SEQ ID NO: 1674 - DNA, 625 bp, Pennisetum glaucum
cctcccctgcggcggcgcagcagcggcaaccgaagatggtgaagttcctgaagcccggcaaggccgtgctcctcctccagggtcggttcgccggctgcaaggcggttatcgttcgcgtgttcgaggagggcacccgcgaccgcccctacgggcactgcctcgtcgccggcctcgccaagtaccccaagaaggtgatccgcaaggactccgccaagaagacggccaagaagtcccgtgtcaagtgcttcatcaagctcgtcaacttttcccatatcatgcctacccgctacaccctcgacgtcgacttcaaggacgtcgcctccagctgccccgacgcgctctccacccgggacaagaaggtcgccgcctgcaaggccgccaaggcgcgccttgaggagaggttcaagaccggcaagaacaggtggttctttaccaagctccgtttctagatgccggaccgcctgcatagtgccctgctttagttgtcagtttcttgtatcagatactcttttaagctatctctgctttggtattgccatggagacttggtacttaatattacggatatcggagagaattttattaagacatgtcaatgatgtgttaaatgttcccatagatctgg

SEQ ID NO: 1675 - DNA, 1003 bp, Avena sativa
aaaccctagcgccgccacctacataatctccgtcccttcaatttctcccccatttcccacatcacccaaaccctacccaaacccatctgcggcggcggcggagcacgcgaagatggtgaaattcctgaagcccggcaaggcggtgatccttctgcagggtcggttcgccggcaagaaggcggtgatcgtgcgtgtcttcgaggagggcacccgcgaccgcccctacggccactgcctcgtcgccggcctcgccaaataccccaagaaggtgatccgcaaggactcggccaagaagacggccaagaagtcgcgcgtgaagtgcttcctgaagctcgtcaacttcacccacctcatgcccacccgctacaccctcgacgtcgacttcaaggacgtgtccgtcgccgggcccgacgcgctctcctccaccgacaagaaggtcggcttcgccaagaccgccaaggctcgcctcgaggagaggttcaagaccggcaagaacaggtggttcttcaccaagctccgcttctagacccgcccgccccccggtgcagagcagagcaggctcttcgagtactaccacctccgctttacatttagtttgccttgtccttggtaatcagtcgcctgcgctaagatattgttctctgttttgttattgagcatgaagaagactctgtgttttagtgtggatcttgttatggaatatgacttttcatgtgctaaaccatgtgaagaatagatctggttggaattttgttcaggattttactacatgtgatatgctgtctagtttctcgtcatattgttattttgtatggttcggtcttggtggttgattatcaacttgacaaaagcccatgtcctgtagtcagtttctcctcaggcacatcacttatagatgcagtctgttgttttcaagttcgccttcctcaacagttagtaagggtcttaagtggtaatcgtccgttccggtccttcacgtcggaccaacgtaacaaggaagacg

SEQ ID NO: 1676 - DNA, 670 bp, Avena sativa
ggcaggacgcgaagatggtgaagttcctgaagcccggcaaggcggtgatcctgctgcagggccggttcgccggcaagaaggcggtgatcgtgcgcgtgttcgaggagggcacccgggaccgcccctacggccactgcctcgtcgccggcctcgccaagtacccgaagaaggtgatccgcaaggactcggcgaagaagacggccaagaagtcccgcgtcaagtgcttcctcaagctcgtcaacttcacccacctcatgcccacccgctacaccctcgacgtcgacttcaaggacgtgtccgtcgccgggcccgacgcgctctcctccaccgacaagaaggtcggcttcgccaagaccgccaaggctcgcctcgaggagaggttcaagaccggcaagaacaggtggttcttcaccaagctccgcttctagacccgcccgcccgccggtgcagagcagagcaggctcttcgagtactaccaccccccgctttacatttagtttgccttgtccttggtaatcagtcgcctgcgctaagatattgttctctgttttgttattgagcatgaagaagactctgtgttttagtgtggatcttgttatggaatatgacttttcatgtgctaaaccatgtgaagaatagatctggttggtaattttgttctaggtatttt

SEQ ID NO: 1677 - DNA, 765 bp, Secale cereale
ccccagacccctcccccaacccaccaccggcggcggcgcagcgcgagagaggagaagcgaagatggtgaagttcctgaagcccggcaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcaccaccaaggacaagaagatcaccgccgccaagtccgccaaggccaagctcgaggagaggttcaagaccggcaagaacaggtggttcttcaccaagctccgcttctaggccagccgtccgtccgcgcagcagccgtccgcttcagggccgtcggtctctgccgttactacccgtttacatttttagctgcttgctctttggtatccgtccctgttttggtgtttgcccatgaagactctgtgtttagcttggatcttatgagatatgatgacgtttcatgtgttaaatcatgtgaagaatagatcttgtttggaattttgttcagctttattaccctgcttggtgccatgtgctgtctgttgtgtcctaatagtactgttgtatggattacagtctt

SEQ ID NO: 1678 - DNA, 721 bp, Secale cereale
tccacagcccacagacccctcccccaacccaccaccggcggcggcgcagcgcgagagaagaaggaggagaagcgaagatggtgaagttcctgaagcccgggaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcaccaccaaggacaagaagatcaccgccgccaagtccgccaaggccaagctcgaggagaggttcaagaccggcaagaacaggtggttcttcaccaagctccgcttctaggccgtccctccgtccctccgtccgcgcagcagcgggcggtcggcctctgccgttactacccgaaccctttacttttttagttgcttgttatcggtgactgttgctgcgcttaagatgtcctgttttggtattgcccatgaagactctgtgtttagcttggatcttatgagatatgatgatgtttcatgtgttcaatcatgtgaagaatagatcttgtttggaattttgtt

SEQ ID NO: 1679 - DNA, 770 bp, Secale cereale
ccccaacccaccaccggcggcggcgcagcgcgagagaggagaagcgaagatggtgaagttcctgaagcccggcaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcaccaccaaggacaagaagatcaccgccgccaagtccgccaaggccaagctcgaggagaggttcaagaccggcaagaacaggtggttcttcaccaagctccgcttctaggccgttcttccgtccgcgcagcagccgtccgcttcagggccgtcggtctctgccgttactacccgtttacatttttagctgcttgctctttggtatccgtccctgttttggtattgcccatgaagactctgtgtttagcttggatcttatgagatatgatgacgtttcatgtgttaaatcatgtgaagaatagatcttgtctggaattttgttcagcgctattacttgcttgctgccatgtgctgtctgttgtgtcctaatagtactgttgtatggattacagtcttgtggtgaattattttgcatc

SEQ ID NO: 1680 - DNA, 766 bp, Secale cereale
cccaacccctcccccaacccaccaccggcggcggcgcagcgagagagagagaggaggagaagatggtgaagttcctgaagccgggcaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtcttcctcaagctcgtcaacttcacccacctcatgcccacccgctacaccctcgacgtcgacctcaaggaggtggcctccggcgcgcccgactccctcaccaccaaggacaagaagatcaccgccgccaagtccgccaaggccaagctcgaggagaggttcaagaccggcaagaacaggtggttcttcaccaagctccgcttctaggccgttcttccgtccgcgcagcagccgtccgcttcagggccgtcggtctctgccgttactacccgtttacatttttagctgcttgctcttggtatccgtccctgttttggtattgcccatgaagactctgtgtttagcttggatcttatgagatatgatgatgtttcatgtgttaaatcatgtgaagaatagatcttgtttggaattttgttcagcgttattaccctgcttgctgccgtatgctgtctattgtgtcctaatagtattgttgtatggatttcagtctcggt

SEQ ID NO: 1681 - DNA, 809 bp, Secale cereale
ccctcccccaacccaccaccggcggcggcgcagcgcgagagagagaggaggagaagatggtgaagttcctgaagcccggcaaggcggtgatcctgctgcagggcaggtacgccgggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcccccgactccctcaccaccaaggacaagaagatcaccgccgccaagtccgccaaggccaagctcgaggagaggttcaagaccggcaagaacaggtggttcttcaccaagctccgcttctaggccgtccctccgtccgtccgtccgcgcagcagcgggcggtcggcctctgccgttactacccgaaccctttacttttttagttgcttgttatcggtgactgttgctgcgcttaagatgtcctgttttggtattgcccatgaagactctgtgtttagcttggatcttatgagatatgatgatgtttcatgtgttaaatcatgtgaagaatagatcttgtttggaattttgttcagcgttattaccctgcttgctgccatatgctgtctgttgtgttctaatagtattgttgtatggatttcagtctcggtggtgaattatattgcatctcctaaaaaaaaa

SEQ ID NO: 1682 - DNA, 759 bp, Secale cereale
gactcctcaagctcccagacccctccccaacccacccacccaccgcggcggcgcagcgcgagagaggaggagaagatggtgaagttcctgaagcccgggaaggcggtgatcctgctgcagggcaggtacgcggggaagaaggcggtgatcgtgcgcgtgttcgaggagggcacccgcgaccgcccctacgggcactgcctcgtggccgggctggccaagtaccccaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcaccaccaaggacaagaagatcaccgccgccaagtccgccaaggccaagctcgaggagaggttcaagaccggcaagaacaggtggttcttcaccaagctccgcttctaggccgtccctccgtccgtccgtccgcgcagcagcgggcggtcggcctctgccgttactacccgaaccctttactttttagttgcttgttatcggtgactgttgctgcgcttaagatgtcctgttttggtattgcccatgaagactctgtgtttagcttggatcttatgagatatgatgatgtttcatgtgttaaatcatgtgaagaatagatcttgtttggaattttgttcagcgttattaccctgcttgctgccatatgctgtctgttgt

SEQ ID NO: 1683 - DNA, 803 bp, Pseudoroegneria spicata
accctcccctccccccgaaacccaccggcggcggcgcagcgcgaggaagagaagatggtgaagttcctgaagcccggcaaggcggtgatcctgctgcagggcaggtacgcggggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtcttcctcaagctcgtcaacttcacccacctcatgcccacccgctacaccctcgacgtcgacctcaaggaggtggcctccggcgcgcccgactccctcacccccaaggacaagaagatcagcgccgccaagtccgccaaggccaagctcgaggagaggttcaagaccggcaagaacaggtggttcttcaccaagctccgcttctaggccgcccggcttgccgcccgcgcagcagcaggccacgcccccgccctccctcccaccacccctttccatttttagttgcttgctcctggtaactgttgctgcacttaagatctcctgttttggtattgcccatgaagactctgtgtttagcgtcgatcttatgagatatgatcatgtttcatgtgttgaatcatgtgaagaatagatcttgttggaattttgttcagcgttattacttggtgagatatgctgtctgttgtgccctaatgttattgttgtatgggttgtagtcttggtggtgaattatattgcatctctctgttagtgtgtctcca

SEQ ID NO: 1684 - DNA, 809 bp, Triticum aestivum
gcgcccgccccacagagagagagagagaccacagacccctcccctcccctcccctcccccaacccaccggcggcggcgcagcgcagcttgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccgtacgggcactgcctcgtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccgccaaggccgccaaggccaagctcgaggagaggttcaagaccggcaagaacaggtggttcttcaccaagctccgcttctaggccggccggccgcgccagggcggtctctgccgttattactacccgaaccctttacatttttagttgcttgttatcggtgactgttgctgcgcttaaggtgtcctgttttggtattgcccatgaagaagactctgtgtttagcttggatcttatgagatatgatgatgtttcatgtgttaaatcatgtgaagaatagatctttgttggaattttgttcagtgttattacttcttgagatatgctgtctgttgcgtcctaatattattgttgtatgggttgtagtcttggtg

SEQ ID NO: 1685 - DNA, 825 bp, Triticum aestivum
ggtggcgcccgctctagaactagcggatcccccgggccgcaggaattcggcacgaggcccaaacccaccaccggcggcggcgcggcgcagctcgaggaaggaggcgaagatggtgaagttcctgaagcccggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgccgccaaggccgccaaggccaagctcgaggagaggttcaagaccggcaagaacaggtggttcttcaccaagctccgcttctaggcctgcaggccgaccgcgcagggcgtttctctgccgttactacctgaacccgtttacatttttagctgcttgctcttggtatccgtccctgttttggtaattgcccatgaagactctgtgtttagcgtggatcttatgagatatgatggtgtttcatgtgttgaatcatgtgaagaatagatctttgttggaattttgttccgcgttattacttcgtgagatatgctgtctgttgtgtcttaatattattgttttgtaatgattttggtataatctatcttgctcttgtggtgttctggttc

SEQ ID NO: 1686 - DNA, 729 bp, Triticum aestivum
gtcgcggccgaggtcccacaacccctccccaacccaccaccggcggcggcgcagcgcgaggaagaggaagcgaagatggtgaagttcctgaagccgggcaaggcggtgatcctgctgcagggaaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaaaaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgccgccaaggccgccaaggccaagctcgaggagcggttcaagaccggcaagaacaggtggttcttcaccaagctccgcttctaggccatccgtttgaccggtcgcgcagggttgtctctgccgttactactacccgaaccctttacatttttagttgcttgttatcggtgactgttgctgcgcttaagatgtcctgttttggtattgcccatgaagaagactctgtttagtgtggatcttatgagatatgatgatgtttcatgtgttgaatcatgtgaagaatagatctttgttggaattttgttgagcgttattacttcttga

SEQ ID NO: 1687 - DNA, 409 bp, Avena sativa
agatggtgaagttcctgaagcccggcaaggcggtgatcctgctgcaggggaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccgccaaggccgccaaggccaagctcgaggagaggttcaagaccggcaagaacaggtggttcttcaccaagctccg

SEQ ID NO: 1688 - DNA, 414 bp, Hordeum vulgare
gaagatggtgatgttcctgaagccggccaaggcgatgatcctgctaccgggtaggtacgccgggaagaaggcggtgatcgtccgcgtcttcgaggagggcacccgcgaccgcccctacggccactgcctcgtcgccggcctggcgaagtaccccaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgcat

SEQ ID NO: 1689 - DNA, 412 bp, Hordeum vulgare
gaagatggtgatgttcctgaagccggccaaggcgatgatcctgctaccgggtaggtacgccgggaagaaggcggtgatcgtccgcgtcttcgaggagggcacccgcgaccgcccctacggccactgcctcgtcgccggcctggcgaagtaccccaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgc

SEQ ID NO: 1690 - DNA, 532 bp, Secale cereale
cccacacaacccactcggcggcggcggagcacgcgaagatggtgaagttcctgaagcccggcaaggcggtgatccttctccagggtcggttcgccggccggaaggctgtaattgtgcgcgttttcgaggagggcacacgcgaccgcccctacggacactgcctcgttgccggcctagccaagtaccccaagaaggtgatccgcaaggactcggccaagaagacggcgaagaagtcgcgcgtgaagtgcttcctgaagttggtcaacttcacccacatcatgcccacccgctacaccctcgacgtcgacttcaaggacgtcgcctccggcgggcccgacgccctcgccacccgcgacaagaaggtcgcctcctgcaaggccgccaaggcacgtctcggaggagaggttcaagaccggcaagaacaggtgttcttcaccaagctccgcttctaggagcagagcgtactttacaatactagtagttcttgtcttgcaatacaagtagcgacactgagctatctctatcactgttt

SEQ ID NO: 1691 - DNA, 684 bp, Secale cereale
cccacacaacccactcggcggcggcggagcacgcgaagatggtgaagttcctgaagcccggcaaggcggtgatccttctccagggtcggttcgccggccggaaggcggtaattgtgcgcgttttcgaggagggcacacgcgaccgcccctacggacactgcctcgttgccggcctagccaagtaccccaagaaggtgatccgcaaggactcggccaagaagacggcgaagaagtcgcgcgtgaagtgcttcctgaagttggtcaacttcacccacatcatgcccacccgctacaccctcgacgtcgacttcaaggacgtcgcctccggcgggcccgacgccctcgccacccgcgacaagaaggtcgcctcctgcaaggccgccaaggcacgtctcgaggagagggtcaagccggcaagacaggtgtctcaccagctccgcttctaggagcagagcttctttacaatactagtagttccttgttcttgcaagcaatagcacactgagctatctctatcactggtttttgtattgtccatgaggattttgtggttagtatggatctcggagagagtttaattaaggcatgatgatgattgtgttccatgtgttaaatcatgctaaaggatgcacattgttgcaattttgttggagcttactccctgagctgtttatttccccagtc

SEQ ID NO: 1692 - DNA, 815 bp, Ananas comosus
ggatgatcttatctccttctgaatgaatatctctctctctctctcgtcggccacatccaatccagtacagacagccatggtgaagtttctgaagccggggaaggcggtgatcgtgctgacggggaggttcgcggggcggaaggcggtgatcgtgcgggtgttcgaggaggggacgcgggaccggccgtacgggcactgcctggtggcgggggtggcgaagtacccgaagaaggtgatccggaaggactcggcgaagaagacggcgaagaagtcgcgcgtgaaggcgttcctgaaggtggtgaacttctcccacctgatgcccacccgctacaccctcgacgtcgacctcaaggacgtcgtcaccctcgactccctccagtcccgcgacaagaaggtctccgcctgcaaggaggccaaggcccgcttcgaggagcgcttcaagaccggcaagaaccgctggttcttcaccaagctccgattctgatcctcatcctcatctccgttggtacccatttcactctccttctccttttcccgattcttcttcttcttcatctttatcgttgtcgtcgtagtcgtcgttgtgtttttgcgtttgcgttttggatcgactctgtggatgttaatcggatggataatgtcaggttcaggttaagcatctactgaaggattttaattattaggctttattattactgctctttacggtttcgctggatctggatgatgagtttttatgttatagttattgttatggatcgatctattgatgtcaatcggataatgtaaggttcggattaagcatctggtgaggc

SEQ ID NO: 1693 - DNA, 656 bp, Cenchrus ciliaris
cggcaaggccgtgctcctcctccagggtcggttcgccggctgcaaggcggttatcgttcgcgtgttcgaggagggcacccgcgaccgcccctacgggcactgcctcgtcgccggcctcgccaagtaccccaagaaggtgatccgcaaggactccgccaagaagacggccaagaagtcccgtgtcaagtgcttcatcaagctcgtcaactttacccatatcatgcctacccgctacaccctcgacgtcgacttcaaggacgtcgcctccagctgccccgacgcgctctccacccgggacaagaaggtcgccgcctgcaaggccgccaaggcgcgccttgaggagaggttcaagaccggcaagaacaggtggttctttaccaagctccgtttctagatgccggaccgcctgcatagtgcgctgctttagttgtcagtttcttgtatcagatactcttttaagctatctctgctttggtattgccatggagacttggtacttaatattacggatatcggagagaattttattaagacatgtcaatgatgtgttaaatgttcccatagatctggcggaaattttggtcagaatcgctgcttggaatgcaaaaacaaactacgggacacgcacaggagtagcgagacacacagggtagtag

SEQ ID NO: 1694 - DNA, 458 bp, Panicum virgatum
gtccacctcctgagccctgcccaccctccaaccccggcggcggcagcggcggcggcggcgcagcagcagcagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatcgcccaccgctacacccttgacgtcgacttcaaggacgtcgcctcgggcggcccgacgcgctctccacccgggacaagaaggtcgccgcctgcaaggccgcgaaggcccgcctcgaggagaggttcaagacaggcaag

SEQ ID NO: 1695 - DNA, 490 bp, Hordeum vulgare
cccaacctgaaacccattggaggcggcgcaacgcgaggagaggagaaggaagatggtgaagttcttgaagcccgacaaggcggtgatcctgctgcagggtaggtacgccgggaagaaggcggtgatcgcgcgcgtgttcgaggaagtcacccgcgaccgcccctatgggcactacctggtcgtcggcctggccaaataaccgaagaaggtgacccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgcatgactcgacatgattcaagaaatgccaac

SEQ ID NO: 1696 - DNA, 810 bp, Musa acuminata
tgagcttgagaggcggcgaggcgatcggagtgggggaggaggaggagaaatggtgaagttcctgaaaccgaacaaagcggtgatcgtcctgcaaggccgttttgcggggcggaaggcggtcatcgtgcgggccttcgacgacggcacgcgggagcggccctacggccattgcctggtggccggcatcgccaagtacccgaagaaggtcatccgcaaggattcggcgaagaagacggctaagaagtctcgcgtgaaggcctttctgaagctggtgaactacagccacatcatgcccacccgttacacgctcgatgtcgatctcaaggacgtcgccaccctcgacgcgctgcagtcccgcgacaagaaggtcaccgcatgcaaggagaccaaggcccgcttggaggagcgcttcaagaccggcaagaaccggtggttcttcaccaagctcaggttctaagctaaggtagcatctatctagttctcgcaatgcgtctgctttccattaatgtgggacggttccgtgccaatgcttgttgaaatcattatatgttttagattctcgttttcgttcatctgacaatcttcattttatttggctgatctatggacgtcgttgttggtttaaatcaatcgtgtttgcctacaattgcatctttgcaagcgatccgttgaaagaaaactacaagaccatttcagtacatagattagtgattctagatttctgaacttgatgtttgttgtgtccggcttattctgatggttcagaacttatagggactgatgatgcacgtcttgttctttatcatccgg

SEQ ID NO: 1697 - DNA, 761 bp, Elaeis guineensis
ggtttgcaaagcacctccttccagtgataactcgatatccgagcagagccgccgtcgacgcgtcgtcgtcatcgtcaggtaagggaaaatggtaaagttcttgaaaccagggaaggcggtgatcgtcctccaggggcggttcgccgggcggaaggcggtgatcgtgcggtgcttcgacgagggcacccgcgaccgcccctatggccactgcctcgttgccggcatcctcaagtaccccaagaaggtcatccgcaaggattcggccaagaagacggccaagaagtcccgcgtcaaggccttcttgaagatggtgaactacagccacatcatgcccacccgctataccctggatgtggatctcaaggacgtcgtcacccttgacgttctccagtcccgggacaagaaggtggccgcctgcaaggagaccaaggcccgcttcgaggagcgcttcaagaccggcaagaaccggtggttcttcactaagctccgcttctagataaaggtatacagttcatgagattgattaccgctgtctagggtttctttcttatattgttatggatcgctttgctttgtcgtcgttgttgttatggttggtgtcatttggttttgttattggatctagtagaccttttaatgtagttggcacttaactgttttgatggagttacttggttatgtttaggatgaatggatccggatgagttcaatagatcaaaagtgcttttattaaattgcggattttgatccgtttatctttt

SEQ ID NO: 1698 - DNA, 736 bp, Elaeis guineensis
ggggagtttcctgtcgaaggagataggagaagatggtcaagttcttgaaacctgggaaggcggtgatcatccttcagggccggttcgccggcaggaaggcggtgatcgtgaggtgcttcgacgagggcacccgcgaccgtccttacggccattgcctcgtcgcgggcatcctcaagtatcctaagaaggtcatccgcaaggactcggcgaagaagacggccaagaagtcccgcgtcaaggccttcttgaaggtagtgaactacagccacatcatgcccacccgctataccctagatgtggatctcaaggacgcggtcaccctcgacgccctccagtcccgggacaagaaggtggtcgcctgcaaggagaccaaggcccgcttcgaggagcgcttcaagaccggcaagaaccggtggttctttaccaagctccgcttctaagagaggggtatacagatgagatgagataagatgctgcctactgcctagcgttactttcttattttgttttcgattgcttggcgtaatcgtcgttattgttatggttggtgtcatttggagttgtttatttgatctagtagactagttggctcgtaacagtttttgatggggtattttttcttaaccggtttatgagatgaatggatccagatgagttcgatatatgaaaatgctcttattaaaaaaaaaaaactaagagactacgtacgaacggacgacacaagggagagcgcccc

SEQ ID NO: 1699 - DNA, 689 bp, Sarracenia psittacina
gggttttatttgggaggtccgagaggaagaaggcggcgaaaccagagctctgcagagaggtgaaaatggtgaagttcttgaagcccaacaaggcggtgatagtcctccaaggccgcttcgccggccggaaggccgtcatcgtccgatcgttcgacgacggcacgcgtgaccgcccctacggccactgcctcgtagccggcatcgccaagtacccgaagaaggtgattcgcaaggactcggccaagaagaccgctaagaagtctcgcgtgaaggcgttcgtcaagctcgtcaactacaaccacatcatgcccactcgttacaccctcgacgtcgatctcaaggaagttgtcactctcgacgcccttcagtcgcgcgacaagaaggtcgcagccgccaagggggccaaggctcgattcgaggagcgtttcaagactggtaagaacaggtggttcttctccaagctccgattctgattgcaggtggatttttgctatgtttcaattatgttcttcttaatctgtagacgtgatctgccttatgtttcgtgggagatttaaggatttttttatgatatttttggtgaaatatttactttgacattttgaattgtggaggtggttcacacttcaatttttatggcgtattgaagtttgttggaataggactttgagaaactgatgggttcgttc

SEQ ID NO: 1700 - DNA, 729 bp, Musa acuminata
ggtttccacttcaagtggcggcgagggggaagggtgagcaactcggatcgatcgggaaaagaggagaagatggtgaagtttctgaagccgaacaaggcggtgatcatccttcaagggcgattcgctgggaggaaggcagtgatcgtgcgggccttcgacgacggtactcgggagcggccctacgggcactgcctggtggccggcgtcgccaagtacccgaagaaggtcatccgcaaggactcggcgaagaagacggccaagaagtcgcgggtgaaggcgttcctgaagctggtcaattatagccatatcatgcccacccgctacaccctcgacgtcgatctcaaggacgtcgtcaccgccgattcccttcagtcccgcgacaagaaggtcaccgcctgcaaggagaccaaggcccgcctcgaggaacgcttcaagaccggcaagaaccggtggttcttcaccaagcttaggttctaatctcttctagcccgcttttcttagatctatctaccagtaatatttctactacttccatcatcgtctgtcgagatctatagcgttctatgaggtttttagcctcattttggttcatcggaggacgaaactgatttgatcatggatcgaatgacattttatatctgttgcttaaacggatgagtcgaatgctttgcgccaatcgtgtttcatgtgctttcatcttcgcatgcgatgagtagcaagtaacctgca

SEQ ID NO: 1701 - DNA, 805 bp, Cocos nucifera
ggggggcgctgccggcgtggagtttccagtcgaagaaagtaggagaagatggtcaggttcttgaaacctgggaaggcggtgatcatccttcagggccggttcgccggcaggaaggcggtgatcgtgcggtgcttcgacgagggcatccgcgaccgtccgtatggccattgcctcgttgccggcatcctcaagtatcctaagaaggtcatccgcaaggactcggcgaagaagacggccaagaagtcccgcgtcaaggcctttttgaaggtggtgaactacagccacatcatgcccacccgctataccctagatgtggatctcaaggacgcggtcaccctcgacgctctccagtcccgggacaagaaggtggccgcctgcaaggacaccaaggcccgcttcgaggagcggttcaagaccggcaagaaccggtggttctttaccaagctccgcttctagagagaggtatacagatgagatgagatgagatgctgcttactgcctggttactttcttattttattttcgattgcttcgcggaatcgtcgttattgttatggttggtctcattttgagttgttatttgatctagtagactagctggctcgtaacagtttttgattggggtattttcttaaccggtttatgaggtgaatggatccagatgagttcaatatatgaaaatgcttttattagattgtggttttagttttgttaatcgattttttatgatgatatgatgatcctgagattaaaaggtggaatgatgttcgttcacgcgtgttgctgatggtattttattgacagc

SEQ ID NO: 1702 - DNA, 917 bp, Cocos nucifera
aacgagaacttgattacccaccaaagccgccgccgacgcgtcgtcgtcatcatcatcaggtaagggaaaatggtgaagttcttgaaaccagggaaggcggtgatcgtcctccaggggcggttcgccgggcggaaggcggtgatcatacggtgcttcgacgagggcacccgcgaccgcccctacggccactgcctcgttgccggcatcctcaagtaccccaagaaggtcatccgcaaggattcggccaagaagacggccaagaagtcccgcgtcaaggccttcttgaaggtggtgaactacagccacatcatgcccacccgctataccctggatgtggatctcaaggacgtcgtcaccctcgacgttctccagtcccgggacaagaaggtggccgcctgcaaggagaccaaggcccgcttcgaggagcgcttcaagaccggcaagaaccggtggttcttcactaagctccgcttctagataaaggtatacggttcatgagattgatgcccgctgtctagggtttctttcttatattgttatggatcgctttgcttagtcgtcgtcgttgctatggttggtgtcatttggatttgttattggatctagtagacgttttaatgtagttggcacttaactgttttgatggagttacttggttatatgtttaggatgaatggatccggatgagttcaatagatgaaaaatgcttttattaaattgtgggttttaatccgtttatctttttgctaatctgattttgtgatgctatgatgatcctgatatgaaaaaattgaatgatgttgatttacatgtgtggatgatggtacggtatcttaatatttagccacatggggagtataatcttatttttaaaattcttctcctaataggtgtcagcgatgtaatttagataaatc

SEQ ID NO: 1703 - DNA, 547 bp, Platanus occidentalis
agaaagaggcagcgaagatggtgaagttcctgaaacccaacaaagccgtggtggtgttgcagggacgatacgcgggacggaaggctgtgatcgtgagatcgttcgacgagggaactcgtgatcgaccgtacggtcactgcctggtggctggggtagccaaataccccaagaaggtgattcgcaaggactccgccaagaagactgccaagaagtcacgtgtgaaggcattcatcaagctcgtcaactacaaccacatcatgcccactcgctacacgctcgatgttgatctcaaggacgtggttaccctcgatgcccttcagtctcgggacaagaaggttacggccgccaaggagaccaaagctcgccttgaggaccgcttcaagaccggaaagaacaggtggttcttcaccaagctcaggttttaacctctgcagtgagtgctatcacttctgctagggtttctattttgtgaggaaatactttgttaatgtcaggatctggaagattgggaatggacttctggcctcctttatcgttgttttagagt

SEQ ID NO: 1704 - DNA, 1579 bp, Prunus mume
gcccaagtatgtatgtagattcgatagtcttggactcttgggttgtctactatttaggccacgcctggcctggtttgctctattgggcttttttgtaatttctcatcgttaattgcccatttgtgaaaccaacaccctctaacaaccaaacgtatataaagtaaaaaccccttcactgagctgcttcctcttcccgcagcctccgagtttgcttagggttttcaacattttctcggggaaaacaaagaggaagcgaaaatggtgaaatttctcaaggcaaacaaagcggtggtgctcctgcagggacgatacgcgggcaggaaagccgtgatcgtgaaatccttcgaggaagggacacgtgacaggccgtacgggcactgtttggttgcggggatagccaagtacccgagcaaggtaatcagaaaggactcggccaagaagacggccaagaagtcccgggtcaaggccttcgtgaagctcgtgaactaccagcacatgatgccgacgcgctacaacctggacgtcgacctgaaggaggtgctcacggtggacgcattgcagacacgcgacaagaaggtagcggcgaagaaggagatcaaggcccggttggaggaccggttcaagagtggcaagaaccgatggttcttcaccaagcttaggttctgagtcgtttggctccctctctatgtttttccatttttagttgttatgtgatactagcatataattttgaggattattattgcaagttttggtttaatatgttttaataatattaagatagttcttagctgctgctgctttgactctgaaagcatcatcaaccaatcaacttcccacaaaatacccaatgccacgtgtactatattgacgcgtcctttggtgttggcggctgccagccgagtacgaaatattcataagagtaagactgtggccagaagaaaaccaaaatatttgtatgagctctcctccaatcattttttttccccaaacgaaagaaagtttattaaagtcgaacggaaaggtttatcaaaaactcactcagtccacacttggttccatattcttgacacaaaagccgcaacccagtgcgttgccttattacactgaaggggagtatctttgaaaactacctgctgcaactgtccagcaagcatctatcttcaagactgctcatcatgagtcacgatcaccaccatcatcaccaggctccagaggtatatccaccaccaccaccttccgatgcagttcacggaaacagtcaaggtggtccatatgttgttgcaccaccagttgcttaccccatgaaacatgatggtcctgaatacccccaccaaccacctacctaccccgagcaacaacagcaacctgcagagtctcatcatcgtgggagtgatggattttgcacaagatggtaattgaacattctcaacccccttaaattacatttttctcaagtaaaataaggggctaatatgttatcatgtttatacttaattccatattggtttctttgtatcaacagttgttttgccatgttgagctgtttctgcgactcgtgctgcgtgccgttaggtag

SEQ ID NO: 1705 - DNA, 613 bp, Prunus persica
cgagtttgcttagggttttcaacattttctcggaaaaaccaaagaggaaccgaaaatggtgaaatttctcaaggcaaacaaagcggtggtgctcctgcagggacgatacgcggggaggaaagccgtgatcgtgaaatccttcgaggaagggacacgtgacaggccgtacgggcactgtttggttgcggggatagccaagtacccgagcaaggtgatcagaaaggactcggcgaagaagacggcgaagaagtcccgggtcaaggccttcgtgaagctcgtgaactaccagcacgtgatgccgacgcgctacaacctggacgtcgacctgaaggaggtgctcacggtggacgcgttgcagacacgcgacaagaaggtggcggcgaagaaggagatcaaggcccggttggaggaccggttcaagagtggcaagaaccggtggttctttaccaagcttaggttctgagtcgttggctccctctctatgtttttccaattttggttgttatgtgatactagcatataattttgaggattattattgcgagttttgttttaaatttgtgcttaattttctgttcatttttcccaagaaatatatttgaaaatcactatg

SEQ ID NO: 1706 - DNA, 792 bp, Hordeum vulgare
atcctgctgcagggcaggtacgcggggaagaaggcggtgatcgtccgcgtcttcgaggagggcacccgcgaccgcccctacggccactgcctcgtcgccggcctggcgaagtaccccaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaagaacaggtggttcttcaccaagctccgcttctaggttcttcgtccgtccgcgccattactaccccgaaccctttacattcttagtcgctcgttatcggacactgttgctgcgctcaagatttcctgttttggctttggtattgcccgtaaagactatgtttttagattggatcttatgagattgatgggtggttcatgtgttgaatcatgagatctgcttggaattctccttcagtattttaccagtgttatgatgatgatgatgcttgcctaatatcgctgcatgacttgggtcaaaaaaaaaaaaaaaaaaaccttaagggggggccccgggaccccaatttccccctaagggggggccgattttaccccccgttaacttgggcctgtgtttattcacaccttgagtggcgttccgtttttatcggtaactgccaaaaattcg

SEQ ID NO: 1707 - DNA, 728 bp, Cenchrus ciliaris
gtcggttcgccggccgcaaggcggtgatcgtgcgcgtgttcgaggagggcacccgcgaccgcccctacgggcactgcctcgtcgccggcctcgccaagtaccccaagaaggtgattcgcaaggactccgccaagaagacggccaagaagtcccgtgtcaagtgcttcatcaagcttgtcaacttcacccacatcatgcccacccgctacaccctcgacgtcgacttcaaggacgtcgcctccggcggccccgacgcgctctccacccgggacaagaaggtcgccgcctgcaaggccgccaaggcgcgcctcgaggacaggttcaagaccggcaagaacaggtggttctttaccaagctccgtttctagatgccgggcgtcctgcatagtgccctgctttagttgtcagtttcttgtatcggatactcttttgagctatctctgctttggtattgccatggagacttggtgcttagtattacagatatcggagagaattttatcaagacatgtcgatgatgtgttaaatgttgtcgcatgaatctggctgaaattttgctcagaatcactgcttgggatgtactgtttttctcctgcattgtgctcaaaagtattcgtcttgctagtgacagataatcgtgatgcatcatgtagcttgcagtttgttaagctattgatacggtaattatattaggtgaattgacctagtaccttggaaccagactaaaa

SEQ ID NO: 1708 - DNA, 802 bp, Amorphophallus konjac
ccgggggaggttcgtacgcatctccctcgcaagggtttttctcgggagcccgatctcccactcggtgtcggcggagaagcggaagtccgcagcagcggcagggaggggccgccaccggcgaagatggtgaagttcctgaagccgaacaaggcggtgatcatcctgcaggggcgcttcgccgggcgcaaggcggtgatcgtgaagaacttcgacgacgggacccgcgagcgcccctacggccactgcctggtggcgggcatctccaagtaccccaagaaggtgatccgcaaggactccgccaagaagacggcgaagaagtcccgggtgaaggccttcgtcaaggtcgtcaactacaaccacatcatgcccacccgctacaccctcgacgtcgacctcaaggaagtcgtcgccgcccccgacgccctgcaggcccgcgacaagaaggtgacggcctgcaaggagatcaaggcccgcttcgaggagcgcttcaagaccggcaagaacaggtggttcttcaccaagctgaggttttaagccttggatcgatctcgctgtgctctcccgttggatgggtcattccctttttctcgtttcggttagggattttggagccttatttgccatgcttgttaaagattcatacttgatttggttttgtagtatcgccattggatctggttttgttttgtgttgatttttttctgcactacggcactttcatatctgcttactattactgttaggagaagtgaataggtgaagtgtttttctgcaatcaatggtgactttagcccttgattcg

SEQ ID NO: 1709 - DNA, 857 bp, Musa acuminata
ggacttcgttgcggcggcgaggaggtgcacgatccggatcgatcgggcgcggcggctaacgggaaggagaggaagatggtgaagtttctgaagccgaacaaggcggtgatcgtcctgcaagggcgattcgcggggcggaaggcggtgatcgtgcgagccttcgacgacggcacccgggagcggccctacgggcactgcctggtggccggcatcgccaagtacccgaagaaggtgatccgcaaggactccgcaaagaagacggccaagaagtcgcgcgtgaaggcgtttctgaagctggtgaactatagccacatcatgcccacccgctacacactcgacgtcgatctcaaggacgtcgtcaccctcgattcgctccagtcccgcgacaagaaggtcaccgcatccaaggagaccaaggctcgccttgaggagcgctttaagaccggaaagaaccgatggttcttcaccaagctcaggttctaaagcaaagtagcgatctttagtttcatttctgacgctgctattttcatctacatgagacggcatcatttaattcatggatggcatgctatttgtctgtgtggtttcacctgtttttaggacatgtcacggtaatttcctggatactaaatgttttcagtctgagttcatgctgtgttaggataattttgataaattggatatttaggtgagtggcagtttgatttggtttgcgtcatctgttgatcttcgtgatggtcgtctaattgctatgaggaatctatttggaaattctcttgatatatatatagtagtgacccagagatttcaacatgataatttttatgtctgaaatcttctggttgctaggaaagcac

SEQ ID NO: 1710 - DNA, 582 bp, Musa acuminata
attcccaggagttgagggaggcggcgaggaggaaggaagagaagatggtgaagtttctgaagccgaacaaggcggtgatcatcctgcaggggcggttcgccgggcgaaaggcggtgatcgtgcgggccttcgacgacggcacgcgggagcggccctacgggcactgcctggtggccggcatcgccaagtacccgaagaaagttatccgcaaggactcagcgaagaagacggccaagaagtcgcgggtgaagtcgttcctgaagctggtgaactacagccacatcatgcccacccgctacaccctcgacgtcgacctcaaggatgtcgtcaccatcgactccctccagtcccgcgacaagaaggtctccgcttgcaaggagaccaagtctcgccttgaggagcgcttcaagaccggcaagaatagatggttcttcactaagctcaggttctaatctatagaagccttcgctatttagttccatcggtaatgccgctaatgttactgcaattttccccatcaaatgtgagacagttgtggacctgctgagactctatattctagtatttcgattttgatggcac

SEQ ID NO: 1711 - DNA, 742 bp, Fagus grandifolia
acttgtagctttggtttcttcaaagcaaggccgagaggcagagagagagagtagcgaaaatggtgaagtttctcaaaccaaacaaagcagtgatactcttgcaaggccgttacgcaggtcgtaaggcagtgatcgtgagagccttcgatgaaggcacacgtgacagaccatacggtcactgtttggttgcagggataagcaagtacccgagcaaggtgatccgcaaggactcggctaagaagactgcgaagaagtcacgcgtgaaggctttcgtgaagcttgtgaacttccagcatctgatgcccacgcgctacaccctggacgtggacctcaaggacgctgtatctgtggattgccttcagtctaaggataagaaagtcactgctgctaaggagaccaagaagaggcttgaggatcgcttcaagactggaaagaacaggtggttctttactaagcttaggttctgagccagcgaattaggttttctctttctgtttctgtttctgtttctctatcttttttgttaaagaaagaagtattttgggtttaatattatgtttttatgaaccaatatatcgtttttattgatgggttttgtctgatctgattcatattaagcatttgggtttttgttgattagttaaatttgctcccttttttagatgatatgtgtgtctttgtttcgatttttggtctgaatttgttagttcattgaatttggggtaggttatttagtatcaag

SEQ ID NO: 1712 - DNA, 538 bp, Castanea mollissima
aaaatggtgaagtttttgaagccaaacaaagcagtgatactcctgcagggacgatacgcaggacgcaaggcggtgatcgttcgatccttcgacgaaggcacccgggacaggccgtacgggcactgtttggtagcggggataaagaagtacccaagcaaagtgatccgcaaggactcggcgaagaagacggcgaagaagtcccgcgtgaaggcgttcgtgaagctggtgaacttccagcacctgatgcccacgcgttacaccttggacgtggatttgaaagacgtggtcgccgtggattcgcttcagtccaaggacaagaaagtcactgcggccaaagagaccaagaagaggctcgaggagcgtttcaagactgggaagaataggtggttcttcaccaagcttaggttctgagttttgagtgagagatgagattcaatcaaatcaatgcagtctactactactactttagctgtttatttttaaaaaagttttagttatgattttatttgatgtttggataattatggacttggattgt

SEQ ID NO: 1713 - DNA, 538 bp, Castanea mollissima
gggggcctccaaagaaagagcgtacattcaaagagagaaaaatccagagagagagagagagagagagagaaaaatggtgaagtttttgaagccaaacaaagcagtgatactcctgcagggacggtacgcaggtcgcaaggcggtgatcgttcgatccttcgacgaaggcactcgggacaggccgtacgggcactgtttggttgcggggataaagaagtacccgagcaaagtgatccgcaaggactcggccaagaagacggccaagaagtcccgcgtcaaggccttcatcaagctcgtgaacttccagcacctgatgcccacgcgctacaccttggacgtggatttgaaagacgtggtcgctgtggactcgcttcagtccaaggacaagaaagtcactgcggcgaaagagaccaagaagaggcttgaggagcgtttcaagactgggaagaataggtggttcttcaccaagcttaggttctgagtgtgattgattcaatcaatcaatggagtctactattactttaggtgtttttttttt

SEQ ID NO: 1714 - DNA, 524 bp, Castanea mollissima
aatggtgaagtttttgaagccaaacaaagcagtgatactcctgcagggacgatacgcaggacgcaaggcagtgatcgttcgatccttcgacgaaggcacccgggacaggccatacgggcactgtttggttgcggggataaagaagtacccaagcaaagtgatccgcaaggactcggcgaagaagacggcgaagaagtcgcgcgtgaaggccttcgtgaagctcgtgaacttccagcacctgatgcccacgcgttacaccttggacgtggatttgaaagacgtggtggctgtggattcgcttcagtccaaggacaagaaagtcactgcggccaaagagaccaagaagaggctcgaggagcgtttcaagactgggaagaataggtggttcttcaccaagcttaggttctgagttctgagtgagagatgagattttatcaaatcaatgcagtttaagttttgtatgattttattgatgtttggataattattgacttcgtttatggatttgttctttattacaagtt

SEQ ID NO: 1715 - DNA, 548 bp, Castanea mollissima
agagagagagaaatggtgaagtttttgaagccaaacaaagcagtgatactcctgcagggacgttacgcaggacgcaaggcagtgatcgttcgatccttcgacgaaggcacacgggacaggccgtacgggcactgtttggtagcggggataaagaagtacccaagcaaagtgatccgcaaggactcggcgaagaagacggcgaagaagtcgcgcgtgaaggcgttcgtgaagctggtgaacttccagcacctgatgcccacgcgttacaccttggacgtggatttgaaagacgtggtggctgtggattcgcttcagtccaaggacaagaaagtcactgcggccaaagagaccaagaagaggctcgaggagcgtttcaagactgggaagaataggtggttcttcaccaagcttaggttctgagttctgagtgagagatgagattcaatcaaatcaatgcagtttaagttttgtatgatttttattgatgtttggataattgtggacttcgtttgtggatttgttctttattacaagttgattttgcttag

SEQ ID NO: 1716 - DNA, 905 bp, Gossypium hirsutum
gggttttcagtcactcgtactattatatatacacttcaatttcgagtttatcattttcgacaatcacatccattgccgccgctgtcgtcgcaatggtgaagtttctaaaaccgaacaaggccgtgatcgtcctccaaggccgatacgccggccgcaaagccgtgatcgttagatccttcgacgaaggcacacgcgaccgcccttacggccattgtttggtcgccgggacaaagaagtacccgagcaaagtcatccgcaaggactcggccaagaaaacggcgaagaaatcgcgtgtgaaatgcttcgtcaagctagtgaattaccagcacctgatgcccacgcgctacaccctcgacgtggatttgaaagacgtggtcaccgccgatgctctccagaccaaggacaagaaagtggcggcttgtaaggccactaaagagaggtttcaggagaggttcaagacggggaagaacaggtggttctttactaaacttaggttttgaatgatttattctaatggtgttaaagctttttatgtagtttctttaacattttggatttgaattttgagtctgttgtgcaatgagatattttctgggtttcttattgatttttctcgtttctgttgcaaattcatataattttctgagtgttttattgatttcaagttttttgtttcatagatctatggaagatggagaattaaataatataatgttagaagttagttttaatgtttgtatatatattttataattgttaattgatttgttagtgagctgcattatgattacggttctttccacgaaactcatgtagtctcatgaaactaagtgaagataaaattagtcaccaacgcctcgagagaacatgccattgttggtttgagaaatcgaatcgacacgggc

SEQ ID NO: 1717 - DNA, 703 bp, Gossypium raimondii
tcaatttcaagtttatcattttcgacaatcacatccatcgccgccgctgtcgtcgcaatggtgaagtttctaaaaccgaacaaggccgtgatcgtcctccaaggccgatacgccggtcgcaaagccgtgatcgttagatccttcgacgaaggcacacgcgaccgcccttacggccattgtttggtcgccgggacaaagaagtacccgagcaaagtcatccgcaaggactcggccaagaaaacggcgaagaaatcgcgtgtgaaatgcttcgtcaagctagtgaattaccagcacctgatgcccacgcgctacaccctcgacgtggatttgaaagacgtggtcaccgccgatgctctccagaccaaggacaagaaagtggcggcttgtaaggccactaaagagaggtttcaggagaggttcaagacggggaagaacaggtggttctttactaaacttaggttttgaatgatttattctaatggtgttaaagctttttatgtagtttctttaacattttggatttgaattttgagtctgttgtgcaatgagatattttctgggtttcttattgatttttctcgtttctgttgcaaattcatataattttctgagtgttttattgatttcaagttttttgtttcatagatctatggaagatggagaattaaataatttaatgtttgtatatatattttataattgt

SEQ ID NO: 1718 - DNA, 693 bp, Quercus alba
agagcgtacattcacagagagagagagagagagagagagagaaatggtgaagtttttgaagccaaacaaagcagtgatactcctgcagggacggtacgcaggtcgcaaggcagtgatcgttcgatccttcgacgaaggcacccgggacaggccgtacgggcactgtttggttgcggggataaagaagtacccgagcaaagtgatccgcaaggactcggcgaagaagacggccaagaagtcccgcgtcaaggccttcgtcaagctcgtcaacttccagcacctgatgcccacgcgctacaccttggacgtggacttgaaagacgtggtcgccgtggactcgcttcagtccaaggacaagaaagtcactgcggccaaagagaccaagaagaggctcgaggagcgtttcaagactgggaagaataggtggttcttcaccaagcttaggttctgaagtctttagattcaatcaatggactctatttttttaaagttttgtatggtttttattgatgtttggataattatggcatctgggttttcgttgaattgttggattttgctttttataattttgatgtgttatgtcttattattataagttaactgcggttcgtggattttgcttaattttatgatacattgttgtactgtactcaatattcttcttttacaattacatttgcactgtcatga

SEQ ID NO: 1719 - DNA, 703 bp, Phalaenopsis aphrodite
cagaagagaagggcggagcccccgtaggaagagggagaaaggtttcaaagatggtgaagtttcttaaacccggcaaagccgtcatcgtactcaacggccgcttcgccggccggaaggcggtaatcgtccgatcctttgacgatggaacccgcgaccgcccttacggccactgcctcgtcgccggtatcgccaagtaccccaggaaggtcatccgcaaggactcagcgaagaagacggcaaagaagtctagggtgaaggctttccttaagctggtcaactacacccacatcatgcccacccgatatactctcgacgtcgatctcaaggacgttgtcactgtagatgcgctccagtctcgcgacaagaaggtcacggcctgcaaggaaaccaagacgcgattcgaggagcgattcaagtcggggaagaatcgatggttcttcacgaagctaaggttctaggaacttggaagaaatttgaaagcgtaggtttgcttctggagcaatctaatgtcgtaattttaattgttgttttttgtcggaattatggttctggtactaaactgcttcccatggctttgaattttgctgttgtgaatttctaattgtgctgtgagctatgcttatcttcatgaattcaatacattgaatttttctttcatttgcgctctgtgttggttgctttgcttatttttactgctataaaa

SEQ ID NO: 1720 - DNA, 1292 bp, Phalaenopsis aphrodite
cggcgatcgtcagagtaggaagaaaactcaaagatggtgaagtttctgaagccgggaaaggctgtcatcattctcaatggccgatttgccggtcgtaaggcggttatcattcgatctttcgacgacggcacccgtgatcgtccttacggtcactgcctcgtcgccggaatcgctaaataccctagaaaggtcatccgaaaggattcggccaagaagacggcgaagaaatcaagggtcaaggcctttctaaaggttgttaattacacccacatcatgcccacccgatacacccttgatgtcgatctgaaggagattgtcactcttgacgcgctccaatctcgggataagaaggtcacagcctgtaaggagaccaaagcgcgttttgaagaacgattcaagacagggaagaaccggtggttctttacgaaactgaggttctaggtaaagcgaatgattcattgaggctagggtgcttgctctttgagtaatccagcggtacggttttcgattttatttttttgtttccgtgttatgaatctggtactggttatcttataagattttgaggctttctattccgagttcttagttgttgctgtaagactaataattaagatattgtttctttacaatgtgtctttcgtgggaaattgctagaatttacccctaggggctgtactgtaacggatttaagtgtcatttgatttaaatcttgcaagaaagaaaattggcaacttttaaattggattcagtaagtcctgtttacattggatttcttcaaagttttgacttaaatcccggatttactaaatcttttttgttggcaggatttagtaaatccggatttacaggattcactaaaactgttaaagttgaagaatcaaagctctagatcattcagattgatgtaaaagcttttttaaatgttctttcattttagttttatcaagcttttatgctttgctaagaaaggcacttgtaaggtaagaatgtgtgggatgatttggacctaccttaattggcttaagaatgaaggttaaagggtggaaaaacatttataaaaccatgatcattagtctcattcttaaattgctcaactttataaattttcattcctaattcattatgattgaatattgcacaactactaacattaatttgtgcatttttcttgcaacttgtgggccatgctatgttggttccattaactttttcattaaaggaacaggggccgcggagtcaatcccgcggccgcgttccgtcaaaaaaagtttcggctttttacaataacc

SEQ ID NO: 1721 - DNA, 782 bp, Fragaria vesca
atttgcgcagccagagagctagggtttccacagagagaacgaaaatggtgaagttcctcaagcctaacaaagccgtgctcctactccaggggaggttcgccggacggaaagccgtaatcgtgaaggccttcgatgaagggacacgtgaccggccgtacgggcactgcttggtcgccggaatagccaagtatccgagcaaggtgatcaggaaagactcagccaagaagacggccaagaagtccagggtgaaagccttcatcaagctcgtcaactaccagcacgtgatgcccacgcgctacagcctcgacgtcgacctcaaggaggtcgccaccgtcgacgcgttgcagtcacgcgacaagaaggtgacggcggccaaggagatcaaggccaagttggaggaccggttcaagagtggcaagaaccggtggttcttcaccaagcttaggttttgagggcattttggtctttctgttttcaattttcttttcaattgtgtttttctttttgtgctcaatgcatcgctgaaaattttgaagttattgatagtatttgtcttcggttctcattttgagcttcgttttcgatttatttagtgcaatagttataaagattttcgcattattgagagcaaagatttttgctttgtttgcgcaacggtatagaacattgaacttatcatcttgtcatgtcatatatacaattatgcaaaggcacttggaatttgaacaggaaaagaaattagttcaactgaagttttatgactatatacagagtgttcaaga

SEQ ID NO: 1722 - DNA, 588 bp, Cocos nucifera
ggggggcgctgccggcgtggagtttccagtcgaagaaagtaggagaagatggtcaggttcttgaaacctgggaaggcggtgatcatccttcagggccggttcgccggcaggaaggcggtgatcgtgcggaccttcgacgaaggcactcgcgaccgcccctacggtcactgcctcgttgccggcatcctcaagtaccccaagaaggtcatccgcaaggattcggccaagaagacggccaagaagtcccgcgtcaaggccttcttgaaggtggtgaactacagccacatcatgcccacccgctataccctggatgtggatctcaaggacgtcgtccccctcgacgttctccagtcccgggacaagaaggtggccgcctgcaaggagaccaaggcccgcttcgaggagcgcttcaagaccggcaagaaccggtggttcttctccaagcaccggttctagatcaccagcggcaacggtccataatttttcttatgaattttgttgcgaatgaatggttagaatcttgtcttttaaaaaagcttgtattttgatggatttagatccatcgtcctcgttggtctagcattaatc

SEQ ID NO: 1723 - DNA, 553 bp, Castanea mollissima
gactctcattttctttctcttcctcctctgcctccaaaagagcgtacattcaaagagagagagagagagagagagagagagagaaatggtgaagttttgaagccaaacaaagcagtgatactcctgcagggacgatacgcaggacgcaaggcagtgatcgttcgatccttcgacgaaggcacacgcgacaggccatacgggcactgtttggtagcggggataaagaagtacccaagcaaagtgatccgcaaggactcggcgaagaagacggcgaagaagtcgcgcgtgaaggcgttcgtgaagctggtgaacttccagcacctgatgcccacgcgttacaccttggacgtggatttgaaagacgtggtggctgtggattcgcttcagtccaaggacaagaaagtcactgcggccaaagagaccaagaagaggctcgaggagcgtttcaagactgggaagaataggtggttcttcaccaagcttaggttctgagttttgagtgaatgatgagattcaagcaaatcaatgcagtctagtactactactttagctg

SEQ ID NO: 1724 - DNA, 918 bp, Amorphophallus konjac
gaagagaaggagcgaagatggtgaagtttctgaagccgaacaaggcggtgatcgtgctgcagggccgcttcgccgggcggaaggccgtcatcgtgaagaacttcgatgagggcacccgcgaccgcccctacgggcactgcctggtggcgggcatctacaagtaccccaagaaggtcatccgcaaggactcggccaagaagacagcgaagaagtcccgggtgaaggccttcgtgaagctcgtcaactacaaccacatcatgcccacccgctacaccctcgacgtcgacctcaaggacgtggtcaccgtcgacgtcctccagaccaaggacaagaaggtagtcgcctgcaaggagaccaaggcccgcttcgaggagcgcttcaagacgggtaagaacaggtggttcttcaccaagttgaggttttgagtggtgggtcgatcgatctctggggaccaagctgccgaatgccgatttctttttttgattcgtcgtctcgtctttctttatcatacttgtaatgtccttatgatgaggttgaagttctgttagccttttggatctatttgagtccttaaagttgttcttaggatggtagctgttggacagttgatcaaatggaacggctttgctggtatttataatcttgtcgcgctcgtagcaagtttgtgtggcatgtctagatttttaaaaaaaatctcgtatgattgatgtcttttatggtccgcgtaatctaagagttgatagaagggaaagctttggttttctaatggtgttggattctctggtcgtagattttggataaagaatggagtctattgcggcgttgtgtgtttacaagggagctacattgtctaatcgtgttggattagactgataaaagatttcgcctataggggaatgggtataacacaactaattg

SEQ ID NO: 1725 - DNA, 643 bp, Arabidopsis lyrata
cacttagggttcatagcagccacagagagacgaagagagggatctaccaaacgaaacaacaatggtgaagttcttgaagcagaacaaggccgtgatccttcttcaaggtcgttacgccggaaagaaagccgtcatcatcaaatccttcgacgacggtacccgtgatcgtgcatacggacactgcctcgtcgccggactcaagaagtatccaagcaaagtcatccgcaaagactcagcgaagaagacagctaagaaatctagggttaagtgtttcatcaagcttgttaattaccagcatctgatgcctacacgttacacactagacgtggatctcaaggaagttgcgactcttgatgctcttcagagtaaggataagaaggttgctgctcttaaggaagctaaggctaagcttgaggagaggttcaagactggtaagaacagatggttctttactaagctcaggttctgaagaaatcttggatttcgagaggaatacattttgagctttttgttatcgaaatttatcgtatttttagtttctagggttcatttcctatggtgaaaaatgtggatcctgttttggattgtggaagatgttttgttgaagtttggattatggattttgccttttattttgattctc

SEQ ID NO: 1726 - DNA, 651 bp, Arabidopsis thaliana
acttagggttcatagcagccagagagagagagacaagtgagagggatctaccaaacgaagcaacaatggtgaagttcttgaagcagaacaaggccgtgatccttcttcaaggacgttacgccggaaagaaagccgtcatcatcaaatccttcgacgacggtaaccgtgatcgtccttacggacactgcctcgtcgccggactgaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaagactggtaagaacagatggttctttaccaagctcaggttctgaagaaattttctatttcgtgaggaattcattttgagcgttttgttatcgtgttttttagtttctagggttcatttcccatggtgaaaaatgtggatcctgttttggattgtggaagatgttttgttgaagtttggattatggatttgatcttttattttgattctctaatgcattctta

SEQ ID NO: 1727 - DNA, 494 bp, Fagus grandifolia
gcagcagcagcctctaaaaagagaaagagaaacaaatctatcatcgcaacaagaagaagatggttaagttcttgaagccgaacaaggcagtcgtcctccttcagggccgctttgctggtcacaaggccgtgatcgttcgttccttcgacgatggcaaccgtgaccgcccttacgggcactgcttggttgctggtctagccaagtacccaaagaaggtgatccgtaaggactccgccaagaagactgccaagaagtcccgcgtcaaggcctttgtcaagctcgtcaactacacccatctcatgcccacacgttactctctcgatgtcgatctcaaggacgtcgtcacggtcgatgctcttcagtctagggacaagaaggtcacggcttccaaggagaccaaggccaggtttgaggacaggttcaagtctggcaagaacaggtggttcttttctaagctcaggttttgattttgttttctgggggttttgttcggg

SEQ ID NO: 1728 - DNA, 665 bp, Vaccinium corymbosum
cggcgaaaccagagctccgaaaatggtgaagttcttgaagccaaacaaggcagtcatcgtcctccaaggccgcttcgcaggccgaaaggccgtcatcgtcaaatccttcgacgaaggcactcgcgaccgtccgtacggccactgcctcgtcgccggcgtagccaagtaccccaagaaggtcatccgaaaggactcagcgaaaaagacggctaagaagtctcgcgtcaaggcgttcatcaagcttgttaactacaaccacatcatgcccactcgttacactctcgacgtggatctgaaggatgttgttactgtggatgcgcttcagtcgagggataagaaggttactgctgccaaggaggctaagggccggttcgaggagcggttcaagactgggaagaacaggtggttcttttccaagctccgtttctgagaaggtctcatttcaattgagttccgttatatccgattttaggtttatgtcgtgttatgtcttaattgtagtgacggaaactttgtcctgttttcttcatgatggtttggataattttgtcttaaattttgaagttattctatgatttgactgttgaacttggttatattttcaaggatattctgttatcggttgcttttatactttttattgtatgttttcacagtttttaggt

SEQ ID NO: 1729 - DNA, 614 bp, Vaccinium corymbosum
cggcgaaaccagagctccgaaaatggtgaagttcttgaagccaaacaaggcagtcatcgtcctccaaggccgcttcgcaggccgaaaggccgtcatcgtcaaatccttcgacgaaggcactcgtgaccgtccgtacggccactgcctcgtcgccggcgtagccaagtaccccaagaaggtcatccgaaaggactcagcgaaaaagacggctaagaagtctcgcgtcaaggcgttcatcaagcttgttaactacaaccacatcatgcccacgcgttacactctcgacgtggatctgaaggatgttgttactgtggatgcgcttcagtcgagggataagaaggttactgctgccaaggaggctaagggccggttcgaggagcggttcaagactgggaagaaccggtggttcttttccaagctccgtttctgaaaaggtctcatttcaattgagttccgttatatccgattttaggtttatgtcgtgttatgtcttaattgtagtgacggaaactttgtcctgttttcttcatgatggtttggcgaattttgtcttaaattttgaagttattctatgatttgactgttgaacttggttatattttcaaggatattct

SEQ ID NO: 1730 - DNA, 684 bp, Ricinus communis
ctagacggcaaataaacaagtaaagctcttccaggtcgcagcagtaagaaccaaaaatggtgaagttcttgaagcccaacaaagccgtgatcctcctgcaggggcgctacgcagggcgcaaagccgtgatcgtgagatccttcgacgatggaacacgtgaccgtccctatgggcattgccttgtcgctggcatatcaaagtacccagcaaaagtgatcaagaaagactctgccaagaagacagcaaagaaatctcgtgtgaaggcatttatgaaggtagttaactacagccatctgatgccaacaagatacacacttgatgttgatttgaaggatgtggcgactcccgatgctttggttactaaggataagaaggttactgccgcaaaagagatcaagaaaaggctcgaggacaggttcaagactggcaaaaatcgttggttcttttccaagctcaggttttaaagatcgattacgggattactgctatcgcatgttttttttatttaagtgaagcttctctgtctgctttaaacatatggcaattttgttatgttgactctcgtctttattgtagtttgatttaaatggatatgaaggttagccttattaatttggttttatttgctgggtattttaattgatgtcgtgcagctttggtttttaatttaattggtttgtttac

SEQ ID NO: 1731 - DNA, 613 bp, Castanea mollissima
agagagagagagagagaaatggtgaagtttttgaagccaaacaaagcagtgatactcctgcagggacgttacgcaggacgcaaggcagtgatagttcgatccttcgacgaaggcacacgggacaggccgtacgggcactgtttggttgcggggataaagaagtacccaagcaaagtgatccgcaaggactcggcgaagaagacggcgaagaagtcgcgcgtgaaggcgttcgtgaagttcgtgaacttccagcacctgatgcccacgcgttacaccttggacgtggatttgaaagacgtggtcgccgtggattcgcttcagtccaaggacaagaaagtcactgcggctaaagagaccaagaagaggctcgaggagcgtttcaagactgggaagaataggtggttcttcaccaagcttaggttctgagttctgagtgagagatgggattcaatcaaattaatgcagtttaagttttgtatgatttttattgatgtttggataattatggacttggtttgtggatttgttctttattacaagttgattttgcttagaatgttgttgttgttgtgtttgcttaattttatgatgatacattgttgtgcctgatttt

SEQ ID NO: 1732 - DNA, 668 bp, Cichorium intybus
ccctagcaatagcttggtgcgtgtagaagtgtgtgagcagcggcggcggactttgaggcgaagcggagatggtgaagtttttgaagccaaacaaggcagtggtggtcctcaatggacgctttgctggccggaaggcggtgatcgtcaggcaattcgacgacggcacacgtgaccgcccgtacggccactgcctcgttgccgggatcgccaagtacccaaagaaggtgatccgtaaggattcagcgaagaagacggccaagaaatcgcgcgtgaaggcattcatcaagctcgtgaactacaaccacatcatgccgacgaggtacacgctcgacgtagatctgaaggacgtcgtaaccgtcgatgcacttcagtcccgcgacaagaaggttactgcttgcaaggaaaccaaagcacggctcgaggagcgattcaagacgggaaaaaaccgttggtttttctcgaagctccgcttttgaggttcagatgagttatatctgttttcagttttgttgtcttcgtcaatatcatgatagactttgattactggtagatcacatttatttttgaagtgttttgtttgattgatatttctgttgcaattgaaagttactgaatctattaggtaaacatttcttaaatgaattgattgcccaatggctttgagccta

SEQ ID NO: 1733 - DNA, 704 bp, Cichorium intybus
tataaaacagagccaaggtgcaatctctaaaaccctagaaaggatctactacttttgtgagatcagcggcggcgaaaatggtgaagtttttgaagccaaacaaagcggtagtggttctcaacggccgttttgccggacggaaagctgtgatcgtaaggcaatttgacgacggaactcgtgaccgtccttatggccactgcctcgttgccggaatcgccaagtacccgaagaaggtgatccgaaaggactcagctaagaagacggcgaagaagtcgagggtgaaggcatttatcaagctcgtcaactacaaccacatcatgccgactaggtacacgcttgacgtcgatctgaaggatgtcgtcacagttgacgctcttcagtcgcatgacaagaaggtgactgcctgtaaggaaacaaaagcacggttggaggaccggttcaagaccggtaagaatcgttggttcttttcgaagctccgattctgaggaaaagataagttgttttacatttccgttttgtgtttgttcttctcaattttcagctgatggatgataatgttcgactctattgatcctagtgcactttcgattttgatatatcttgcatctgcgttattagtactaaactataattgaatttcatttttgtgcgggtaatttgctgcatcagttgttcattagcgtgaatgacatgacgtttgcacc

SEQ ID NO: 1734 - DNA, 720 bp, Cichorium intybus
ttttgcaaaaacaaatgttataaaacagagccaaggtgcaatctctaaaaccctagaaaggatctactacttttgtgagatcagcggcggcgaaaatggtgaagtttttgaagccaaacaaagcggtagtggttctcaacggccgttttgccggacggaaagctgtgatcgtaaggcaatttgacgacggaactcgtgaccgtccttatggccactgcctcgttgccggaatcgccaagtacccgaagaaggtgatccgaaaggactcggcaaagaagactgcgaagaagtcgcgggtgaaggcattcatcaagctcgtcaactacaaccacatcatgccgactaggtacacgcttgacgtcgatctgaaggatgtcgtcacggtagatgcgcttcagtctcatgacaagaaggtgactgcctgtaaggaaacaaaagcaaggttggaggatcggttcaagaccggtaagaatcgttggttcttttcgaagctccgattctgaggaaaagataagttgtgttacatttccgttttgtgtttgttcttcccaattttcagctgatggatgataatgttcgactctattgatcctagtgcactttcgattttgatatatcttgcatctgcgttattagtactaaattatagtcgaatttaattttatgatgacaatttactgcatcagttgttcatttccctgagtgacatgacgtttgcat

SEQ ID NO: 1735 - DNA, 777 bp, Gossypium hirsutum
agttcgaaaatttgaaatattaacaactaaagaaaaaaagagggatttagggagaagagaatcagagccgcagctgccgccgtcgccatggtgaagtttcttaaaccaaacaaggcagttatcgtcctccagggccgatacgctggccgcaaagccgtcattgtcagatctttcgacgatggcacacgtgaccgcgcctatggccattgtttggttgcagggataaagaagtatccgagcaaggttatccgcaaggactccgcgaagaaaaccgccaagaagtcacgcgtcaagtgcttcatcaagctcgtcaattaccagcacctgatgcccacgcgctacaccctcgatgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttatgtagttttatcgaacaattttgaatttaatgacgggttttgaatctgtttggataagatatttctgggttattatttttgttatattatggaacgtgatttgctcatttctataagaaatttaagcttttgaactattttgtgtcctttatgatttatcatattgtcttaacgtagatctgtagatcaatggaggttgtgaattgaatctttaatgtttgaacctattataatgtcatcactgtcattagaa

SEQ ID NO: 1736 - DNA, 934 bp, Gossypium hirsutum
agtaagggcttttgagtggagagaaccggagctactgccgtcgtcgccgccatggtgaagtttctgaaatccaacaaggccgtgattgtcctccaaggccgatatgctgggcgcaaagcggtgatcgttagatccttcgacgatggaacacgtgaccgcccctatggccactgtttggttgcagggataaagaagtacccgagcaaggtcatccgcaaggattccgccaagaaaacagcaaagaaatcgcgcgtcaagtgcttcgtcaagctcgtcaactaccagcacctgatgcccacccgctacaccctcgacgtagacttgaaagacgtggttaccgtcgatgcacttcagaccaaggacaagaaagtggcggcttgcaaggcgaccaaggagaggttcgaagagaggttcaagactggaaagaacaggtggttctttactaagcttaggttttgagggtatttacctttattatagtatctttttttgagaaaaaaaagtttgaatttggatctagtgtttcaagcattttgaattttaaggacggattttgaatctgttccgatgggatatttttatgtgctcttttgttgttatatgatgctatgttgcttactcatttctcttagacatttatgtttttttatctctcaaaaatagaatcttttaattataaaatgttccaatgttttgccattttttttgtatgatggttgctgcattggagttgtttctcctgcctgagaaatgggtatgcttcagcttcaagatggagttttggattgaaatttcttggattttaaagcttaatttcaattcaattcttcatcaaccatttacttgtcatctaatgggtgactatttgtctatttgtttgttggattggcttttattattgatattaaaattcgcagtggtttagaaattaaaa

SEQ ID NO: 1737 - DNA, 658 bp, Curcuma longa
agagtcctttcggatcgtagctggaggcgaggccgacaaaaaggtgaagatggtgaagtttctgaagcccaacaaggccgtcatcatcctccagggccgcttcgccggtcggaaggcggtgatcgttcgggccttcgacgacggcacgcgggagcgcccttatggccactgcctagtggccggcatcgccaaataccctaagaaggtcattcgcaaggactcggcgaagaagacggccaagaagtcgcgggtgaagcccttcctgaagctggtcaactacaaccacatcatgcccacccgctacaccctcgacgtggacctgaaggacaccgtcaccctcgatgcgctccagtcccgggacaagaaggtttctgcttccaaggagacgaaggcccgcttcgaggagcgattcaagaccggaaagaacaggtggtttttcaccaagctcaggttttaatctaatgatgtgcctacttgcttcatagatcgacatttaatttcgttgtcgcttagactgtttttgactatcgttcaactttaattcgcttgcgattgcatctctatttctttcttcattctacctggaaaccatgtctgcaaattcacaatcctaaatttatgtttgaagcaatcgatatggttcgttgttttggatctc

SEQ ID NO: 1738 - DNA, 679 bp, Taraxacum officinale
cggcggggatgtttagaagcggctgacacagacctagagaggaagcgaaaatggtgaagtttttgaaaccaaacaaggctgtggtggtcctcaatggtcgtttcgctggtcggaaagctgtgattgtcaaacagttcgatgacggaacacgtgaccgtccatacggccactgcctcgtcgccggaattgccaaatacccgaagaaggtgattcgtaaagactcagccaaaaagaccgccaagaagtcgcgcgtgaaggcatttatcaagctagtgaactacaaccacataatgccgaccaggtacacgctcgacgtcgatctcaaggatgttgtctcagtcgatgcgctccagtcgcgtgacaagaaggtgactgcgtgcaaagaggccaaagctcggttagaggagcgattcaagaccgggaaaaaccgttggttcttctcaaagctccgattttgagttgtttctggtgtcaggttttgttatatttcttctcagtttttagctcatgaatgatgattgtgatagattgtttaatgctagtttattttgtggtttttggattgattttctgttgcaattcaagatacatttgagagtattattgttcgaacgtcacgtatgtgtctttacttggttatctatatggttttgttacactaaaaaaaaaaaaaaaaaaa

SEQ ID NO: 1739 - DNA, 625 bp, Gossypium raimondii
acttagggtttttgggagaagagaatcagagccgcagctgccgccgtcgccatggtgaagtttcttaaaccaaacaaggcagttatcgtcctccagggccgatacgctggccgcaaagccgtcattgtcagatctttcgacgatggcacacgtgaccgcgcctatggccattgtttggttgcagggataaagaagtatccgagcaaggttatccgcaaggactccgcgaagaaaaccgccaagaagtcacgcgtcaagtgcttcatcaagctcgtcaattaccagcacctgatgcccacgcgctacaccctcgatgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttatgtagttttatcgaacaattttgaatttaatgacgggttttgaatctgtttggataagatatttctgggttattatttttgttatattatggaacgtgatttgctcatttctataagaaatttaagcttttgaacta

SEQ ID NO: 1740 - DNA, 1411 bp, Gossypium raimondii
cttaagtaagggcttttgagtggagagaaccggagctactgtcgtcgccgccgccatggtgaagtttctgaaatccaacaaggccgtgatagtcctccaaggccgatacgctgggcgcaaagcggtgatcgttagatccttcgacgatggaacacgtgatcgcccctatggccactgtttggttgcagggataaagaagtacccgagcaaggtcatccgcaaggattccgccaagaaaacagcaaagaaatcgcgcgtcaagtgcttcgtcaagctcgtcaactaccagcacctgatgcccacccgctacaccctcgacgtagacttgaaagacgtggttaccgtcgatgcacttcagaccaaggacaagaaagtggctgcttgcaaggcgaccaaggagaggttcgaagagaggttcaagactggaaagaacaggtggttctttactaagcttaggttttgagggtatttatctttattatagtatcgttttttgagaaagaaaagtttgaatttggatctagtgtttcaagcattttgaattttaaggacggattttgaatctgttccgatgagatatttttatgtgctcttttgttgttatctgatgctatgttgcttactcatttctcttagacatttatgatttttaatctctcaaaaatagaatcttttaattataaaatgttccaatgttttgccatttttttggtattatggttgctgcattggagttgtttctcctgcctgagaaatgggtatgcttcagcttcaagatggagttttggattgaaatttcttggattttaaagcttaatttcaattcagttcttcatcaaccatttacttgtcatctaatgggtgactatttgtctatttgtttgttggattggcttttattattgatattaaaattcgcggtggtttagaaattaagcttctaggtattaattgtaacgataaaccattagaattatcaagcctgtttttgaaatttggaaattcgttaccaattgtttagcataaaaatatactctgctgttctatgttatggtttagaagtcggggcttggatttgttcatccttgtttgttccttggggttcaaagtaatcatttgattcttgttctacctggactaggtaacgagtgttgaatgcggacatgtgactgacattagctcactctatgttttcaagtttgtctgatatgttaggtattttgatgcatgctataggaaaaatgaagaattggactacatgtgggattcactttgcagttttatggtgcaattagaattctctctttctgtaggatatttgactggtgatccgatgacaatgatatggttttacactgttcatggttttgctctatttgtgtgaaattgctaaaaagactattttagggtt

SEQ ID NO: 1741 - DNA, 668 bp, Vitis vinifera
acagccacaaaacctagggtttccatttaggagagaaagcgagcaggtaggctagggttttgggttgtctctctctctcagagcagaaatggtgaagttcctcaagcaaaacaaggccgtcgtcgtcctccaggggcgtttcgccggtcggaaggcggtgattgtccgctctttcgacgacggaacccgcgatcggccgtatgggcactgccttgtcgccggaattgccaagtacccgaagaaggtgatccggaaggactctgcgaagaagacggcgaagaagtcgagagtgaaggctttcatcaagctcgtcaactacaaccacctgatgcccactcgttacaccctggacgtggatctcaaggacgtagtcaccgtcgacgcacttcagagcagggacaagaaggtgacggcggccaaggagaccaaggccaggttcgaggagcggttcaagactgggaagaacaggtggttctttaccaagctcaggttctgagtcatgtgtcttaaggctttctttactatgaactcaaatcggacttgttatgttttagggattctgtctttttgatgtgttaattttaaggattatggagatggagtttagtttctgttttgaatttggttcaatattggttaaatctaatatggttgcgatttcctgttta

SEQ ID NO: 1742 - DNA, 815 bp, Vitis vinifera
ctagggtttccatttaggagagaaagcgagcaggtaggctagggttttgggttgtctctctctctcagagcagaaatggtgaagttcctcaagcaaaacaaggccgtcgtcgtcctccaggggcgtttcgccggtcggaaggcggtgattgtccgctctttcgacgacggaacccgcgatcggccgtatgggcactgccttgtcgccggaattgccaagtacccgaagaaggtgatccggaaggactctgcgaagaagacggcgaagaagtcgagagtgaaggctttcatcaagctcgtcaactacaaccacctgatgcccactcgctacaccctggacgtggatctcaaggacgtagtcaccgtcgacgcacttcagagcagggacaagaaggtgacggcggccaaggagaccaaggccaggttcgaggagcggttcaagactgggaagaacaggtggttctttaccaagctcaggttctgagtcatgtgtcttaaggctttctttactatgaactcaaatcggacttgttatgttttagggattctgtctttttgatgtgttaattttaaggattatggagatggagtttagtttctgttttgaatttggttcaatattggttaaatctaatatggttgcgatttccagtttatttggttttgttaactattggattctgtggtttgttttatagttcacgcgcttgttcgaaattaatggaaccccctttttcagatgcttttggaaaacaagtgggatggactcctttataccttttttcgtgaacttacacgaatccctttcttttaaat

SEQ ID NO: 1743 - DNA, 627 bp, Actinidia deliciosa
agagagagcggcggaaatagagcgaaaatggtaaagttcctgaagcagaacaaggcggtgatcgtcctgcagggacgcttcgccggtcgcaaggccgtcatcgtccgctccttcgacgacggcactcgcgaccggccgtatgggcactgcctggtggctggaatcgccaagtacccgaagaaggtgatccgcaaggactcggccaagaagacggcgaagaagtcgcgcgtgaaggccttcatcaagctcgtcaactacaaccacatcatgccgacgcgctacaccctcgacgtcgacctcaaggacatcgtaactgtcgatgccctccagtcgcgcgacaagaaggttacggcagcgaaggaggccaaggccaggctcgaggagcgtttcaagaccggcaagaaccggtggttcttctccaagctccgattctgagcgcgtttcggtttgattctatttctattatgtgacgtttctcttaatctgtagggatcattccttcgtgttctgctcgggtttagagatttttcgtgatgttttggtgaaatcttgcctgaaattttaagtttttctatgatttaaatgttgagttttgttggattttaatagatctgtgctctttttcat

SEQ ID NO: 1744 - DNA, 690 bp, Actinidia deliciosa
tcacatttgtgagtcatgactcttgtgagtgtgaagagaggtgtaaacaatcctcgtgccgaattcggcacgagggagagagggagagagagcggcggaaccagagcgaaaatggtgaagtttctgaagccgaataaggcagtgatcatcctccagggccgcttcgccggccgcaaggccgtaatcgtccgctccttcgacgacggcactcgcgatcgggcttacgggcactgcctggtggctggaatcgccaagtacccgaagaaggtgatccgtaaggactcggccaagaagacggcgaagaagtcgcgcgtgaaggccttcatcaagctcgtcaactacaatcacatcatgcctactcgctacaccctcgacgttgacctcaaggacatcgtcactgtcgatgccctccagtcgcgcgataagaaggttacggcggcgaaggaggccaaggcccggcttgaagagcggttcaagaccggcaagaaccggtggttcttctccaagctccgattctgagcgcattctggtttgattctcgttctattatgttatgtttatcttaatctgtagggatcatccctttatgttctgctcgggtttagagatttttcgtgatgttttggtgaaatgttgactgaaatttgaagtttttctatgatttaaatgttgagttttgttggtctttaa

SEQ ID NO: 1745 - DNA, 631 bp, Quercus alba
aaagagcctacattcaaagagagagagagagacacagagaaaatggtgaagtttttgaagccaaacaaggcggtgatacttctgcagggacggtacgcaggccgcaaggccgtgatcgttcggtccttcgacgaaggcacccgcgacaggccttacggtcactgtttggttgcggggataaagaagtacccgagcaaggtgatccgcaaggactcggccaagaaaacggccaagaagtcccgcgtcaaggccttcatcaagctcgtgaatttccagcacctgatgcccacgcgttacaccttggacgtggatttgaaagacgtggtcgccgtggattcgcttcagtccaaggacaagaaagtcactgcggcaaaagagaccaagaagaagcttgaggagcgtttcaagactgggaagaataggtggttcttcaccaagcttaggttctgagtgatctttgattcaatcaatagagtctattaatggtcttattgaagaagcaacccaacaaaacctatatctgtttttgacttctctgtttttaagttttgtatggtttttattgatgtttggatgattatggcatctgggttttgttgaattgttggattttgcatattataattttgat

SEQ ID NO: 1746 - DNA, 668 bp, Quercus alba
ctccaaagagcctacattcaaagagagagagagacacagactctgtgaaaatggtgaagtttttgaagccaaacaaggcggtgatactcctgcagggacggtacgcaggccgcaaggccgtgatcgttcggtccttcgacgaaggcacccgcgacaggccttacggtcactgtttggttgcggggataaagaagtacccgagcaaggtgatccgcaaggactcggccaagaagacggccaagaagtcccgagtcaaggccttcatcaagctcgtgaatttccagcacctgatgcccacgcggtacaccttggacgtggatttgaaagacgtggtcgccgtggattcgcttcagtccaaggacaagaaagtcactgcggccaaagagaccaagaagaagctcgaggagcgtttcaagactgggaagaataggtggttcttcaccaagcttaggttctgagtgatcttgattcaatcaatagagtctactactttaggtgtttttttttttttaatggtcttattgaagaagcaacccaacaaaacctatatctgtttttgacttctctgtttttaagttttgtatggtttttattgatgtttggataattatggcatctgggttttgttgaattgttggattttgcatattatagttttgatttgggtc

SEQ ID NO: 1747 - DNA, 780 bp, Quercus alba
tataaatcatctcattttctctttctcctcctcctccaaagagcctacattcaaagagagagagagagacacagactctgtgaaaatggtgaagtttttgaagccaaacaaggcggtgatactcctgcagggacggtacgcaggccgcaaggccgtgatcgttcggtccttcgacgaaggcacccgcgacaggccttacggtcactgtttggttgcggggataaagaagtacccgagcaaggtgatccgcaaggactcggccaagaagacggccaagaagtcccgcgtcaaggccttcatcaagctcgtcaatttccagcacctgatgcccacgcggtacaccttggacgtggatttgaaagacgtggtcgccgtggattcgcttcagtccaaggacaagaaagtcattgcggccaaagagactaagaagaagcttgaggagcggttcaagactgggaagaataggtggttcttcaccaagcttaggttctgagtgatctttgattcaatcaatagagtctgctactttaggtggtttttttttaatggtcttattgaagaagcaacccaacaaaacctatatctgtttttgacttctctgtttttacgttttgtatggtttttattgatgtttggatgattatggcatctgggttttgttgaattgttggattttgcatattataattttgatttgggttagaatgttgttgtgtatgcttaacatcaatggcaacatataagactcagtttggtcgcatgcatttgacaatgcagggg

SEQ ID NO: 1748 - DNA, 894 bp, Quercus alba
atctcattttctctttctcctcctcctccaaaagagcctacattcaaagagagagagagacacacagagactctgtgaaaatggtgaagtttttgaagccaaacaaggcggtgatactcctgcagggacggtacgcaggccgcaaggccgtgatcgttcggtccttcgacgaaggcacccgcgacaggccttacggtcactgtttggttgcggggataaagaagtacccgagcaaggtgatccgcaaggactcggccaagaagacggccaagaagtcccgcgtcaaggccttcatcaagctcgtcaatttccagcacctgatgcccacgcggtacaccttggacgtggatttgaaagacgtggtcgccgtggattcgcttcagtccaaggacaagaaagtcactgcggccaaagagaccaagaagaagctcgaggagcgtttcaagactgggaagaataggtggttcttcaccaagcttaggttctgagtgatctttgattcaatcaatagagtctgctactttaggtgttttttttttttaaatggtcttattgaagaagcaacccaacaaaacctatatctgtttttgacttctctgtttttaagttttgtatggtttttattgatgtttggataattatggcatctgggttttgttgaattgttggattttgcatattataattttgatttgggttagaatgttgttgtgtattcttaacatcaatggcaacatatgagactctgtttggtcgcatgcatttgacaatgcaggggccaccgggcaaaaaaaaggaattaaatatttaaaataattgtgctttttccaaatggtctgtgattgctttggtctgtgatttgtaaacttggaacaaaaacccccttaaacaatt

SEQ ID NO: 1749 - DNA, 795 bp, Quercus alba
tataaatcatctcatttttctctttctcctcctcctccaaaagagcctacattcaaagagagagagacacacacagagactctgtgaaaatggtgaagtttctgaagccaaacaaggcggtgatactcctgcagggacggtacgcaggccgcaaggccgtgatcgttcggtccttcgacgaaggcacccgcgacaggccttacggtcactgtttggttgcggggataaagaagtacccgagcaaggtgatccgcaaggactcggccaagaagacggccaagaagtcccgagtcaaggccttcatcaagctcgtcaatttccagcacctgatgcccacgcggtacaccttggacgtggatttgaaagacgtggtcgccgtggattcgcttcagtccaaggacaagaaagtcactgcggccaaagagactaagaagaagcttgaggagcggttcaagactgggaagaataggtggttcttcaccaagcttaggttctgagtgatctttgattcaatcaatagagtctactgctttaggtggttttttttaatggtcttattgaagaagcaacccaacaaaacctatatctgtttttgacttctctgtttttacgttttgtatggtttttattgatgtttggatgattatggcatctgggttttgttgaattgttggattttgcatattataattttgatttgggttagaatgttgttgtggtcttggtcgcatgtatttgacaatgcagggggctaccggggcaagaaaaggtagttaaatatttagattaattgtg

SEQ ID NO: 1750 - DNA, 564 bp, Quercus alba
agacacacacagagactctgaaaatggtgaagtttttgaagccaaacaaggcggtgatactcctgcagggacggtacgcaggtcgcaaggccgtgatcgttcgatccttcgacgaaggcacccgcgacaggccttacggtcactgtttggttgcggggataaagaagtacccgagcaaggtgatccgcaaggactcggccaagaagaccgccaagaagtcccgcgtcaaggccttcatcaagctcgtcaatttccagcacctgatgcccacgcggtacaccttggacgtggatttgaaagacgtggtcgctgtggattcgcttcagtccaaggacaagaaggtcaatgcggccaaagagaccaagaagaagctcgaggagcggttcaagactgggaagaacaggtggttcttcaccaagcttaggttctgagtgtgattcaatcaatggagtctaataactgttttgacttctctgtttttaagtttgtatggtttttattgatgcttggataatattggcatctgggttttgttgaattgttggattttgcatattataattt

SEQ ID NO: 1751 - DNA, 559 bp, Quercus alba
agagagacacacacagagaaaatggtgaagtttttgaagccaaacaaggcggtgatactcctgcagggacggtacgcaggtcgcaaggccgtgatcgttcgatccttcgacgaaggcacccgtgacaggccttacggtcactgtttggttgcggggataaagaagtacccgagcaaggtgatccgcaaggactcggccaagaagaccgccaagaagtcacgcgtcaaggccttcatcaagctcgtcaatttccagcacctgatgcccacgcgttacaccttggacgtggatttgaaagatgtggtcgccgtggattcgcttcagtccaaggacaagaaagtcaatgcggccaaagagaccaagaagaagctcgaggagcggttcaagactgggaagaacaggtggttcttcaccaagcttaggttctgagtgattgattcaatcaatggagtctactactttaggtttttaagttttgtatggtttttattgatgtttggataattatgccatctgggttttgttgaattgttggattttgcatattataattttgatg

SEQ ID NO: 1752 - DNA, 971 bp, Petroselinum crispum
tctagggtatttgaagaggactataaagaaagaggcattttctcccaagacagcaatctcatcgaaaatggtgaagtttctgaagccaaacaaggccgtaatcgtcctcaacggccgattcgccggccggaaagccgtgataatccgcgccttcgacgaaggcactcgtgaccgcccttacggccactgcctcgtcgccggcatctcgaagtacccgaagaaggtgatccgaaaggactctgcgaaaaagacggcgaaaaagtcgcgggtgaaggcgttcatcaagacggtgaattacaaccacataatgccgactcgctacactctggatgtggatttgaaagatgttgttacgcctgattgtttgcagtcacgtgataagaaggttacggctgctaaagaggctaaggccaggcttgaggagcgctttaagactgggaagaatcgctggttttttaccaagcttaggttctgagtatcgaggtttcatgttgttttgagtttaattgaaatgaaatgttgtttcgagtggtttctcgaggattttcagtttagtttttgcgtattttgttggattctaattacatgatacattttcagtggtttatgatatcgtcttcggattatatgtgccttggtttttgcgacttatgttcaatggtttgctcgtaatttttattttacaaacaatttaggtattgttcctccgagtggatgtttgcgattggctttttggaatgtgttagttatgttatctgataaatcatgagtatttataaatgttatatatgcttttggtattgccctgtttgtaagtaacatgtctgtcatattgtttgctgtatacagtaagtttttagcaaattcattggccctttttaaatagtttgatgtgttgtctgtgtttgctattatttaatccaaggtgatacacacttgattttgtagtgtaccttttggactgctattaa

SEQ ID NO: 1753 - DNA, 757 bp, Petroselinum crispum
tctagggtatttgaagaggactataaagaaagaggcattttctcccaagacagcaatctcatcgaaaatggtgaagtttctgaagccaaacaaggccgtaatcgtcctcaacggccgattcgccggccggaaagccgtgataatccgcgccttcgacgaaggcactcgtgaccgcccttacggccactgcctcgtcgccggcatctcgaagtacccgaagaaggtgatccgaaaggactctgcgaaaaagacggcgaaaaagtcgcgggtgaaggcgttcatcaagacggtgaattacaaccacataatgccgactcgctacactctggatgtggatttgaaagatgttgttacgcctgattgtttgcagtcacgtgataagaaggttacggctgctaaagaggctaaggccaggcttgaggagcgctttaagactgggaagaatcgctggttttttaccaagcttaggttctgagtatcgaggtttcatgttgttttgagtttaattgaaatgaaatgttgtttcgagtggtttctcgaggattttcagtttagtttttgcgtattttgttggattctaattacatgatacattttcagtggtttatgatatcgtcttcggattatatgttccttggtttttgcgactcttgtagattgttatgttcaatggtacaaatgtttgctcgtaatttttcttttacaaacaagttaggtgttgttcctctgagtggatgtttgcgattggctttttgga

SEQ ID NO: 1754 - DNA, 734 bp, Capsicum annuum
atttgttctcgtctcttatcataagatcgagtaaagagcccaaggcccaaaagcccttaacaattactgtcttatttactggccaatataaacaaagaaaagcctagctagggtttcatccatcgccaatcgcagcagcaaaaaaacgaaagaactgcagatatggtgaaattcctaaagccaaacaaagccgtagtgcttctccaagggcgccacgcaggtaggaaagcagtaatcgttcgagcattcgacgatggtacacgtgacaggccatacggacattgtttggtcgccggcgtagcaaagtacccaaagaaagtgattcgtaaagactctgctaaaaagcaagcgaagaaatcacgggtcaagacttttatcaagcttgttaattacacacatataatgcctacacgttacacattggatgttgatttgaaggaaactgttactgttgattgtcttcagacacgtgataagaaggttactgctgctaaggaagcgaaagcgaagtttgaagagaggtttaagactgggaaaaatcgttggttttttactaagcttagattttgagtggtttgctgtttttattggtaattttctattcaggatattaaggatttttgtctgtgtttgttttgttcaattggacttgaaatgaaagatctagttttatcttttattactattcgcattacagacatattcttaatattgcaattgtttagaacgggcaa

SEQ ID NO: 1755 - DNA, 840 bp, Platanus occidentalis
ggtgaagttcttgaagcccaacaaagcggtgatcattctgcagggaaaatttgctggacggaaggcggtcatcatcagatcgttcgacgagggtactcgtgatcgaccctatgggcactgcttggtggctgggattgccaagtaccccaagaaggtgattcgcaaggattccgccaagaagacagccaagaagtcccgcgttaaggctttcatcaagctcgtgaactacaaccacatcatgcctactcgttacacactggacgttgatctcaaggacgttgtcaccctcgacgcacttcaatctcgggacaagaaggtcacggccgccaaggagactaaagctcgcttggaggagcgcttcaagaccggaaagaacaggtggtttttcaccaagctcaggttctgagtgacatgttatctatcgaatctctctgtttttttttttttttttagggtatcgcatttagatggacaatgccttttttgatttctttataaacgcgaggactcgaaagatcgataattggcttttgaactcattttcactagttattgagttcatttttgtgttaaatttgatgatctgaacttgttctgctttgcctcatttatatttgtcaattattcgattggtttatcttctcttcttttttttttttttcttcttcttttagtttaactgtccggttttatattatcgcatgctggatcaaaggacgtgtctctatctttatgttgtttctactgagatcacagaatggttggtttggttttcttgttggtttcttgtttacggtctaaggttgtttaagatttctataattgttgttggtcgtatgc

SEQ ID NO: 1756 - DNA, 642 bp, Eutrema halophilum
agagaggaggaaaatcgtggtgaagaaacaatggtgaagttcttgaagcagaacaaggcagtgatcctccttcaaggccgatacgccgggaagaaggccgtgattatccgatccttcgacgacggaaaccgtgagcgtccctacggacactgcctcgtcgccggactcaagaagtacccgagcaaggtcatccgaaaagactcggcgaaaaagacggcgaagaaatctagggttaagtgtttcatcaagctcgttaactaccagcacctgatgcctactcgttacactctcgatgtggatctcaaggaagtcgccacgctcgacgctcttcagtccaaggacaagaaggtcgctgctctcaaggaagccaaggccaagctcgaggaacgtttcaagaccggcaagaacagatggttcttcaccaagctcaggttctgaggaaaattcgtttttctcacgccctttttcttgcttttcggattacagcgtattattagtttcttatggtgaacaatgtgtatcctgttttggattgtgaaagttcgattctggattttgattctcgaatgcattttgattacctctttgattgctttgaattatctgcttggattttgccataagttgattttgttagatcca

SEQ ID NO: 1757 - DNA, 697 bp, Eutrema halophilum
ctctgaaattagggttttacgccggaagaggttgagaagccatggttaagtttttgaagcagaacaaggcggtgatcctcctccaaggtcgttatgctgggaagaaggccgtgatcatccgttcgttcgacgacggaaaccgcgagcgtccgtacggacactgtctcgtcgccggactcaagaagtatccgagcaaagtcatccgcaaggactccgcaaagaagacggcgaagaaatcgagggtcaagtgcttcatcaagctcgtgaattaccagcatctgatgcctactcgttacacactcgacgtggatctgaaggaagttgcgactctcgatgctctccagtctaaggacaagaaggtcgctgctcttaaggaggctaaggctaagctcgaggagcgtttcaagaccggaaagaacaggtggttcttcaccaagctcaggttctgagaaccgagtttcattttccgttggttaaatgtcttcttttactatcgaatttataatctacttttttgtatggtttaagacctttggtttgaaaatgattctggattttgccttaatttatgtcatcagtggtttaatagctgaattagctttgtgcgttagtatttaattatattctagaaatgttctgcaagattagattttccagtgtcaccgtgatggttttggtattgaagtggctttttttt

SEQ ID NO: 1758 - DNA, 586 bp, Eutrema parvulum
aggagagggatctcgtggtgaagaaacaatggtgaagttcttgaagcagaacaaggcagtgatcctccttcaaggccgatacgccggaaagaaggccgtgattatccgatccttcgacgacggaaaccgtgagcgtccctacggacactgcctcgtcgccggactcaagaagtacccgagcaaggtcatccgaaaagactcggcgaaaaagacggcgaagaaatctagggttaagtgtttcatcaagctcgttaactaccagcacctgatgcctactcgttacactctcgatgtggatctcaaggaagtcgccacgctcgacgctcttcagtccaaggacaagaaggtcgctgctctcaaggaagccaaggccaagctcgaggaacgtttcaagaccggcaagaacagatggttcttcaccaagctcaggttctgaggggaaattcgtttttctcacgccctttttttcttgcttttcggatttacagcgtattattagtttcttatggtgaacaatgtgtatcctgttttggattgtgaaagttcgattctggattttgattctcgaatgcattttgatttcctc

SEQ ID NO: 1759 - DNA, 558 bp, Eutrema parvulum
ctctgaaattagggttttacgccggaagaggttgagaagccatggttaagtttttgaagcagaacaaggcggtgatcctcctccaaggtcgttatgctgggaagaaggccgtgatcatccgttcgttcgacgacggaaaccgcgagcgtccgtacggacactgtctcgtcgccggactcaagaagtatccgagcaaagtcatccgcaaggactccgcaaagaagacggcgaagaaatcgagggtcaagtgcttcatcaagctcgtgaattaccagcatctgatgcctactcgttacacactcgacgtggatctgaaggaagttgcgactctcgatgctctccagtctaaggacaagaaggtcgctgctcttaaggaggctaaggctaagctcgaggagcgtttcaagaccggaaagaacaggtggttcttcaccaagctcaggttctgagaaccgagtttcattttccgttggttaaatgtcttcttttactatcgaatttataatctacttttttgtatggtttaagacctttggtttgaaaatgattctggatttt

SEQ ID NO: 1760 - DNA, 429 bp, Hordeum vulgare
acccgaaacccaccggcagcggcgtagcgtaaggagaggagaaggaagatggtgaagttcctgaagccgggcaaggcggtgatcctgctgcagggtaggtacgccgggaagaaggcggtgatcgtgagcgtgttcgaggagggcacccgcgaccgcccctacgagcactgcctggtcgccggcctggccaaataccagaagaaggtgatccgcaaggactcggcgaagaagacggccaagaagtcgcgcgtcaaggtcttcctcaagctcgtcaacttcacccacctcatgcccacccgctacaccctcgacgtcgacctcaaggaggtggcctccggcgcccccgactccctcaccaccaaggacaagaagctcaccgccgccaagtccgccaaggccaagctcgaggagaggttcaagaccggcaag

SEQ ID NO: 1761 - DNA, 726 bp, Glycine max
gtggagcaatagcagcagaacagagagagcaaaaccctagagcatccatcacaagcagaggaagaagatggtgaagttcctgaagcctaacaaggcagtgatcgtcctgcagggccgctacgccgggcgcaaggcggtgatcgtgaggaccttcgacgagggaaccagggagcgcccctacggccactgcctcgtcgccggaataaagaagtacccaagcaaggtcatcaagaaggactccgcgaagaagaccgcgaagaaatctagggttaaggccttcgtgaagctcgtgaactaccagcacctcatgcccacgcgctacacgctcgacgtggatctaaaggacgctgttacccccgatgttctagccaccaaggacaagaaggttaccgctctcaaggagaccaagaagcgcctcgaggagaggttcaagaccggcaagaataggtggttcttcaccaaactcagattctgatttcgaaagcgtgaggttttatttattagggttttcggaatgttgccttttaatatattgtatccgtgttttgcaaatcttatcaaaactattattctgctcttagatttgttatcgtcgccgacttttgttaattaatatttctgccttttaatttacgggggaaatgaatgcgaacatattttgataccgagtcattcgcataaaatgtgtcaattcggatatgaaaatttctagtttgtttgatgagc

SEQ ID NO: 1762 - DNA, 1081 bp, Amborella trichopoda
ttttatgcgatctcccacattcgccaataccaattctagggtttcattgtccttaaaaaccctatttctacaaaccttgcgtttcgcttacagagagagagagagagagagagcgagagagaggaggcatcagaagaagcaaagatggtgaagtttttgaagcctaacaaggccgtgatcctccttcaaggtcgatttgctggtcgcaaagccgtgattattcgtgcctttgatgaagggacgagagatcgcccatatggccattgccttgttgcagggatcgcgaaatatcctaaaaaggttatcaggaaggattcagcaaagaagactgcaaagaaatctagggttaaggtcttcgtcaaactggtaaactacaaccacatcatgcctactcgatacactcttgatgtcgatctcaaagatataatcacactcgaggctctgcaatctcatgataagaaggtcactgttgctaaagacgctaaggctcgatttgaggagaggttcaagactgggaagaacaggtggttcttcactaagctccgcttctgaagaagtcatttgatctcctttttgtggtttgtggaattttctctttgtcatgttttggttatggattaagtgttttagccaatgagaccccggtaaactggatattctcgttcatttagttattctctctctaggatcttttctctctctcttgagcatgagctactgaaggatttcatatttgtagcttaactagtgcccttgagagttaatatggagattgaggatctcaagtgtggatttagatgaggctgtttttttttttcctatagattttggcaggaatacagacagttatgcttttaatttcctttaacttcccattttctcttttaaactgagtaatgaattgtcatcttttatgtgttatttggaagggatatgaatctgataagaatgtgcgaaatccaatttataattactgcattagcaactcttttgtattgttaataacctttattagagaaatgagtctttttccatatgtttgcagttattgaattatttgaggaattatattttcttgaat

SEQ ID NO: 1763 - DNA, 556 bp, Brassica juncea
agacgaagccatggttaagtttctgaagcagaacaaagctgtgatcctccttcaaggtcgttatgccggcaagaaggctgtgatcatccgttccttcgacgacggcaaccgcgagcgtccttacggacactgcctcgtcgccgggctcaagaagtaccccagcaaggtcatccgcaaggactcagccaagaagacggcgaagaagtcgagggtcaagtgtttcatcaaggtcgttaactaccagcatctgatgcctactcgttacacgttggacgtggatctgaaggaagttgcgactctcgaggctctggcttcgaaggataagaaggtggcggctcttaaggaggctaaggctaagctcgaggagaggttcaagactgggaagaacaggtggttcttcaccaagctaaggttctgagaaccgagtttctttttatcttttgtaatggaatttacagattgcttttgtagttctagaatgaatgtggatcatgttttggatggattaagacttttttagactaaaccatttcattcatttttgttgtttatttgt

SEQ ID NO: 1764 - DNA, 521 bp, Brassica juncea
gtttctctctgcaatcaaggggttatcgccggaagagagagagagaagccatggttaagttcctaaagcagaacaaagcggtgatcctcctccaaggccgttacgccggcaagaaggcggtgatcatccgctccttcgacgatggaaaccgcgagcgtccctacgggcactgcctcgtcgcgggtctcaagaagtacccgagcaaggtcatccgcaaggattcggccaagaagacggcgaagaagtcgagggtcaagtgtttcatcaaggtcgtgaactaccagcatctgatgcctactcgttacacgctcgacgtggatctgaaggaggtcgcgactctcgaggctctggcttcgaaggataagaaggtggcggctcttaaggaggccaaggctaagctcgaggagaggttcaagactggtaagaacaggtggttcttcaccaagctcaggttttgagaaagttttatgttttttttttgtaatggaatctacagtatgctttttgttagtttgttggaa

SEQ ID NO: 1765 - DNA, 595 bp, Brassica juncea
gtctctgcaactaaccttttcgccggaagagagcagcagccatggttaagttcctgaagcagaacaaagcggttatcctcctccaaggccgttacgccgggaagaaggcagtgatcatccgctccttcgacgacggaaaccgcgagcgtccttacggacactgcctcgtcgcgggactgaagaagtatccgagcaaggtcatccgcaaggactcagccaagaagaccgccaagaaatctcgagtcaagtgcttcatcaaggttgtgaactaccagcatctgatgcctactcgttacacattggacgtggatctgaaggaggttgcgactctggaagctctggcttcgaaggacaagaaggtggcggctcttaaggaggctaaggctaagcttgaggagaggttcaagactggaaagaacaggtggttctttaccaagctcaggttttgaagaacccattttgtcttttccgttttactttatcctttgtaatggaatttactttatgcttatgtagtttccagaatgaatgtggaacatgttttggatgggtttaagacatgttttgaagtttaattattgaatttttttgtcac

SEQ ID NO: 1766 - DNA, 555 bp, Brassica juncea
atctagacaagtgaagaaacaatggtgaagttcttgaagcagaacaaggcagtgatcctccttcaaggccgatacgctggaaagaaggccgtgatcatccgttccttcgacgacggaaaccgtgagcgtccttacggacactgcctcgtcgccggactcaagaagtacccgagcaaggtcatccgcaaggactcggcgaagaagacggccaagaaatctagggttaagtgtttcatcaaggtcgtcaactaccagcatctgatgcctacccgttacaccctcgacgtggatctcaaggaagtcgcgaccctcgaggctctggcttcaaaggacaagaaggtcgctgctctcaaggaggcgaaggctaagctcgaggaacgtttcaagaccgggaagaacagatggttctttaccaaactcaggttctgaaggaatcactgtcggaagaaacattttgagagtttttgttgttgcattttcttatccaatatttaaaacagcgtattattgttagtttctatggttcgtatggagaacaatgtggatcctgttttg

SEQ ID NO: 1767 - DNA, 602 bp, Brassica oleracea
tttgtctctgcaactaaacccttttcgccggaagagagcagcagccatggttaagttcctgaagcagaacaaagctgtgatcctcctccaaggccgttacgccggcaagaaggcagtgatcatccgctccttcgacgacggaaaccgtgagcgtccttacggacactgcctcgtcgcgggactgaagaagtatccgagcaaggtcatccgcaaggactcagccaagaagacggcgaagaaatctcgagtcaagtgcttcataaaggtcgtgaactaccagcatctgatgcctactcgttacacattggacgtggatctgaaggaggttgcgactgtggaagctctggcttcgaaggacaagaaggtggcggctctcaaggaggctaaggctaagctcgaggagaggttcaagactggaaaaaacaggtggttctttaccaagcttaggttctgagatctttttgtaatggaatttacaatatgcttatgtaatttcgagaatgaatgtggaaccatgttttggattggtttaagaccgtttggtttgaagtttaattcttgaggttttgtcatttttagttatgatcatttttgctatattg

SEQ ID NO: 1768 - DNA, 945 bp, Brassica oleracea
cagatagcctcctaaaaaaacataactgcaagtttggaagcaaaaaatgtactctagcacaagacgcatgtatactataagccggacctgatatatatatcgagagagaggtatgttgcaaggcatactctattttaaaaatgtgaataaagtttattctgttgtgagatatttggatttcagtaggcccagcccactatatatgggccgagtgagaagcctttcatttctacctttagggttttccataccacactatatatatattttcatagcaaactaatcctcgccggaaaaaaagtagagacgaagccatggttaagtttctgaagcagaacaaagctgtgatcctccttcaaggccgttatgccggtaagaaggctgtcatcatccgttccttcgacgacggcaaccgcgagcgtccttacggacactgcctcgtcgccggactcaagaagtacccgagcaaggtcatccgcaaggactccgccaagaagactgcgaagaagtcgagagtcaagtgtttcatcaaggtcgttaactaccagcatctgatgcctactcgttacacgttggatgtagatctgaaggaagtggcgactctcgaggctctggcttctaaggacaagaaggtggcggctcttaaggaggctaaggctaagctcgaggagaggttcaagactgggaagaacaggtggttcttcaccaagctcaggttctgagaaccgagtttctttacagtctacttttgtagttctagaaatgaatgtggatcgtgttttggatggtttaagacttttggtttgaaattgattctgggttttgtctttattacttgtcaattttaatcatttgtagctgcgagtgtctgctttgattatgtctggagaaacattttcatttcattttgcttccgatctttatatttcagtggaatttaccgtc

SEQ ID NO: 1769 - DNA, 701 bp, Brassica rapa
aaaacaatccttgccggaagaggtagagagagagagaagccatggttaagtttctgaagcagaacaaagctgtgatcctccttcaaggccgttacgccggcaagaaggccgtcatcatccgctcctttgacgacggcaaccgcgagcgtccttacggacactgcctcgtcgccgggctcaagaagtaccccagcaaagtcatccgaaaggactcggccaagaagacggcgaagaagtcgagagtcaagtgtttcatcaaggtcgtgaactaccagcatctgatgcctactcgttacacgttggacgtggatctgaaggaagttgcgactctcgaggctctggcttcgaaggacaaaaaggtcgcggctcttaaggaggctaaggctaagctcgaggagaggttcaagactgggaagaacaggtggttcttcaccaagctaaggttctgagaaccgagtttctttacactctacttttgtagttctagaaatgaatgtggatcgtgttttggatggtttaagacttttggttttgaaattgattctgggttttgtctttttttctttttttaaatttatattatggaaactcaacaaatctttgccctttgttgattaagtttaatcagtactgtgccttgtgttctgcgaatcaaatttcttatgcttcggacattgaaatgaaatagtgttagcgagatg

SEQ ID NO: 1770 - DNA, 765 bp, Brassica rapa
tcattgagtttctttatcaactattaaacctagcattttcgctgaaccgccacttagcttttttcagcggcgataacgaagacgaaggagagggatctatctacacaagtgaagcaacaatggtgaagttcttgaagcagaacaaggcagtgatcctcctccaaggccgatacgccgggaagaaggcggtgatcatccgatccttcgacgacggaaaccgtgagcgtccttacggacactgcctcgtcgccggactcaagaagtacccgagcaaggtcatccgcaaggactcggcgaagaagacggccaagaaatctagggttaagtgtttcatcaaggtcgtcaactaccagcatttgatgcctacacgttacaccctcgacgtggatctcaaggaagtcgcgactctcgaggctctggcttcaaaggacaagaaggtcgctgctctcaaggaggcgaaggctaagctcgaggaacgtttcaagaccgggaagaacagatggttctttaccaaactcaggttctgaaggaatcactgtcggaagaaacattttgagagtttttgttgttgcattttcttatccaatatttaaaacagcgtattattgttagtttctatggttcgtatggagaacaatgtggatcctgttttggattgtgaaagacttctgttggaaatatttctgttctggagtttgattctctattgcattttgattacctctttaatgattttgcttaggattttgtgataatttgagtatt

SEQ ID NO: 1771 - DNA, 791 bp, Brassica rapa
ttctttttgtctctgcaactaaccttttcgccggaagagagcagcagccatggttaagttcctgaagcagaacaaagcggttatcctcctccaaggccgttacgccgggaagaaggcagtgatcatccgctccttcgacgacggaaaccgcgagcgtccttacggacactgcctcgtcgcgggactgaagaagtatccgagcaaggtcatccgcaaggactcagccaagaagaccgccaagaaatctcgagtcaagtgcttcatcaaggttgtgaactaccagcatctgatgcctactcgttacacattggacgtggatctgaaggaggttgcgactctggaagctctggcttcgaaggacaagaaggtggcggctcttaaggaggctaaggctaagctcgaggagaggttcaagaccggaaaaaacaggtggttctttaccaagcttaggttctgagatctttttgtaatggaatttacaatatgcttatgtaatttcgagaatgaatgtggaaccatgttttggattggtttaagaccgtttggtttgaagtttaattcttgaggttttgtcatttttagttatgagcatttttgctatattggtgcgtttattaatatattgtcactggtttgtgtgttaagttctaattgatcaaatctggttccagtttttacaacgttggattgatttttattgaaatggtattcggtttttgtatgatcatcaattttggtgtaagcttggttttaaagttttaaaaggctcgttcctttttggagcaatggcg

SEQ ID NO: 1772 - DNA, 650 bp, Fagus grandifolia
ggttggttcaacaaagcgaggccgagaggcagattgagagtatagtgcgcaagcgaaaatggtgaagttcttgaaacctaacaaggcggtgatactgctacaaggacgttacgcaggtcgcaaggctgtgatcgtgagggccttcgacgatggtacacgtgacaggccatacggtcactgtttggttgcagggataagcaagtacccgagcaaggttatccgcaaggactcggcgaagaagacagcgaagaagtcacgcgtgaaggctttcgtgaagctcgtgaacttccagcacctcatgcccacgcgttacaccctcgacgtggacctcaaagacgtggtctccgtcgattctctccaatccaaggacaagaaggttactgccgccaaggagattaagaagaagctcgaggatcgcttcaagactggaaagaacaggtggttcttcactaagcttaggttctgagccacccaccgattggttcgaactggattttatggcattttgtgttttgttcattagttagacttgcttgttatgtttactgatttatatttgaggacttgttttatgagtaattttggatctgattttgatgatatgtgtgcacttgtttttctttgtggatttgcttgttttatgatatgtt

SEQ ID NO: 1773 - DNA, 787 bp, Brassica napus
aaaaaaagtagagacgaagccatggttaagtttctgaagcagaacaaagctgtgatcctccttcaaggccgttatgccggtaagaaggctgtcatcatccgttccttcgacgacggcaaccgcgagcgtccttacggacactgcctcgtcgccggactcaagaagtacccgagcaaggtcatccgcaaggactccgccaagaagactgcgaagaagtcgagagtcaagtgtttcatcaaggtcgttaactaccagcatctgatgcctactcgttacacgttggatgtagatctgaaggaagtggcgactctcgaggctctggcttctaaggacaagaaggtggcggctcttaaggaggctaaggctaagctcgaggagaggttcaagactgggaagaacaggtggttcttcaccaagctcaggttctgagaaccgagtttctttacagtctacttttgtagttctagaaatgaatgtggatcgtgttttggatggtttaagacttttggtttgaaattgattctgggttttgtctttattacttgtcaattttaatcatttgtagctgcgagtgtctgctttgattatgtctggagaaacattttcatttcattttgcttccgatctttatatttcagtggaatttaccgtcaacttattatctagtttctagaatgaatgtcgctcatgtttcccatggtttatgacttatttggttcttgatttttgtctttttagttaatgatcatttgctatattggcgctttaatttatatactgtcactac

SEQ ID NO: 1774 - DNA, 610 bp, Brassica napus
tttcgccggaagggagaagcagccatggttaagttcctgaagcagaacaaagcggttatcctcctccaaggccgttacgccgggaagaaggcagtgatcatccgctccttcgacgacggaaaccgcgagcgtccttacggacactgcctcgtcgcgggactgaagaagtatccgagcaaggtcatccgcaaggactcagccaagaagacggccaagaaatctcgagtcaagtgcttcatcaaggtggtgaactaccagcatctgatgcctactcgttacacattggacgtggatctgaaggaggttgcgactctggaagctctggcttcgaaggacaagaaggtggcggctcttaaggaggctaaggctaagctcgaggagaggttcaagaccggaaaaaacaggtggttctttaccaagcttaggttctgagatctttttgtaatggaatttacaatatgcttatgtaatttcgagaatgaatgtggaaccatgttttggattggtttaagaccgtttggtttgaagtttaattcttgaggttttgtcatttttagttatgagcatttttgctatattggtgcgtttattaatatattgtcactggttt

SEQ ID NO: 1775 - DNA, 668 bp, Brassica napus
tgacggaccggtccggaattcctggtcgacccacgcgtccggcaactaaacccttttcgccggaagagagcagcagccatggttaagttcctgaagcagaacaaagctgtgatcctcctccaaggccgttacgccggcaagaaggcagtgatcatccgctccttcgacgacggaaaccgtgagcgtccttacggacactgcctcgtcgcgggactgaagaagtatccgagcaaggtcatccgcaaggactcagccaagaagacggcgaagaaatctcgagtcaagtgcttcataaaggtcgtgaactaccagcatctgatgcctactcgttacacattggacgtggatctgaaggaggttgcgactgtggaagctctggcttcgaaggacaagaaggtggcggctctcaaggaggctaaggctaagctcgaggagaggttcaagactggaaaaaacaggtggttctttaccaagcttaggttctgagatctttttgtaatggaatttacaatatgcttatgtaatttcgagaatgaatgtggaaccatgttttggattggtttaagaccgtttggtttgcagtttaattcttagaggttttttcatttttagttatgatcatttttgctatattggtgcgtttattagtatattgtcactggtttgat

SEQ ID NO: 1776 - DNA, 597 bp, Daucus carota
cagagagagtgagcggcgctaacaaacccccaaaatggtgaagtttctcaagcccaacaaagccgtcatcgtcctcaacggccgtttcgccggccgtaaagccgtcatcatccgcgccttcgacgaaggcactcgtgaccgcccctacggccactgcctcgtcgccggcatctcgaagtacccgaagaaggtcatccgcaaggactccgcgaaaaagacggcgaaaaagtcgcgcgtgaaggctttcatcaagctggtgaactacaatcacatcatgccgacgaggtacactctggacgtggatctgaaggatgttgtgacgccggattgtctgcagtcgagggataagaaggtgaccgcggctaaagctaccaaggcgaagctcgaggagaggttcaagaccgggaaaaaccgctggttctttactaagcttaggttttaattttcaatttctgttttgtttcgtgctggattttaagttctattggatgatgctgcgtaatgtttggattgaaatgttattggagttttggattcgtttcgtaagatatgctaatatatctatgtttttgattacttattagtaatgcggaattg

SEQ ID NO: 1777 - DNA, 682 bp, Daucus carota
aaaatggtgaagtttctcaagcccaacaaagccgtcatcgtcctcaacggccgtttcgccggtcgtaaagccgtcatcatccgcgccttcgacgaaggcactcgtgaccgcccctacggccactgccttgtcgccggcatctcaaagtaccccaagaaggtcatccgcaaggactccgcgaaaaagacggcgaaaaagtcgcgcgtgaaggctttcatcaagctggtgaactacaatcacatcatgccgacgaggtacactctggacgtggatctgaaggatgtggtgacgccggattgtctgcagtcgagggataagaaggtgacggcggccaaggccaccaaggcgaagctcgaggagaggttcaagaccgggaaaaaccgctggttctttactaagcttaggttttaaatttcaatttctgttttgtttcgtgctggattttaagttctattggatgatgatgcgtaatgtttggattgaaatgttattcgagttttggattcgtttcgtaagatatgctaatatatctatgtttttgattacttattagtaatgcggaattggttcacgattaaattatatatgtgtttttggtatggaatgattttgttcttctatttgaatgcataatattgtattagttgctggtgttaaatatagctaattgtgataggggagg

SEQ ID NO: 1778 - DNA, 683 bp, Daucus carota
caaaatggtgaagtttctcaagcccaacaaagccgtcatcgtcctcaacggccgtttcgccggccgcaaggccgtgatcatccgcgccttcgacgaaggcactcgtgaccgcccctacggccactgcctcgtcgccggcatctcgaagtacccgaagaaggtcatccgcaaggactccgcgaaaaagacggcgaaaaagtcgcgcgtgaaggctttcatcaagctggtgaactacaaccacatcatgccgacgaggtacactctggacgtggatctgaaggatgttgtgacgccggattgtctgcagtcgagggataagaaggtgaccgcggctaaagctaccaaggcgaagctcgaggagaggttcaagaccgggaaaaaccgctggttctttactaagcttaggttttaaatttcaatttctgttttgtttcgtgctggattttaagttctattggatgatgatgcgtaatgtttggattgaaatgttattcgagttttggattcgtttcgtaagatatgctaatatatctatgtttttgattacttattagtaatgcggaattggttcacgattaaattatatatgtgtttttggtatggaatgattttgttcttctatttgaatgcataatattgtattagttgctggtgttaaatatagctaattgtgataggggagg

SEQ ID NO: 1779 - DNA, 733 bp, Daucus carota
cttcctcaccaagccccaccctatatattcaccgctaaccaatttctagggttttagagcttcaaaacagagggtgagcaaagcggcgctaacaaaatggtgaagtttctcaagcccaacaaagccgtcatcgtcctcaacggccgtttcgccggtcgtaaagccgtgatcatccgcgccttcgacgaaggcactcgtgaccgcccctacggccactgcctcgtcgccggcatctcgaagtacccgaagaaggtcatccgcaaggactccgcgaaaaagacggcgaaaaagtcgcgcgtgaaggcgttcatcaagctggtgaactacaaccacatcatgccgacgaggtacactctggacgtggatctgaaggatgttgtgacgccggattgtctgcagtcgagggataagaaggtgaccgcggctaaagctaccaaggcgaagctcgaggagaggttcaagaccgggaaaaaccgctggttctttacgaagcttaggttttaaatttcaatttgtgttttttttttcgtgttggattttaagctttattggataatgatgacagtgtaatgttttgggttcaaatgttgctggagtttcggattcatgatatgttaatttagatatgtttttgattacttgttattagtaatgcggaattggttcctggttaagatatatctgtgtttttggtattaaatgattctatctatttaaatgcataataatgtat

SEQ ID NO: 1780 - DNA, 706 bp, Centaurea maculosa
aatggtgaagtttttgaagccaaacaaggccgtggtggtcctcaacggccgtttcgccggccggaaggccgtcatcgtgaagcagttcgacgacggaactcgcgaccgtccctacggccactgcctggtcgccggaatcgccaagtacccgaagaaggtcatccgcaaggactccgcgaagaagaccgcaaagaagtcgcgtgtgaaggcattcatcaagctcgtgaactacaaccacattatgccgaccaggtacacgctcgacgtcgatctcaaggacgtcgtatccgtcgatgcgctccagtcgcgtgataagaaggtgaccgcctgcaaggagacgaaggcgcgtttggaggagcgtttcaagaccgggaagaaccgttggttcttctcgaagcttcgattctgaggatttgatttgaattgagatgagttgcttcagttgtttcaggttttgtttgctatatttgtgtttttgaactttttagttttatgaatgacgatgaatcgatgatagactgattaatgctagttttactttcgttttcaaattgattgattttctggcgatttatgagtgattttcagaggattaatcgtttgaactttatgtttgtgtgattttgtttaactggttataagaatagttttccagttgcttattaatctataaacaagttcagtgtgctaaaaaaaaaaaaaaaag

SEQ ID NO: 1781 - DNA, 776 bp, Cichorium intybus
atttgtgtcatatcgtgtatgagaagcgcggcgagcagacttgagagacgaagcgaaaatggtgaagtttttgaaaccaaacaaggctgtggtggtgctcaatggtcgtttcgctggtcggaaggctgtgattgtcaaacagtttgatgacggaactcgtgaccgtccctacggccactgcctcgttgccggaattgccaaatatccgaagaaggtgatacgtaaagactcagcaaagaagaccgcgaagaagtcgcgtgtgaaggcatttatcaagcttgtgaactacaaccacataatgccgacgaggtacacgctcgacgtcgatctcaaggatgtcgtctcggtcgatgcgctccagtcgcgtgacaagaaggtgaccgcctgcaaagagaccaaagcacggttagaggagcgtttcaagaccggaaaaaaccgttggttcttctcgaagctccgattctgaggaaaagatgagttgtttttaatgtcaggttttgctatatttcttttcaattttagctgatggatgatgatgctgatacactggttaatgttagtttactttcatttaaatggattgattttgtgttgcaaattatgatacattttagtcgattaattgttacaacttcaagtttgtgtattgacttggtttagtcattgtttgtatcgtcacattcaatatgattttgctccactaatcttatgattaggtttccagctgctgaataacttcacgaccacctagtaaacttgcatagattactttgagt

SEQ ID NO: 1782 - DNA, 748 bp, Cichorium intybus
agcagcggcggcggactttgaggcgaagcggagatggtgaagtttttgaagccaaacaaggcggtggtggtgctaaatggacgctttgctggccggaaggcggtgatcgtcaggcaatttgacgacggcacacgtgaccgcctgtacggccactgcctcgttgccgggatcgccaagtacccaaagaaggtgatccgtaaggattcagcgaagaagacagccaagaaatcgcgcgtgaaagcattcatcaagctcgtgaactacaaccacatcatgccgacgaggtacacgctcgacgtagatctgaaggacgtagtaaccgtcgatgcacttcagtcccgcgacaagaaggttactgcttgcaaggaaactaaagcacggctcgaggagcgattcaagacgggaaaaaaccgttggtttttctcgaagctccgcttttgaggttcagatgagttatatctgttttcagttttgttgtcttcgtcaatatcatgatagactttgattactggtagatcacatttatttttgaagtgttttgtttgagtgatatttctgttgcaattgaaagttactgaatctattaggtaaacatttcttaaatgagttgattgcccaatggctttgagcctataggagtttaatcaaacattagtcattgaggacgaggttgcccaatgactcatcttttatcttcttacatgaacataagctgataacgactaaaagcagatttagcataaaaaaa

SEQ ID NO: 1783 - DNA, 652 bp, Cichorium intybus
gatcagcggcggcgaaaatggtgaagtttttgaagccaaacaaagcggtagtggttctcaacggccgttttgccggacggaaagctgtgatcgtaaggcaatttgacgacggaactcgtgaccgtccttatggccactgcctcgttgccggaatcgccaagtaccctaagaaggtgatccgaaaggactcggcaaagaagacggcgaagaagtcgcgggtgaaggcattcatcaagctcgtcaactacaaccacatcatgccgactaggtacacacttgacgtcgatctgaaggatgtcgtcacggttgatgcgcttcagtctcatgacaagaaggtgaccgcctgtaaggaaacaaaagcaaggttggaggagcggttcaagaccggtaagaatcgttggttcttttcgaagctccgattctgaggaaaagataagttgtgttacatttccgttttgtgtttgttcttctcaattttcagctgatggatgataatgttcgactctattgatcctagtgaactttcgattttgatatatcttgcatctgcgttattagtactaaactataactgaatttcatttttatgagggtaatttgctgcatcagttgttcagtagtgtgaatgacatgacgtttgcatcagttttgg

SEQ ID NO: 1784 - DNA, 606 bp, Cynara scolymus
gcgggctcaaccctacagaatctacttgtgtgtgagagaggagcggcggcgaaaatggtgaagtttttgaagccgaacaaggcggtggtggttctcaacggccgttttgccggacggaaagcggtgatcgtcagacaatttgatgacggaactcgtgaccgtccctatggtcactgtctcgttgccggaatcgccaagtacccgaagaaggtgatccgaaaggattctgcgaagaagacggctaagaaatctcgcgtgaaggcattcatcaagctcgtgaactacaaccatatcatgccgactaggtacacgctcgacgtagatctcaaggatgtcgtcacggtcgatgcgcttcagtcgcatgacaagaaggtgactgcttgcaaggagacgaaagcacggttggaggagcgtttcaagaccggaaagaaccgttggtttttctcgaagctccgattctgaggaaaagataagttgttttgccctttcggattttgttctgttatttctcgattttcagctggtgaatgataatgctagactttttatgaatcttaatgcactttcagtttttatatacatattttgcatctgtgttttcaagcg

SEQ ID NO: 1785 - DNA, 576 bp, Flaveria ramosissima
taaggcggagcagcggcggcgaaaatggtgaagtttctgaagccaaacaaggcggtggtggtcctcaacggccgtttcgccggccggaaggcggtgatcgtccggcaattcgacgacggaactcgcgaccgtccgtacggccactgtctcgtcgccggaatctccaagtacccgaagaaggtgattcgaaaggattcagcgaagaagacggcgaagaagtcgcgagtgaaggcgttcatcaagctcgtgaactacaaccacatcatgccgacgaggtacacgttagatgtagatctgaaggatgtggtgacgcttgatgctcttcaatcgcgtgataagaaggtcactgcgtgcaaggagacgaaggcgaggcttgaggagcggtttaagaccgggaagaaccggtggttcttctcgaagcttcggttctgaggacgagataaggtgatttacgattcgatgctttttgtttgttttcgtgatttttgtttacggacgttgttgttagactgttgttgatgattatgcacttttgattttgaaatttatgttaaacctgcagttttcagcgaggtt

SEQ ID NO: 1786 - DNA, 590 bp, Flaveria ramosissima
cagcaacaatcgtaagagtcgaaggcggagcagcggcggcgaaaatggtgaagttcttgaagccaaacaaggcggtggtggttctcaacggccgtttcgccggccggaaagcggtcatcgtccggcaattcgacgacggaactcgcgaccgtccgtacggccactgtctcgtcgccggaatctcgaagtacccgaagaaggtgatccgaaaggactccgcgaagaagacagcgaagaagtcgcgagtgaaggcgttcatcaagctcgtgaactacaaccacatcatgccgaccaggtacacgctagatgtggatctgaaggatgtggtgacgcttgatgcgcttcagtcgcgtgataagaaggtcactgcgtgtaaggagacgaaagcgaggcttgaggagcggtttaagaccgggaagaaccggtggttcttctcgaagcttcgattctgaggacgagataaggtgatttacgttttggtgtttttggtgtgtttttgatgattttcgtttggtgaaattatgttgttagactgttattgatcgttatgcacttttgattttgatatctatgttaaacctgcagttttt

SEQ ID NO: 1787 - DNA, 562 bp, Flaveria ramosissima
ctagcagcagcaacaatcgtaagagtcgaaggcggagcagcggcggcgaaaatggtgaagttcttgaagccaaacaaggcggtggtggttctcaacggccgtttcgccggccggaaagcggtcatcgtccggcaattcgacgacggaactcgcgaccgtccgtacggccactgtctcgtcgccggaatctcgaagtacccgaagaaggtgatccgaaaggactccgcgaagaagacagcgaagaagtcgcgagtgaaggcgttcatcaagctcgtgaactacaaccacatcatgccgaccaggtacacgctagatgtggatctgaaggatgtggtgacgcttgatgcgcttcagtcgcgtgataagaaggtcactgcgtgtaaggagacgaaagcgaggcttgaggagcggtttaagaccgggaagaaccggtggttcttctcgaagcttcgattctgaggacgagataaggtgattacgttttggtgttttggttgtgtttttgtatgatttcgtttggtgaaattatgttgttagactgttattgatcgttatgcacttt

SEQ ID NO: 1788 - DNA, 2014 bp, Zingiber officinale
ggcgattggcgagaatcctttcggatcgtagccggcagaaaggctgacaagaagatggtgaagtttctgaagcccaacaaggccgtcatcatcctccagggccgcttcgccggtcggaaggcggtgatcgttcgggccttcgacgacggcacgcgggagcgcccttacggccactgcctagtggccggcatcgccaaataccctaagaatgtcattcgcaaggactcggcgaagaagacggccaagaagtcgcgggtgaagcccttcctgaagctggtcaactataaccacatcatgcccacccgctacaccctcgacgtggatctgaaggacattgtctccctcgatgctcttcagtcccgggacaagaaggtttctgcttccaaggagacgaaggcccgcttcgaggagcgattcaagaccggaaagaacaggtggtttttcaccaagctcaggttttaatctaatgatgtgcctttttttttgcttcatttgcataaccagttctactgcgattagcgttttgtaagatctattagctgtcatgtcgatcatccgcctgtcgaatcgttgtgattcatgaatagatcgacatttaatttcgttttgtcgcttagactgttatcgattatcgttcaactttaatttgcttgcgattgcaaaaaaaaacgcaatcgcccccacggtcacaaactcacaatggactcgacagtcgcagtgtcctccgacgagaacgccgaagtagctaggtcgatcgtgccggtggtggcccctgtgccgcctccggttgtcgagaaagatcctccgatcaccccggccgctggtggcgccgacgacggaagcaaggtagtgcgctccgtggtgcgaaggtggaagagggaggacctcttggacaaggccgggttagtgctccgcgcgctggcttgggtcttctcgctcgtcgccgtcgccttgctggcctccaacaagcaaggcggatggatgaacttcgaccgctaccaggagtaccggtacttgttgtccgtcgcggcgatagccatggtgtactcgatggtgcagttgctcaggcaggcgcaccggttcatgaccggcaaggatttagcgccgttgacgtactcctggacattcgatttcgccggagatcaggtgatggcatacttgctgatctctgcttcatctgccgccatcccaattacagatcgcatgcgacgggaagtagtgaatagcttcactgatatatcagtagtcgcaatcagtatgactctcttgtcatttgtagcactgggttcatgttctcttatctctggcttcaaagttgctaggcggagttacttttagttgtgtatccctcaactccgctctgcgcctctgtattataagtttcccactatatgtgtactgatacacccttgttgtactttgttagagtataaacggacttttttcctcgtgccgaattggcacgagggcttcccaaaccctcgtcttcccttcttatccactccactcatcgcactctccgcagcgacgccttcgattcccttctcccatgtcggtgaccatcccctccggtggcttctcggcttcctccttcgcgactacggaccgtcgcctgtgccgctggcctgctgtctccgtctccttcgtttccagccggccggccgcgccggggccattcgttcgagcagcttcctcctccaagcctggcgccgcagcgggagtgaagcccgcaaagggcatcacgaagccccgtcctgtctctcctgccatgcaggcgcttgtcggcgtgccggaaatcccccgcacccaagccctcaagctcatttgggcttacatcaaggagcacaaccttcaggatccaaatgacaagaaggtaatcatatgcgatgagaaactaaaagctattttcggtgggaaagatcgagttgggtttctggaaatagcagggttgattacccctcactttgcaaagtgaaaaagtactgtgacattagctaatttttggtatatggat

SEQ ID NO: 1789 - DNA, 686 bp, Vitis vinifera
aaaaacccaaaacctctatataccacccatccaatcagatccgaaaaccctagtaaaggaggagcggcagcggagagaatatccaggcgcaaccaaaaatcccacagaaatggtgaagttcctcaaacccaataaggccgtagtcctcctacagggccgcttcgccggccgtaaggccgtgatcgtgcgctcattcgacgatggtacacgtgaccgcccctatggccactgcctcgttgccggcatcgccaagtacccaaagaaggtgatccgcaaggactcggctaagaagacagcgaagaagtcgagagtcaaggccttcatcaagcttgtcaactacaaccacatcatgcccactcgctatactctcgatgtagacctcaaggacgttgtctctcccgatgtgctgcagtcaagggataagaaggtgacggctgccaaggagactaagaagaagctcgaggagcggttcaagactggcaagaacaggtggttcttttccaagctcaggttctaagttgtttattgtttttctgaaaaagataaagattttgatttgtatttcgagttgagagggttttttggggatttatttgatggatcttgttgatgaattcatctgggatttgaagattttgattattacttgaaatgcatttttgtgttttatatacctttttcctgca

SEQ ID NO: 1790 - DNA, 646 bp, Ipomoea batatas
ttacggccggggagacgagtgatagaaagaggcagagatcagaagcagcggaggaggagagaggcgcaaagatggtgaaattcctgaaaccaaacaaggcggtgatccttctgcagggccgttacgccggccggaaggcggttatcgtccgcgccttcgatgagggaacccgtgaccgcccctacggccactgcctcgtcgccggcgtatccaagtacccgaagaaggtcatccgcaaggactccgcgaagaagcaggcgaagaagtctcgcgtgaaggtgttcgtgaagctcgtgaactacaaccacatcatgcccactcgctacaccctagatgtcgatctcaaggacgtcgtctccggcgactgcctccagtctcgggacaagagggtcactgctgctaaggagaccaaggcccggttcgaggagaggttcaagactgggaaaaaccgttggttcttcaccaagctcaggttctgagctctgagttttggtaattctgttttggagtgttttgctatgttatgttattcataggtgatactggcttattgtctgagggaaatcggatattgttactgttagtattcagtcaatgttttgtcttgtctttgaactcattctactgctatttgattaacaacttt

SEQ ID NO: 1791 - DNA, 622 bp, Actinidia deliciosa
gagagggggagagagagagagagagcggcggaaccagagcgaaaatggtgaagtttctgaagccgaataaggcggtgatcatcctccagggacgcttcgccggccgcaaggccgtaatcatccgctccttcgacgacggcactcgcgatcgggcttacgggcactgcctggtggccggaatcgccaagtacccgaagaaggtgatccgtaaggactcggccaagaagacggcgaagaagtcgcgcgtgaaggccttcatcaagctcgtcaactacaatcacatcatgcctactcgctacaccctcgacgtcgacctcaaggacatcgtcactgtcgatgccctccagtcgcgcgacaagaaggttacggcggcgaaggaggccaaggcccggctcgaagagcggttcaagaccggcaagaaccggtggttcttctccaagcttcgattctgagcgcgttctggtttgattctcgttctattatgttatgtttatcttaatctgtagggatcattcctttatgttctgctcgggtttagagatttttcgtgatgttttggttaaatgttgactggaatttgaagtttttctatgatttaaatgttgatttttgttggtcttta

SEQ ID NO: 1792 - DNA, 1005 bp, Lactuca sativa
cgaaaccctagcaatagcttggtgcatacttttgtgtgagcagcggcggcggaggacatcgagaggaatcggagatggtgaagtttttgaagcccaataaggccgtcgttgtcctcaatggacgctttgccggcaggaaggcggtcatcgttaggcaatttgacgacggcactcgtgaccgaccttacggccactgcctcgtcgccggaatcgcaaagtacccaaagaaggtgattcgcaaggattcagcaaagaagacagcgaagaagtctcgtgtgaaggcattcatcaagctcgttaactacaaccacatcatgccgacgaggtacaccctcgacgtagatctgaaggacattgtaacggttgatgcgcttcagtcacgtgacaagaaggttactgcttgcaaggagaccaaagcacggcttgaggagcgattcaagactggaaaaaaccgttggtttttctcgaagctccgcttctaagtataagatgagttgtctctggtttaaattttgttgtcttcgtcaatatcatgatagactttgattactggtagttcacatttatttttcaagtgttttattttgagtgatatttctgttacatttgatagttactgaatctattaggtaaacatttcttaatcgagtttattgcccaatgagtatgggattttagcatcattgaggacgatgatgcctaatttggttcgaatacattgggcaggaatgtgtcttgttatctatttcctccaatgaacatgaaatgataacgtatgaaaatagcaaaattttatggaattagatgtgatttccttaatcactgaatgatttcaggcccttgtgtattgaattcagtttcgccttgcatccaaagaatctattaagattagggatttgatttttgtttagggttggcttaagaatcaatttttcatggatagatctggtctttgttatcattcatatcctgtttttgtttggaaaagattttgttcgcataagc

SEQ ID NO: 1793 - DNA, 854 bp, Lactuca sativa
attggcaatttgtaactactcctgtttctgggccttatttagtagaggctaccagcccacccacgtcaatgctatctaaaatttataaaccctagaaatatatctgtcgtatcgtgtttaagaagcgcggcggaggcaaaggcaaacctaagagaagatcagaagaagcggaaatggtgaagtttttgaaacctaacaaggctgtcgttgttctcaacggccgtttcgctgggcggaaggccgtgatcgtaaaacagttcgatgacggaactcgtgaccgtccctacggccactgcctcgtcgctggaatcgccaaatatccgaagaaggtgattcgtaaagattcagcaaagaagactgcgaagaagtcgcgtgtgaaggcatttatcaagctagtgaactacaaccacataatgccgacgaggtacactctcgacgtcgatctcaaggatgtcgtctcggtcgatgctctccagtcgcgcgacaagaaggttacagcttgcaaagagaccaaagcaaggctagaggagcggttcaagaccgggaaaaaccgttggttcttctcgaagctccgattctgagttgtttttcgtgtcaggttttgttacgtttttccgaatctttagttgatgaatgttgatgatgatagactgattaatgctagtttacttgtatcgatttttggttgcaaatcaagatacgtttcaaggattagttgtttgtacctcatgcttgtttgttggattggttatcgatatgagtttgttcctttcatcgtataattgctgtttaatattcatatccacagtattcatcttgaatggaatactttcagctgatcaatacaaatcgat

SEQ ID NO: 1794 - DNA, 1341 bp, Lactuca sativa
aacaaatgttataaaacagagccaaaggtgcaacccctaaaaccctagaaaggatctactagtttgtgagatcagcggcggcgaaaatggtgaagtttttgaagccaaacaaggctgtggtggttctcaacggccgtttcgccggaaggaaagctgtaatcgtgaggcaatttgatgacggaacccgtgatcgtccttatggccactgcctcgttgccggaatcgccaaatacccgaagaaggtgatccgaaaggactcggcaaagaagacggcgaagaagtcgcgggtgaaggcattcatcaagctagtgaactacaaccacatcatgccgactaggtacacgctcgacgtcgatctcaaggatgtcgtcaccgtcgacgcgcttcagtcgcatgacaagaaggtgactgcctgtaaggagaccaaagcacgattggaggagaggttcaagaccgggaagaatcgttggttcttttcaaagctccgattctgagcaaaagataagttgttttacatttccttttttgtgtttgttcttctcaattttccgctgatggattttaatgctcagacttttattgatactagtgcatcttcgatttatattttgcgtcttcttttgtagtttttaattataattgaattttgtgcttatgatggtaatatgctggatcaaatcgatgttggatttgggactttagttgcttattaacctgaaatgatttgtttttagtgtaaaattgcttgattcaacttggttccgtgatagattaacatgataatcgaaagttaactatattaacaaaatgcatattgttcatgaatcagtgctctctatcttttttcatgagactctaaaagctgcattgtgcttttagctcgaactgaatatttgtttatacttacaaactgaagtaagtttgtgaaaacatcataaatgaatacataaatgttggaattttgtcttttttgttcagtgagaatttctgttattaaacattcctttgatcattagtgggtttgattgataacagaatttgattgaaaatctctccatatttgtttgaaatcttacaacttttaatccgtgtttttcaaatttgtttacaacacttggtctacatggttttgtagtatatgttttaaaggtgcaacagtaggaatgaaactaggttgctatttgatgaaaatgtctagacagattcattttcgtccactttaccaaaatattgaagtcatgtcgtccacaattgctttatgtcttcacataagttgaaacactcctcactaaagggcattcgggataacaacataatttcgaaaaagtataacattttaac

SEQ ID NO: 1795 - DNA, 755 bp, Petroselinum crispum
ccacaaaacacagagaacgagagtgtgagcgaagcggcggcaaccacaaagcaggtaaaaatggtgaagtttctaaagccaaacaaggccgtcatcgtcctcaacggccgtttcgccggccgcaaagccgtcatcatccgtgccttcgacgaaggcactcgtgaccgtccttacggccactgcctcgtcgccggcatctcaaagtaccctaaaaaggtcattcgcaaggactctgcgaaaaagacggcgaaaaagtcgcgagtcaaggcctttatcaagctggtgaattacaatcacatcatgcctactaggtacactctggacgtggatctcaaggatgtggtgacgtcggattgtcttgcgtcaagggataagaaggtgactgctgccaaagcgaccaaggcgaagcttgaggagaggtttaagactgggaaaaaccgttggttctttactaagcttaggttttaaatttgagtttgtgttgttttggatttctgttggattttaagtttaattggatgatgttgcgtaatgttttggatttaaatgtcgaaggagttttggattcgtttcgtaagatatgtttatgtttatgtttatgtttacttgttattgttgatgtggaattggtttgtgattggttattggcgtgttttgagcatgaaatgaatttgttgttgcgatttagattaatagtactactttaggtgctgatgtgataatgtaggtaattgcgattagtttagttaggagag

SEQ ID NO: 1796 - DNA, 756 bp, Platanus occidentalis
agcgagagcgagcgagcgaggagcagcgaaaatggtgaagttcttgaaacccaacaaagccgtgatcgtgttgcaggggcgatacgctgggcggaaggctgtaatcgtgagatcgttcgacgagggcactcgtgatcgaccctacggccactgcttggtggctgggatatccaagtacccgaagaaggtgattcgtaaggattctgcaaagaagactgcgaagaagtcccgtgtgaaggccttcatcaagcttgtcaactataaccacatcatgcctactcgctacaccctcgatgttgatctcaaggacgttgttaccctcgataccctccaatctaaggacaagaaggtcacggcggctaaggagaccaaagctcgcttggaggagcggttcaagacggggaaaaacaggtggttcttcaccaaactcaggttctaagtgaaaaatctgctagggattcgtattttgacaggaaatactttgttaaatgtgaggatatggaagatatggaatgggttcttaaactcgtttttagtagttgttggatggaattatcttagcttgtactgtttttgatgaatccgttttggatttttttttatgatccgtggtttgttttctttattttgttagaataatggcttgataatgattaatttcggatttaaggatattattagtttgtgtgtttttcctacggagattgctgaatggtggatctgggtttcttcttggattctgtttgggctttaagc

SEQ ID NO: 1797 - DNA, 900 bp, Papaver somniferum
gcatcgttcccttcctcagtcggatctcgttcaacacagagagagtagattcagcagaaccttaggaggtagcgacaatggttaagtttttgaagccaaacaaagctgtggtagtgctacaaggacgctttgctgggcgtaaggctgttatcattcgtgctttcgatgagggaacacgtgagcgtccatatggtcattgcttagttgcagggattaacaagtaccccaagaaggtaattcgcaaggattcagccaagaagactgcgaagaaatcaagagtgaaggctttcatcaagcttgtgaactataaccacatcatgcctacacgttacacccttgatgtcgatctcaaggatgttgtcactccagatgttcttacttcccgtgacaagaaggttacagctgctaaagagacaaaggctcgtttggaggagaggttcaagaccgggaaaaacaggtggttcttcaccaagctcaggttctgaggctctgtgaaagagtttcattgttatctttttgagtagttatcattggctgagtttcagttttcttttttgaccgtaattgcattaaagataatacagggatttaaggttttgactctgaacttttaaatgactagtttatggcattgtctggttttagattccaaaacatatgtggtttgttagttcctcaagtggcatttatgatactgttagccagaaccaactaacttgttatagtttattacatagtattatgctcaatttgttctagtacatgaggccttgcacatatcagttgatgaagctgtgaatttaagcaagaaccttgaattctaggagtgctgatgcagcttaaatgctgcacgcgtgctgatgatgatgaatctgttagccattattacattgtaaattt

SEQ ID NO: 1798 - DNA, 668 bp, Papaver somniferum
catcgttcccttcctcagtcggatctcgttcaacacagagagagtagattcagcagaaccttaggaggtagcgacaatggttaagtttttgaagccaaacaaagctgtggtagtgctacaggggcgctttgctgggcgtaaggctgttatcatccgtgctttcgatgagggaacacgtgagcgtccatatggtcattgcttagttgcagggattaacaagtaccccaagaaggtaattcgcaaggattcagccaagaagactgcgaagaaatcaagagtgaaggctttcatcaagcttgtgaactataaccacatcatgcccacacgttacactcttgatgtcgatctcaaggatgttgtcactccagatgttctcacttcccgtgacaagaaggttacagctgctaaagagacaaaggctcgtttggaggagaggttcaagaccgggaaaaacaggtggttcttcaccaagctcaggttctgaggctcggtaacagagtttcattgttatctttttgagtagttatccactgagtttcagtttcctttttgactgtaattgcattaaagataatacagggatttaaggttttgactctaaacttttaaagggctagtttatggcattgtctggttttagattccaaaacatatgtggtttgctagtt

SEQ ID NO: 1799 - DNA, 558 bp, Raphanus sativus
agagagagcagcagccatggttaagttcctgaagcagaacaaagcggtgatcctcctccaaggccgttacgccggcaagaaggcagtgatcatccgatccttcgacgacggaaaccgcgagcgtccttacggacactgcctcgtcgcgggactcaagaagtatccgagcaaggtcatccgcaaggactcggccaagaagacggcgaagaaatctagagtcaagtgcttcatcaaggtcgtgaactaccagcatctgatgcctactcgttacacgttggacgtggatctgaaggaggttgcgactctggaagctctggcgtcgaacgacaagaaggtggcggctcttaaggaggctaaggctaagctcgaggagaggttcaagaccgggaagaacaggtggttctttaccaagctcaggttttgaagaagccattttgtcgtttctgttttttattattaatcgttttgtaatggaatttacagtatgcttatgtagtttcgagaatgaatgtggaacatgttttggatggtttatgaactttggtttgaagtttaatt

SEQ ID NO: 1800 - DNA, 642 bp, Raphanus sativus
ggacctagggttttcagcggcgataacgaagaagacgaagaagagggatctagacaaacaagtgaagcaacaatggtgaagttcttgaagcagaacaaggcagtgatcctcctccaaggccgatacgccggaaagaaggccgtgatcatccgctccttcgacgacgggaaccgcgagcgcccttacggacactgcctcgtcgccggactcaagaagtacccgagcaaggtcatccgcaaggactctgcgaagaagacggccaagaaatccagggttaagtgtttcatcaaggtcgtcaactaccagcacctgatgcccacgcgttacaccctcgacgtggacctcaaggaagtcgcgaccctcgaggctctgtcttccaaggacaagaaggtcgctgctctcaaggaggccaaggctaagctcgaggaccgtttcaagaccgggaagaacaggtggttctttaccaaactcaggttctgaaggagttcttgtcggaagaaagcgtttttgttgttgcattttcgtatctgatatttaaaacagcgtattattagtttcgtatggagaacagcgtggatcctgttttggattgtgaaagatttttgttgaaatttctgttctggaatttgattctctatttgc

SEQ ID NO: 1801 - DNA, 681 bp, Senecio madagascariensis
aagcagtggtatcaacgcagagtggccattacggccggggagcagaagaagaatatccagcggcggcggcgaaaatggtgaagtttctgaaaccaaacaaggcagtggtggtcctcaacggccgattcgccggccggaaagccgtcatcgtcaagcaattcgacgacggcactcgcgaccgtccttacggccactgtctcgtcgccggaatcgcaaagtacccgaagaaggtgatccgtaaggattcagctaagaaaaccgcaaagaagtcgcgcgtgaaggctttcatcaagctcgtgaactacaaccacatcatgccgacgcgctacacgctcgatgtggatctgaaggatgtggttacactcgacgcgctccagtcgcgtgataagaaggtcggcgcgtgtaaggagacgaaggctaggcttgaggagaggtttaagaccgggaagaacaggtggttcttctcgaagcttcgattctgaggtgaaaatgattttaattttatcgttttgattttgttatcgatatgatatgatagactttgattacttgtagtttgaatcgtatgatgagttttggaagattaatcgtatggatgttatgttttgtgattgtaatttgcggcggatttatgcggaattgctttcgattaatcgtttaatgttggaatattttattaaa

SEQ ID NO: 1802 - DNA, 634 bp, Senecio madagascariensis
aagcagtggtatcaacgcagagtacgcgggaacacggcggagaaaaaaagtaatcaaaaatggtgaagtttttgaaaccaaacaaggcagtagtggtcctcaacggccgtttcgccggccgtaaagccgtcatcgtcaaacaattcgacgacggcactcgtgaccgtccttacggccactgtctcgtcgccggaatcgcaaagtatccgaagaaagtcatccgtaaagactccgctaagaaaaccgctaaaaagtctcgtgtgaaggctttcattaagcttgttaactacaatcatatcatgcctacgcgctacacgctcgatgtggatctgaaagatgtggtgtctgttgacgcgttgcagtcacgcgacaagaaggtgactgcttgtaaggagaccaaggccaggttggaggaacggtttaagactgggaaaaaccgttggttcttctcgaagcttcgattctgagaaattgaaaatgaatttgtgaggtggtttatggttttatgattttcgttatattttgtttactgtttttagattatgaattatgatgttagactgagtaatgttagtttactttatgttatatggaccgaattttgtttcgttatcaatctatctttaatttgttt

SEQ ID NO: 1803 - DNA, 670 bp, Solanum phureja
catttcatccagccgagagagatagtgtgtgagagaggaatcagcggcggcgaggatggtgaagtttttgaagccaaacaaggctgttatccttcttcaaggcaaatatgccggccggaaagctgtgatcgtaagggcatttgatgaaggaacaagggacaggccatatggccattgtttggttgcaggtatctccaagtacccgaagaaggtgatccgcaaggattcagcaaagaagcaggcgaagaaatctcgtgtcaaggctttcatcaagctcgtgaactacaaccacatcatgccaactcgttacacactcgatgtggatctgaaggatgttgtcaatgctgatgttcttcaggcacgcgacaagaaggtgaccgctgcaaaggagaccaaggctaggcttgaggagaggttcaagaccgggaaaaatcgctggttctttactaagcttaggttctgagcgaagattgaatccgattttgatgaaatggtaatattcttagtattaaagagttttgagggatgttgtttttgttatcaaagatactgttaggctgtttttttgtgtttgaactattttattgatggataattcctggctcttgttttagttatctacaattttataatggtttgtttctaatgtttgagtagcttgatatttcta

SEQ ID NO: 1804 - DNA, 921 bp, Glycine max
gtggagcaatagcagcagaacagagagagcaaaaccctagagcatccatcacaagcagaggaagaagatggtgaagttcctgaagcctaacaaggcagtgatcgtcctgcagggccgctacgccgggcgcaaggcggtgatcgtgaggaccttcgacgagggaaccagggagcgcccctacggccactgcctcgtcgccggaataaagaagtacccaagcaaggtcatcaagaaggactccgcgaagaagaccgcgaagaaatctagggttaaggccttcgtgaagctcgtgaactaccagcacctcatgcccacgcgctacacgctcgacgtggatctaaaggacgctgttacccccgatgttctagccaccaaggacaagaaggttaccgctctcaaggagaccaagaagcgcctcgaggagaggttcaagaccggcaagaataggtggttcttcaccaaactcagattctgatttcgaaagcgtgaggttttatttattagggttttcggaatgttgccttttaatatattgtatccgtgttttgcaaatcttatcaaaactattattctgctcttagatttgttatcgtcgccgacttttgttaattaatatttctgccttttaatttacgggggaaatgaatgcgaacatattttgataccgagtcattcgcataaaatgtgtcaattcggatatgaaaatttctagtttgtttgatgagcactttttgttttgattgcgtttttagccccaatatcttttctaagtttctgcaattgtttgcaattttccacaatattaaagcttgtggcagaagtttactgaaatgaatcaccaagttcaattcatatgttgatatgaatcagctaatattcagtgagcaatgtcgatatgcttatgatgatgcaagtgctgtt

SEQ ID NO: 1805 - DNA, 675 bp, Solanum lycopersicum
atttcatccagccgagagagatagtgtgtgtgtgtgagagagattcagaggcggcgaggatggtgaagtttttgaagccaaacaaagctgttatccttcttcaaggcaagtatgccggccggaaagctgtgatcgtaagggcatttgatgaaggaacaagggacaggccatatggccattgtttggtcgcaggtatctccaagtacccgaagaaggtgatccgcaaggattcagcaaagaagcaggcgaagaaatctcgtgttaaggctttcatcaagctcgtgaactacaaccacatcatgcctactcgttacacactcgatgtggatctgaaggatgttgtcaatgctgatgttcttcaggcacgtgacaagaaggtgaccgctgcaaaggagaccaaggctaggcttgaggagaggttcaagaccgggaaaaatcgctggttctttaccaagcttaggttctgagcgaagattgaatccgattttgatgaaatggtaattttttttagtattaaagagttttgaggaatgtgtttgttatcaaagatactattaggctgtttttgtgtttgcactattttattgatggataattcctggctcttgtttcagttacctacagttttataatggcttgtttctaatgtttgagtagcttgatatttctatattc

SEQ ID NO: 1806 - DNA, 694 bp, Tragopogon dubius
aaaacaaagcccaccaatagcttaatgttatacaaagttttcaaaccctagccagccatatatccctgtgtcatatcgtcgtttaagaaccgcggcggaggtagacctagacaggaagcagaaatggtgaagtttttgaagcccaacaaggcggtggtagtcctcaacggccgattcgctggtcgaaaggctgtaatcgtcaaacagttcgatgacgggactcgtgaccgtccatacggacactgcctcgttgccgggatcgccaaatacccgaagaaggtgattcgcaaagattcagcaaagaagacggcgaagaagtcgcgtgtgaaggctttcatcaagctagtgaactacaaccacataatgccgacgaggtacacgctcgacgtcgatctcaaggatgttgtttccgtcgatgcgctccagtcccgtgacaagaaggtcactgcctgcaaagagaccaaagcacggctagaggagcgcttcaagaccgggaaaaaccgttggttcttctcaaagctccggttctgaggaaaaaaagatgagttgtttccggtttcagttttttgctttatttcttcttgaattttagctgatgaatgatacgatgatagaccgatttatgctagtttactttaagtttaaatggattgatttttgtttgcaaatcgagatacatttcagagggttaatc

SEQ ID NO: 1807 - DNA, 947 bp, Glycine max
aaaaaaagaaaaaaggggaattccgtgtcaacagcacttgcatcatcataagcatatcgacattgctcactgaatattagctgattcatatcaacatatgaattgaacttggtgattcatttcagtaaacttctgccacaagctttaatattgtggaaaattgcaaacaattgcagaaacttagaaaagatattggggctaaaaacgcaatcaaaacaaaaagtgctcatcaaacaaactagaaattttcatatccgaattgacacattttatgcgaatgactcggtatcaaaatatgttcgcattcatttcccccgtaaattaaaaggcagaaatattaattaacaaaagtcggcgacgataacaaatctaagagcagaataatagttttgataagatttgcaaaacacggatacaatatattaaaaggcaacattccgaaaaccctaataaataaaacctcacgctttcgaaatcagaatctgagtttggtgaagaaccacctattcttgccggtcttgaacctctcctcgaggcgcttcttggtctccttgagagcggtaaccttcttgtccttggtggctagaacatcgggggtaacagcgtcctttagatccacgtcgagcgtgtagcgcgtgggcatgaggtgctggtagttcacgagcttcacgaaggccttaaccctagatttcttcgcggtcttcttcgcggagtccttcttgatgaccttgcttgggtacttctttattccggcgacgaggcagtggccgtaggggcgctccctggttccctcgtcgaaggtcctcacgatcaccgccttgcgcccggcgtagcggccctgcaggacgatcactgccttgttaggcttcaggaacttcaccatcttcttcctctgcttgtgatggatgctctagggttttgctctctctgttctgctgctattgctc

SEQ ID NO: 1808 - DNA, 649 bp, Papaver somniferum
ttattttccaagtacatttaggtttttaaaacagtattttgattgagaagttgtatatttctcatggatggaatttttgtctatggattaatggggggagataaaaacacagtttcttcagatcaaaccagagtgcggcggaacaaagaggcggagcaaaaatggtgaagtttttgaaaccaaacaaggccgtaatcgtcttacaaggtcgattcgcaggtcgtaaagcagtgattgtgaagcaattcgatgaaggaactcgtgagcgtccttatggtcactgtttggtagctggaatcatgaagtacccaaagaaagtcatccgtaaagattcagcaaagaagacagcaaagaaatcgagagtgaaagctttcatcaaggttgtgaattacaatcacatcatgccaactcgttacactcttgatgtggatcttaaagatgttgttacacctgatgcgttgacatctagggataagaaggttactgctgctaaggagactaagaagaggttggaggaaaggttcaagactaggtaaaaacaggtggttcttcactaaactcaggttttaagcatctcttttcattttgggaggtagtgtcaagggattatcatgcgggttcaacagtgttctcaggaattatatgtttt

SEQ ID NO: 1809 - DNA, 749 bp, Eutrema halophilum
ggaggaaaatcgtggtgaagaaacaatggtgaagttcttgaagcagaacaaggcagtgatcctccttcaaggccattacggccgggaagaaggccgtgattatccgatccttcgacgacggaaaccgtgagcgtccctacggacactgcctcgtcgccggactcaagaagtacccgagcaaggtcatccgaaaagactcggcgaaaaagacggcgaagaaatctagggttaagtgtttcatcaagctcgttaactaccagcacctgatgcctactcgttacactctcgatgtggatctcaaggaagtcgccacgctcgacgctcttcagtccaaggacaagaaggtcgctgctctcaaggaagccaaggccaagctcgaggaacgtttcaagaccggcaagaacagatggttcttcaccaagctcaggttctgaggaaaattcgtgtttttctgaagaagttttgagctttattttgttgctttttcgtatcggattttacagcgtatttttagtttcgtatgatgaacaatgtggatccttttttggattgtgaaatttctattttggattttgattgtctaatgcttattgattccattaaattatctgcgttggttttgccataatttgaacttggttgattttgttttatcctggaactccattgcaatgagcttgttgttgatcattctcggtttagaaaaatgatcattgcttacttgaatcaaagttattcgattttggtaa

SEQ ID NO: 1810 - DNA, 659 bp, Cirsium arvense
ggggggcctcatttgataaaatcactacgctataaagaggctgctgcaaatttctgaaaccctagcaacacatctctctcttataccgtctttgagaagcgcggcggagaggcagatctcgagaggaagcgaaaatggtgaagtttttgaagccaaacaaggccgtggtggtgctcaacggccgtttcgccggaaggaaggctgtgatcgtgaaacagttcgacgacggaactcgtgaccgtccttacggccactgccttgttgccggaatcgctaagtatccgaagaaggtgatacgcaaggactcagcgaagaagaccgcaaagaagtcgcgtgtgaaggcgtttatcaagcttgtgaactacaaccacataatgccgacgaggtacactctcgacgtcgatctgaaggatgtagtctcggtcgatgcgttgcagtcgcgtgacaagaaagtgacggcctgcaaagagacgaaagcacgattggaggagcgtttcaagaccgggaaaaccgttggttcttctcgaagctccgattctgaggaaaaaagaggacttgcttcaggtgtcaggttttttgctatattttattttgaaattttagttgatgaatgacgatgatagactgattaatgctagattactttcattttgacttga

SEQ ID NO: 1811 - DNA, 601 bp, Taraxacum officinale
aaggatctactagtttgtgagatcagcggcggcgaaatggtgaagtttttgaagccaacaaggctgtggtggttctcaacggccgttttgccggacggaaagcggtgatcgtgaggcaatttgacgacggaactcgtgaccgtccctatggccactgcctcgttgccggaatcgccaagtacccgaagaaggtgatccgaaaggactcagcaaagaagacggcgaagaagtcgcgtgtgaaggcatttatcaagctagtgaactacaaccacatcatgccgactaggtacacgctcgacgtcgatctcaaggatatcgtcaccgtcgacgcgcttcagtcaaatgacaagaaggtaactgcctgtaaggagaccaaagctcgattggaggagaggttcaagaccgggaagaatcgttggttcttttcaaagctccgattctgaggaaaagataagttgttttgcatttctgttttgtgtttgttcttctaaattttccgctgatggatgataatgctcgacttttattattactagtggattttcgatttcgagatatcttcagctgcgtttttagtattgacgatcaatgaactttgtgt

SEQ ID NO: 1812 - DNA, 568 bp, Flaveria ramosissima
aaggcggagcagcggcggcgaaaaggtgaagtttctgaagccaaacaaggcggtggtggtcctcaacggccgtttcgccggccggaaggcggtgatcgtccggcagttcgacgacggaactcgcgaccgtccgtacggccactgtctcgtcgccggaatctccaagtacccgaagaaggtgatccgaaaggattcagcgaagaagacggcgaagaagtcgcgtgtgaaggcgttcatcaagctcgtgaactacaaccacatcatgcctacgaggtacacgttagatgtagatctgaaggatgtggtgacgcttgatgcgcttcaatcgcgtgataagaaggtcactgcgtgtaaggagacgaaggcgaggcttgaggagcggtttaagaccggtaaaaaccggtggttcttctcgaagctccgattctgagaaccagataaggtgatttacgatttgatgctttttgttcgttttcgtgattttcgtttatgaacgatgatgttagactgttattgatgattatgcacttttgattttgaaatttatgttaaacctgcagtttcagcg

SEQ ID NO: 1813 - DNA, 741 bp, Allium cepa
ctacctcccctgtggcgtccgttcggacgagtctcaagaagacaggtggttatacacgcagaggtacgggggatcacaagattagggtttgagccgccatttctcaggtaagcaatggttaagtttctcaagccaaacaaggctgttatcctcttgcaaggtcgtttcgcaggtcgaaaagctgttatcgtcaagaacttcgacgatggtactcgcgatcgtgcctatggccactgcctcgtcgccggaattctcaagtacccgaagaaggtgatccgcaaagactctgctaaaaaggaccgcgaagaaatcaagggtgaaggcgtttctgaaagtggtgaactacagccacataatgccaacacgatacacgttggatgtggatctgaaggatgtggttactgtagatgccttgcagacgaaggacaaaaaggtggaaacttgcaaggaagtaaaaaagcggttcgaggagaggttcaaaaccggaaagaacaggtggtttttcacaaagttgaggttttgaatcttctttctataattattctgagatcttattttagggttgatttggacttatccaagtttggattttgaattctgtttttgtttaatcatggtactttgttggattattaatattgatattgatattgctgcttctttcttttttaaaaacatgtattgttgtagattaactggtatttcatgaaaaacaccaataccttggtattgttcttttca

SEQ ID NO: 1814 - DNA, 1549 bp, Solanum tuberosum
gatccagccgagagagatagtgtgtgagagagagaatcagcggcggcgaggatggtgaagtttttgaagccaaacaaggctgttatccttcttcaaggcaaatatgccggccggaaagctgtgatcgtaagggcatttgatgaaggaacaagggacaggccatatggccattgtttggttgcaggtatctccaatacccgaagaaggtgatccgcaaggattcagcaaagaagcaggcgaagaaatctcgtgtcaaggctttcatcaagctcgtgaactacaaccacatcatgccaactcgttacacactcgatgtggatctgaaggatgttgtcaatgctgatgttcttcaggcacgcgacaagaaggtgaccgctgcaaaggagaccaaggctaggcttgaggagaggttcaagaccgggaaaaatcgctggttcttcactaagcttaggttctgagcgaagattgaatccgattttgatgaaatggtaatattcttagtattaaagagttttgagggatgttgtttttgttatcaaagatactattaggctgtttttgtgtttgctctattttattgatggataattcctggctcttgttttagttatttacagttttataatggtttgtttctaaaaaaaaaaaaaaaaaaacgagatacgggactgcaacttccaaatatgcttcaaggaaaaatgttggtgttcgtatacctgatgatcctgtctgtcaagcaatcttagaaaaagttggatggacctctaatatccacaagcgtcaagtcacctaaggagaatgagtggatactggatcccgtcattatagctgatgtatatggtccagagggacttgattttgttgttgatcgggtgttcgagtggctgatccatcaactgtagttgatatgactgaaagtggtcctagaattatacggcagggaaagggtcctaagcagccttggatgataatggaagatgatgattctgctgtagataaatagaacccattgttgccgctgtttaagtaagaagtactgcttaaaatgtacacttcctcaagccagagctcttgtacagcacacagataagatggtgaatcccttgttgatcttgaacagagtcttttagtcttcattagtgtagattgctgtaaatacttaatgtggtaaatcaagaatcacatataatgttttgcttgtctaaactctaaagcaagtaatgatcactctctctcattccctgccctctggtgatttatattgcgtttctcctgcaagctcccttcgtgaaaactgtggaagccttgtcctgccagagcgccatgcctctattttctttctcgtcggtgtagtgaagggagaagtctctgctctaagttctatggtctatgtcgaggggtggggaggggttctatttggtttcaattactgtaactgtttctgatcaattgaaaggttgaaataactactgtttgatgtttttatacgcgtaaaaagaagggataggggccatactacatagcctccgttttcgtacgaaaaaaaaaa

SEQ ID NO: 1815 - DNA, 620 bp, Zinnia violacea
acagagcgaaagtaagctttacggcggccgaaaatggtgaagtttctgaaaccaaacaaggcagtggtggtcctcaacggccgtttcgccggccggaaagcggtaatcgtccgtcaattcgacgatggaactcgcgatcgtccgtatggccactgtctggttgcaggaatctccaaatatccaaaaaaaagtgatccgtaaggattcagcgaagaaaaccgcgaagaaatcacgagtgaaagcgttcatcaaactcgtgaattacaaccacatcatgccgactaggtatacgcttgatgtagatctgaaagatgttgttacgcttgatgcgttacagtctcgtgataagaaggttactgcgtgtaaggagacgaaagctaggtttgaggagcggtttaagaccggtaagaaccggtggtttttctcgaagctgaggttctgagatgttgaagaagacggagaagaatataagttgtttactgttttcggttattttagtttttatttgatgattgataatgcgatgttgctagacttgttttgaattgaatgcacttttggttttgatatttgtttttgaatctgtggtttttagttttgaatttgtgtgtttgatatct

SEQ ID NO: 1816 - DNA, 662 bp, Acacia harpophylla
atcagcgagcgtggaggcagaagaaggaggagacccagctacagaagaccgaaactcctgaaaatggtaaagttcttgaagccgaacaaagccgttattctccttcagggacgctatgctggtcgcaaagcggtaatcctacgtaacttcgatgatggcacgcgtgaccgcccctacggccactgtttagtcgccgggatcaaaaagtaccccagcaaggtcatcaagaaggattcagcaaagaagacggccaagaaatctagggttaaggcttttgttaagctcgtgaactatcagcatctcatgcctactcgttacaccctcgatgtggatctcaaggaggtagcgaccatagatgccctccaatctaaggacaagaaggttactgccttgaaggagaccaagaagagattcgaggagaggttcaagaccggcaagaacaggtggttctttaccaagcttaggttctgagtgtttctctttgggaaggacgtcgccgttttatactatttttgtttctgttttagttttgttaaagggaattttggatagagattatagtattatcgtttcttattgcgtatgttggactatgtactttttttctttagctaaattgatgatcatgttgtttctattcataaaaaaaaaaaaaaaaaaag

SEQ ID NO: 1817 - DNA, 581 bp, Ambrosia trifida
agacacttcaaccaaccaaaacaatggtgaagtttctaaaaccaaacaaggcagtagtcgtcctcaacggccgtttcgccggccgtaaagccgtcatcgtcaaacagttcgacgacggcactcgcgaccgtccatacggacactgcctcgtcgccggaatctccaagtacccaaagaaggtcatccgtaaggattcagcaaagaagacggcgaagaagtctcgtgtgaaggcgtttattaagctggtgaactacaaccacataatgccgactaggtatacgcttgatgtggatctaaaggatgttgttactgttgatgtgttgcagtcacgtgacaagaaggtgactgcgtgtaaggaggctaaggctaggttggaggaacggtttaagactggaaagaacaggtggttcttctcgaagcttcggttttgaggtggttttgatgttgcaggttttgttatgattgttagttttatgcagtttgctggattaatgttttgaattttatgtgttatgtttgtggtttgaatgatttgagactatgttttaatttggtttccagttatatgatggtggattgat

SEQ ID NO: 1818 - DNA, 409 bp, Aquilegia formosa
atggtgaagtttctcaaacccaacaaggctgtgatcgttcttcaaggtcgatttgcaggaagaaaggcagttatcattcgtcaattcgatgaaggaactcgtgatcgtccatatggtcattgtttggtagctggaattgcaaagtacccaaagaaggtgattcgaaaggattcagcgaagaagacagcaaagaaatctcgagttaaggctttcatcaagcttgttaactataaccatatcatgccgactcgttacactcttgatgttgatcttaaggatgttgcgaatctcgaaacttttcaatctcgtgataagaaggttactgctgccaaggagattaagtctcgtttggaggagaggttcaagactggaaagaaccgttggtttttctcaaagctcaggttctgat

SEQ ID NO: 1819 - DNA, 599 bp, Arabidopsis lyrata
ttcttctttgcggtgtgagaaagaaacaatggtgaagtttctgaagcagaacaaggccgtgatcctccttcaaggccgttacgccggtaagaaggcagtgatcatcaaatccttcgacgacggaaccagtgaccgtcgttacggacactgcctcgtcgccggactgaagaagtatccaagcaaagtcatccgcaaagactcagcgaagaagacggcgaagaagtctcgagtgaaatgtttcatcaaactcgtgaattaccagcatctgatgcctacacgttacacactcgatgtagatctgaaggaagttgcgactcttgatgctcttaagagtaaagataagaaggtgactgctcttaaggaagctaaggctaagcttgaggagaggttcaagactggcaagaacaggtggttctttactaagctcaggttctgaagaagaatctttgagtttttatctttatcgaattttataactatctattttgtttagttctagaatcagtttggattattgtttaagactattttggtttggaattgattctggcttttgtcttttacttatgatcatttgcgatattgatgctttccaattt

SEQ ID NO: 1820 - DNA, 613 bp, Arabidopsis thaliana
aattagggtttcttctttgcggtggtgagaaacaatggtgaagtttctgaagcagaacaaagcggtgatcctccttcaaggccgttacgccggcaaaaaggcagtgatcatcaaatccttcgatgacggaaccagtgaccgtcgttacggacactgcctcgtcgccggactgaagaagtacccgagcaaagtcatccgcaaagactcagcgaagaagacggcgaagaaatcaagagtgaaatgtttcatcaagctcgtgaattaccagcatctgatgcctactcgttacacgctcgatgtagatctgaaggaagtagcgactcttgatgctcttaagagtaaggataagaaggtgactgctttaaaggaagctaaggctaagcttgaggaacgtttcaagactgggaagaacaggtggttctttactaagctcaggttctgaagaagaacctttgagatttttatctatctatctactttttgtttagttctagaatgaatttggatcattgtttaagaccttttggtttggaattgattctggattttgtctcttacttataatcttttgctatattgatgcctcattttatatattgtcactggtttaata

SEQ ID NO: 1821 - DNA, 569 bp, Aristolochia fimbriata
tgtaaagatgattttagggttcccactttccatcgacgagcgcccgaagagaccctccttaaaccctagcggaggcctcttttagcttttccttccttgacgagcggaggcagaggcggcgttgacggagagcgctcgaaaggcaccatggtgaagtttctgaagcccgggaaggcggtggtcctcctgcaaggccgattcgccggccggaaggcggtcatcatccgctccttcgacgacggcacccgggaccggccgtacgggcactgcctgatcgccggcatctccaagtacccgaagaaggtgatccgcaaggattcggcgaagaagaccgcgaagaagtcgagggtgaaggccttcatcaagctcgtcaattacaaccatataatgcccacgcggtacaccctcgacgtcgacctcaaggacgtcgtctccatcgacgccttccagtcgcgcgacaagaaggtcgccgccgccaaggagaccaaggccaagctcgaggagaggttcaagacggggaagaaccggtggttcttcagcaaactcaggttctgatgtcttttcacggt

SEQ ID NO: 1822 - DNA, 547 bp, Arnica chamissonis
tatggcgcggcggcgaaaatggtgaagtttctgaagccaaacaaggcggtggtggtgctcaacggtcgtttcgccggccggaaagctgtgatcgtgaggcaatttgacgacggaactcgtgaccgtccctatggccactgcctcgtcgccggaatctccaagtacccgaagaaggtgatccgaaaggactcagcgaagaagacagcgaagaagtcgcgcgtgaaggcattcatcaagctcgtgaactacaatcacatcatgccgactaggtacacgcttgacgtagatctgaaggatatcgtcacggttgatgcgcttcagtctcgtgacaagaaggtaaccgcctgtaaggagacgaaagcacgtctcgaggagcggttcaaaaccggaaagaaccgttggttcttctcgaagctccgattctgaagaaagataagttgttttacgtttcggtttttgtgtctgatttcttaattttcatttgatggatgatgttgctatactcgtattgatcctaatgcattttcaatttcaatcaacatcgtga

SEQ ID NO: 1823 - DNA, 637 bp, Brassica juncea
agtacgcgggagggttttcagcggcgacaacgaagacgaaggagagaggagatctagaacaagcgaagaaacaatggtgaagttcttgaagcagaacaaggcagtgatcctcctccagggccgatacgccgggaagaaggccgtgatcatccgttccttcgacgacggaaaccgcgagcgtccttacggacactgcctcgtcgcggggctcaagaagtacccgagcaaggtcatccgcaaggactcggccaagaagacggcgaagaagtcaagggtcaagtgtttcatcaaggtcgtcaactaccagcatctgatgcctacgcgttacaccctcgacgtggatctcaaggaagtcgccaccctcgaggctctttcgtccaaggacaagaaggtggctgctctcaaggaggccaaggcgaagctcgaggagcgtttcaagactggcaagaacaggtggttcttcaccaagctcaggttctgaggacattttgagcttttttcgtatggagtttaaaagctttgttttagtttctactagggttcatatgttgaacgatgtggatcctgttttatcttgtggaagacgttttgttggaatttcgattctggattttctatgttatgattatctaatgca

SEQ ID NO: 1824 - DNA, 561 bp, Brassica juncea
ttttttcagcggcgataacgaagacgaaggagagggatctatctaccaagtgaagcaacaatggtgaagttcctgaagcagaacaaggccgtgatcctccttcaaggccgatacgccggaaagaaggccgtcatcatccgttccttcgacgacggaaaccgtgagcgtccttacggccactgcctcgtcgccggactcaagaaatacccgagcaaggtcatccgcaaggactcggccaagaagactgcgaagaaatctagggtcaagtgtttcatcaaggtcgttaactaccagcatctgatgcctacacgttacaccctcgacgtagatctcaaggaagtggcgaccctcgaggctctttcgtccaaggacaagaaggtcgctgctctcaaggaagctaaggctaagctcgaggagcgtttcaagaccgggaaaaacaggtggttcttcaccaagctcaggttctgaagacgttttgagcttttttttttagttgttgctttcgttcattttagtttctaaggttgacaatgtggatcctgtttcggaagatgaaagatt

SEQ ID NO: 1825 - DNA, 720 bp, Brassica juncea
cttagggttttcagcggcgacaacgaagacgaaggagagaggagatctagaacaagcgaagaaacaatggtgaagttcttgaaacaaaacaaggccgtgatccttcttcaaggccgatacgccggaaagaaagctgtgatcatccgctccttcgacgacggaaaccgtgagcgtccttacggacactgcctcgtggccggactcaagaagtacccgagcaaggtcatccgcaaggactcggccaagaagacggcgaagaaatctcgggtcaagtgtttcatcaaggtggttaactaccagcatctgatgcctacacgttacaccctcgacgtggatctcaaggaagtcgccaccctcgaggctctttcttcaaaagacaagaaggtggctgctctcaaggaggccaaggcgaagctcgaggagcgtttcaagactggcaagaacaggtggttctttaccaagctcaggttctgaggacgttttgagctctttcgtatggagtttaaaagctttgttttagtttctactagggttcatatgttgaacgatgtggatcctgttttatcttgtggaagacgttttgttggaatttcgattctggattttctctgttatgattatctgatgcattttgatttacctactcgtttcctttgaatgatctgcatatgttttataacctttagatatacctcgatcataatctcgatagaaaatgat

SEQ ID NO: 1826 - DNA, 563 bp, Brassica juncea
ggttttttcttcagcggcgataaagagaagaaacaaacaatggtgaagttcttgaagcagaacaaggccgtgatccttctccaaggccgatacgccggaaagaaggccgtgatcatcaaatccttcgacgacggaaaccgcgagcgtccctacggacactgcctcgtggccggactcaagaagtacccgagcaaggtcatccgcaaggactcggccaagaagacggcgaagaaatctagggtcaagtgtttcatcaaggtcgtcaactaccagcatctgatgcctacacgttacaccctcgacgtggatctcaaggaagtggcgaccctcgatgctctttcgtccaaggacaagaaggtcgcggctctcaaggaggctaaggctaagctcgaggagcgtttcaagaccgggaagaacaggtggttcttcaccaaactcaggttctgaggacttttgagttctttttttttattgttgcttttcgcattgaatttttcagcgtacctttagtttctaaggttgaacaatgtggatcctcttttggaagatgaaagattgtttct

SEQ ID NO: 1827 - DNA, 633 bp, Brassica juncea
tcgccggaagaggagccatggttaagtttcttaagcagaacaaagcggtgatcctccttcaaggccgttacgccggcaagaaggctgtgatcatccgttccttcgacgacggaaaccgcgagcgtccctacggacactgcctcgtcgccggactcaagaagtaccctagcaaggtcatccgcaaggactcggccaagaagacggcgaagaagtcgagggtcaagtgtttcatcaaggtcgtgaattaccagcatctgatgcctactcgttacacgcttgacgtggatctgaaggaagtggccactctcgaagctctgtcttcgaaggataagaaggtggcggctcttaaggaggccaaggctaagctcgaggagaggttcaagactggaaagaacaggtggttcttcaccaagctcaggttttgagaacgtttttatcttttgtattggaatctagaatgaatgtggaacatgttttggatgatttaagactttggtttggaatttaattctggaagttttctttttaattatactggtgcctttatttatatatcatcacaggttaaatagttgaattaggtttgtgtgtgaaaagccaaatgattaaatatggtttccatggattgttatt

SEQ ID NO: 1828 - DNA, 523 bp, Brassica juncea
aatggtgaagttcttgaagcagaacaaggccgtgatcctccttcaaggccgatacgccggaaagaaggccgtcatcatccgctccttcgacgacggaaaccgtgagcgtccttacggccactgcctcgtcgccggactgaaaaagtacccgagcaaggtcatccgcaaggactcggccaagaagacggcgaagaaatctagggtcaagtgtttcatcaaggtcgtcaactaccagcatctgatgcctacgcgttacaccctcgacgtggatctcaaggaagtcgcgaccctcgaggctctttcttccaaggacaagaaggtcgctgctctcaaggaggccaaggctaagctcgaggagcgtttcaagaccgggaagaacaggtggttctttaccaagctcaggttctgaaggaacgttttgagccttttgttgttgcatttctatattaaaacagcttattactagtttcgggttcatagaacaatgtggatcctgttttggcttgtggaagacgttttctcg

SEQ ID NO: 1829 - DNA, 724 bp, Brassica juncea
tttttttcagcggcgatacgaagacgaaggagagggatctatctacacaagtgaagcaacaatggtgaagttcttgaagcagaacaaggcagtgatcctcctccaaggccgttacgccggaaagaaggccgtgatcatccgatccttcgacgacggaaaccgcgagcgtccttacggacactgcctcgtcgcggggctcaagaagtacccgagcaaggtcatccgcaaggactcggccaagaagacggcgaagaagtcaagggtcaagtgtttcatcaaggtcgtcaactaccagcatctgatgcctacgcgttacaccctcgacgtggatctcaaggaagtcgcgaccctcgaggctctttcttccaaggacaagaaggtcgctgctctcaaggaggctaaggctaaactcgaggaacgtttcaagaccgggaagaacagatggttctttaccaaactcaggttctgaaggaatcactgtcggaagaaacattttgagagtttttgttgttgcattttcttatccaatatttaaaacagcgtattattgttagtttctttggttcatatggagaacagtgtggaacctgttttgggttgtgaaagacttttgttggaaatttctgttctggagtttgattctctattgcattttgattacctctttgcttccattgaatgattttgcttaggattttgtgataatttgagttttagtaatgtc

SEQ ID NO: 1830 - DNA, 572 bp, Brassica oleracea
gtttctctcagcaactaatcgtttcgccggaagaggagccatggttaagtttctaaagcagaacaaagcggtgatcctccttcaaggtcgttacgccggcaagaaggcggtgatcatccgatccttcgacgacggaaaccgcgagcgtccctacggacactgcctcgtagccggactcaagaagtacccgagcaaggtcatccgcaaggactcggccaagaagacggcgaagaagtcgagggtcaagtgtttcatcaaggtcgtgaattaccagcatctgatgcctactcgttacacgcttgacgtggatctgaaggaagtggccactctcgaagcactgtcttcgaaggataagaaggtggcggctcttaaggaggccaaggctaagctcgaggagaggttcaagactggaaagaacaggtggttcttcaccaagctcaggttctgagaaccttttatccttttttttttttgtaatggaatctacagtatgcttttgtagtttgtggaacatgttttggatggtttaagacttaatggtttgaaatttggttctggaagttttgttctta

SEQ ID NO: 1831 - DNA, 664 bp, Brassica oleracea
ttttttttcagcggcgataagacaagacgaaggagagggatctacacaagtgaagcaacaatggtgaagttcttgaagcagaacaaggcagtgatcctcctccaaggccgatacgccgggaagaaggcggtgatcatccgttccttcgacgacggaaaccgcgagcgtccttacgggcactgcctcgttgccgggctcaagaagtaccccagcaaggtcatccgcaaggactcagcgaagaagacggcgaagaaatctagggttaagtgtttcatcaaggtcgtcaactaccagcatctgatgcctacgcgttacaccctcgatgtggatctcaaggaagtcgcgaccctcgaggctctgtcttcaaaggacaagaaggtcgctgctctcaaggaggctaaggctaagctcgaggagcgtttcaagaccgggaagaacagatggttctttaccaaactcaggttctgaaggaatcactgtcggaagaaacattttgagcttattttgttgttgcattttcttatccaatatttaaaacagcgtattattgttagtttctatggttcatatggagaacaatgtggatcctgttttgggttgtgaaagacttttgttggaaatttctgttctggagtttgattctctattgcaatttgattacctc

SEQ ID NO: 1832 - DNA, 587 bp, Brassica oleracea
tcggcgataaagagaagaaacaatggtgaagttcttgaagcagaacaaggccgtgatccttcttcaaggccggtacgccggaaagaaagccgtgatcatccgctccttcgacgacggaaaccgtgagcgtccttacggacactgcctcgtggccggactcaagaagtacccgagcaaggtcatccgcaaggactcggccaagaagacggcgaagaaatctcgggttaaatgtttcatcaaggtcgttaactaccagcatctgatgcctacccgttacaccctcgacgtggatctcaaggaagtcgctaccctcgaggctctttcttcaaaggacaagaaagtcgctgctctcaaggaggctaaggcgaagcttgaggaacgttttaagactggcaagaacaggtggttctttaccaagctcaggttctgaagacatttcgtatggagttttacagctttacttttttctagggttcgtggacgacgtggatcctcttttatcttgtgaaagactttttgttggaatttcgattctggattttctatgttatgattatctaatgcagttttatttacgtcctcgtttc

SEQ ID NO: 1833 - DNA, 824 bp, Brassica rapa
tttaggcccagcacatgttatatgggccgaatcagatgcatttcacgcctttagggtttgctcatagcacagagtatatataccaaaaaacctaatcccttccgtcgtttctctcagcaacttagcatttcgccggaagaggagccatggttaagtttcttaagcagaacaaagcggtgatcctccttcaaggccgttacgccggcaagaaggctgtgatcatccgttccttcgacgacggaaaccgcgagcgtccttacggacactgcctcgtcgccggactcaagaagtaccctagcaaggtcatccgcaaggactcggccaagaagacggcgaagaagtcgagggtcaagtgtttcatcaaggtggtgaattaccagcatctgatgcctactcgttacacgcttgacgtggatctgaaggaagtggccactctcgaagctctgtcttcgaaggataagaaggtggcggctcttaaggaggccaaggctaagctcgaggagaggttcaagactggaaagaacaggtggttcttcaccaagctcaggttttgagaacgtttttatcttttgtattggaatctagaatgaatgtggaacatgttttggatgatttaagactttggtttggaatttaattctggaagttttctttttaattatactggtgcctttatttatatatcatcacaggttaaatagttgaattaggtttgtgtgtgaaaagccaaatgattaaatatggtttccatggattgttattgaaattctctgtattcgtttttttttcaaatggtatgagttaaggtctaggcttttgttaca

SEQ ID NO: 1834 - DNA, 713 bp, Brassica rapa
attattaaacctagaattttcactgaagccgccaccacctagggtttctagcggcgataggagagagagggagagagagatctagagaagtgaagcaaaatggtgaagttcttgaagcagaacaaggccgtgatcctccttcaaggccgatacgccggaaagaaggccgtcatcatccgctccttcgacgacggaaaccgtgagcgtccttacggccactgcctcgtcgccggactcaaaaagtacccgagcaaggtcatccgcaaggactcggccaagaagacggcgaagaaatctagggtcaagtgtttcatcaaggtagttaactaccagcatctgatgcctacgcgttacaccctcgacgtggatctcaaggaagtggcgaccctcgaggctctttcgtcaaaggacaagaaggtggcggctctcaaggaggctaaggctaagctcgaggagaggttcaagaccggcaagaacaggtggttcttcaccaagctcaggttctgaagacgttttgatcttcttttttattaattgttgattgaatttttcagcgtcattttcgtttctactgttgaacaatgttgatcttgttttggaagatgaaagatcttttctcggaatttttttttttaattttgattatttacatgttcatttcctttgaatgatctgcttaagtttacaaaatgttagttcatattgattggtta

SEQ ID NO: 1835 - DNA, 694 bp, Brassica rapa
actgaatccgccacttagcggcgataaagagaagaaacaatggtgaagttcttgaaacaaaacaaggccgtgatccttcttcaaggccgatacgccggaaagaaagctgtgatcatccgctccttcgacgacggaaaccgtgagcgtccttacggacactgcctcgtggccggactcaagaagtacccgagcaaggtcatccgcaaggactcggccaagaagacggcgaagaaatctcgggtcaagtgtttcatcaaggtggttaactaccagcatctgatgcctacccgttacaccctcgacgtggatctcaaggaagtcgctaccctcgaggctctttcttcaaaggacaagaaagtcgctgctctcaaggaggctaaggcgaagcttgaggaacgttttaagactggcaagaacaggtggttctttaccaagctcaggttctgaggacatttcgtatggagttttacagctttactattttagtttctagggttcatttgttggacgacgtggatcctcttttatcttgcgaaagactttttgttggaatttcgattctatgttatgattatctaatgcagtttgatttacctcctcgtttcctttgaatgatctgcttatgttttatatctttagtagatctaccttgttcataatctcgatagaaaatgatcattttgtttctaaagat

SEQ ID NO: 1836 - DNA, 737 bp, Theobroma cacao
gacctagggtttttgagaggagagaatcagagccgctgcagccgccgtcaccatggtgaagtttcttaaacccaacaaggccgtcatcgtcctccaaggcagatatgccggacgcaaagccgtgatcgtgaaatccttcgacgacggcacacgtgaacgcgcatacggccactgtttggttgcaggggtaaagaagtacccaagcaaggttattcgaaaggactccgccaagaaaacagccaagaagtcacgcgtcaagtgcttcatcaagctcgtgaattaccagcatctgatgcccacgcgttacaccctcgacgtggacttgaaagacgtggtcaccgtcgatgctcttcagacaaaggacaagaaagtggctgcctgcaaggcaactaaggagaggtttgaagagaggttcaagactggaaagaacaggtggttctttactaagcttaggttttaagggttttgttggtgttgtcgcttttgagttattatattgtcattttgaagaaaagaagtttgagttttatctagtgtcttgaacattttggatttgaatctgttcggatgagatttttctgggttcttattttagttatattttgatacgtgatctgctcatttctgtcagaaattttatgtttttgaacctttctgcatgctttatgatctatcatattgttttaccgcagagctgtagaacgttggaagatgataattaaatcatttaatgttag

SEQ ID NO: 1837 - DNA, 738 bp, Brassica napus
ggtacacaaaaacctaatcccttccgtcgtttctctcagcaacttagcatttcgccggaagaggagccatggttaagtttcttaagcagaacaaagcggtgatcctccttcaaggccgttacgccggcaagaaggctgtgatcatccgctccttcgacgacggaaaccgcgagcgtccctacggacactgcctcgtcgccggactcaagaagtaccctagcaaggtcatccgcaaggactcggccaagaagacggcgaagaagtcgagggtcaagtgtttcatcaaggtcgtgaattaccagcatctgatgcctactcgttacacgcttgacgtggatctgaaggaagtggccactctcgaagctctgtcttcgaaggataagaaggtggcggctcttaaggaggccaaggctaagctcgaggagaggttcaagactggaaagaacaggtggttcttcaccaagctcaggttttgagaacgtttttatcttttgtattggaatctagaatgaatgtggaacatgttttggatgatttaagactttggtttggaatttaattctggaagttttctttttaattatactggtgcctttatttatatatcatcacaggttaaatagttgaattaggtttgtgtgtgaaaagccaaatgattaaatatggtttccatggattgttattgaaattctctgtattcgtttttttcaaatggtatgagttaaggtcaaaaaaaaa

SEQ ID NO: 1838 - DNA, 637 bp, Brassica napus
ccaccacctagggtttctagcggcgataggagagagagagagagagagagagagagatctagagaagtgaagcaaaatggtgaagttcttgaagcagaacaaggccgtgatcctccttcaaggccgatacgccggaaagaaggccgtcatcatccgctccttcgacgacggaaaccgtgagcgtccttacggccactgcctcgtcgccggactcaaaaagtacccgagcaaggtcatccgcaaggactcggccaagaagacggcgaagaaatctagggtcaagtgtttcatcaaggtagttaactaccagcatctgatgcctacgcgttacaccctcgacgtggatctcaaggaagtggcgaccctcgaggctctttcgtcaaaggacaagaaggtggcggctctcaaggaggctaaggctaagctcgaggagaggttcaagaccggcaagaacaggtggttcttcaccaagctcaggttctgaagacgttttgatcttctctttttaattgttgattgaatttttcagcgtcattttagtttctactgttgaacaatgttgatcttgttttggaagatgaaagatcttttcttggtaatttttttttaatttgattatttacatgttcatttaacg

SEQ ID NO: 1839 - DNA, 512 bp, Brassica napus
agccatggttaagtttctgaagcagaacaaagctgtgatcctccttcaaggtcgttatgccggcaagaaggctgtgatcatccgttccttcgacgacggcaaccgcgagcgtccttacggacactgcctcgtcgccgggctcaagaagtaccccagcaaggtcatccgcaaggactcagccaagaagacggcgaagaagtcgagggtcaagtgtttcatcaaggtcgttaactaccagcatctgatgcctactcgttacacgttggacgtggatctgaaggaggttgcgactctcgaggctctggcttcgaaggacaagaaggtggcggctcttaaggaggctaaggctaagctcgaggagaggttcaagtctggaaagaacaggtggttcttcaccaagctaaggttctgagaaccgagtttctttttatcttttgtaatggaatttacagattgcttttgtagttctagaatgaatgtggatcatgttttggatggattaagactttttt

SEQ ID NO: 1840 - DNA, 688 bp, Brassica napus
agcggcgataaacaagacgaaggagagggatctacacaagtgaagcaacaatggtgaagttcttgaagcagaacaaggcagtgatcctcctccaaggccgatacgccgggaagaaggcggtgatcatccgttccttcgacgacggaaaccgcgagcgtccttacgggcactgcctcgttgccgggctcaagaagtaccccagcaaggtcatccgcaaggactcagcgaagaagacggcgaagaaatctagggttaagtgtttcatcaaggtcgtcaactaccagcatctgatgcctacgcgttacaccctcgatgtggatctcaaggaagtcgcgaccctcgaggctctgtcttcaaaggacaagaaggtcgctgctctcaaggaggctaaggctaagctcgaggagcgtttcaagaccgggaagaacagatggttctttaccaaactcaggttctgaaggaatcactgtcggaagaaacattctgagcttattttgttgtttcattttcttatccaatatttaaaacagcgtattattgttagtttctatggttcatatggagaacaatgtggatcctttttgggttgtgaaagacttttgttggaaatttctgttctggagtttgattctctatggcattttgattacctctttgcttccattgaatgattttgctttggattttg

SEQ ID NO: 1841 - DNA, 566 bp, Brassica napus
ataaagagaagaaaaaatggtgaagttcttgaagcagaacaaggccgtgatccttcttcaaggccggtacgccggaaagaaagccgtgatcatccgctccttcgacgacggaaaccgtgagcgtccttacggacactgcctcgtggccggactcaagaagtacccgagcaaggtcatccgcaaggactcggccaagaagacggcgaagaaatctcgggttaaatgtttcatcaaggtcgttaactaccagcatctgatgcctacccgttacaccctcgacgtggatctcaaggaagtcgctaccctcgaggctctttcttcaaaggacaagaaagtcgctgctctcaaggaggctaaggcgaagcttgaggaacgttttaagactggcaagaacaggtggttctttaccaagctcaggttctgaggacatttcgtatggagttttacagctttactttagtttccagggttcatttgttggacgacgtggatccccttttaatttgtgaaagactttttgttggaatttcgattctggattttctatgttatgattatctaatgct

SEQ ID NO: 1842 - DNA, 631 bp, Brassica napus
tggtgaagttcttgaagcagaacaaggcagtgatcctcctccaaggccgatacgccgggaagaaggcggtgatcatccgatccttcgacgacggaaaccgtgagcgtccttacggacactgcctcgtcgccggactcaagaagtacccgagcaaggtcatccgcaaggactcggcgaagaagacggccaagaaatctagggttaagtgtttcatcaaggtcgtcaactaccagcatttgatgcctacgcgttacaccctcgacgtggatctcaaggaagtcgcgactctcgaggctctggcttcaaaggacaagaaggtcgctgctctcaaggaggcgaaggctaagctcgaggaacgtttcaagaccgggaagaacagatggttctttaccaaactcaggttctgaaggaatcactgtcggaagaaacattttgagagtttttgttgttgcattttcttatccaatatttaaaacagcgtattattgttagtttctatggttcgtatggagaacaatgtggatcctgttttggattgtgaaagacttctgttggaaatttctgttctggagtttgattctctattgcattttgattacctctttgcttccattgaatgattttgcttagg

SEQ ID NO: 1843 - DNA, 696 bp, Brassica napus
cattcgatcggccattcggccggtgattgagttctttatcaactattaacctagcattttcgctgaaccgccacttagcttttttttcagcggcgatacgaagacgaaggagagggatctatctacacaagtgaagcaacaatggtgaagttcttgaagcagaacaaggcagtgatcctcctccaaggccgatacgccgggaagaaggcggtgatcatccgttccttcgacgacggaaaccgtgagcgtccttacggacactgcctcgtcgccggactcaagaagtacccgagcaaggtcatccgcaaggactcggcgaagaagacggccaagaagtctagggttaagtgtttcatcaaggtcgtcaactaccagcatctgatgcctacgcgttacaccctcgacgtggatctcaaggaagtcgcgactctcgaggctctttcttcaaaggacaagaaggtcgctgctctcaaggaggctaaggctaagctcgaggaacgtttcaagaccgggaagaacagatggttctttaccaaactcaggttctgaaggaatcactgtcggaagaaacattttgagtttactttgttgttgcattttcttatccaatatttaaaacagcgtattattgttagtttctatggttcatatggagaacaatgtggatcctgttttggattgtgaaagacttctgtt

SEQ ID NO: 1844 - DNA, 571 bp, Daucus carota
caaaatggtgaagtttctcaagcccaacaaagccgtcatcgtcctcaacggccgtttcgccggccggaaagccgtcatcatccgcgccttcgacgaaggcactcgtgaccgcccctacggccactgcctcgtcgccggcatctcgaagtacccgaagaaggtcatccgcaaggactccgcgaaaaagacggcgaaaaagtcgcgcgtgaaggcgttcatcaagctggtgaactacaaccacatcatgccgacgaggtacactctggacgtggatctgaaggatgtggtgacggcggattgtctgcagtcgagggataagaaggtgactgcagccaaggccaccaaggccaagctcgaggagaggttcaagaccgggaaaaaccgctggttctttacgaagcttaggttttaaatttcaatttctgttttgtttcgtgctggattttaagttctattggatgatgctgcgtaatgtttggattgaaatgttattggagttttggattcgtttcgtaagatatgctaatatatctatgtttttgattacttattagtaatgcggaattggttc

SEQ ID NO: 1845 - DNA, 581 bp, Daucus carota
aacagagggtgagcagagcggcgctaacaaaatggtgaagtttctcaagcccaacaaagccgtcatcgtcctcaacggccgtttcgccggccggaaagccgtgatcatccgcgccttcgacgaaggcactcgtgaccgcccctacggccactgccttgtcgccggcatctcaaagtaccccaagaaggtcatccgcaaggactccgcgaaaaagacggcgaaaaagtcgcgcgtgaaggcgttcatcaagctggtgaactacaaccacatcatgccgacgaggtacactctggacgtggatctgaaggatgtggtgacggcggattgtctgcagtcgagggataagaaggtgacggcggccaaggccaccaaggcgaagctcgaggagaggttcaagaccgggaaaaaccgctggttctttacgaagcttaggttttaaatttcaatttgtgttttttttttcgtgttggattataagttttattggataatgatgtgtaatgttttggattcaaatgttgctggagtttcggattcgtgatatgctaatttagatatgtttttgattacttgttattagt

SEQ ID NO: 1846 - DNA, 523 bp, Daucus carota
cagagagagtgagcggcgctaacaaacccccaaaatggtgaagtttctgaagcccaacaaagccgtcatcgtcctcaacggccgtttcgccggccgcaaggccgtgatcatccgcgccttcgacgaaggcactcgtgatcgcccctacggccactgccttgtcgccggcatctcaaagtaccccaagaaggtcatccgcaaggactccgcgaaaaagacggcgaaaaagtcgcgcgtgaaggcgttcatcaagctggtgaactacaaccacatcatgccgacgaggtacactctggacgtggatctgaaggatgtggtgacggcggattgtcttcagtcgagggataagaaggtgacggcggccaaagccaccaaggcgaagctcgaggagaggttcaagaccgggaaaaaccgctggttctttactaagcttaggttttaaatttcaatttctgttttgtttcgtgctggattttaagttctattggatgatgctgcgtaatgtttggattgaaatgttatt

SEQ ID NO: 1847 - DNA, 591 bp, Daucus carota
gccacaaaacagagagagtgagcggcgctaacaaacccccaaaatggtgaagtttctgaagcccaacaaagccgtcatcgtcctcaacggccgtttcgccggtcgtaaagccgtcatcatccgcgccttcgacgaaggcactcgtgaccgcccctacggccactgcctcgtcgccggcatctcaaagtacccgaagaaggtcatccgcaaggactccgcgaaaaagacggcgaaaaagtcgcgcgtgaaggctttcatcaagctggtgaactacaatcacatcatgccgacgaggtacactctggacgtggatctgaaggatgtggtgacggcggattgtcttcagtcgagggataagaaggtgactgcagccaaggccaccaaggccaagctcgaggagaggttcaagaccgggaaaaaccgctggttctttacgaagcttaggttttaaatttcaatttgtgttttttttttcgtgttggattttaagctttattggataatgatgacagtgtaatgttttgggttcaaatgttgctggagtttcggattcatgatatgttaatttagatatgtttttgattacttgtt

SEQ ID NO: 1848 - DNA, 564 bp, Daucus carota
caaaatggtgaagtttctgaagcccaacaaagccgtcatcgtcctcaacggccgtttcgccggtcgtaaagccgtcatcatccgcgccttcgacgaaggcactcgtgatcgcccctacggccactgccttgtcgccggcatctcaaagtaccccaagaaggtcatccgcaaggactccgcgaaaaagacggcgaaaaagtcgcgcgtgaaggctttcatcaagctggtgaactacaaccacatcatgccgacgaggtacactctggacgtggatctgaaggatgtggtgacggtggattgtcttcagtcgagggataagaaggtgactgcggccaaagccaccaaggcgaagctcgaggagaggttcaagaccgggaaaaaccgctggttctttactaagcttaggttttaattttcaatttctgttttgtttcgtgctggattttaagttttattggatgatgctgcgtaatgtttggattgaaatgttattggagttttggattcgtttcgtaagatatgctaatatatctatgtttttgattacttattagtaatgcggaa

SEQ ID NO: 1849 - DNA, 647 bp, Manihot esculenta
ctagggtttagagagagtcagagcttcaaacggcgagaagatggtgaagtttctgaagccaaacaaggcggtgatcatcctccaaggccgttatgctggtcgcaaggcggtgatcatcaagtccttcgatgagggaacacgcgatcgaccctacggccactgcttggttgcagggataaagaaatacccaagcaaggttatcaaaaaggactctgccaagaagacggccaagaagtcccgcgttaagtgcttcgttaagctcgtcaactaccagcacttgatgcccacccgctacactctcgatgtcgacctcaaggacgttgtatccgtcgacgcattgcagagcaaggagaagaaggttgcggcttgcaaggacactaaggcgaggttcgaggagaggttcaagacgggcaagaataggtggttctttaccaagctcaggttttgagctttatactaaggggttcagttcgtagaattttcttggtttcttttgcttaaattttacttttatgaaatgggtatgttttgcttttgagacttgtcaagtggttattgcgaatttgatgaactttttcagatctattgggacgagttatttatcagcatatacaatcttagtatctttttatggattttgtttgatt

SEQ ID NO: 1850 - DNA, 442 bp, Castanea mollissima
aacaaacccatctcgatggtgaagttcttgaaaccaaacaaggcagtggtccttcttcagggccgattcgcaggtcacaaggcagtgatcgtgcgcaacttcgacgatggcaaccgagacagaccctacggtcactgtttggttgctggtctagccaagtatcccaagaaggtgatccgcaaggactcggccaagaagaccgccaagaagtctcgcgtcaaggccttcctcaaggtcgtgaactactctcacatcatgcccactcgctacactctcgatgtcgatctcaaagacattgtctctgtcgatgctcttcagtctagggacaagaaagtcactgcagctaaagagaccaaggctaggttcgaggacaggtttaagtctgggaagaataggtggttcttttctaagctcaggttttgagttttgttttctggggtta

SEQ ID NO: 1851 - DNA, 619 bp, Cirsium arvense
caaaaatctatttctgtgtgagagaggagcggcggcgaaaatggtgaagtttttgaagccaaacaaggcagtggtggttctcaacgggcgtttcgccggccggaaagcggtgatcgtcagacaatttgacgatggaactcgtgaccgtccctatggtcactgtctcgttgccggaatcgctaagtacccgaagaaggtgatccgaaaggattctgcgaagaagacggcgaagaaatctcgcgtgaaggcattcatcaagctcgtgaactacaaccacatcatgcctactaggtacacactcgatgtagatctcaaggatatcgtcaccgtcgatgcgcttcagtcgcatgacaagaaggtgactgcttgtaaggagacgaaagcacggttggaggagcgttttaagaccggaaagaaccgttggtttttctcgaagctccgattctgaggaaaagataagttgttttgcgtttcggtttttgttctgtttgttctcaattttcagctggtgatatgataatttctagacttttattcaatcctaatgcactttcagttatcatatatgtcttgcatttgtgtttttcggtattgaatttcatgtttatgaccgtaattt

SEQ ID NO: 1852 - DNA, 627 bp, Cirsium arvense
cttttgtgcctgtgagcagcggcggcggtggaggatttgcagaggaggcgaaaatggtgaagttcttgaaacctcacaaggcggtggtggtgctcaacggccgttttgctggccggaaggcggtgatcgtcaggcaatttgacgaaggcactcgtgatcgtccctacggccactgtctcgtcgccggaatcgccaagtatccgaagaaggtgattcgtaaggattcggcaaagaagacggcgaagaagtctcgtgtgaaggcattcatcaagctcgtgaactacaaccatatcatgccgacaaggtacacactcgacgtagatctgaaggacgtcgtaacggtggatacgcttcagtcgcgtgataagaaggttacggcttgcaaggagacgaaagcacggttcgaggagcgattcaagtcagggaaaaaccgttggttcttttcgaagctccgtttctgagagtataagatgagcttttttttcttctagtttcgattttgttatgttcgtcaatatgtgatagactctgattactggttgttcacatttatttttgatatgtttcattcaagtaattttctgttgcaattggaatgaatttcagaggattaatcggaaaaaagaa

SEQ ID NO: 1853 - DNA, 760 bp, Cocos nucifera
aaaagatgcggcgtctcagtcagaaccccgagccgccggagcgtcgcctgagagagggcaaatccgtagtttctcgctaaaatccccgaccgtaccctataaagtcctcgctttccttggttgccgggactcccagatctgatccatccagaaccacaggcggagaaagaagatatccgtcaggcggcgccggcgccggcgaaggggaggatggtgaaatttttaaagcctaacaaagccgtgagcgtcctccaggggcgattcgccgggcggaaggcggtgatcgtgcggaccttcgacgaaggcactcgcgaccgcccctacggccactgcctcgtcgccggcgtcgccaagtatcccaggaaggtcatccgcaaggactcggccaagaagaccgccaagaagtcccgcgtcaaggccttcttgaaggtggtaaactacagccacctcatgcccacccgctacaccctcgacgtcgacctcaaggacgtcgtcaccctcgacgtcctccagtcccgggaccggaaggtgaccgcctgcaaggagaccaaggcccgcttcgaagagcgcttcaagaccggcaagaaccggtggttcttctccaagcaccggttctagatcaccagcggcaacggtccataatttttcttatgaattttgttgcgaatgaatggttagaatcttgtcttttaaaaaagcttgtattttgatggatttagatccatcgtcctcgttggtctagcattaatctttctttctt

SEQ ID NO: 1854 - DNA, 693 bp, Gossypium hirsutum
tcctttctcgagttagggttttgcgccagggcgagaatcaaagccgccgtcgccatggtgaagtttctaaagcccaacaaagctgtcattgtcctccaaggccgatacgccggacgcaaagctgtgatcgtaaaatccttcgacgacggcacacgtgaccgtccctatggccactgtttggtcgcggggataaaaaagtacccgagcaaggtcatcctcaaggactccgccaagaaaaccgccaagaaatcgcgcgtcaagtgcttcgtcaagctcgtgaactaccagcacctgatgcccacacgatacaccctcgacgtcgacttgaaagacaccgtcacagtcgacgcgcttcagaccaaggacaagaaagtagccacttgtaagactatcaaacaaaggctggaagagaggttcaaaacaggaaaaaacaggtggttctttaccaagcttaggttttaagtcttcctttccttttaacattttccgtagaacctcttatatcatttgcacttctcttggtgctgtacttattcagccttagatcgatacggaaaaaaagcttgagaattcgagtccttcgttgtttggccatttttgtatcatcatcgatgctatattgagttgaactttgttgtttctgctgcatttgtattgtacctttaagcgaattacgctcttcaattcttccat

SEQ ID NO: 1855 - DNA, 625 bp, Taraxacum officinale
tgagtgtttttgtgtgtgagcagcggcggcggacattgaggtaagcagagatggtgaagtttttgaagccaaacaaggcggtcgtggtgctcaatggacgttttgcaggccggaaggcggtgatcgtcaggcaatttgacgacggcacacgtgaccgaccttacggccactgcctcgtcgccgggatcgccaagtacccaaagaaggtgatccgtaaggactcagcaaagaagacagccaagaaatcgcgcgtgaaagcattcatcaagctcgttaactacaaccacatcatgccgacgaggtacactctcgacgtagatctgaaggacatcgtatcggtcgatgcgcttcaatcgcgcgacaagaaggttactgcttgcaaggagaccaaagcacggttcgaggagcgattcaagacgggaaaaaaccgttggtttttctcgaagctccgattctaagtataagatgagttgtctctggtttcagttttgttgtcttcgtcaatatcactatagacttgataactgttagctcaaattttatttttgatatgtttcattcgagtgatatttcttttgcatttgaaaaatactgaatctattagctaaaacatttcttaaattgc

SEQ ID NO: 1856 - DNA, 741 bp, Solanum melongena
atcatttcatccggctgagagagatagtgagagagagggagagaatcagcggcggcgaagatggtgaagtttttgaagccaaacaaagctgtgatcgttcttcaaggcaaatatgccggccggaaagctgtgattgtgagggcatttgatgagggaacaagggacaggccatatggccattgtttggttgcaggtatctccaagtacccgaagaaggtgatccgcaaggactcagcgaagaagcaggcgaagaaatctcgcgtcaaggctttcatcaagctggtgaactacagccatatcatgccaactcgttacacactcgatgtggatctgaaggatgttgtcaatgtagatgttcttcagtctcgtgacaagaaggttactgcttccaaggagaccaaggctaggcttgaggagaggttcaagaccgggaaaaatcgatggttcttcactaagcttaggttctgagcaaagattgaatgcgattttgatgaaatggtaatatttctagtattaaagagttttgagggatgtttttgttatcaaagatactattaggctgtttttgtgtctgcactgtttttttgatggataattcctagctcttctttcagttatctacattttatattggtttgcttctgattttgttgatagcttgatatttatattatcgagtctctctgtttgaatgatggtataacttttattgctttaatgtctatgttctgtgttgcacag

SEQ ID NO: 1857 - DNA, 938 bp, Flaveria ramosissima
agacgcatagtgatatacaataccctcagaggcggcgacgatggtgaagtttctgaagcccaacaaggcggtggtggtgctcaacggccgtttcgccggccggaaggcggtgatcgtcaggcagttcgacgacggaacccgcgaccggccgtacggccactgtctggtcgccggaatctcaaagtacccgaagaaggtgatccgaaaggactctgcgaagaagacggcgaagaagtcgcgtgtgaaggcgttcatcaaggttgtgaactacaatcatatcatgccgacgaggtacacgcttgatgtggatctgaaggatgttgttacggtcgatgcgcttcagtcgcgtgataagaaggtgactgcttgtaaggagacgaaggcgaggttggaggagcgattcaaaactggaaaaaaccgttggttcttctcgaagctccgattctgaggagaagataagttttgatttcagcttttttgtctgttttgtttgattttgatcttatcaacgataatcgtagacttgttattgttcgtaatgcgcttttggtttcgatatatgccttgaatctgttgtttttagtatgaaattgatggatttgagcttaatttgatgcatttgtagttcgattgctgttgtcggtattatgcgtttacattggtgttgaatgtgctgcttgtagtgtgttatgagatttgatagattgtcaatgaagctctgtctttttttaataacatttcgagtgaggattagcgttatgtgagaactcatggtgattgtgttgaactgttgatgcaacattgttcttcacattggcttgtttcttctatttttccatgaatgtgaggcctttcatcaaacattttaagagcagtttttaacaactcttgttaccccacattcatgctaattgaagcatacaaatctgaactaaact

SEQ ID NO: 1858 - DNA, 619 bp, Flaveria ramosissima
cgcatagtgatatacatataccctcagcggcggcgacgatggtgaagtttctgaagcccaacaaggcggtggtggtgctcaacggccgtttcgccggccggaaggcggtgatcgtcaggcagttcgacgacggaacccgcgaccggccgtacggccactgtctggtcgccggaatctcgaagtacccgaagaaggtgatccgaaaggactctgcgaagaagacggcgaagaagtcgcgtgtgaaggcgttcattaagcttgtgaactacaatcatatcatgccgacgaggtacacgcttgatgtggatctgaaggatgttgttacggttgatgcgcttcaatcgcgtgataagaaggtgacagcttgtaaggagacgaaggcgaggtttgaggagcgatttaagactggaaaaaaccgttggttcttctcgaagctccgattctgaggagaagataaggtttgatttctgtttttggtctgtttcgtttgattttgatcttatcaacgataatcgtagacttgttattgttcgtaatgcgctttttgtttctatttatgccttgaatctgttgttttggttatcaaattgatggatttgagcttaatttgatgcatttg

SEQ ID NO: 1859 - DNA, 643 bp, Fraxinus spp
gtgagagagagagaggaccaaatctcggcggcaatggtgaagtttctgaaaccaaacaaggcggtgataatcctccaggggaggtacgccggccggaaggcggtgatcattcgcaacttcgacgatggtacccgcgaccgcccttacggacactgcctggtggccggtctagccaagtacccgcgcaaggttatccgcaaggactctgccaagaagcaggctaagaaatcacgcgtcaagtgctttatcaagctggtgaactacaaccacattatgccgactcgttacaccctcgacgtggacctcaaggacgtagtatctatcgaatccctccagtccagagacaagaaggtgactgccgctaaggaagccaaggcacggttcgaggagcggttcaagactgggaaaaaccgctggttcttcaccaagctcaggttttgaggaggacattctgtaattttaatttggatctagtagcagcgctttaaaaagagggatttttgtttcgttatatttgagaaatgactctgcattgaagttgatgtttatttccaagttactctttttagaactgtttatgctgagaaacttatctggtatcatcttcatattcaattgaaatgctggctccgattagaatctt

SEQ ID NO: 1860 - DNA, 645 bp, Fraxinus spp
gaacatagagagaagagacaggaccaaatctctgtggcaatggtgaagtttctgaaaccaagcaaggcggtgattatcctccaggggcgttacgcaggtcggaaggcggtgatcattcgcaacttcgacgacggcacacgcgaccgtccttacggccactgcctggtggctggtttagccaagtacccgcgcaaggtcatacgcaaggactccgccaagaaacaggctaagaaatcacgcgtgaagtgctttatcaagctggtgaattacaaccacatcatgccgactcgttacaccctcgacgtggacctaaaggatgtagtatcactcgaatccctccagtccagagacaagaaagtgactgcagctaaggaggccaaggcacggttcgaggagcggttcaagactgggaaaaaccgctggttcttcaccaaactcaggttctaaggaggacattctggtaattttaatttggatccggtagtagtgccctgaaaaagagggatttttgttttgttacgtttccgaagtgactctgcatttgaagttgatttttatatcaatgttactctttctagaactgtttattctgagaaatttatctgttatcatcttcaattttaattgaaattctggctttttcac

SEQ ID NO: 1861 - DNA, 698 bp, Gossypium raimondii
aaactcatattatctattacctcatttttcaattaatattttccagggcgagaatcaaagccgacgtcgccatggtgaagtttctaaagcccaacaaagctgtcattgtcctccaaggccgatatgccggacgcaaagccgtgatcgtaaaatccttcgacgacggcacacgtgaccgtccctatggccactgtttggtcgcggggataaaaaagtacccgagcaaggtcatccgcaaggactccgccaagaaaaccgccaagaaatcgcgcgtcaagtgcttcgtcaagctcgtgaactaccagcacctgatgcccacacgatacaccctcgacgtcgacttgaaagacaccgtcaccgtcgacgcgcttcagaccaaggacaagaaagtagccacttgtaagactatcaaacaaaggatggaagagaggttcaaaacaggaaaaaacaggtggttctttaccaagcttaggttttaagtcttcctttcctttaacattttccgtagaacctcttatgtcgtttgcactcctcttggtgctgtacttaaattcaaccttagatggatacggaaaaaaagcttgagaattcgagtcttcgttgtttggccatttttgtatcatcatcgatgctgtattgagttgaacttggttaacctttaagcgaattccgctcttcaattcttccatgcgtaactt

SEQ ID NO: 1862 - DNA, 648 bp, Carpinus betulus
ggggttttacatagcgggggcgagagagtgcgaaagacagagcaagaaaatggtgaaattcctgaagccaaacaaggtggtgatcctcctgcagggccgctatgcagggcgcaaggcggtgatcgtgagggcctttgatgagggcactcgggaccgcccgtacggccactgtttggtggctgggataagcaagtacccgagcaaggtcatacgcaaggactcggccaagaagacggccaagaagtcccgcgtgaaggcctttgtgaagctcgtaaactaccagcaccttatgcccacacgttacaccctcgatgtcgacctcaaggatgtcgtctccctcgagagcctccagtccagggataagaaggtcaccgccgccaaggataccaagaagaggttggaggatcgcttcaaatctggaaagaacaggtggttctttaccaagctgaggttctgagtaggatctctgccgttactgattgttctatttcagtttgtgtcgtcttttcttgtattactcttggtcttcttaacaagacagttgtttttttatcaagtatcctagtacttttcattagtggaaattttgggtttagtatgaagttttatgaactgctgtaaactcgtttggatgagatacatgatgga

SEQ ID NO: 1863 - DNA, 560 bp, Ipomoea nil
gagggtttcattttcgtctcgcagcagtaagcagcggcggctagcgtcgaaaatggtgaaatttctcaagcctaacaaggccgttattctccttcagggccgctatgccggcaagaaggcggtcatcgtgaagtccttcgacgacggcactcgcgatcgcccctacggccactgccttgtcgccgggatcgccaagtatccgagcaaggtgatccgcaaggactccgccaagaagcaggcgaagaagtctcgcgtgaggactttcgtcaagctcgttaactacaaccacattatgccgacgcgctacaccctggacgttgacctgaaagacgccgtcacccccgactgccttcagtcgcgggacaagagagtcgctgccgcgaaagaggcgaaagctcgtctcgaagatcggttcaaaactgggaagaacaggtggttcttttccaaactcaggttctgagtagatcaatacataaatactctcagcctatgagctttttgtctgtttctcttagtaattttttcaactggattttgtttacttgaagatgttatcctta

SEQ ID NO: 1864 - DNA, 656 bp, Nicotiana benthamiana
accagcgaattcagctccactttattgcattcatcggcggcggcgagtgaagatggtgaagttcctgaaaccaaacaaagcggtaattattctccaaggcaaatacgccgggcgaaaagcagtaatcattcgtgcattcgatgaaggaacaagagatcgaccatacggccattgtttagttgcaggtataagcaaatatccgaaaaaagtaattcgaaaagattcagccaaaaaacaagcgaagaaatcacgagttaaggcttttattaagctcgttaattacaatcacattatgccgactcgttatacacttgatgtagatctgaaagatgttgttaatgtcgatgttcttcagtctcgtgataagaaggttactgctgctaaggaagctaaagctcggcttgaggaaaggtttaagactgggaaaaaccgttggttttttactaagcttaggttttgatctcttaaattttgctttaaaattgaggttttgtcgcagttattgaggggattaacgggtgatattgttattattatctaaatgtagtagttaatgtgagtctgttttgtctttgagcaatttcttaaaatgaagaatatccagatttgctttacatttcttcattaattttctggtaattttcttaataattgtt

SEQ ID NO: 1865 - DNA, 708 bp, Nicotiana benthamiana
agtaactagggctttacgctccatttgcattcagccgagagagattgaataagagagagagagagaatccgcggcggcgaggatggtgaagtttttgaagccaaacaaagctgtaatcattctccaaggcaaatatgccggccgtaaggcagtgatcattagggcattcgatgaaggaacaagggacaggccatacggccattgtttggttgcaggtatttccaagtatcctaagaaggtgatcagaaaggactcagccaaaaagcaggcgaagaagtcacgtgtcaaggctttcattaagctcgtgaattacaaccacatcatgcccactcgttacacgctcgacgtggatctgaaggatgttgtcaacgtggatgttctgcagtcacgtgataagaaggttactgctgctaaggaggcgaaagctaggcttgaggagaggttcaagactggaaaaaatcgttggttcttcactaagcttaggttctgagcgaatgttgttttggtccttgcactgctggtaatttttatcgcatatgattaagattgactgttattttgatgaatatggtaatattagtagtagtaaaggagtgatggataatgtttttatcattaagctacatttagtctgtttttgtttttgcactgttttgtttatgaaagattactagatccgcttttaattactctaatagtttcatgctg

SEQ ID NO: 1866 - DNA, 545 bp, Quercus alba
acaaagaaacaagatggtgaagttcttgaagcccaacaaggcagtggtccttctacagggccgattcgcaggccacaaagccgtgatcgttcgcaacttcgacgatggcaaccgagacagaccctacggtcactgtttggtagctggtctagccaagtacccaaagaaagtgatccgcaaggactcggccaagaagaccgccaagaagtcacgcgtcaaggccttcctcaaggtcgtgaactactctcacatcatgcccactcgctacactctcgatgtcgatctcaaagacattgtctccgccgatgctcttcagtctagggacaagaaggtcactgcagctaaggagaccaaggctaggttcgaggacaggtttaagtctggaaagaataggtggttcttttctaagctcaggttttgattttttgttttctggggttgtttctttttagatggttttgtttgagtaatattggataatgttactacagaattgagaattgagaaatgagataaatgttattttgttatagttttgatgggtt

SEQ ID NO: 1867 - DNA, 635 bp, Olea europaea
gagaagagagagaggaccaaatctttgtggcaatggtgaagtttttgaaaccaagcaaggcggtgattgtcctccagggacggtacgccggtcggaaggcggtgatcattcgcaacttcgacgacggcacacgcgaccgcccttatggccactgcctggtggctggtttagccaagtacccgcgcaaggtcatccgcaaggactccgccaagaaacaggctaagaaatcacgcgtgaagtgctttatcaagctggtgaattacaaccacatcatgccgactcgttacaccctcgacgtggacctaaaggatgtggtatcactcgaatccctccagtccagagacaagaaagtgactgcagcgaaggaggccaaagcacggttcgaggagcggttcaagactgggaaaaaccgatggttcttcaccaagctcaggttctgaggaggacattctggtaattttaatttggatctagtagtagtgctttgaaaaagagggatttttgttctattacgtttccaaagtgactctgcatttgaagttgacgtgtatttcgaagttactctttttagaactgtttatgctgagaaatttatctggtatcttcttcaatttcaattgaaatgctggcttttt

SEQ ID NO: 1868 - DNA, 523 bp, Allium cepa
gaaaattagggttaaggtccgcagccgcctctgaaagagttcgccatggttaaattcctaaaaccaaacaaagcggtcatcctcctgcaaggccgatttgctggccgtaaagcggtcattgtgaagaatttcgacgacggaactcgtgaccgcgcctacggtcattgcctcgttgcaggaatactcaaataccccaaaaaggtcatccgaaaagattcggccaagaagacagctaaaaagtccagagtgaaagcttttatcaaggttgtgaattacagtcacatcatgccgacgaggtacacgcttgatgtagatttgaaggatgttgccactcttgatgctctgctgtcgaaggataagaaagttgaagcgtgcaaggaggtgaagaagcgcttcgaggagaggttcaagactggaaagaacaggtggttttttacaaagttgaggttttaaatgttttatcaattaatgcttagtatttgtgtgtttccgagtcggactatttaatattcagagtttgaat

SEQ ID NO: 1869 - DNA, 485 bp, Allium cepa
agccgccattcatcaggtaagcaatggttaagtttctcaagccaaacaaggccgttatcctcttgcaaggtcgtttcgctggtcggaaagcagttatcgttaagaacttcgacgatggtactcgcgatcgtgcctatggccactgcctcgtcgccggaattctcaagtaccccaagaaggtgatccgcaaagactctgctaaaaagaccgcgaagaaatcaagggtgaaggcgtttctgaaagtggtgaactacagccacataatgccaacacgatacacgttggatgtggatctgaaggatgtggttactgtagatgccttgcagacgaaggacaaaaaggtggaaacttgcaaggaagtaaaaaagcggttcgaggagaggttcaaaaccggaaagaacaggtggtttttcacaaagttgaggttttgaatcttctttctataattattctgagatcttattttagggttgatttggacttat

SEQ ID NO: 1870 - DNA, 572 bp, Allium cepa
acaagattagggtttgagccgccatttctcaggtaagcaatggttaagtttctcaagccaaacaaggctgttatcctcttgcaaggtcgtttcgcaggtcgaaaagctgttatcgtcaagaacttcgacgatggtactcgcgatcgtgcctatggccactgcctcgtcgccggaattctcaagtacccgaagaaggtgatccgcaaagactctgctaaaaagaccgcgaagaaatcaagggtgaaggcgtttctgaaagtggtgaactacagccacataatgccaacacgatacacgttggatgtggatctgaaggatgtggttactgtagatgccttgcagacgaaggacaaaaaggtggaaacttgcaaggaagtaaaaaagcggttcgaggagaggttcaaaaccggaaagaacaggtggtttttcacaaagttgaggttttgaatcttctttctataattattctgagatcttattttagggttgatttggacttatccaagtttggattttgaattctgtttttgtttaatcatggtactttgttggattattaatattgatattga

SEQ ID NO: 1871 - DNA, 702 bp, Allium cepa
tctgaaaattagggttaaggtccgcagccgcctctgaaagagttcacaatggttaaattcttaaaaccaaacaaagcagtcatcctcctacaaggccgctttgctggccgtaaagcggtcatcgtgaagaatttcgatgacggaactcgtgaccgcgcctacggtcattgcctcgttgccggaatacttaaataccccaaaaaggttatccgaaaagattcggccaagaagacagctaaaaagtcgagagtgaaagcttttattaaggttgtgaattacagtcacatcatgccgacgaggtacacgctcgatgtagatttgaaggatattgctactcttgatgctctgcagacgaaggacaagaaagttgaagcttgcaaggaggtgaagaagcggttcgaggagaggttcaagactggaaagaacaggtggttttttacaaagttgaggttttaaatgttttatcagttaatgcttagcattcgtgtgtttcaaagagtcggactatttaatattcagagtttgaatcctcattttgtttcgtgagaatcagcttatgctattgttttagttctgtgtgtttgttgcaaatttcattttaaagctatgctagttgttttgcaagttataatttacaaaatctgtttctatgagctcattgaaaattgtaacgatctggatatttattcctatagttggttt

SEQ ID NO: 1872 - DNA, 607 bp, Allium cepa
tccgcagccacctctgaaagagttcacaatggttaaattcttaaaaccaaacaaagcagtcatcctcctacaaggccgctttgctggccgtaaagcggtcatcgtgaagaatttcgatgacggaactcgtgaccgcgcctacggtcattgcctcgttgccggaatacttaaataccccaaaaaggttatccgaaaagattcggccaagaagacagctaaaaagtcgagagtgaaagcttttattaaggttgtgaattacagtcacatcatgccgacgaggtacacgctcgatgtagatttgaaggatattgctactcttgatgctctgcagacgaaggacaagaaagttgaagcttgcaaggaggtgaagaagcggttcgaggagaggttcaagactggaaagaacaggtggttttttacaaagttgaggttttaaatgttttatcagttaatgcttagcattcgtgtgtttcaaagagtcggactatttaatattcagagtttgaatcctcattttgtttcgtgagaatcagcttatgctattgttttagttctgtgtgtttgttgcaaatttcattttaaagctatgctagttgttttgcaagtt

SEQ ID NO: 1873 - DNA, 843 bp, Allium cepa
gcctagttacgggggatctgaaaattagggttaaggtccgcagccgcctctgaaagagttcacaatggttaaattcttaaaaccaaacaaagcagtcatcctcctacaaggccgctttgctggccgtaaagcggtcatcgtgaagaatttcgacgacggaactcgtgaccgcgcctacggtcattgcctcgttgccgggatacttaaataccccaaaaaggttatccgaaaagattcggccaaaaagacagctaaaaagtcgagagtgaaagcttttattaaggttgtgaattacagtcacatcatgccgacgaggtacacgctcgatgtagatttgaaggatattgctactcttgatgctctgcagacgaaggataagaaagttgaagcttgcaaggaggtgaagaagcggttcgaggagaggttcaagactggaaagaacaggtggttttttacaaagttgaggttttaaatgttttatcagttaatgcttagcatttgtgtgtttcaaagagtcggactatttaatattcagagtttgaatcctcattttgtttcgtgagaatcagcttatgctattgttttagttctgtgtgtttgttgcaaatttcattttaaagctatgctagttgttttgcaagttataatttacaaaatctgtttccatgagctcattgaaaattgtaacgatctggatatttattcctatagttggtttgagttgaacgtttgtttaaccatgatttgcaatgtttcaaagaaggcacgaatggtaacgtcttgtaataaaagtcttattctaacccattttaaatataatgaatcagaaaccaaaacacacac

SEQ ID NO: 1874 - DNA, 664 bp, Capsicum annuum
gagcgagagagagatagagagaaaccaagagaaaaacaatccgcggcggcgaagatggtgaagttcttgaagccaaacaaagcagtgatccttcttcaaggtaaatacgccggtaggaaggcggtaatcatccgtgcatttgatgaaggaacaagggacaggccatacggtcattgtttggttgcaggtatttccaagtacccgaagaaggtgattcgcaaggattcagcaaagaagcaggcgaagaagtctcgggttaaggcgtttatcaagctggtgaattacactcacatcatgcctacccgctacactctcgatgtggatctgaaggatgttgtcaacgctgatgtgctttcgactagggataagaaggttactgctgcgaaggagacgaaggcgaggtttgaggagaggttcaagaccggaaaaaaccggtggttctttgccaagcttaggttctaagcttttgtgctgtttgaaggctctggtaattttagttttatttggtttaagacaattcgattttgatgaaatggtgatgctcgtaatatttaagtgttgatggagactgaatttgctatctattaggctgtttttgatgttactttattttaattgatggataatttctagctgtcccttcagttcaatcaatctgatgttt

SEQ ID NO: 1875 - DNA, 858 bp, Cajanus cajan
aaacagtgacgcgtgagtccaggcccaacagaaaccctgaggcagagaagacggtgctagggtttgtataagttaggaagggaatggcgtgagggtagtaacggcgagagtggagagagagcgaaggcgaagatggtgaagtttctgaaagcgaacaaagcggtgatcgtgctgcaggggcgttacgcgggaaagaaggcggtgatagtccgaagcttcgacgagggaacgcgcgagcgcccctacggccactgcctggttgcggggataaagaagtacccaagcaaggtcatcaagaaggactccgccaagaagaccgccaagaagtcccgcgtcaaggccttcctcaagttggtcaactaccagcacctcatgcccacgcgctacacgctcgacgtcgacctcaaggacgccgtcacccccgacgccctccacgccaaggataagaaggtcaccgccctcaaggagaccaagaagcgcctcgaggaccgcttcaagaccggcaagaaccggtggttcttcaccaagctcaggttctgagctattctatactatgcattctttttgcttctacttctcgctttccatttcttaattgttaacttttaattctctcctcaccctacatttcgctacttttcgctttattttttttatattttcgcaatgtgtttgattcctgttgtagattcaccttctttggttcctgaatcggttagatttgccttgtttgatttcgattgtagcatgttttcgaaaccctagcattttaattggccgaattaaaaagtgagaaaatacactctaatacgacgacgtttaaggaattatgtgagtaatcatacttttatttgttga

SEQ ID NO: 1876 - DNA, 574 bp, Platanus occidentalis
gacagagagagagagagagcagcgaaggaaggaaggaagatggtgaagttcctgaaacccaacaaagcagttattttgttgcaggggcgatttgccggacggaaggctgtgatcatccgatcgttcgacgaagggactcgtgatcgaccttatgggcattgcttagtggctgggattgccaagtaccccaagaaggtaattcgcaaggactccgccaagaagactgccaagaagtcccgcgtgagggctttcataaggctcgtcaactacaaccacatcatgcccactcgctacaccctcgacgtcgatctcaaggacgtcgtcacccttgatgccctccaatcacgggacaagaaggtcaccgcagcaaaggagaccaaaactcgcttcgaggagcgcttcaagaccggaaagaataggtggttctttagcaagctcaggttctaagtgaaacctctgctttgctatcgattctttctactttattttttttttataggaactactttgttaatgtgaggattcagaccatctgcaaacgggttctcaactcatatttgtagtatttgttgtt

SEQ ID NO: 1877 - DNA, 827 bp, Papaver somniferum
ctcagtcggatctcgttcaacgcagagagattcagcagaaccttaggaggtagcgacaatggttaagtttttgaagccaaacaaagctgtggtagtgctacaaggacgctttgctgggcgtaaggctgttatcattcgtgctttcgatgagggaacacgtgagcgtccatatggtcattgcttagttgcagggattaacaagtaccccaagaaggtaattcgcaaggattcagccaagaagactgtgaagaaatcaagagtgaaggctttcatcaagcttgtgaactataaccacatcatgcctacacgttacacccttgatgtcgatctcaaggatgttgtcactccagatgttcttacttcccgtgacaagaaggttacagctgctaaagagacaaaggctcgtttggaggagaggttcaagaccgggaaaaacaggtggttcttcaccaagctcaggttctgaggctctgtgaaagagtttcactgtcatcttttttgagtagttatcgactgagtttcagtttccttttttgactgtaattgcattaaagataatacagggatttaaggttttgactctaaacttttaaatgactagtttatggcattgttttagattccaaaacatgtggtttgttagttcctcatgatactgttggccagaaccaaccaacttgttatagtttattacatagtattacgctcaatttgtgctagtacatgaggccttgcacatatcagttgatgaagctgtgaatttaagcaagaaccttgaattctaggagtgctgatgcagcttaaatgctgcacgtgtgctgatgatg

SEQ ID NO: 1878 - DNA, 696 bp, Raphanus sativus
agggccggcaaggtagagagagagagtgagagacgaccccatggttaagtttctgaagcagaacaaagctgtgatcctcctccaaggtcgttatgccggcaagaaggcagtgatcatccgttcattcgacgacggcaaccgcgagcgtccctacggacactgtctcgtcgccgggctcaagaagtatccgagcaaggtcatccgcaaggactcggccaagaagacggcgaagaagtcgagagtcaagtgtttcatcaaggtcgtgaactaccagcatctgatgcctactcgttacacgttggacgtggatctgaaggaggttgcgactctcgaggctctgtcttcgaaggataagaaggtggcggctcttaaggaagctaaggctaagctcgaggagaggttcaagaccggtaagaacaggtggttcttcaccaagctcaggttctgagaaatgagttttctctttttatcttttgtaatggaatttacggattacttttgtagttctaaaatggtgatgtggatcgtgtttaagacttgttggtttgaaagattttgcctttttttaacatttatcatcatttgcttagcttgaattttcaagatttacagtgctggattggtagtgaaatgtgcttgtctgaatttgtgtttcattgccaactgttatgaatcaaagtaaatgcttatgtcaca

SEQ ID NO: 1879 - DNA, 631 bp, Raphanus sativus
gcgggaaagagggagcttaggggagcgcgagagagagagaagaagccatggttaagttcctaaagcagaacaaagcggtgatcctcctccaaggccgttacgccggcaagaaggcggtgatcatccgctccttcgacgacgggaaccgcgagcgaccatacggacactgcctcgtcgcgggactcaagaagtacccgagcaaggtgatccgcaaggactcggccaagaagacggcgaagaagtcgagggtcaagtgcttcatcaaggtcgtgaactaccagcatctgatgcctactcgttacacgctcgacgtggatctgaaggaggtggcgactctcgaagctctgtcttcgaaggataagaaggtggcggctcttaaggaggccaaggctaagctcgaggagaggttcaagactgggaagaacaggtggttcttcaccaagctcaggttttgagaaagttttatcgtttttgtaacggaatctacagtatgctttttgtagtttgtcggaacatgttttggatggtttaagacttatggtttgatatttgattcttggaatttttgttcttttattacgatcatttgctatgttggtgctttagttaatatatcttcactggtttagca

SEQ ID NO: 1880 - DNA, 756 bp, Raphanus sativus
ggaatccgccacctagggttttcagcggcgataacgaagaagacgaagaagagggatctagagaaacaagtgaagcaacaatggtgaagttcctgaagcagaacaaggcagtgatcctcctccaaggccgatacgccggaaagaaggccgtgatcatccgctccttcgacgacggaaaccgcgagcgcccttacggacactgcctcgtggccggactcaagaagtacccgagcaaggtcatccgcaaggactcggcgaagaagacggccaagaaatctagggttaagtgtttcatcaaggtcgtcaactaccagcacctgatgcctacgcgttacacccttgacgtggacctcaaggaagtcgcgaccctcgaggctctttcttccaaggacaagaaggtcgccgctctcaaggaggccaaggctaagctcgaggagcgtttcaagaccgggaagaacaggtggttctttaccaaactcaggttctgaaggagttcttgtcggaagaaagcgtttttgttgttgcattttcgtatctgatatttaaaacagcgtattattagtttcgtatggagagcaatgtggattcctgttttgggattgtgaaagacgagtttgattatctatttgcattttgattacctctttactaccgttgaatgatttgcttaggattttgttgattatttgagttttagaaatgtctggcttacgttttggttagttttgttagagtctaatagatcttttctatcca

SEQ ID NO: 1881 - DNA, 601 bp, Rhizophora mangle
agggtttagataaagagcgagacgtcgccgaggcagccgagaataaagagtgaaggagagaaaatggtgaagttcctgaagccaaacaaggcagtgatcctccttcaaggtcgttatgccggtcgcaaggcggtgatcgtgaagaacttcgacgacggcacccgcgaccgtgcttacggccactgcctcgtcgccgggatcaagaagtatcccgccaaggtcatcaggaaggactctgccaagaagacggccaagaagtcacgtgtcaagtgcttcatcaagctcgtcaattaccagcacctgatgcccacgcgctacaccctcgacgtggatttgaaggatgtcgtcaccctcgatgccctccagaccaaggaaaagaaggtgacagccgccaaggagaccaaggcccggttcgaggagcggttcaagactggcaagaaccggtggttctttaccaagctcaggttttgagtgtcgttttgttaaggaaaattagcttgtttttgttggttttgcgaagacttgttaagcagtaatcgattgttaaacttatccgtgaactaagcttttgagatctgtttgaatttaatgttaatttgga

SEQ ID NO: 1882 - DNA, 626 bp, Carthamus tinctorius
gcggggctgcataggtcgtgtgtgtgtgtgttttgtgtgtgtgagcggcggcggcggcagaggaggatttgcagaggagggcggcgaaaatggtgaagttcttgaaacctcacaaggcggtggtggtgctcaacggccgtttcgccggccggaaggcggtgatcgtcaggcagttcgacgaaggcacccgagatcgtccctacggccactgcctcgtcgccgggatcgccaagtacccgaagaaggtgatccgtaaggactcggcgaagaagacggccaagaagtctcgcgtgaaggcattcatcaagctcgtgaactacaaccacatcatgccgacgaggtacacgctcgacgtggatctgaaggacgtcgtcaccgccgacacgctccagtcgcgcgacaagaaggtgacggcctgcaaggagaccaaggcacggttcgaggagcgattcaagtcagggaaaaaccgttggttcttctcgaagctccgattctgaggacgagatgagttttttttctttcctttctagtttcaattttgttatgttcgtcgatatgatgatgatgatagaccatgattgattactggttgttcgcatttatttttgatatttttcattctggta

SEQ ID NO: 1883 - DNA, 670 bp, Carthamus tinctorius
cgggacacatccatctctcttataccgtgattgagaagcgcggcggagaagaggcagattcggagaagaagaagaagccgaaatggtgaagtttttgaagccaaacaaggccgtggtggtcctcaacggccgtttcgccggcaggaaggccgtcatcgtcaagcagttcgacgacggaactcgcgaccgtccctacggccactgcctcgtcgccggaatcgccaagtacccgaagaaggtgattcgcaaggactcggcgaagaagaccgcaaagaagtcgcgcgtgaaggccttcatcaagctcgtgaactacaaccacataatgccgaccaggtacacgctcgacgtcgatctcaaggacgtcgtctccgtcgatgcgctccagtcgcgtgacaagaaggtgacggcctgcaaggagaccaaggcgcgtttggaggagcgtttcaagaccgggaaaaaccgttggttcttctcgaggcttcgattctgaggaaacgagctgtgttgcttcaggtgtttcaggttttgtttgctatatttgtttttttttgaagcttttagtttatgaatgacgatgatagactgattaatgctagcttactttcattttcaaattgatcgattttttggcggttcatgattgatttttcagaggattaatcgttcgaac

SEQ ID NO: 1884 - DNA, 441 bp, Scabiosa columbaria
agaagaagaaaggaagagggaagcaaaaaaaatggtgaagtttttgaaacctaacaaggcggtggtgatccttaacggccgattcgccggtcgcaaggccgtcatcatcagagcattcgacgaaggcacacgcgatcgtccatacggtcactgtctcgtcgccggcatctcaaagtacccgaagaaggtgattcgcaaggattccgctaagaagacggcgaagaaatctcgcgtcaaggcattcatcaagctcgtcaattacaatcacatcatgccgactcgttacaccttagatgtagatctcaaggagatcgtcacacttgatgctcttcaatcgcgcgataagaaggttactgcggcgaaggagacaaaggcaaggcttgaagagcggtttaagaccgggaagaaccgttggttcttctccaagctccgattctaagg

SEQ ID NO: 1885 - DNA, 662 bp, Nicotiana tabacum
ttcagccaagagagattggagagagagagagagagagaatccgcggcggcgaggatggtgaagtttttgaagccaaacaaagctgtaatcattcttcaaggcaaatatgccggccggaaagcagtgatcattagggcatttgatgaaggaacaagggacaggccatacggccattgtttggttgcaggtatatccaagtaccctaagaaggtgatccgaaaggactcagccaaaaagcaggcgaagaagtcacgtgtcaaggctttcatcaagctcgttaattacaaccacatcatgcccactcgttacacgctcgacgtggatctgaaggatgttgtcaacgtggatgttctgcagtcacgtgacaagaaggttactgctgctaaggaggcgaaagctaggcttgaggagaggttcaagactgggaaaaatcgttggttcttcactaagcttaggttctgagcgtgggatgttttggtccttgcactgctggtaattttgatctcgtatgattaagattgactgagattttgatgaatatggtaatatttgtagtggtaaaggagtgatggataatgtttttatcattatgctacatttagtctgtttttgtctttgcactgctttatttatgaaaaattactagatctgcttataattac

SEQ ID NO: 1886 - DNA, 692 bp, Nicotiana tabacum
gcgggggcattcagccgagacagattgaatagagagagagagagaatccgcggcggcgaggatggtgaagtttttgaagccaaacaaagctgtaatcattcttcaaggcaaatatgccggccgtaaggcagtgatcattagggcatttgatgaaggaacaagggacaggccatacggccattgtttggttgcaggtatttccaagtaccctaagaaggtgatccgaaaggactcagccaaaaagcaggcgaagaagtcacgtgtcaagactttcatcaagctcgtgaattacaaccacatcatgccaactcgttacacgcttgacgtggatctgaaggatgttgtcaacgtggatgttctgcagtcacgtgacaagaaggttactgctgctaaggaggcgaaagctaggctcgaggagcggttcaagactggaaaaaatcgttggttcttcactaagcttaggttctgagggaaggttgttttggtccttgcactgctggtaattttgatctcatatgattaagattgactgaattttgatgaatatggtaatattagtagtgttaaaggagggatggataatgtttttattattaagctacatttagtctgtttttttctttgcactgttttgttgatgaaaaattactagatctgcttttaattacgctgatggtttcatgttgtggcaa

SEQ ID NO: 1887 - DNA, 750 bp, Oryza sativa
gtctctctctctcgctctcgtccccgccgcggcgccgccctgctctccccctaggtgccgctgcgatttcggagggccggtagtccggcggcaaggaaggaggcggggcgcgatgaggttggagaagtgctggttctgctcctccaccatctaccccggccacggcatccagttcgtccgcaacgacgccaagatcttccgcttttgccggtcaaaatgccataaaaattttaagatgaagaggaatcctcgtaaggttaaatggacaaaagcatacagatgcttgcatgggaaggacatgacgcaggactccacctttgagtttgagaggaagaggaacagaccagagcgctatgaccggaatgtcactgcacaaactcttaaggctatccctcttattacaaagattagacatgaacgccataaaaaacatattacagagaggcaaaaacagggtaagacaaagcaaagggagagagatgctaaggagttggaacaggatattcaaatgctcccgaagaaggataccatgctgtcaacacaaaagacaaaggtcgtggtcaaagtttctcagcagcagaccgaagaaaatcttatggaagagtaatgaaatggaatcatgttgcatgcgctctcattttgtcatctttatgcaacacttgtgtttctaattgttactttgcaagttgtatttgactgattaccagcaagttttgcacgtactgtgtgcctgtgtgctttgtgacttcc

SEQ ID NO: 1888 - DNA, 955 bp, Oryza sativa
gtcggtctctctctctcgctctcgtccccgccgcggcgccgccctgctctccccctaggtgccgctgcgatttcggagggccggtagtccggcggcaaggaaggaggcggggcgcgatgaggttggagaagtgctggttctgctcctccaccatctaccccggccacggcatccagttcgtccgcaacgacgccaagatcttccgcttttgccggtcaaaatgccataaaaattttaagatgaagaggaatcctcgtaaggttaaatggacaaaagcatacagatgcttgcatgggaaggacatgacgcaggactccacctttgagtttgagaggaagaggaacagaccagagcgctatgaccggaatgtcactgcacaaactcttaaggctatccctcttattacaaagattagacatgaacgccataagaaacatattacagagaggcaaaaacagggtaagacaaagcaaagggagagagatgctaaggagttggaacaggatattcaaatgctcccgaagaaggataccatgctgtcaacacaaaagacaaaggtcgtggtcaaagtttctcagcagcagaccgaagaaaatcttatggaagagtaatgaaatggaatcatgttgcatgcgctctcattttgtcatctttatgcaacacttgtgtttctaattgttactttgcaagttgtatttgactgattaccagcaagttttgcacgtactgtgtgcctgtgtgctttgtgacttccatctatatttgagccttgggcctagtaatggtgtctgtgcggacgtgcgctaagcccaaggtggtgtgcaccctagggctaaccctaggatatctctaatcatatttattttatttagtagccattattgtttagagttggattttgcttagattattatgccaaatataatttcgcaggtaattcgatttgtagaactcc

SEQ ID NO: 1889 - DNA, 1017 bp, Brachypodium distachyon
gagcgccccgtccccctcgctcgtcttcctcgactgactcgagtaaagcaagcgccgccgccgccggttgatctcccctccgtctctctcgctcccaacctcccatcaccccacaaaccgatttttctccccgtttcatctccttgatcccccccaaattcgtaaccacggcaaaaaatcataccttgccctgctggttcctccgccggccgctgcgtgcgtgcgtgtgtgtgccgaccgaggctgaggcggcgccatgaggttggagaagtgctggttctgctcctccaccgtctacccgggccacggcatccagttcgtccgcaacgacgccaaggtctttcgcttttgccgatcaaaatgccacaagaatttcaagatgaagaggaatcctcgcaaggttaaatggacgaaagcatacaggcgcttacgtggcaaggacatgacacaggattccacgtttgagttcgagaggaagaggaacagaccagaacgctacgaccgcaatgtcactgaacagactctcaaggctatcccgcttattacaaagattagacatgaacggcagaagacgcatattacggataggcagaaacagggtaagagcaagcaacggcagaaggatgctaaggaggtggagcaggatattggtatgcttcccaagaagcttcaagaaacaaagctcaaggtcgaagtttctcagcagcagaccgaagacaatcttatggaggagtaaggcagaaccgttttgcctgtgtgttcatgtggtcctttccctgcagcactttgtgtttcgtcagacttatcatgtaaaatctgctttcagacagagtgcaagcaaagtttcgcatgctatataatcatgtagacgatggtcgaagttgttttcttattgttgtgatcgtgaaattaacttagtcactgttgaggtgtatcagctagtgttggtaaaaaaatatcccagctttgtctggaagttgtgtagaatctttgtttgctgtctcggtgtcaaaattc

SEQ ID NO: 1890 - DNA, 908 bp, Hordeum vulgare
ctccctcctcccctcctcggcggccgccgccgccccgcatcgcagccggcgagtccccccgcccgcagccgtcctaagccgccgccgccgtgcgcgacgtcggggtcaccgaggagttggcgccatgaggttggagaagtgctggttctgctcctccaccgtctaccccggccacggcatccagttcgtccgcaacgacgccaaggtcttccgcttctgccgatcaaaatgccacaagaacttcaagatgaagaggaaccctcgcaaggttaagtggaccaaggcgtacagacgcctgcgtggaaaggacatgacacaggattccacgtttgagtttgagaggaagaggaacaggccggagcgctacgaccgtaacgtcaccgaacagactctcaaggccatcccgcttatcacaaagatcagacatgaacggcagaagaaacacattacagagagacagaagagtggtaagagcatggtgcggaagagcgatgctaaggagctggagcaggatattggcatggttcccaagaaggagaccgagaattatgtagccaagcagaaggttctagtttcccagctcaagaccgaagagaatcttatggaagagtaatggaatcaaacagttttgtgtgtgtgcgagcatgtgatccgtcctatatcaagtactttgtgtttcatcagaatgtagacgacagtgaacatttgttttctacttaccatgagcaagttatgcatgtgctgttatcgtgtggccgatggtcagatttgctctcctactgcttaatagaatcgtgaaattaaccggtcactgttatcgtgtgtccggtcactgttatcgtgtgttcatctttgtttagtagcatgtgctctgtactttcggtatgatgcagaagaatcatcagctt

SEQ ID NO: 1891 - DNA, 1009 bp, Hordeum vulgare
gccgccgaccgcaaccaaacccttcctccccttccgccccgtctcgcctccctcctcccctcctcggcggccgccgccgccccgcatcgcagccggcgagtccccccgcccgcagccgtcctaagccgccgccgccgtgcgcgacgtcggggtcaccgaggagttggcgccatgaggttggagaagtgctggttctgctcctccaccgtctaccccggccacggcatccagttcgtccgcaacgacgccaaggtcttccgcttctgccgatcaaaatgccacaagaacttcaagatgaagaggaaccctcgcaaggttaagtggaccaaggcgtacagacgcctgcgtggaaaggacatgacacaggattccacgtttgagtttgagaggaagaggaacaggccggagcgctacgaccgtaacgtcaccgaacagactctcaaggccatcccgcttatcacaaagatcagacatgaacggcagaagaaacacattacagagagacagaagagtggtaagagcatggtgcggaagagcgatgctaaggagctggagcaggatattggcatggttcccaagaaggagaccgagaattatgtagccaagcagaaggttctagtttcccagctcaagaccgaagagaatcttatggaagagtaatggaatcaaacagttttgtgtgtgtgcgagcatgtgatccgtcctatatcaagtactttgtgtttcatcagaatgtagacgacagtgaacatttgttttctacttaccatgagcaagttatgcatgtgctgttatcgtgtggccgatggtcagatttgctctcctaccgcttaatagaatcgtgaaattaaccggtcactgttatcgtgtgtccggtcactgttatcgtgtgttcatctttgtttagtagcatgtgctctgtactttcggtatgatgcagaagaatcatcagcttgtggttttgagcataccctggctttctctagacggtggtttaaaatcttggttc

SEQ ID NO: 1892 - DNA, 832 bp, Avena sativa
cgagcccctcttctccgcacgtaacctagggttcgccctcctttcatagtccttcccctcctaccgtcgcagcctccactccaattcccaccctcgtcttcgtcttcctgatccccgtcggctgctgcgcgtccccgcgacggcgcgatgaggttggagaagtgctggttctgctcctccaccgtctacccaggccacggcatccagttcgtccgcaacgacgccaagatcttccggttctgccggtcaaaatgccacaaaaacttcaagatgaagaggaaccctcgcaaggttaagtggacgaaagcgtacaggcatctgcgcggcaaggacatgacgcaggacgccacgtttgagttcgagaggaagaggaacaggccagaacgctacgaccggaacgtcaccgagcagactctgaaggccatcccacttatcacgaagattaggcatgaaaggcagaaaaaacacatcactgagagacagaaggcgggtaagagcatgtcacggaagaaggacgccaaggagttggaccaggatcttcagatgcttcccaagaaggacacagcgaactatgtacctaagcagaaggttttggtttctcagctcaagaccgaagagaatcttatggaagagtagtggagtggaaatcttttggtgcttgcatgttcacatggccctttgtatgcagtactacttttggttttgtaagattgtagaccaccgtggcacttgttttcgacttggtacttgcaggttatgcatgtgttgtaatggtgcagactatggtcggatttgttatcctatctctaatagaatcatgaacttaaccggt

SEQ ID NO: 1893 - DNA, 777 bp, Avena sativa
ccctgccgccgccccccgtcgcgtcgagctcccctccgcaggcaacccgagctgccccgtcgatttcgcaggaggcggcgccatgaggttggagaagtgctggttctgctcctccaccgtctaccccggccacggcatccagttcgtccgcaacgacgccaagattttccgcttctgccgatcaaaatgccacaagaacttcaagatgaagaggaaccctcgcaaggttaaatggacgaaagcgtataggcacttgcgtggcaaggacatgacacaggattccacgtttgagttcgagaggaagaggaacaggccggaacgctacgaccggaacgtcaccgagcagactctgaaggccatcccgcttatcacgaagattaggcatgataggcagaagaaacacatcactgagagacagaaggcgggtaagagcatgtcacggaagaaggacgccaaggagttggaccaggatcttcagatgcttcccaagaaggacacagcgaactatgtacctaagcagaaggttttggtttctcagctcaagaccgaagagaatcttatggaagagtagtggaatggaaatcttttggtgcttgcatgttcacatgttcctttgtatgcagtactacttttggttttgtaagattgtagaccacagtggcacttgttttcgacttggtacttgcaggttatgcatgtgttgtaatggtgcagactatggtcggatttgttatcctatctctaaaatagaatcatgaacttaaccggtcattgtta

SEQ ID NO: 1894 - DNA, 833 bp, Secale cereale
tccccccccgcccgcccacagccggcctaagctgccgccgcgcgcgcccggggtcaccgaggaggcggcgccatgaggttggagaagtgctggttctgctcctccaccgtctaccccggccacggcatccagttcgtccgcaacgacgccaagatctttcggttctgccgatcaaaatgccacaagaacttcaagatgaagaggaaccctcgcaaggttaagtggaccaaggcgtacagacgcctgcgtggaaaggacatgacacaggatgccacgtttgagttcgagaggaagaggaacaggccggagcgctacgaccgtaacgtcactgagcagactctgaaggccatcccgcttatcacaaagatcagacatgagcggcagaagaaacacattacagagagacagaaggctggtaagagcatggtgcgaaagagcgacgctaaggagctggatcaggatattggcatggttccaaagaaggaaaccgagagctatgtagccaagcagaaggttctagtttctcagctgaagacggaagagaatcttatggaagagtaatggaatcaaacagttttgtgtgcgcgcgtgcatgtgatgatcctcttctatatcaagtactttgtgtttcgtaagaatgtagacgacactgaacatttgttttctacttactatgagcatgttatgcatgtaatgttatcgtgtggacgatggtcagatttgctctcctgccgtttagtagaaaatcatgaaattaaactggtcactgttattgtgtgctcatttttgttcagtatattgtccaccgttacttttggtacgatgcaaaagtc

SEQ ID NO: 1895 - DNA, 808 bp, Brachypodium distachyon
cttccccatcttctccttccccctaccagcaggccgccgccgccagacgtcgcggcgagctctctctccgcagccgagctaggctgctgcttggtgtgtaccggcggaggtttgaggcggcgccatgaggttggagaagtgctggttctgctcctcgacagtctacccgggccacggcatccagttcgtccgcaacgacgccaaggtcttccgcttttgccgatcaaaatgccacaagaatttcaagatgaagaggaatcctcgcaaggttaaatggacgaaagcatacaggcgcttgcgtggcaaggacatgacacaggattccacgtttgagttcgagcggaagaggaacaggccagaacgctacgaccgcaacgtcaccgaacagactctcaaggctatcccacttattacaaagattagacatgaacggcagaagacgcatatttcagataggcagaaacagggtaagagcaagcaaagggagaaggatgctaaggaggtggagcaggattttcatatgcttcccaagatgcttcaagaaacaaaggtcaaggtcagagttacccagcagcagaccgaagacaatgttatggaggagtaaggcagaaccattttgtctgtgcgttcatgtggtcttttccgtgcagcactttgtgtttcatcagactgttaacttaccatgtagacgatggtaaaatgtgctttcagacagaatgcaagcaaagttttgcatgctatataatcatgtagacgatggtcaaagttgttttcttattgttgcgatcgtgaaattaacttagtccct

SEQ ID NO: 1896 - DNA, 916 bp, Avena sativa
ccacaaccctcctctcccttccccctgccgccgccccccgtcgcgtcgagctcccctccgcaggcaacccgagctgccccgtcgatttcgcaggaggcggcgccatgaggttggagaagtgctggttctgctcctccaccgtctaccccggccacggcatccagttcgtccgcaacgacgccaagatcttccggttctgccggtcaaaatgccacaagaacttcaagatgaagaggaaccctcgcaaggttaaatggaccaaagcgttcaggcatctgcgcggcaaggacatgacgcaggacgccacatttgagtttgagaggaagaggaacagaccagaacgctacgaccgcaatgtcaccgagcagactctgaaggccatcccgcttatcacgaagattaggcatgaacggcagaaaaaacacatcactgagagacagaaggcgggtaagagcatgtcacggaagaaggacgccaaggagttggaccaggatcttcagatgcttcccaagaaggacacggcaaactatgtacctaagcagaaggttttggtttctcagctcaagaccgaagagaatcttatggaagagtagtggaatggaaatcttttggtgcttgcatgttcgcatggtcctttgtatgcagtactacttttggttttgtaagattgtagaccacagtggcacttgttttcgacttggtacttgcaggttatgcatgtgttgtgatggtgcagactatggtcggatttgttatcctatctctaaaatagaatcatgaacttaaccggtcattgttaatgtggtcagttttgttcagtgtcctacctgaatacttttggtattgcccaaaaagttcaggcaattcttgttttcaaagaatcacatatttgtctgaaggataacgttggcgaagt

SEQ ID NO: 1897 - DNA, 850 bp, Festuca arundinacea
ggccgccgcctcccagtcgcggcgagcccttcttccccacacgtaacctagggttcgcccttctccctagtccttcccctcccactccaaatcccctccctcgtcttcgccttcctgacccccggcggctgccgcgcgttccccagacggcgcgatgaggttggagaagtgctggttctgctcctccactgtctaccccggccacggcatccagttcgtccgaaacgacgccaaggtcttccgcttctgccgatcaaaatgccacaagaacttcaagatgaagaggaaccctcgcaaggttaagtggaccaaggcttacaggcgcctgcgtggcaaggacatgacgcaggacacgacgtttgagttcgagaggaagaggaacaggccggagcgctacgaccggatcctcacggagcagactctgaaggccatcccgctcatcaccaagatcagacatgaacggcagaagaaacacatcacagagagacagaaggggggtaagagcatgtcacggaagaaggacgcgaaggagctggagcaggatcttcagatgcttcctaagaaggacaccgtggcctatgaagctactaagcagaaggttatcgtttctcagctcaagaccgaagagaatcttatggaagagtagtggaatggaaatgttttggtgcttgcatgttcacatggtcccttgtatgcagtactactttgggttctgtaaggttgcagacggtgatgacatttgttttcgactgagtactagcaggttttgcgtgtgctgtaatggtgcagactatggtcggatttgataccttaccgttaatagaatcgtgaacttaatcagtcattgttg

SEQ ID NO: 1898 - DNA, 728 bp, Avena sativa
agctgccccgtcgatttcgcaggaggcggcgccatgaggttggagaagtgctggttctgctcctccaccgtctaccccggccacggcatccagttcgtccgcaacgacgccaagatcttccggttctgccggtcaaaatgccacaagaacttcaagatgaagaggaaccctcgtaaggttaaatggaccaaagcgttcaggcatctgcgcggcaaggacatgacgcaggacgccacgtttgagttcgagaggaagaggaacaggccggagcgctacgaccggaacgtcaccgagcagactctgaaggccatcccgcttatcacgaagattaggcatgataggcagaagaaacacatcactgagagacagaaggcgggtaagagcatgtcacggaagaaggacgccaaggagttggaccaggatcttcagatgcttcccaagaaggacacagcgaactatgtacctaagcagaaggttttggtttctcagctcaagaccgaagagaatcttatggaagagtagtggagtggaaatcttttggtgcttgcatgttcacatggccctttgtatgcagtactgcttatggttttgtaagattgtagaccacagtggcacttgttttcgacttggtacttgcaggttatgcatgtgttgtaatggtgcagactatggtcggatttgttatcctatctctaaaatagaatcatgaacttaaccggtcattgtta

SEQ ID NO: 1899 - DNA, 1065 bp, Triticum aestivum
caccccaaggggaaccagcttatgggccccttatggcctatttttaggggggccactattaggacacagttttttaccaaaaaaagcagggctggtacccggtcccggaatttcccggggataattgtcgacccaacgcttcccgcgaattggggaccgaggggcacctgacatgggactgaagggagtaagaacctttcctccccttttcgcccccgtcccgttttccctcccccccttcctcggcggccgccgccgccccccatcgcggcgagtccccccgcccgcagccgacctaagctgccgccgcgtgcgcccggggtcaccgaggaggcggcgccatgaggttggagaagtgctggttctgctcctccaccgtctaccccggccacggcatccagttcgtccgcaacgacgccaagatctttcggttctgccgatcaaaatgccacaagaacttcaagatgaagaggaaccctcgcaaggttaagtggaccaaggcgtacaggcgcctgcgtggaaaggacatgacacaggatgccacgtttgagttcgagaggaagaggaacaggccggagcgctacgaccgtaacgtcactgagcagactctgaaggccatcccgcttatcacgaagatcagacatgaacggcagaagaaacacattacagagagacagaagggtggtaagagcatggtgcgaaagagtgacgctaaggagctggatcaggttatcggcatggttcccaagaaggagaccgagaactatgtagccaagcagaaggttctagtttctcagctgaagaccgaagagaatcttatggaagagtaatggaatcaaacagttttgtgtgtgcgcgtgcatgtgatccttttctatatggagtactttgtgtttcatcagattgtagacgacagtgaacatttgttttctacttactatgagcaagttatgcatgtgatgttatcgcgtggacgatggtcagatttgctctcctaccgtttaatagaattgcgaaattaaccagtcattgttattatatgttcatttttgcttagtagtgtgt

SEQ ID NO: 1900 - DNA, 500 bp, Avena sativa
cggcgccatgaggttggagaagtgctggttctgctcctccaccgtctaccccggccacggcatccagttcgtccgcaacgacgccaagatctttcggttctgccgatcaaaatgccacaagaacttcaagatgaagaggaaccctcgcaaggttaagtggaccaaggcgtacaggcgcctgcgtggaaaggacatgacacaggatgccacgtttgagttcgagaggaagaggaacaggccggagcgctacgaccgtacgtcactgagcagactctgaaggccatcccgcttatcacgaagatcagacatgaacggcagaagaaacacattacagagagacagaaggctggtaagagcatggtgcgaaagagcgacgccaaggagctggatcaggatatcggcatggttcccaagaaggagaccgagaactatgtagccaagcagaaggttctagtttctcagctgaagaccgaagagaatcttatggaagagtaatggaa

SEQ ID NO: 1901 - DNA, 748 bp, Avena sativa
ggagccaaaaccttctttctccttctcccactccccctgccggccgccgccgcctcagttgcggcgagcccctcttctccgcacgtaacctagggttcgtcctccttccttagtccttcccctcctaccgacgcagcctccactccaattctcaccctcgtcttcgtcttcctgattcccggcggctgctgcgcgtccccgcgacggcgcgatgaggttggagaagtgctggttctgctcctccaccgtctatccaggccacggcatccagttcgtccgcaacgacgccaagattttccgcttctgccgatcaaaatgccacaagaacttcaagatgaagaggaaccctcgcaaggttaaatggacgaaagcgtataggcacttgcgtggcaaggacatgacacaggattccacgtttgagttcgagaggaagaggaacaggccggaacgctacgaccgtaacgtcaccgagcagactctgaaggccatcccgcttatcacgaagattaggcaagaacggcagattcaacacatcgctaagagacagatggcaggtaagagcatgtcacggaagaaggacgccaaggagttggagcaggatcttcagatgcttcccaagaaggacatctcacattatgaaactaagacgaaggttcttgtttctcagctcaagaccgaagagaatcttatggaagagtaatggaatggaaatgtcttccttgtgcgtgcatgtagtccttactatgcg

SEQ ID NO: 1902 - DNA, 848 bp, Echinochloa colona
cgcgcacccggcgttgcggctcttctcacctagggttcccccatatctccgccgccgccctcgtcttcgcttgcagccgccgcgacctgatcgggcctgcaagtgctctccgaaatcgagtctccgccgactgggggagcctgtagggcggcgtcaaggaaggaggcggcgccatgaggttggagaagtgctggttctgctcctccaccatctaccccggccatggcatccagttcgtacgcaacgacgccaagatctttcgcttttgccgatccaagtgtcataaaaatttcaagatgaagaggaatcctcgtaaggttaagtggacaaaagcatacaggcgtttgcatggcaaggacatgacccaggattcgacctttgagtttgagaggaagaggaacaggcctgagcgctatgaccggaatgtgaccgagcaaactctaaaggccataccgcttattacaaaggtcaggcatgagcgcctgaagaagcacattacagataggcacaaacctggtaaaaccaaggagcgggagagagatagcaaggagctggagcaggacatcaacattcttccaaagaagcttatcagtaacgagctttcagctgagagaccaaagatcttggtcaaagttgagaggccgcagacagaagataatatgatggaagagtagtcggattgtattgtgttgcttgtgttcatgtcgtatgcagaccatgtttttagtttcttgagattgtactgctgcagtcgatgaaagatgttaacgtatttgtggaccgagtatcaagttttgcatgtggtgccaggtacctatactggagtggagtcaaaagaacatatggga

SEQ ID NO: 1903 - DNA, 876 bp, Echinochloa colona
gctcccagccggccgcgcgcacccggcgttgcggctcttccttctcacctagggttcccccatatctcctccgccgccctcgtcttcgcttgcagccgccgcgacctgatcggctgccgattgggggagcctgtagggcggcgtcaaggaaggaggcggcgccatgaggttggagaagtgctggttctgctcctccaccatctaccccggccatggcatccagttcgtacgcaacgacgccaagatctttcgcttttgccgatccaagtgtcataaaaatttcaagatgaagaggaatcctcgtaaggttaagtggacaaaagcatacaggcgcttgcatggcaaggacatgacccaggattcgacctttgagtttgagaggaagaggaacaggcctgagcgctatgaccggaatgtgaccgagcaaactctaaaggccatcccacttattacaaaggtcaggcatgagcgcctgaagaagcacattacagataggcataaacctggtaaaaccaaggagcgggagagagatagcaaggagctggagcaggacatcaacattcttccaaagaagcttatcagtaacgagctttcagctgagaggccaaagatcttggtcaaagtggagaggccgcagacagaagataatatgatggaagagtagtcggattgtgttgtgttgcttgtgttcatgtcgtatgcagaccatgtttttagtttcttgagattgtactgctgcagtcgatgaaagatgttaacgtatttgtggaccgagtatcaagttttgcatgtggtgccaggtacctatactggagttgagtcaaaagaacatatgggatgaattaacttcatgatgattgtgatgatcaacttttt

SEQ ID NO: 1904 - DNA, 1056 bp, Echinochloa colona
agctcccagccggccgcgcgcacccggcgttgcggctcttccttctcacctagggttcccccatatctcctccgccgccctcgccttcgcttgcagccgccacgacctgatcggctgccgattgggggagcctgtagggcggcgtcaaggaaggaggcggcgccatgaggttggagaagtgctggttctgctcctccaccatctaccccggccatggcatccagttcgtacgcaacgacgccaagatctttcgcttttgccgatccaagtgtcataaaaatttcaagatgaagaggaatcctcgtaaggttaagtggacaaaagcatacaggcgtttgcatggcaaggacatgacccaggattcgacctttgagtttgagaggaagaggaacaggcctgagcgctatgaccggaatgtgaccgagcaaactctaaaggccataccgcttattacaaaggtcaggcatgagcgcctgaagaagcacatcacagacaggcacaaacctggtaaaaccaaggagcgggagagagatagcaaggagctggagcaggacatcaacattcttccaaagaagcttatcagtaacgagcttacagctgagagaccaaagatcttggtcaaagtggagaggcagcagacagaagataatatgatggaagagtagtcggattgtattgtgttgcttgtgttcatgtcgtatgcagaccatgtttttagtttcttgagattgtactgctgcagtcgatgaaagatgttaacgtatttgtggaccgagtatcaagttttgcatgtggtgccaggtacctatactggagtggagtcaaaagaatatatgggatgcattaacttcatgatgcttgtggtcatcagctttttaaggttagtctaggtgttctggaatgaaggcgcgcttaaatggtggcttgcacaatttggtgcgctacgggtcagagtgtagcatttatcgaatacttgttccttgatataataaattatattaaccactggctacgggtaactgatggaagcacgagtcaattggttggcaaagaggg

SEQ ID NO: 1905 - DNA, 1003 bp, Festuca arundinacea
agtggtatcaacgcagagtacggggggctcttttctcttctcccactcccccctgccggccgccgcctcccagtcgcggcgagcccttcttctccacacgtaacctagggttcctcctcctccccttccaccatcgcagcctccaccccaacttccccttcctcttcctgatccccgtcgtctgctgcgcgtcccccagacggcgcgatgaggttggagaagtgctggttctgctcctccaccgtctaccccggccacggcatccagttcgtccgcaacgacgccaagatcttcgcttctgccgatcaaaatgccacaagaacttcaagatgaagaggaaccctcgcaaggttaagtggaccaaggcttacaggcgcctgcgtggcaaggacatgacacaggactcgacgtttgagttcgagaggaagaggaacaggccggagcgctacgacaggaacgtcgccgagcagactctcaaggccatcccgcttatctcgaagatcagacataaacggcaggagaagcacataactgagagacagaaggctggtaagaaactgtcacggaagaaggacgccaaggagctggaccaggatcttcagatgctccccaagaaggacaccgtggcctatgaagctaagcagaaggttatcgtttctcagctcaagaccgaagagaatcttatggaagagtaatggaatggaaatgtttggcgcttgcatgttcacatggtcctttgtatgcagtacttctttgtgttttgtaaggttttagacagcaatgacatttgttttcgactgagtactagcaggttttgcgtgtgctgtaatggtgcagactatggtcggatatgttaccttatcgttaatagaatcgtgaacttaatcggtcattgttgatgtagttaacaaaaaaaaaaaaaaaaaaaaaaaaaaaaaaaaaacaaaaaaaaaaaaaaaaaaaaaaaacaaaaaaaaaaaaaaaaaaacaaaaaaacaaaaac

SEQ ID NO: 1906 - DNA, 935 bp, Lolium multiflorum
ccggccgccgcctcccagccgcggcgagcccttcttccccacacctaacctagggttcgcccttctccttagtcctcccctcccaccgtcgccgcctccgctccaacaaatccccaccctcgtcttcgtcttcctgatcccaagcggctgccgcgcgtccccccgacggcgcgatgaggttggagaagtgctggttctgctcctccaccgtctaccccggccacggcatccagttcgtccggaacgacgccaaggtcttccgcttctgccgatcgaaatgccacaagaacttcaagatgaagaggaaccctcgcaaggttaagtggaccaaggcgtacaggcgcctgcgtggcaaggacatgacgcaggacacgacgtttgagttcgagaggaagaggaacaggccggagcgctacaaccggatcctcacagaggagactctcaaggccatcccgctcatcaccaagatcaggcatgaacggcagaagaaacacatcacggagagacagaagggtggtaagagcatgtcacggaagaaggacgcgaaggagctggagcaggatcttcagatgcttcctaagaaggacaccgtggcctatgaagctgctaagcagaaggttatcgtttctcagctcaagaccgaagagaatcttatggaagagtagtggaatggaaatgttttggtgcttgcatgttcacatggtcccttgtacgcagtactactttgggttttgtaaggttgtagacggtgatgacgtttgttttcgactgagtattagcaggttttgtgtgtgctgtaatggtgcagactatggtcggatttgttaccttaccgttaatagaatcgtgaacttaatcagtcattgttggtgtggtcattttactacatgaaaaattcaggcagttgttgctttaagtaaaaaaaaaaaaaaaag

SEQ ID NO: 1907 - DNA, 719 bp, Setaria italica
tttcgctgccgatttgggggagcctgtagtgcggcgctaaggaaggaggcggcgccatgaggttggagaagtgctggttctgctcctccaccatctaccccggccatggcatccagttcgtccgcaacgacgccaagatctttcgcttttgccgatcaaagtgtcataaaaatttcaagatgaagaggaatcctcgtaaggttaagtggacaaaagcatacaggcgcttgcatggcaaggacatgacccaggattcgacctttgagtttgagagaaagaggaataggcctgagcgctatgaccggaatgtgaccgagcaaactctgaaggccatcccgattattacaaaggctaggcatgagcgcctgaagaagcacatttcagacaggcaaaaacctggtaaaaagaaggaactggagagagataacaaggagctggagcaggacatcaacatgcttccgaagaagcttattagtaatgaggcttcagctgagaaaacaaaggtcaaggtcaaggtcaaagttgttcagcagcagactgaagatcggatggaagagtagccggttggtattgtgttgcttgtgctcatgtcgtatgcagaccttttcttttgagtttctcgagattgccctgctgccatgtagtcgacgaaagatgttaacatttgtggaccgaatatcaacaagttttgcgtgtggtggcagatacttgtactggag

SEQ ID NO: 1908 - DNA, 732 bp, Avena sativa
caccctcgtcttcgtcttcctgattcccggcggctgctgcgcgtccccgcgacggcgcgatgaggttggagaagtgctggttctgctcctccaccgtctacccaggccacggcatccagttcgtccgcaacgacgccaaggtcttccgcttctgccgatcaaaatgccacaagaacttcaagatgaagaggaaccctcgcaaggttaagtggacgaaagcgtacaggcatctgcgcggcaaggacatgacgcaggatgccacatttgagttcgagaggaagaggaacaggccggaacgctacgaccggaacgtcaccgagcagactctgaaggccatcccgcttatcaccaagattaggcatgaacggcagaagacacacatcaataagagacagcaggcgggtaagagcatgtcacggaagaaggacgccaaggagctcgatcaggatcttcagatgcttcccaagaaggacatcgcgcattatgaacctaagacgaaggttctcgtttctcagctcaagaccgaagagaatcttatggaagagtaatggaatggaaatgtcttgcttgtgcgtgcttgtagtactttctatgcaatatgttgggtttcatcagattgtactagatgacaatgcaatatgttttcgatcgagtagaagcaagttttgcatgtgctgtaatcgtcagatttggtttcttatcattataatagaatcgtgcactttaccagtc

SEQ ID NO: 1909 - DNA, 823 bp, Saccharum officinarum
cagtcggccagttgcgcttgccctccgccgctcgccagccgcccgcgcgcccagcgccgctcgtcggcctcccgcccgcccgcagtcgcatatcaccaaacccgttctttttctgctgattgggggccccgtaggacggcaccaaggaaggcggcgccatgaggttggagaagtgctggttctgctcctccaccatctaccctggacatggaatccagttcgtccgcaacgatgccaagatcttccgcttttgccggtcaaagtgtcataaaaattttaagatgaagaggaatcctcgtaaggttaagtggacaaaagcatacagacaattgcatggcaaggacatgacaaaggatacaacctttgagtttgagaggaagaggaacaggcctgagcgctatgaccgcaatttgacggagcaaactctgaaggccatcccacttattacaaagattaggcatgaccgcctggagaagcacatttcaaacagacataaacctggtaaacgcaaggagatggagaaagattctaaggagctggatcaggacatcggcatgcttcccaagaagcttattagcaacgagctcgcagtggagaaaacaaagatcaaggtcaaagttgttcagcagcagacagaagataatgctatggaagagtagtgcgtggcattgtgttgttcttgtccgatgcagatctttttgtatttacctattatgaaattgatgaaagatgtttagacaatgtattcatggagtgagtatcagcatgttttccgtgtggttcctgatacctacccggctacactggaggtggtatgtgagat

SEQ ID NO: 1910 - DNA, 1553 bp, Panicum virgatum
cggaacccacgatttatggttctctcacgtactcgaaattcggattgatgcagcccagaacggcccatggtcaggtctagcccaagttgcccaacccgcgtgagaaccgtgcgatcggagttggaggaagcgaacggctgagaaaggccgagcagccttcatacgtaaaccctaccccacttggttgccttcctctcccagccggccgcgcgcacccggcgttgcggctcctctcaggctcagctagggttcgcctctcctccgccgccctcgtcttcgttttgcagccgcgaccagagcgctccaagtcgagcgtttcgaccagatacgtttgggggaagccggtagggcggcgccaacgaaggaggcggcgccatgaggttggagaagtgctggttctgctcctccaccatctaccccggccatgggatccagttcgtccgcaacgacgccaagatctttcgcttttgccgatcaaagtgtcataaaaatttcaagatgaagaggaatcctcgtaaggttaagtggacaaaagcatacagggccttgcatggcaaagacatgacccaggattcaacctttgagtttgagaggaagaggaacaggcctgagcgctatgatcggaatatgaccgagcaaactctaaaggccatccctgtcattataaaggctaggcatgaacgtctgaagaagcacattaaagacagacacgatcctggtaaaaagaaggcgctggagagagataacaaggagctggagcaggacatcaacatgcttcctaagaagcttttcagtaatgaggctccagctaagaaacaaaaggtcacggtcaaagttgttcagcagcagacagaagatcggatggaagagtagccggatggtattgtgttgcttgtgttcatgtcgtatgcagacctttactttcgagtttcttgagattgccctggtgccatgtagtccatggaagatgttaacatttgtggactgagtatcagagttttgcatgtggtggcagagacatatactggagtggagtcaaaaggatgtgtactctagtggttgttttgtggtactcgcatttaccgaatactggatccttatagctattgtgaaatattgcgcatcgagcttgccatggcttcacggtggtctcctggcgacgacatgatcgtcctttggagcagcttccgatcaacggcggctgatgctctcagctgtcagctcagctaacggacaccttgcgcatccctttcatctcgcgagatgcgacggaagctccggattcggcgacgcgcccggcggcaatgacgccgtcgcggtcgctgtttgttcgaatatatacgatcaataatgcaaggcacacagtgcaactccgagcaggacacgttttcgtttctcaaaaagaaatgcgagaagaggatacagattggtggcaaattcgaacacatacgaggagctccgtgggaggttcattattgagacttttttctctttgtttttttaattggactatttctctcttcttaataagaagatacgcagctcccaataat

SEQ ID NO: 1911 - DNA, 2862 bp, Brachypodium distachyon
aaagatgccgttacaaaagcgaagaagcagtaggcgttaagcacaaggctgcctgcgtggcctgcgcgcatcagagtctcctcctcctcctcccgtcccgacccacctcgcctctactctactctactcgccaccgagaccgaatccagtccaccgcgtggagctgctgtacgacgcgcagctcgtgcggtgcaggcggagctagcggacaggcatcaataaacaaatccgggcgggcggaggcgtccgcgccgtgagaggagagaggggaagcgatcgtggtgaggggggcgatgcgggcgagagagatgcacccgctctgctgcctcgccggcgccgccgaatactgccccggcggcggcgccggggaccgctccccgccgccgccgcccgccccggccttggatggggcgcccgcggcggttgcgggggtgctgtacaagtggaccaacatcggcagcggctggcgcccgcgctggttcgcgatccgcgggggcgtgctcgcctactcgaagatccgccgccgcgtcgccgcggaggagacgccgccgccgccgcgccacgaggccgccggcgtgaggctgatcggtggcgcggcccgcgctgccggggagcagcccgtcggattcgtccatctcaagatctcatcatttagcgaaagtaaatcagatgacaagcgattttatattattactccaaccaagacacttcagctgaggactggctgtgctaaagatcgtgtggcttggattgaagcacttgtttctgccagaagtgaatattctctttgtggggttttaccatgtgaccagaatgatggatcattttctacagaaaagctcagggaccgcttgcatgcggaaggtgttggtgcatcaattgttaaagactgtgagcagattgttcattcagaattttcacagtatcacacacagatgaagcaacgctgtgaatcatacttaagctttattggcagccttccacgggaacttgaggtagttaattcaggagatgcaactattgttgacaatctagagctgcaattgttcaagcctgattgttccagctctggaaaatgtagtgaatacagcaatacagaatcttctgatgatgctgtcaaacaagaaatatgtcaggtgtcagatgaagacgagtttcatttctatgacacaagacaaagtttcagcgattgcactgctagtcctgattttaaaacaagacacttagatcatgggaatgaagctcacaaatttgccaacttactagctgctgataggaccaatgaatattcattgtcgtcttcgaagaggcgctccaagttgcctgaaccagtagaaaaggagaaaagtgttagcctttggtcaatgatcaaagataatgttggcaaggatcttacaagagtctgtctccctgtttactttaatgaaccattatcgtctcttcaaaaatgctttgaagatctggagtattcatacttattggaccgtgcatatgaatgtggtgtaagggggaacggtctgatgagaattctttatgttgctgcctttgcggtctccggatatgcctccacagatagccgtccttgcaagcctttcaatccattattaggggaaacctatgaagctgattaccctgaaaagggaatacgtttcttctctgaaaaggttagtcatcatccgatggccatggcatgccattgcgaagggaaaggttggaaattttggggagacagcaatctgaagagtaaattctggggacagtccattcaactggatcctagcggcgttttaactctagagtttgatgatggagaaactttccagtggagcaaggttacaacaaccattaataaccttatcattggacgagtctattgccatcaccatggcacgatgaacattcgtggaaacagacaatattcatgcaagctgatgtttaaagagcagtctttcctcgaacgcaatcctcgccaggttcaaggctttgttaaatattccgatgggaccaaggttgcatccttgatgggcaagtgggacgagagcatgtattgcattattagtgatgatgcttcgaaagtgagctctcatgtttcacatcagagtgctggtactactttgttgtgggagaaaaatgagcctccagacaacccaactcgatataatttatcatcatttgcgatcactttaaatgagctgacaccagggctcaaggagaagcttccaccaacagattcaagactcagacctgaccaacgacatctagagaatggagagtacgagaaggccaacgctgagaaactgcggttggagacaaggcaacgaatggcaaggaacatgcaggagagtggctggaggccaagatggttccagagagacgcagaagatggaacataccgctacgtcggaggttactgggaggccagggagcagagaaggtgggttggctgcaatgacatatttggcaatttcactgacactccaaagctacacaccggtgcaactgtctaagggagtcctggtctgctggagcactaggcgttgacattacactgatttttgaaggtacataattgatctgttcctctcacactgtagtatcctacaaagaagagctaagatgctcttcttgtcgtcttatatacacaatagctgtgacattaagccgaacgaaaaccatatttcgatatggttttcttttactgagtccgagccttgctaacattgttgctaaatatgtcaataatagcattcgaccccttgtatttgatgaggatggcatgtttgatgctggcaaagcctgcccctatgattgtactctggtggacagtggacgcctcataatcctggacaaagtcctgttgcc

SEQ ID NO: 1912 - DNA, 3482 bp, Setaria italica
gccttgctcgcgaagacgccgtcgccctcgcgtgagccgcttggaagttggaactgtttgcgggaggcgttgggcgcaaggctgcgagcataaaggccccgccccgccgcatcagagtcctccaccgtgagtccacgtctcgtctcctcgctccactcgccacccaacccagggcggaccgaatccgccggccgcgtgaatcgagcggccgaatagagtaatccgcagcccaatgggggccgcgtgagagggcgcgggggcggagatcgggcaggcggcggaggcgagcggcgatgcgggcgtgggagatgcacccgctctgctgcctcgccggagagtggcccggctcgggcggggagctcgcgcccggcgaccgctccccgccgccggagccggcggaggccggggcggaggcgccggcggttgcgggggtgctgtacaagtggaccaacatcggcaagggctggcgcccgcggtggttcgcgatccgcggcggcgtgctggcctactcgaagatccggcggcgcgtcgcggcggagccgcaccccgcgtccgaggccgccggcggcgtcaggctgatcggggtggcgcgcggagccgggggcgccggggagcggcccatcggattcgtgcatctcaagatttcgtcatttagtgaaagtaaatcagatgataaacggttctatataattactccgaccaaaacacttcaactgaggactggttgtgctaaggatcgggcgacttggattgaagcgcttgtcactgcaagaagtgaatattctttgaatggggatttatcaggtgaccagaatgatacatcattttccacagaaaagctcagaaatcgcctgcatactgaaggtgttggcgaggcaattattaaagactgcgagcagattgttcattcagaattttcgcagtaccaaacacagatgaaacagcgttgtgaagagtatttaagctttattggcagtcttccacgggaagttgaggttgttaattcagtagacacgactgtcactgagaagccacagttggagttgttcaagcatgactgctccagctctggaaaatgtagtgaatacagcaacacagaatcttctgatgatgctggcaaacaagagattagtgaactatcagatggagatgaatttcatttctacgacacaagacaaagtttcagtgactttgctacgagtcctgacctgacaaggaaaggcttaaacaatggaaatgaagatcataaatctgttgaatcactaactgccgacaatgccaatgagtatctgctgtcatattcaaaaaggcgcacaaagttgcctgaaccagtagaaaaggagaaaggtgttagcctttggtcaatgatcaaagacaatgttggaaaggatctcacaagagtctgccttcctgtttactttaatgagcctttatcttctcttcaaaagtgctttgaggagttagagtactcttatttgttggatcgtgcatatgaatgtggtttaagggggaatggtctgatgagaattctttatgttgctgcttttgcggtctccggatatgcttccacagattctcgcccctgcaaacctttcaatccattgctaggggaaacctatgaagctgattaccctgaaaaggggatccgtttcttctctgagaaggtcagtcatcaccctatggtcatggcatgccactgtgaggggaaaggttggaaattttggggagatagcaatcttaagagcaaattctggggacaatccattcaagtggatcctgatggtgtgttaacattagagtttgatgatggagaaactttccagtggagcaaggttacaacaacaattaataaccttatccttggtcgactctattgccatcaccatgggacaatgaacataagtggaaatagacaatattcatgcaagctgacgtttaaagagcagtctttccttgatcgaaatcctcgccaggttcaaggagttgtcaaggatgctgatggaaccaaggttgcaaccttgaccggaaagtgggatgaaagcgtgcattgtgtcatcagtgatgatgcctctaaggtgaaatcccatggttcacatcatagtgctggcgccactttgctgtggaagaaaaatgagccttcagcgaatcctactcggtacaatctgtcctcatttgcaataacattaaatgagctgacaccggagctcaaggagaagcttccaccaacagattcgaggctcagaccggatcagcgacacctggagaatggggagcacgagaaggccaatggtgaaaaattgcgtcttgagacaaggcaacggatggcaaggaagatgcaggagagtggctggaaaccaagatggttccaaagggacagcgaagatggaacattccgctatgttggaggttactgggaggcaagggagcagaggaaatgggatggctgcaatgacatatttggtaacttgtctagtagcccaaagctgcaatcatccactctttacgctagctcaagtatatagagattagggcatgttgttcagtaggtgttgacatcacattagtacataagcgagtggcttctctcgtctctgttgtgcaaaggtttgagctaattaacatgctctacttgtcaattgtcatattgaacccaaagacattcaagcagaacccaaagacattcaagcaaaacccaaacttttgtgtacactgggatgcttgtgagaaatcttgctaacattactgttaaaagaattgtcaatgataccatatttcttcttcgcattccacagacgcacttacatgtttggtgctcatgttcttatgctggtggatgtccatatctttggtgattgttggggatgcgcccttgcgggcaaggtctaggcacttatgctggtggaggaggtctaattagaggtataggggctcaatttagacatccgttgtaaagtttagggatctatttgtaatatttaaccacactaataaatatacataaacaaccatctccttcccctataattagagctttatagcttgggggagaggacttttgaccatttatctgttcgggatttctgatcccaatagtgatgctgccaagattgccttctagtatactttagacacgtcgcatctatgaactactgcatccattctgacgtttaagataatatagttagttcgaaagtaaattaatcatcttatcctaagcatcatgtaggaagcacgcaattaatccttcggttaagggctaaaaaacttggcattgaaaggctcacggttggagtgggcattgtgatttgagtttactcattctctgctaacctcaaaatctttcaggcttccagcaagtgaccaaagtcgtactatacttcctgattgtgggccatatgtgggctgcagctttagttggcgctgggcctagtgggctccaatctccatgtctcacgggctccaatctacattggacttctggg

SEQ ID NO: 1913 - DNA, 2537 bp, Panicum virgatum
ccgccggccgaatagagtaatccccggccagaatggaggccgcgtgagagagagagacagagagatcggggcgggcggagcggcgatgcgggcgtgggagatgcacccgctctgctgcctcgccggggagtggccgggctcgggcggggggctcgcggacggcggccgctccccgccgccggagacgccggaggcgccggcggtggcgggcgtgctgtacaagtggaccaacatcggcaagggctggcgcccgcggtggttcgcgatccgcgggggcgtgctcgcctactccaagatccggcgccgcgtcgcggccgaggccgcgggcggcgtcaggctgatcggggtggcgcgcggcgccgggggagccgcggagcggcccatcggattcgtgcatctcaagatatcatcatttagtgaaagtaaatcagatgataaacgcttctatataattactccaaccaaaacacttcaactgaggactggttgtgctaaggatcgggcgacttggattgaagcgcttgtcactgcaagaagtgaatattcttttaatgaggatttatcgggtgaccagaatgatgcttcattttccacagaaaagctcagaaatcgcttgcatgctgaaggtgttggtgaggcagttattaaagactgtgagcagattgttcattcagaattttcgcagtaccagacacagatgaagcagcgttgtgaagagtatttaagctttattggcagtcttccacgtgaagttgaggtagttaattcagtagatacaactgtcactgagaagccacagttggagttgttcaagcatgattgctccagctctggaaaatgtagtgaatatagcaacacagaatctgatgatgttggcaaacaagagatttgtgaactatcagatggagatgaatttcatttctacgacacgagacaaagtttcagtgactttgctgcaagtcctgagatgagaaggagatgcctaaacaatggaaatgaagatcatgtatctattgagtcactaactaccgacaaggccaacgaagatctgtcatattcgaaaaggcgcacaaagttgcctgaaccagtagaaaaggagaaaggtgttagcctttggtcaatgatcaaagacaattgtggaaaggatctgacaagagtctgccttcctgtttactttaacgagcctctatcttctcttcagaagtgcttcgaggaattggagtactcttatttgttggatcgtgcatatgaatgtggtttaagggggaatggtctgatgagaattatttatgttgctgcttttgcggtctccggatatgcttccacagattgtcgcccctgcaaacctttcaatccattgcttggggaaacctatgaagctgattaccctgaaaaggggatccgtttcttctctgagaaggttagtcatcatcctatggtcatggcatgccactgtgaggggaaaggttggaaattttggggagatagcaatcttaggagcaaattctggggacaatccattcaactggatcctgatggtgtgttaacattagagtttgatgatggagaaactttccagtggagcaaggttacaacaacaattaataaccttatccttggtcgagtctattgccatcaccatggcacaatgaacataagtggaaatagacgatattcatgcaaactgacatttaaagagcagtctttccttgatcgaaatcctcgccaggttcaaggagttgtcaaggatgctgatggaaccaaggttgcaacattgatggggaagtgggatgaaagtgtgcattgtatcatcggtgatgatgcctcaaaggtgaaatcccatggttcacaccagagtactggtgccactttgctgtgggagaaaaacaagccttcagccaatcctactcggtacaacctgtcatcatttgcaataacattaaatgagctgacaccggagctcaaggagaagcttccaccaacggattcgaggctccgaccagatcagcgacacctggagaatggggagtatgagaaggccaatgctgaaaaactgcgtctcgagacaaggcaacggatggcaaggaagatgcaggagagtggctggaaaccaagatggttccaaagggacagcgaagatggaacattccgctacattggaggttactgggaggcaagggagcagaggaaatgggatgggtgcaacgacatatttggtaacttgtctagcagcccaaagctgcaaccatccactctctacgctagctcaagtatatagggattagggcatgttgtttagtaggtgttgacgtcgcattagtacataagcgagtggcttccctcgtctctgttgtgcaaaggtttgagctaacatgctctacttgtcaattgtcatattgaacccaagggacattcaagcataacccaaacttttgtggacactgggatgcttatgagaactcttgctaacattactgctaaaagaattgccaatgataccatttttcttctttgtattccacaaggacgtggttacg

SEQ ID NO: 1914 - DNA, 2891 bp, Sorghum bicolor
gcaggagcaggccgcgccgcgccggcgttcatcagttcccaactgttttgcggatgcgccgagccggaggcggaggcgttaagcgcaaggctgccagcataaagcccccctggcgcccgcccgcccgccgcatcagagcctcctcctccctccgcgagcgagtccacgtcccgtcttcctcgctccactcgcccacccaagccgggccgaatccgccgctcgaatagagtaatccgaggagcaagccaaatggtggccgcgtgagtgagggaccgcgggcgggcggagatcgggcgggcggccggccggtgggtgggtagggggggagactaactaagggcagggccgcgccgcgatgcgcgcgtgggagatgcacccgctctgctgcctcgctggggagtggccgtcctcgggcggcggcggcggcgggctcgcgcccggcgaccgctccctgccgccggcggaggaggacgcagacgcggcgggggaggcgccggcggtggccggggtgctgtacaagtggaccaacatcggcaaggggtggcgcccgcgctggttcgcgatccgcggcggcgtgctcgcctactcgaagatccggcgccgcgtcgcggcggagccgcatcccgccaccgaggccgcgggcggcggcggcgtcaggctgatcggggtggcgcgtggcggcgccggcgggggcgcaggggagcgccccatcggattcgtgcctctcaagatatcatcatttagtgaaagtaaatcagatgataaacggttttatataattactccgaccaaaacacttcaactgaggactggttgtgctaaggaccgggcgacttggattgaagcgcttgtctctgcaagaagcgaatattcttttaatggggatttatcgggtgatcagaatgatgcatcattttccacagaaaagctcagaaatcgcttgcatgcagaaggcattggtgaggccgttattaaagactgtgagcagattattcattcagaattttcgcagtaccaaacacagatgaagcagcgttgcgaagagtatttaagctttattggcagtcttccacgggaagttgaggtagttaattcagtagattcaactgtccctgagaagccacagctggagctgttcaagcatgactgctccagctctggaaaatgtagtgaatatagcaacacagaatcttctgatgatgttggcaaacaagagattagtgaactatcagatggagatgaatttcatttctatgacacaaggcaaagtttcagtgaatttgctactagtcctgctgacccgagaaagggatgcttaaataacggaaatgaagatcataaatctgttgaaccactgtctgctcacaaggccgagaaatgtatgctgtcacattcaaaaaggcgctcacagttgcctgaaccaatagaaaaggagaaaggagttagcctttggtcaatgatcaaagacaatgttggaaaggatctaacaagagtctgccttcctgtttactttaatgagcctttatcttctctccagaagtgctttgaagagttggagtactcttatttgttggaccgtgcatatgaatgtggtttaagggggaatggtctgatgagaattctttatgttgctgcatttgcggtatctggatatgcatccacagattctcgcccatgcaaaccttttaatccattgcttggggaaacttacgaagctgattaccctgaaaaggggatccgtttcttctctgagaaggtcagtcatcatcctatggtcgtggcatgtcactgtgaggggaaaggatggaaattttggggagacagcaatctaaagagcaaattctggggacaatccattcaactggatcctaatggtgtgctaactttagagtttgatgatggagaaactttccaatggagcaaggttacaacaacaataaacaaccttatccttggtcgagtatattgccatcaccatggcacaatgaacataagtgggaatagacgatattcatgcaagttgacgtttaaagagcagtctttccttgatcggaatcctcgccaggttcaaggagtcgtcaaggatgctgatggaagcaaggttgcaacattgatggggaagtgggatgaaagtgtgcattgtatcatcaacaatgatgcctctaaggcgaactcccatggttcacaaaagagttctggtgccactttgctatgggagaaaaacgagcctccagtcaatcctactcggtacaacttgtccgcatttgcaataacattaaatgagttaacaccagagctcaagcttccaccaacggattcaaggctgagaccagatcaacggcacctggagaatggggagtacgagaaggccaatgctgaaaaactgcgtctcgagacacggcagcggatggcaaggaagatgcaggagagtggctggaaaccaagatggttccaaagggacagcgaggatggaacataccgctatgttggaggttactgggaagcaagggagcagagaacatgggttggctgcaatgacatatttggtaacttgtctagcagccaaaagctgccaccatccgctctctacactagctcaagtatataggggtaatgccgtaagggcatattcagtaggtgttgacatcgcattactcacttctggtacataatcgagaggggtttctctcgtttctgttgtgttaagctgtgagctaacatgctttcctcttgtcaattgtcacattgaaaccaaggacattcaagcataacccaaccttttgtcgatactaggacacttataagaaatcttgctaacattattgttaaaagaattgtcaatgtactattttcttctttgcattccacaaggacgtgtttgcatgtttggt

SEQ ID NO: 1915 - DNA, 2329 bp, Echinochloa colona
gccgccggagccggcggcgtccgagggggaggaggcgccggcggtggcgggcgtgctgtacaagtggaccaacatcggcaagggctggcgcccgcggtggttcgcgatccgcgggggcgtgctggcctactcgaagatccggcgccgcgtcgccgcggagccgcatcccgcacccgaggctgccgccgctggtggcgtcaggctgatcggggtcgcgcgcggaggcgccggggagcggcccatcggattcgtgcatctcaagatatcgtcatttagtgaaagtaaatcagatgataagcggttctatattattactccgaccaaaacacttcaattgaggactggttgtgctaaggatcgggcggcttggattgaagcacttgtcactgcaagaagtgaatattcttttaatggggatttatcaggtgaccagaatgatacatcattttccacagaaaagctcagaaatcacttgcatgctgaaggtgtcggtgaggcaattattaaagactgtgagcagattgttcattcagaattttcgcagtaccaaacacagatgaagcagcgatgtgaagagtatttaagctttattggcagtcttccacgggaagttgaggtagttaattcagtagatacaactgtcactgagaagccacagttcgagttgtttaagcatgactgctccagctctggaaaatgtagtgagtacagcaacacagaatcttcagatgatgttggcaaacaagagatcagtgaactatcagatggagatgaatttcatttctatgacacaaggcaaagttttagtgattgtgctctgagtcctgacctgagaaggagatgcttaaacaatggaaatgaagatcataaatctgttgaaccactaactgctgataacgcaaacaaatatctgctgtcatattcaaaaaggcgcacaaagttgcctgaaccagtagaaaaggagaaaggtgttagcctttggtcaatgatcaaagacaatgttggaaaggatctcacacgagtctgccttcctgtgtactttaatgagcctttatcttctcttcagaagtgctttgaggagttggagtactcttatttgttggatcgtgcatatgaatgtggtttaagggggaatggtcagatgagaattctttatgttgctgcttttgcggtgtccggatatgcttccacagattctcgcccctgcaaacctttcaatccattgctaggggaaacctatgaagctgattaccctgaaaagggaatccgtttcttctctgagaaggtcagtcatcatcccatggtcatggcgtgccactgtgaggggaaaggttggaaattttggggagatagcaatcttaagagcaaattctggggacaatccattcaagtggatcctgatggtgtgttaacattagagtttgatgatggagaaactttccagtggagaaaggttacaacaacaattaataaccttatccttggtcgactttattgccatcaccatggcacaatgaacataagcggaaataggcaatattcatgcaagctgacgttcaaagagcagtctttccttgatcgaaatcctcgccaggttcaaggagttgtcaaggatgctgatggaaccaagtttgcaaccttgacgggaaagtgggatgaaagcgtgcattgtatcattggtgatgacgcctctaaggtgaaatcccatggttcacatcagagtgctggtgccactttgctgtgggagaaaaacgagcctccagccaatcctactcgctacaacctgtcctcatttgcaataacattaaatgagctaacgccggggctcaaggagaagcttccaccaacggattcaaggctcagaccggatcagcgacacctggagaatggggagtatgagaaggccaatgctgaaaaactacgtctcgagacaaggcaacggatggcaaggaagatgcaggagagtggttggaaaccaagatggttccagagggacagcgaagatggaacattccgctatgtaggaggttactgggaggcaagggagcagaggaaatgggatggctgcaacgacatatttggtaacttgtctagcagcccaaagctgcaatcatccactctctacgctagctcaagtatatagggattaggacatgttgttcagtaggtattgacgttgcattagtacataatcgagtggcttctctcatctctgttgtgcaaaggtttgagctaacatgttctacttgtcagttgtcatattgaacctaaggacattcaagcataacccaaacttttgtggacactgggatgcttatataaatctggc

SEQ ID NO: 1916 - DNA, 2711 bp, Zea mays
ctccgcgcgagtccacgtctcgtctcctcctcgcccgtctcgccaaccacgccggccgcaccgaatccgctgctcgaatactagactagtccgaagagccaaatggtggtcgcgtgaggggcgggcggcaggagatcggcccgcccggggaggggggagactacgatgcgggcgtgggagatgcacccgctctgctgcctcgccgccggggagtggccggcctcgggcgcggcccgcgacgaccgctccccgccgcccgagggctcgggggaggcgccggcggtggcgggggtgctgtacaagtggaccaacatcggcaagggctggcgcccgcgctggttcgcgatccgcggcggcgtgctggcctactcgaagatccgccggcgcgtcgcggcggctcctccgcgtcccgcctccgaggccgcgggcggcgtcaggctcatcggggtggcgcgcggcgccggggagcgccccatcggattcgtgcctctcaagatgtcatcatttagtgaaagtaaatcagatgataaacgtttttatataattactccgaccaaaacacttcaactgaggactggttgcgcaaaggaccgggcgacttggattgaagcgcttgtcactgcaagaagcgagtattcttttaatggggatttatcaggtgaccaaaacgtcgcatcattttctacagaaaagctcagaaatcgcttgcacgtcgaaggtgttggtgaggcagttattaaagactgtgaacagattattcagtcagaattttcgcagtaccaaacacagatgaagcagcgttgcgaagagtatttgagttttattggcagtcttccacgggaagttgaggtagttaattcagtagattcaactgtccctgagaagtcacagctggaactgttcaagcatgactgctccagctccggaaaatgtagtgaatatagcaacacagaatcttctgatgatgttggcaaacaagagattagtgaactatcagatggagatgattttcatttctatgacacaaggcaaagtttcagtgaatttactacgactcctgctgacctgagaaagggatgtgtaaacaccggaaatgaagatcataaatctgttgaatcactgactgttgatgaggccgagaaatatatgctgtcacatccaaaaaggcgctcacagttgcctgagccaatagaaaaggagaaaggggttagcctttggtcaatgattaaagacaatgttggaaaggatctaacaagagtctgccttcctgtttacttcaatgagcctttatcttctctccagaagtgctttgaagagttggagtactcttatttgctggatcgtgcatatgaatgtggtttaagagggaatggtctgatgagaattatttatgtcgctgcatttgcggtctctggatatgcgtccacagattcccgcccctgcaaaccatttaatccattgcttggggaaacctatgaagctgattaccctgaaaaggggatccgtttcttctctgagaaggtcagtcatcatcctatggtcatggcatgtcactgtgaggggaaaggttggaaattttggggagacagcaatctaaagagcaaattctggggacaatccattcgactggatcctaatggtgtgctaactttagagtttgatgatggagaaactttccaatggagtaaggttacaacaacaattaacaaccttatccttggtcgagtatattgccatcaccatggcacaatgaacataagtgggaatagacgatattcatgcaaactgacgtttaaagagcagtctttccttgatcggaatcctcgccaggttcaaggagttgtcaacgatgctgatggaagcaaggtcgcaacattgatggggaagtgggatgaaagtatgcattatatcatcaacaatgatgcctccaagaccaactcccatggttcacatgagggttctggtgccactttgctatgggagaaaaacgagcctccagtcaatcccactcgctacaacttgtccacatttgcaataacattaaatgagttaacaccagagctcaaggagaagctgccaccaacggattcaaggctgagaccagatcaacgtcacctggagaatggggagtacgagaaggccaatgctgaaaaactgcgtctcgagacacggcagcggatggcaaggaagatgcaggagagtggctggaaaccaagatggttccaaagggacagcgaggatgggacataccgctacgtcggaggctactgggaggcaagggagcagagaacatgggttggctgcaatgacatatttggtaacttgtctagcagcccaaagctgccgccatccggtctcaacactagctcaagtatatagaggtaagggcatactgtagtcagtatgtgttgacgtcacattagtcacttatggtacataattgagaggggcttctctcgtttctgttgtgttacgtgttaagctgtgagctaacatgcttctgtcgatactaggagctgacatcgcattaatcacttgggtttagctgtgagctaacatcacttgtggtacactgaatcatttgtcacattgaagccaaggacattcaagcttaacccaagcttttgtcgatactagaaagaacacgagaaatattgccaaaactattgttaaaagaattctttatgatatcattttcttctgcattgcac

SEQ ID NO: 1917 - DNA, 2320 bp, Zea mays
gagagagagactaggggccggccgcgatgcgggcgtgggagatgcacccgctctgctgcctcgccggtgagtggccggcctcgggcggcgggctcgcgcccggcgaccgctccccgccggcggaggacgcgggggcggcgccggcggtggcgggggtcctgtacaagtggaccaacatcggcaaggggtggcgcccgcgctggttcgcgatccgcggcggcgtgctcgcctactccaagatccggcgccgcgtcgcggcggagccgcgtcccgaggccgcgggcggcgtccggctgatcggggtggcgcgcggcgccgcgggcgccgctgagcgccccatcggattcgtgcctctcaagatatcatcatttagtgaaagtaaatcagatgataaacggttttatataattactccgaccaaaacacttcaactgaggactggttgtgctaatgaccgggcgacttggattgaagcgcttgtcactgcaagaagcgaatattcttttaatggggatttatcaggtgatcagaatgatgcatcattttccacagaaaagctcagaaatcgcttgaatgctgaaggcgttggcgaggccgttattaaagactgtgagcagattattcattcagaattttcgcagtaccaaacacagatgaagcaacgttgtgaagagtatttaagctttattggcactcttccacaggatgttgaggtagttaattcagtagattcaactgtccctgagaagccacggctagagctgttcaagcatgactgctccagctctggaaaatgtagtgaatatagcaacacagaatcttctgatgatgttggcaagcaagagattagtgaactatcagacggagatgaatttcatttctatgacacaaggcaaagtttcagtgaatttgcttctagtcctgctgacccgagaaagggatgtttaaacaacggaaatgaagatcataaatctgttgaatcattgacggttgacaaggctgagaaatatatgctatcacattcaaaaaggcgcttacagttgcctgaaccaatagaaaaggagaaaggagttagcctttggtcaatgatcaaagacaatgttggaaaggatctaacaagagtttgtcttcctgtttactttaatgagcctttatcttctctccagaagtgctttgaagagttggagtattcttatttgttggatcgtgcatatgaatgtggtttaagggggaatggtctgatgagaattctttatgttgctgcatttgcggtctctggatatgcatccacagattcccggccttgcaaacctttcaatccattgcttggggaaacctatgaagctgattaccctgaaaaggggatccgttttttctctgaaaaggtcagtcatcatcctatggtcatggcatgtcactgtgaggggaaaggttggaaattttggggagacagcaatctgaagagcaaattctggggacaatccattcaattggatcctaatggtgtgctaactttagagtttgatgatggagaaattttccaatggagcaaggttacaacaacaattaacaaccttatccttggtcgagtatattgccatcaccatggcacaatgaacataagtgggaatagacgatattcatgcaagctgacttttaaggagcagtctttccttgatcggaatcctcgccaggttcaaggagtcgtcaaggatgctggtggaagcaaggttgcaacattgacggggaagtgggatgaaagtgtgcattgtgtcatcaacaatgatgcctctaaggtgaactctcatggtccacatcagagttctggttccactttgctatgggagaaaaatgagcctccagtcaatcctacccgctacaacttgtccgcatttgcaataacactaaatgagttaacaccagagctcgaggagaagctgccaccgacggattcaaggctgagaccagatcaacggcacctggagaatggggagtacgagaaggccaatgctgaaaaactgcgcctcgagacacagcaacggatggcaaggaagatgcaggagagtggctggaaaccaagatggttccaaagggacagcgaggatggaacgtaccgctacgtcggaggttactgggaggcaagggagcagagaacatgggtcggctgcaatgacatatttggtaacttgtctagcagccagaagctcccaccatccgctctctacacgagctgaagtatatagggccaaggacatccaagcataacccaaccttttgtcgatactaggatacttatgagagatcttgtggacattattgc

SEQ ID NO: 1918 - DNA, 4275 bp, Zea mays
ccgcagagtttcccactgttcgagctccgcccgcccgttctaaaaccctagatctctctcccctcacccccgtccctcgacccgccgccgagtcgccggaggaggcgggggcctcgccgcagaagccatgtacctctacagcctgacgctacagcgcgcgacgggcgcggtgtgcgccgtcatcggcagcttcagcgggcgggactcgaagaagtccgccgcctccgggtccggctccacgcaagagatcgccgtggcccggggcagcacgctcgacctcctccgcccggacccggagacgggccgcctccgcacgctcctctccgtcgacgtcttcggcgccatccgctcgctcgcgcagttccgcctcaccggcgccaacaaggattacctcgtcgtcggctccgactcgggccgcctcgtcatcctcgagtactcccccgaccgcaaccgcctcgacaaggtccaccaggagacctttggcaagtcgggctgccgccgtatcgtccccggccagctcctcgccgtcgacccaaagggccgcgcgctctgcatcgccgcgctcgagaagcagaagctcgtctacgtcctcaatcgcgacgccgccgcgcgcctcaccatctcgtccccgctcgaggcgcacaagtccaacactctcaccttcgccctcgccgcgctcgactgtgggttcgacaaccccgtcttcgccgccatcgagctcgagtacgccgagtctgaccgcgaccccacggggcaggccgccaaccaggcgcagaagctcctcaccttctacgagcttgacctggggctcaaccatgtctcccgcaaggtctctgagccgattgataatggtgccaatcttctcgtgactgtaccgggtggtggtgacggtcccagcggtgttctcgtgtgctgtgataacttcgtgctgtaccggaaccagggccacccagagattcgtgctgttattccacgccgtgctgacctccctgctgagcgtggcgtcctcattgtcgcagccgccacacacaaacaaaagagtatgttcttcttcctgctacagactgagtatggtgacatattcaaggttgacctcgatcataatggggatgctgttagtgagctcaggatcaagtactttgacaccataccagtgacatcggctgtctgtgtgctgcgctccggtttcctctttgctgcttctgagtttggcaaccatgcactttaccagttccgtgatattggtagagaagccgatgttgagtcatcttctgcaacactgatggagacagaggagggattccagccagttttctttcagccaagggcactgaagaacctcatgcgcatagatgagattgagagcctcatgccagtcatggacatgcgtgtcgcgaatttattcgatgaggaaacaccccagttgttcactgcctgtggccgtggtccacgctccacgttgcgcatcctgaggcctggccttgccatcagtgagatggcccgatcaatgctgcctgctgagcctattgctgtgtggactgtcaagaagaacatcaatgacatgtttgatgcttacattgtagtgtcctttactaatgtcacgcttgtgctctctattggtgagactattgaagaagtcagcgacagccagttcctggacacgactcactcccttgcagtcacgctccttggtgaggactctctaatgcaggtccatccaaatggcatcaggcacatcagggaagatggccgtgtcaatgagtggaggacgcctggaaagaaaactattacgaaggttggatcaaaccgtctccaggtggtaattgctcttagtggtggagagctcatctattttgagatggatatgactggtcagctcatggaggtagagaagcaggacatgtctggtgatgttgcgtgcctggccattgcaccggtccctgaggggaggcaaaggtccagatttcttgccgtaggatcctatgataacaccattcgtatcctctcattggatcctgatgattgcctgcagcctctaagcgtccagagtgtatcatcggcaccagagtcactcctattcttggaggtccaggcatcagttggtggtgaggatggtgcagattatccagccaaccttttcctcaatgctggtttgcagaatggtgttcttttccgtaccaacgtcgacatggttacgggtcagctatctgacacacgttctcgattcctaggcctgagacctccaaagctgttcccttgtatagttagccacaggcaagcaatgctctgcctgtccagccgtccttggctgggttacatacatcaaggccattttctcttgacaccactgtcctgtgatacactcgaatctgcagcatcattttcttctgatcagtgttcagaaggtgtagttgctgttgcgggagatgccttacgtattttcaccattgaacgcctgggagagactttcaatgagacggcaatccctctgcggtacaccccaaggaagtttgtgattctaccaaagaaaaaatacattgctgtcattgagagtgacaaaggtgcattcagcgcagaagagcgagaagctgctaagaaagagtgccttgatgcttctggtgcagcggagaatggaaatgcgaataatggcgatcctatggagaatggtgatggtcaagatggtgccgaggagggcaacacatttcctgatgaacaatatggttatccaaaagctgaatctgagaggtgggtttcctgcattaggatcttggatccaaggagtagggacacaacctgtctgctggaattgcaggacaatgaggctgctgtcagtatctgcactgtgaatttccatgataaggagcatggaactctactggctattggcactgccaagggtttgcagttctggccaaggaggacccttgctggtggattcatccacgtatataagtttgtggatgaagggaggtcacttgaacttctacacaagacacaggtggaggaagtacctcttgcattgtgccaattccaggggcgattacttgcaggtgttggttcagtgctcagactatatgatctgggtaaaagaaaattgctcagaaaatgtgaaaacaagctttttccgaggacattagtatctattcatacctaccgtgatagaatctatgttggcgatatgcaagagtcatttcactattgcaagtacagacgagatgaaaaccaactctatatatttgctgatgacagtgttcccaggtggcttacaacagcacaacacatagattttgacactatggctggagcagataagtttgggaatatatattttgctcgtcttcctcaggatatctcagatgagattgaagaagacccaactggaggcaagattaagtgggagcaagggaagttaaatggtgcccctaacaaagttgaggagattgtgcagtttcatgtgggtgatgttgtaacgtgtttgcagaaggcctctttgattcctggtggaggtgaatgtcttatttatgggactgtgatgggcagtgtgggagcactgcttgcatttacctccagggaagatgttgatttcttctctcacttggagatgcatctgcgtcaggagcatccaccattgtgtggaagagatcacatggcttacagatctgcctattttccagtgaaggatgtgatagatggtgatctctgcgagcagtatccctccctcccagctgatatgcagaggaagattgctgatgagctggacagaactccgggtgaaatcctgaagaagctagaagacatcaggaacaaaatcatctaaaacagcggcttagtgtgaagaaactaggcagggcagtgccggtgctctttgctttaagactgtatccagttcgagctgttgccgcacttcaagatgtgacagcagcgcatccaacaagtttggagcacgctgatctgtacgatctttcctgatgctatctggtccagtcggcgatttattgctgagatagagcatgtacggcaccagaatgagtttttttgtatctcgtagaagtgatttagctgatgtcgttgactgtttacttggcttgatgtaattgagtgaagttattcatgttggattattcgtgtagtacggggttaccttggtaatgtactaccacaagggcttggttgctaggaagggaattggagggttccaattaagccttcaatcctctctaatttcctcccaaacaagccctaacagatttttgaagcgcagatgcgttgctgtca

SEQ ID NO: 1919 - DNA, 4529 bp, Setaria italica
tcccccaaggccccagcagtcgagcgccgcccgcccaccgccacgctctcctctaaaccctagaccctagatctcccatccctccccccccgatccgcctccgccgtcgtcccaccggaggaggaggaggggttccttggcggcgccatgtacctctacagcctgacgctgcagcgcgcgacgggcgcggtgtgcgccgtcatcggcagcttcagcgggcgcgacacgaagaagtcggcggcctccgggtccgcctccacgcaggagatcgccgtcgcccggggcagcacgctcgacctcctccgcccggacccggagaccggccgcctccgcacgctcctctccgtcgacgtcttcggcgccatccgctcgctcgcgcagttccgcctcaccggcgccaccaaggactacctcgtcgtcggctccgactcgggccgcctcgtcatcctcgagtactcccccgaccgcaaccgcttcgacaaggtccaccaggagaccttcggcaagtccggctgccgccgtatcgtccccggccagctactcgcggtcgaccccaagggccgcgcgctctgcatcgccgcgctcgagaagcagaagctcgtctacgtcctcaaccgcgacgccgccgcgcgcctcaccatctcgtccccgctcgaggcgcacaagtccaacactctcaccttctccctcaccgccctcgactgtggattcgacaaccccatcttcgccgccatcgagcttgagtatgctgagtctgaccgcgaccccacggggcaggctgctaaccaggcacagaagctcctcaccttctacgagctcgacctgggcctcaaccatgtctcccgcaaggcctcggagcccattgacaatggtgccaatcttctagtgactgtccctggtggcggcgatggtccgagtggggttcttgtgtgctgtgacaacttcgtgctgtaccggaaccaggggcatccagaggttcgagctgttattccacgccgtgctgacctacctgctgagcgtggtgtcctcattgttgctgctgctacacacagacaaaagaatttgttcttcttcttactacagaccgagtatggtgacatcttcaaggtcgaccttgaacatagtggggaaactgttactgagctcaggatcaagtactttgacaccatacctgtgacatcagctacctgtgtgctgcgatcaggtttcctctttgctgcttctgagtttggcaaccatgcactttaccagttccgtgatattggccgggatgcggatgtcgagtcctcttcagcaacacttatggagacagaggaggggttccagccggttttctttcagccaaggccactaaagaacctcatgcgcatagatgagatcgagagcctcatgccagtcatggatatgcgtgttgcgaatttatttgacgaggaaacaccccagttgttcacagcctgtggccgtggtccacgctccacgctgcgcatcctgaggcccggccttgccattagtgagatggcacgatcgatgctgcccgcagagcctattgctgtgtggactgtcaagaagaatatcaatgacatgtttgatgcctacattgtcgtgtcctttgctaatgttacgcttgtgctctctattggtgagaccattgaagaagtcagtgacagccagttcctggataccacacactcccttgcagtcacgctccttggtgaggactctctcatgcaggtccatccaagtggtatcaggcacatcagggaggatggccgtgtcaatgagtggaggacgcctggaaagaaaactattacaaaggttggatcaaaccggctccaggtggtaatcgctctcagtggtggagagctcatatattttgagatggacatgactggtcagctcatggaggtggagaagcaggacatgtctggcgatgttgcatgcctggccattgcgcccgttcctgagggtaggcaaaggtccagatttcttgctgtaggatcctatgataacaccatccgtatcctctcgctggaccctgatgactgcctgcagcctctaagtgtgcagagtgtatcatcagcaccagagtcactcctattcctagaggtccaggcatcagttggtggtgaggatggtggagactatccagccaaccttttcctcaatgctggcttgcagaacggtgttcttttccggaccaatgttgatatggttacgggtcagctatcagacacacggtctcgattccttggcctgagacctccaaagctgtttccctgtatggttagccacaggcaagcaatgctgtgcctgtccagccgtccctggctgggctatatacatcaaggtcacttcctcttgacacctctgtcctgtgatactctagaatctgctgcatccttttcttctgatcagtgctcagaaggtgttgttgctgttgccggagatgccctacgtattttcaccattgaacgcctgggagagactttcaatgagacggccatccctctgcgctacaccccaaggaagtttgtgattctaccaaagaaaaaatatatcgctgtcattgagagcgataagggtgctttcagcgcagaagagcgagaagctgctaagaaagagtgccttgaggcttctggtgcagcggagaatggaaatgcgaacaatggggatccaatggagaatggtgatggtcaagaagatggtgctgaggagggcaacacatttcctgatgaacagtatggttatccaaaggcagaatcggagaggtgggtttcctgcattaggatccttgatccaaggagtagggacactacctgtctactggaattgcaggacaatgaggcggctgtgagtatttgcactgtaaatttccatgataaagagcacggcactcttttggctgttggcactgccaagggattgcagttctggccaaagaggacccttgctgctgggttcatccacatatataagtttgtcagtgacgggaggtcacttgaacttctacacaagacacaagtggaggaagtacctcttgcattgtgccaattccagggacggttacttgcaggtgttggttcagtgctcagactatatgatctggggaagagaaaattgcttaggaaatgtgaaaacaagctttttccgaagacaattgtgtctattcatacctaccgtgataggatctacgttggtgatatgcaagagtcgtttcactactgcaagtacagacgggatgaaaaccagttgtatatctttgctgatgacagtgttcccagatgggttacagcagctcaacacatagattttgacactatggctggagctgataagtttgggaatatctattttgctcgtcttcctcaggatatctcagatgagattgaagaagacccaactggaggcaagattaaatgggagcaagggaagttaaatggtgcccctaacaaagtggaggaaatcgtgcagtttcatgtcggtgatgttgtcacaagtttgcagaaggcctctttaattcctggtggaggtgaatgtcttatttacggaactgtgatgggcagcgtgggagcactgcttgcattcacctccagggaagatgttgacttcttctctcacttggagatgcatctccgtcaggagcatccaccattatgtggaagagatcatatggcttacagatctgcttattttccagtgaaggatgtgatagatggtgatctctgcgagcagtatccatccctaccagctgatatgcagaggaagattgctgatgagctcgacagaactcctggtgaaatcctgaagaagctagaagacatcaggaacaaaatcatctaagtccacggtgtagtttgaaagaaataggtagcggcaatagaaccgtctggtcctcgatgcttcaagaattgcatccagtttgagctgttgcagttcttcaagatgtgatgcggcattcaacaagttcagagcaagcttgtgttttgattcctttcttatgctaactcgccagtctgcgtttgagccactcaagcatagattacattactgcattgtatcccttagagctgatttcagctgatgtctcgactgtttgttacttggcttgatgtaattgaagttattcgtggatgcttagtcggtagctaccttgctaatgtaccagagaagtttttcgaagtgttagatgcctcagtgccatccccctcagattgttaagctgatggaatccttaactgctatgcatctgcttgaatctcgcattacattcagaacatttactttcaatttaagtttcttccattttctactgtgtgcatgcgtgtggtttttgggtgtgcccagcttatgcgcataaaatgatttgctattcgtttcaattgcacttgaagcaaatgatttgctcttcgtttcaattgctgcgcctatactggattggacagtggtaggcaccttaactcatcagacgaatgtgggtgatcagcgacgagccgacgacagaatccaccggagatagaaaaaaggagggc

SEQ ID NO: 1920 - DNA, 4290 bp, Oryza sativa
gattccggtgcggccatgtacctctacagcctgacgctgcagcgggcgacgggcgcggtgtgcgccgtcatcggcagcttcagcgggcgcgactcgaagaagtcggcggcgtccgggtcgtcgtcgtcgtcgtcgtccacgcaggagatcgccgtggcccgtggcaccactctcgagctcctccgccccgacccggagaccggccgcctccgcacgctcctctccgtcgacgtcttcggcgccatccgctcgctcgcccagttccgcctcaccggcgccaccaaggactacctcgtcgtcggctccgactccggccgcctcgtcatcctcgagtactcccccgaccgcaaccgcctcgacaaggtccaccaggagaccttcggcaagtccggctgccgccgcatcgtccccggccagctcctcgccgtcgaccccaagggccgcgccctctgcatcgccgccctcgagaagcagaagctcgtctacgtcctcaaccgtgacgccgccgcgcgcctcaccatctcgtctcctctcgaggcgcacaagtccaacacgctcaccttctccctcactgccctcgactgcgggttcgacaaccctgtcttcgccgccattgagcttgagtacgccgagtccgaccgcgaccccaccgggcaggctgccgagcaggcgcagaagcacctcacattctatgagctagacctggggctcaatcatgtctcgcgcaaggcctccgagccgatagataacggtgctaatctactggtgactgtgcctggtggtggtgatgggccaagcgggctcctcgtgtgctgcgacaactttgtgctttaccggaaccaggggcacccggaagtgcgggctgtcattccacgccgcgctgatctcccggctgagcggggtgtcctcatagtcgcagccgccacgcacaggcagaagagcttgttcttcttcttactacagactgagtacggcgatatcttcaaggttgacctcgaacacagtaatgacactgttactgagctcaggatcaagtactttgacaccatacctgtgacatctgctatctgtgtgctgcgctcaggttttctctttgctgcttctgagtttggcaaccatgcactttatcagttccgtgatattgggcgggatgtggatgttgagtcgtcttcagctacactgatggagacagatgaggggttccagcccgtattctttcagccaagagcactcaagaacctgtaccggatcgatgaaattgaaagtctcatgccaatcatggacatgcgtgttgcaaatctatttgatgaggaaacaccacaggtattcacagcctgcggccgtggtcctcggtccaccttgcgcatcctgaggcctgggcttgccattagtgagatggctcgatcgatgttgccggctgagcctattgctgtctggactgtaaagaagaatatcaatgacatgtttgatgcctacattgtcgtgtcctttgccaatgttacacttgtgctctccatcggtgagactattgaggaagtcagcgacagccagtttctggataccactcactccctggcagtttctctccttggcgaggactctctcatgcaggtccacccgaacggcatcaggcacatcagggaagatggccgtgtgaatgagtggaggacacctgggaagaaaactatcactaaggttggatcaaaccggctccaggtggtaatcgccctcagtggtggagagcttatctactttgagatggacatgacaggtcagcttatggaagtcgagaagcaggacatgtctggtgatgttgcatgcctggccattgcgccagttccagaggggagacagaggtcccgattccttgcagttggttcctttgataacaccatccgaatactctccgtggaccctgatgactgcttgcagcctctgagtgtccaaagtgtctcttcagccccagagtccctcatgtttctagaagttcaggcatcagttggcggtgaggacggtgcggaccatccagccaaccttttcctcaatgctggcctgcaaaatggtgtcctgttccgcaccaatgttgacatggtcactggtcagttatctgacacacgatctcggttccttggcctgagacctccaaaactgtttccgtgcatagttagccaccggcaagcaatgctttgcctgtccagccgtccctggcttggctacatacatcaaggtcacttcctattgactccactgtcctgtgatacacttgaatctgctgcatccttctcttctgatcagtgctcagaaggtgttgttgccgttgctggtgatgccctacgaattttcaccattgaacacctgggggagactttcaatgaaacagccatccctctgcgctacaccccaagaaaatttgtgattcttccaaaaaagaaataccttgctgtcattgagagtgataaaggtgcgctcagcgcagaagagcgagaagcggctaagaaggagtgccttgaggctgctggtgttacagaaaatggtaatgcaaataatggggatcagatggagaatggtgatggtcaagaagatggtgctgaggacagaaacacacttccagatgaacagtatggttatccaaaggcggaatcagaaaggtgggtttcttgcatcaggattcttgatccaaagagcagagacacgacttgtctgcttgaattgcaagacaatgaagcagctgttagcatttgcactgtgaactttcatgataaggagcatggtactctcttggctgttggtactgccaagggattgcaattctggccaaagaggaacctttcagctgggttcatccacatatacaagtttgtagatgaagggaggtcacttgaactgcttcacaagacacaggtggaggaagtacctcttgccttgtgccagttccaaggacggttgcttgctggtgttggttcagtcctcaggttatatgatcttgggaagaggaagttgctcaggaagtgtgaaaacaaacttttcccaaggacgatagtgtctatccatacttaccgagataggatctatgttggtgatatgcaagagtcatttcattattgcaagtacagaagggatgaaaaccaactgtacatcttcgctgatgatagtgttcccaggtggctcacagcagcaaatcacatagattttgatactatggcaggggcagataagtttgggaacatatattttgctcgccttcctcaggatctctcagatgagattgaagaagacccaactggggggaagattaaatgggagcaagggaagttgaatggggccccaaacaaagtagaggagattgttcagtttcatgttggtgatgttgtcacatgtttgcagaaagcctctttaataccgggaggcggcgaatgtcttatttatgggactgtgatgggcagtgttggggcactgcttgcattcacctccagggaagatgttgacttcttttctcacttggagatgcatctccgccaggagcatccaccattatgtggaagagatcacatggcctacagatctgcttattttccagtgaaggatgtgattgatggtgacctctgtgagcagtttccatccctcccagctgatatgcaaaggaagattgccgatgaactcgacagaactcctggtgaaatcctgaagaagctggaggacattaggaacaaaattatctgaaagatcattgcgcatagcgaaagaactagacaaactgttgggctctcaatggctgtaaaaacagaatctcctttcctgtccgagacctagcagcttcagatccgtggcacattcaagaaataagaaaacactagggccaatcgagtggagaggtggtaaagtccttaatggtctgatttgtagaattcttggtgctaatgacctggtgtctggaattcgttgttaatggtctgatttgtatatttcttagttaacaatggctaagttgacctttcagatcgaagcgagaataggtcacataactgcatcagcatcagagtgttcttctgtaactcttagagcatgctttagcctttgtgttagtatttgctgtgatgtagttggacaagttctttgttttgatggttgactcatctgtaggctgctgctactttcatgatgtacgatagaaccttttcattttttcaggtgatactgaagcagatgtattggtgctatccaatttgattttcctgtgataatattacacttttgatgatgaaatattctactgctagtagttcaatggca

SEQ ID NO: 1921 - DNA, 4405 bp, Oryza sativa
gcaccacccgccccgccaccgcctccaatctaaaaccctagatctctctctctccccacttctctctcttctccccccgagtcttcctcacccgccgccgccgccgccgccggaggaggaggaggaggaggattccggtgcggccatgtacctctacagcctgacgctgcagcgggcgacgggcgcggtgtgcgccgtcatcggcagcttcagcgggcgcgactcgaagaagtcggcggcgtccgggtcgtcgtcgtcgtcgtcgtccacgcaggagatcgccgtggcccgtggcaccactctcgagctcctccgccccgacccggagaccggccgcctccgcacgctcctctccgtcgacgtcttcggcgccatccgctcgctcgcccagttccgcctcaccggcgccaccaaggactacctcgtcgtcggctccgactccggccgcctcgtcatcctcgagtactcccccgaccgcaaccgcctcgacaaggtccaccaggagaccttcggcaagtccggctgccgccgcatcgtccccggccagctcctcgccgtcgaccccaagggccgcgccctctgcatcgccgccctcgagaagcagaagctcgtctacgtcctcaaccgtgacgccgccgcgcgcctcaccatctcgtctcctctcgaggcgcacaagtccaacacgctcaccttctccctcactgccctcgactgcgggttcgacaaccctgtcttcgccgccattgagcttgagtacgccgagtccgaccgcgaccccaccgggcaggctgccgagcaggcgcagaagcacctcacattctatgagctagacctggggctcaatcatgtctcgcgcaaggcctccgagccgatagataacggtgctaatctactggtgactgtgcctggtggtggtgatgggccaagcgggctcctcgtgtgctgcgacaactttgtgctttaccggaaccaggggcacccggaagtgcgggctgtcattccacgccgcgctgatctcccggctgagcggggtgtcctcatagtcgcagccgccacgcacaggcagaagagcttgttcttcttcttactacagactgagtacggcgatatcttcaaggttgacctcgaacacagtaatgacactgttactgagctcaggatcaagtactttgacaccatacctgtgacatctgctatctgtgtgctgcgctcaggttttctctttgctgcttctgagtttggcaaccatgcactttatcagttccgtgatattgggcgggatgtggatgttgagtcgtcttcagctacactgatggagacagatgaggggttccagcccgtattctttcagccaagagcactcaagaacctgtaccggatcgatgaaattgaaagtctcatgccaatcatggacatgcgtgttgcaaatctatttgatgaggaaacaccacaggtattcacagcctgcggccgtggtcctcggtccaccttgcgcatcctgaggcctgggcttgccattagtgagatggctcgatcgatgttgccggctgagcctattgctgtctggactgtaaagaagaatatcaatgacatgtttgatgcctacattgtcgtgtcctttgccaatgttacacttgtgctctccatcggtgagactattgaggaagtcagcgacagccagtttctggataccactcactccctggcagtttctctccttggcgaggactctctcatgcaggtccacccgaacggcatcaggcacatcagggaagatggccgtgtgaatgagtggaggacacctgggaagaaaactatcactaaggttggatcaaaccggctccaggtggtaatcgccctcagtggtggagagcttatctactttgagatggacatgacaggtcagcttatggaagtcgagaagcaggacatgtctggtgatgttgcatgcctggccattgcgccagttccagaggggagacagaggtcccgattccttgcagttggttcctttgataacaccatccgaatactctccgtggaccctgatgactgcttgcagcctctgagtgtccaaagtgtctcttcagccccagagtccctcatgtttctagaagttcaggcatcagttggcggtgaggacggtgcggaccatccagccaaccttttcctcaatgctggcctgcaaaatggtgtcctgttccgcaccaatgttgacatggtcactggtcagttatctgacacacgatctcggttccttggcctgagacctccaaaactgtttccgtgcatagttagccaccggcaagcaatgctttgcctgtccagccgtccctggcttggctacatacatcaaggtcacttcctattgactccactgtcctgtgatacacttgaatctgctgcatccttctcttctgatcagtgctcagaaggtgttgttgccgttgctggtgatgccctacgaattttcaccattgaacacctgggggagactttcaatgaaacagccatccctctgcgctacaccccaagaaaatttgtgattcttccaaaaaagaaataccttgctgtcattgagagtgataaaggtgcgctcagcgcagaagagcgagaagcggctaagaaggagtgccttgaggctgctggtgttacagaaaatggtaatgcaaataatggggatcagatggagaatggtgatggtcaagaagatggtgctgaggacagaaacacacttccagatgaacagtatggttatccaaaggcggaatcagaaaggtgggtttcttgcatcaggattcttgatccaaagagcagagacacgacttgtctgcttgaattgcaagacaatgaagcagctgttagcatttgcactgtgaactttcatgataaggagcatggtactctcttggctgttggtactgccaagggattgcaattctggccaaagaggaacctttcagctgggttcatccacatatacaagtttgtagatgaagggaggtcacttgaactgcttcacaagacacaggtggaggaagtacctcttgccttgtgccagttccaaggacggttgcttgctggtgttggttcagtcctcaggttatatgatcttgggaagaggaagttgctcaggaagtgtgaaaacaaacttttcccaaggacgatagtgtctatccatacttaccgagataggatctatgttggtgatatgcaagagtcatttcattattgcaagtacagaagggatgaaaaccaactgtacatcttcgctgatgatagtgttcccaggtggctcacagcagcaaatcacatagattttgatactatggcaggggcagataagtttgggaacatatattttgctcgccttcctcaggatctctcagatgagattgaagaagacccaactggggggaagattaaatgggagcaagggaagttgaatggggccccaaacaaagtagaggagattgttcagtttcatgttggtgatgttgtcacatgtttgcagaaagcctctttaataccgggaggcggcgaatgtcttatttatgggactgtgatgggcagtgttggggcactgcttgcattcacctccagggaagatgttgacttcttttctcacttggagatgcatctccgccaggagcatccaccattatgtggaagagatcacatggcctacagatctgcttattttccagtgaaggatgtgattgatggtgacctctgtgagcagtttccatccctcccagctgatatgcaaaggaagattgccgatgaactcgacagaactcctggtgaaatcctgaagaagctggaggacattaggaacaaaattatctgaaagatcattgcgcatagcgaaagaactagacaaactgttgggctctcaatggctgtaaaaacagaatctcctttcctgtccgagacctagcagcttcagatccgtggcacattcaagaaataagaaaacactagggccaatcgagtggagaggtggtaaagtccttaatggtctgatttgtagaattcttggtgctaatgacctggtgtctggaattcgttgttaatggtctgatttgtatatttcttagttaacaatggctaagttgacctttcagatcgaagcgagaataggtcacataactgcatcagcatcagagtgttcttctgtaactcttagagcatgctttagcctttgtgttagtatttgctgtgatgtagttggacaagttctttgttttgatggttgactcatctgtaggctgctgctactttcatgatgtacgatagaaccttttcattttttcaggtgatactgaagcagatgtattggtgctatccaatttgattttcctgtgataatattacacttttgatgatgaaatattctactgct

SEQ ID NO: 1922 - DNA, 4249 bp, Setaria italica
cctcaactccccatcaatcgaacgccgcccgccgcacgctccgtcccgacaccctcccccgcgccccgtcgccgccaccgtctccacctgaggaggaggaggaggaggcggcctcggcgccaccatgtacctctacagtctgacgctgcagcgggcgacgggggcggtgtgcgccgtcatcggcagcttcagcgggcgcgacgcgaagaaggcggcgtccgggtccgcgtcgacgcaggagatcgccgtggcccggggaagcacgctcgacctcctgcgcttggacccggagacgggccgcctccgcacgctcctctccgtcgacgtcttcggtgccatccgctcgctcgcgcagttccgcctcaccggcgccagcaaggactacctcgtcgtcggctccgactccggccgcctcgtcatcctcgagtactcccccgaccgcaaccgcttggacaaggtccaccaggagaccttcggcaagtccggctgccgccgcatcgtccccggccagctgctcgcggtcgaccccaagggccgcgcgctctgcatcgccgcgctcgagaagcagaagctcgtctacgtcctcaaccgcgacgccgccgcgcgcctcaccatctcggccccgctcgaggcgcacaagtccaacaccctcaccttctccctcaccgcgctcgactgtgggttcgacaaccccatcttcgccgccatcgagctcgaggatgctgaatctgaccgcgacccaacggggcaggctgcgaaccaggcgcagaaggtcctcaccttctacgagcttgacctggggctcaaccatgtctcccgcaaggcctctgagccgattgataatggtgccaatcttcttgtgactgtccctggtggcggcgacggtccgagcggggttcttgtgtgctgtgacaacttcgtgctgtaccggaaccaggggcacccagaggttcgtgctgtcattccacggcgtgctgacctccctgctgagcgtggtgtcctaattgttgctgctgctacacacaggcaaaagactctgttcttcttcttactacagaccgagtatggtgacatcttcaaggtcgaccttgaacacagtggggatactgttactgggctcaggatcaaatactttgacactgtacctgtaacatcagctatctgtgtgctgcgatcgggtttcctcctctttgctgcttcagagtttggcaaccatgcactttaccagttccgtgacattggccgggatgcagatgtcgagacctcttcagcaacattgatggaaacagaggaggggttccagccggtattctttcagccaagggcactaaagaacctcatgcgcatagacgacattgagagcctcatgccagtcatggatatgcgtgttgcaaatttatttgatgaggaaacaccccagatattcacagcctgtggccatggtccacgctccacacttcgcatcctgaggcctggccttgccatcagcgagatggcacgatcagtgctgcctgcagagcctattgctgtgtggactgtcaagaagaatatcaatgacatgttggattcctacattgttgtgtcttttgctaatgctacacttgtgctctctattggtgaaacaattgaagaagtcagtgacagccagttcctggataccactcactcgctttcagtcactctcctcggtgaggactctctcatgcaggtccatccaaatggtatcaggcacatcagggaggatggccgtgtcaacgagtggaggacgcctggaaagaaaactattacaaaggttggatcaaaccggctccaggtagtaatcgcactcagtggcggagagctcatctattttgagatggacatgactggtcagctcatggaggtggagaagcaggacatgtctggcgatgttgcatgcctggccattgcaccggtccctgaggggaggcaaaggtccagatttctcgctgtaggatcctatgataacaccatccgtatcctctctctggaccctgatgactgcctgcagcctttaagtgtccagaatgtatcatcagcaccagaatcactcctattcctggaggtccaggcatcagttggtggtgaggatggtgccgactatcctgccaaccttttcctcaatgctggtttgcaaaatggtgttcttttccggacaaatgttgacatggttacaggtcagctatcggacacacgatctcgattccttggcctgagacctccaaagctatttccctgtatagttagccacaggcaagcaatgctctgcctgtccagccgtccctggctgggctatatacatcaaggtcacttcctcttgacaccattgtcctgtgatacgctcgaatctgctgcatccttttcttctgatcagtgctcagaaggtgttgttgctgttgctggagatgccctacatattttcaccattgaacgcctgggagagactttcaacgagacagccatccctctgcgctacaccccgaggaagtttgtgattctaccaaagaaaaaatatattgctgtcattgagagcgataagggtgcattcaacgcagaagagcgagaagctgctaagaaagagtgcctcgaggcttctggtgccgtggaggatggaaatgcgaataatgcggatccaatggagaatggggacgggcaagaaaatggtgctgaggatggcaacacatttcctgatgaacagtatggttatccgaaggcagaatcggagcggtgggtttcctgcattaggatccttgatccaaggagtagggacacgacctgtctgctggaattgcaggataatgaggctgctgtcagtatttgcactgtgaatttccatgataaggagcacggcactcttcttgctgttggcactgccaagggattgcagttctggccaaagaggacccttgctggtgggttcatccacatatataagtttgtggaggatgggaggtcacttgaacttctacacaagacacaagtggaggaagtacctcttgcgttgtgccaattccaaggacggctacttgcaggtgttggttcagtgctcagactatatgatctggggaagagaaagttgctcaggaaatgtgaaaacaagctttttctaaagacaatagtgtctattcatacctaccgtgataggatctatgttggcgatatgcaagagtcatttcactactgcaagtacagacgggatgaaaaccaactatacatctttgctgatgacagtgttcccagatggcttaccgcagctcaacatatagattttgacactatggctggagcagataagcttgggaatatatattttgctcgtcttcctaaggatatttcagatgagattgaagaggacccaactggaggaaagattaaatgggagcaaggaaagttaaatggtgcccctaacaaagttgaggaaatcgtgcagtttcatgtcggtgatgttgtcacatgtttgcagaaggcctgtttaattcctgggggaggtgaatgtcttatttacggaactgtgatgggcagtgtgggtgcactgcttgcattcacttccagggaagatgttgacttcttctctcacttggagatgcatctccgtcaggagcatccaccattatgtggaagagatcacatggcctacagatctgcttattttccagtgaaggatgtgatagatggtgatctctgcgagcagtatccgaccctaccagctgatatgcagaggaagatcgctgatgagctcgacagaacacctggtgaaatcctgaagaagctagaagacatcaggaacaagatcatctgagccgagcccacagtatagtttgaaagaaccagggtagcggcaatgcaactgtctggtcctcggatgcttcaaaagttggatccagcttgacctgttgcagcacttcaagatgtgatgcggcattcaacaagttgggagcaagctcgtgatgtaccctttcttatgctaactggtcctgtctgcattttagagccaatcaagcgtagattagattactgcaccagagtggccttttgcatccctcaaagcagattcagctgacgcattgactgtttgttactcggtagacactgcggtaggcggtagctgccttggcaacgatgtaccatagaaaattttccaagtgttagatgccttgcattatattcagaacatttgcttttgaagcaccatttgctcctcgtttcaattgcatttctaatttaaagccca

SEQ ID NO: 1923 - DNA, 4243 bp, Brachypodium distachyon
ctcttctcccgaccctgctgcagccgcgagcccgtaaaaccctagatctctcgtccccgtctctccccgccgccgccgccgccttcgccgtcgccggaggaggaggaggcgccatgtacctctacagcctgacgctgcagcgcgcgacgggcgccgtgtgcgccgtcatcggcagcttcagcgggcgcgacacgaagaagtcgggcgccgcgggctcctccacgcaggagatcgccgtcgcgcgcggcggtacgctcgacctcctccgcccggacccggagacgggccgcctccgcacgctcctctccgtcgacgtcttcggcgccatccgctcgctcgcccagttccgcctcacgggggccaccaaggactacctcgtcgtcggctccgactccggccgcctcgtcatcctcgagtactcccccgaccgcaaccgcttcgacaaggtccaccaggagaccttcggcaagtcgggttgccgccgcatcgtgcccggccagctcctcaccgtcgatcccaaaggccgagcgctctgcatcgccgccctcgagaagcagaagctcgtctacgtgctcaaccgtgacgcctccgcccgcctcaccatctcgtcccccctcgaggcgcacaagtcccacacgctcaccttcgccctcacggcccttgactgcggattcgacaaccctgtcttcggtgccatcgagctcgagtatggcgattctgaccgtgaccccactgggcaggctgctagccacgcgcagaagctcctcaccttctacgagctcgacctggggctcaatcatgtttcgcgcaaggtctctgagccgatagacaatggtgctaatctgctagtgacagtgcctggtggtggtgatggtccgagcggcctccttgtgtgctgtgacaactttgtcctgtacaggaaccagggccacccggaggtgcgggctgtcattccacggcgtgttgatctcccggctgagcgtggcgtcctaatagttgctgctgccacacacaggcaaaagagcttgttcttcttcttactgcagactgagtatggtgatatcttcaaggttgacctggaacacaatggtgattctgttagtgagctcaggatcaagtactttgacactatacctgttgcatcagccatctgtgtgctgcggtcaggtttcctctttgctgcttctgagtttggcaaccacgcactttaccagttccgtgatattgggcgtgatgtggacgtcgagtcctcttcagcaacactgatggagacagaggaggggttccagccagtattctttcagccaagggcactcaagaacctcgtccggattgatgagattgagagcctcatgccaatcatggacatgcgtattgcaaatttatttgatgaggaaacaccccaggtgtacacagcttgcggccgtggctcgcgctccactatgcgcatccttaggcctggccttgccatcagcgagatggcccgatcaatgctgcctgctgagcctattgctgtttggactgtcaagaagaatatcaatgacatgtttgatgcctacattgttgtgtctttcgccaatgttaccctcgtgctctccattggtgagaccatagaagaagtcagcgacagccagttcctggacactactcactcactcgcagtttccctccttggcgaggattctctaatgcaggtccacccgaatggaatcaggcacattagggaggatggccgtgtcaacgagtggaggacacctggaaagaaaactatcactaaagttggatcaaacaggctccaggtggtaattgccctcagtggcggggagctcatctattttgagatggacatgacaggtcagctcatggaagtggagaagcaggacatgtcaggtgatgttgcgtgcctggctattgctccagttcctgaggggaggcaaaggtcccgttttctggcggttggctcctatgataacaccatacgtatactctccctggaccctgatgactgcttgcagcctctgagcgtacaaagtgtctcctcagccccagagtcacttttgttcctagaagttcaagcatcagttggtggtgaggatggtgcagattatccagccaatctttttcttaatgctggcttgcagaatggtgtcctcttccgaaccaatgttgacatggtcactggtcagctatcagacactcggtctcgattcctgggtctgagacctccgaagctgtttccctgcatagttagccaccgacaagcaatgctttgtctgtccagtcgtccctggcttggctatatacatcaaggccacttcctcttgacaccactatcatgcgatacacttgagtctgctgcgtcgttctcttctgatcagtgctcagaaggtgttgttgctgttgctggagatgccctaaggattttcaccattgaacgcctaggggagacattcaatgagacagctattcctctgcgttacaccccgaggaaatttgtaattctccccaaaaagaaatacctggcagtcattgagagtgataagggtgcatttagtgcagaacagcgagaggctgctaagagggagtgccttgaggcttctggtgcagtggaaaatggaaatggtaatggggatcagatggaaaatggggatggtcaagaggatggtgctgaggagagtaacacacttcctgatgaacagtacggttatccaaaggcagaatcagaaaagtgggtttcctgcattaggattcttgatccaaggagtagggacacaacttgtttgctggaattgcaggacaatgaggcagctgtcagtatttgcactgtgaatttccatgataaggagcatggtactctcctggctgttggtactaccaagggtctgcagttctggccaaagaggagccttgcttctgggttcatccacatatacaagtttgtggatgaagggaagtcacttgaacttcttcacaaaacacaagtggaggaagtgcctctctctttgtgccagttccagggacggttgcttgcaggtgttggttcagtgctcagattatatgatcttggaaagagaaagttgctcagaaaatgtgaaaataagctgttccccaggacaatagtatctattcatacttaccgtgataggatctacgtcggtgatatgcaagagtcatttcattattgcaagtacagacgggatgaaaaccagctgtatatcttcgctgatgatagtgttcccagatggcttacagcagcaaatcacatagatttcgacactatggcaggagctgacaaatttgggaacatatactttgctcgtcttccccaagatctctcagatgagattgaagaagacccaactgggggcaagattaaatgggagcaagggaagttaaatggtgctccaaacaaagtggaggagattgtgcagtttcatgttggtgatgttgtcacgtgtttgcagaaggcctctctaattcctggtggaggtgaatgtcttatttatgggactgtaatgggtagtgtgggagcacttcttgcattcacctccagggaagatgttgacttcttctctcacttggagatgcatctccggcaggagcatccaccattatgtggaagagatcacatggcctacagatctgcttattttcctgtgaaggatgtgattgacggcgacctctgcgagcagtatccatccctcccagctgatatgcagaggaagattgcagatgagctcgaccgaactccaggtgaaatcctgaagaagctggaagacatcaggaacaaaatcatctaatgccgccgcccggcatcactgaacttgatcctcgaatgccaatgccaagtttgcattgctgtaaaacctgaaccttcttcctatccagtacagccattgtggcagtttatgacgtgacatggcattctggaattcacgagtcaaccgagcggacaggccagcgccattcctgatcgtcgaatttgtagacccgttgatgttgttaacacctggctcagttagattcaggcaagcacatagactataggctgcatcggagtggccttttgtacctggtagagcagctgtttagttatttggcttgatgtagctgaactttgtttgataccactgtaggcagaggcctcttttcttcagaatttgtcaagtgactaaagtagagatgttggtgtaaaacatttttgaagtgatgaagtttcctacagtactagacagcggtatac

SEQ ID NO: 1924 - DNA, 4309 bp, Hordeum vulgare
gaactctttctcccaccccggcccgctcaacgccactcctaaaaccctagatctctcgccccctctctcgccgccgcccgccgcccgccggagtaggcgccatgtacctctacagcctgacgctgcagagggcgacgggcgccgtgtgcgccgtcatcggcagcttcagcggccgcgactcgaagaagtcgaacgccgccgggtcctccacgcaggagatcgccgtcgcccgcggcggcacgctcgacctcctccgcccggacccggagacgggccgactccgcacgctcctctccgtcgacgtcttcggcgccatccgctcgctcgcccagttccgcctcacgggggccaccaaggactacctcgtcgtcggctccgactccggccgcctcgtcatcctcgagtactcccccgaccgcaaccgcttcgacaaggtccaccaggagaccttcggcaagtccgggtgccgccgcatcgtgcccggccagctcctctccgtcgaccccaagggccgggcgctctgcatcgccgccctcgagaagcagaagctcgtctacgtcctcaaccgcgacgcctccgcccgcctcaccatctcctccccgctagaggcacacaagtcccacacgctcaccttcgccctcaccgccctcgactgcggatttgacaaccctgtctttggtgccatcgagctcgagtacggtgactctgaccgtgaccccacagggcaggctgctagccacgcgcagaagctcctcaccttctacgagctcgacctggggctcaatcatgtttcgcgcaaggtctccgagccgattgacaatggtgctaatatgctagtgacagtgcctggtggtgccgatggccctagcggtcttcttgtttgctgtgacaacttcgtcctgtaccgtaaccagggccacccagaggtgcgtgctgtcattccgcgccgtgttgacctcccggctgagcgtggcgtcctcatagttgctgctgccacgcacaggcagaagagcttgttcttcttcttactgcagactgagtatggtgatatctttaaggttgacctggaccaccatggtgatactgttagtgagctcaggatcaaatattttgacaccatacctgtggcatctgctatctgtgtgctgcggtcaggtttcctctttgctgcttctgagtttggcaaccacgcactttaccaattccgtgatatcggccgggatgtggatgttgagtcctcctctgcgacactgatggagacagaagaggggttccagccagtgttctttcagccaagggcactcaagaaccttgtccggattgatgagatagagagcctcatgccaatcatggacatgcgtattgcaaatttattcgatgaggaaacaccccaggtgtacacagcttgcggccgtggctcacgctccacgctgcgcatccttaggccaggccttgccatcagtgagatggcccgatcaatgctgcctgctgagcccattgctgtttggactgtcaagaagaatatcaacgacatgtttgacgcctacattgttgtgtcctttgctaatgtcacacttgtgctctcaattggagagaccattgaagaagtcagcgacagccacttcctggacacgactcactcactggcagtttcgctcctcggtgaggactctctcatgcaggtccacccgaacgggatcagacatatcagggaggatggccgtgtcaatgagtggaggacgcctgggaagaaaactatcactaaggttgggtcaaaccggctccaggtggtaattgccctcagtggtggagagctcatctattttgagatggatatgacaggtcagctcatggaggtggagaagcaggacatgtctggtgatgtcgcatgcctggccattgctccggttcctgaagggaggcaaaggtcccgttttcttgcagttggctcctatgataacaccatcaggatactctcccttgaccccgatgactgcttgcagcctcttagtgtacaaagtgtgtcctctgcccctgaatctctcttgttcttagaagtacaggcatcagttggtggcgaggatggtgcagattatccagccaaccttttccttaatgctggtttgcagaatggtgtccttttccgaaccaatgttgatatggtcactggtcagctatcagacacacggtctcgattccttggtctgagacctccaaagctgtttccctgcatagttagccaccgacaagcaatgctttgcttgtccagccgcccctggcttggctatatacatcaaggtcacttcctcttgacaccactctcatgtgacacacttgagtctgctgcgtcgttctcttctgaccagtgctcagaaggtgttgttgctgttgctggtgacgctctgcgtattttcaccatcgaacgtctgggagagacattcaatgagacatctatccctctgcgttacaccccgaggaaatttgtgattctaccaaaaaagaaataccttgcagtcattgagagcgacaagggtgcatttagcgcagaacagcgagaagctgctaagaaggagtgccttgaggctgctggttcagcggaaaatggaaatggtaatggggatcaaatggagaatggtgatggtcaagaagatggtgaggagagtaacacacttcctgatgaacaatatggttatccaaaggcagaatcagagaagtgggtttcctgcattagaattcttgatccaaggagcagggacacaacttgtcttctggaattgcaggacaatgaggcggctgtcagtatttgcactgtgaatttccatgataaggagcatggtactcttctggctgttggtactaccaagggattgcagttctggccaaagaggagcctcgcttctggtttcatccacatatacaagtttgttaatgaagggaagtcacttgaacttcttcacaaaacacaagtggaggaagtgcctctttctttgtgccagtttcaaggacggttgcttgcaggtgttggttcagtgctcaggttatatgatcttgggaagagaaagttgctcagaaaatgtgaaaacaagcttttcccaaggacaatagtgtctattcatacttaccgtgataggatctatgttggtgatatgcaagagtcatttcattactgcaagtacagacgggacgaaaaccagctgtatatcttcgctgatgacagtgttcctagatggcttacagcagcaaatcacatagatttcgacactatggcaggagccgacaagtttgggaacatatattttgctcgtcttccccaggatctctcagatgaaattgaggaagacccaactggaggcaagattaaatgggagcaagggaagttaaatggtgctccaaacaaagtggaggagattgtgcagtttcatgttggtgatgttgtgacatgtttgcagaaggcttctttgatacctggcggaggtgaatgccttatttatgggactgtaatgggtagtgtcggagcactgcttgcattcacctcaagggaagatgttgacttcttctctcacttggagatgcatctccgccaggagcatccaccattatgtggaagagatcacatggcctacagatctgcttatttcccagtgaaggatgttattgatggtgatctctgtgagcagtatccgtccctcccagctgatatgcagaggaagattgccgatgagcttgaccgaactccaggtgaaatcctgaagaagctggaagacatcagaaacaaaatcatctagggtcatcgaatagcatgaatgaatctgactgtggaatgcgactgtcaagtcctcatcggtgtaaaatatttatctcctcacccagtacagccgttgtgtggcgtttttcttttgacacaacacagcattccataattcatgagtcaacggagtggacaggacccacaacccataatcgtcggatctggtgtaccgttgacattgttgacactggctcagtttgccttgtagattcaagcaagaacggacaattaaatgactgtaccagagtagtctttctgtacctgtttcaacaactgttatttggcctgatgtaactgaacttgtttgatgcagtggcttctttcctgatgcatcgcagaactttccaagttactgaggtactcttgagggttgttggtgtttcgttttggaaagttttctactactctttcctgatgcatcttagagctcaagagtagtagggtttttggtgtttcggtttggacatctgtcttgtctatgaagtttttgctgaatgtgcg

SEQ ID NO: 1925 - DNA, 4401 bp, Hordeum vulgare
cctcgaatacgtcagcatccaaatgctatacagaactctttctcccaccccggcccgctcaacgccactcctaaaaccctagatctctcgccccctctctcgccgccgcccgccgcccgccggagtaggcgccatgtacctctacagcctgacgctgcagagggcgacgggcgccgtgtgcgccgtcatcggcagcttcagcggccgcgactcgaagaagtcgaacgccgccgggtcctccacgcaggagatcgccgtcgcccgcggcggcacgctcgacctcctccgcccggacccggagacgggccgactccgcacgctcctctccgtcgacgtcttcggcgccatccgctcgctcgcccagttccgcctcacgggggccaccaaggactacctcgtcgtcggctccgactccggccgcctcgtcatcctcgagtactcccccgaccgcaaccgcttcgacaaggtccaccaggagaccttcggcaagtccgggtgccgccgcatcgtgcccggccagctcctctccgtcgaccccaagggccgggcgctctgcatcgccgccctcgagaagcagaagctcgtctacgtcctcaaccgcgacgcctccgcccgcctcaccatctcctccccgctagaggcacacaagtcccacacgctcaccttcgccctcaccgccctcgactgcggatttgacaaccctgtctttggtgccatcgagctcgagtacggtgactctgaccgtgaccccacagggcaggctgctagccacgcgcagaagctcctcaccttctacgagctcgacctggggctcaatcatgtttcgcgcaaggtctccgagccgattgacaatggtgctaatatgctagtgacagtgcctggtggtgccgatggccctagcggtcttcttgtttgctgtgacaacttcgtcctgtaccgtaaccagggccacccagaggtgcgtgctgtcattccgcgccgtgttgacctcccggctgagcgtggcgtcctcatagttgctgctgccacgcacaggcagaagagcttgttcttcttcttactgcagactgagtatggtgatatctttaaggttgacctggaccaccatggtgatactgttagtgagctcaggatcaaatattttgacaccatacctgtggcatctgctatctgtgtgctgcggtcaggtttcctctttgctgcttctgagtttggcaaccacgcactttaccaattccgtgatatcggccgggatgtggatgttgagtcctcctctgcgacactgatggagacagaagaggggttccagccagtgttctttcagccaagggcactcaagaaccttgtccggattgatgagatagagagcctcatgccaatcatggacatgcgtattgcaaatttattcgatgaggaaacaccccaggtgtacacagcttgcggccgtggctcacgctccacgctgcgcatccttaggccaggccttgccatcagtgagatggcccgatcaatgctgcctgctgagcccattgctgtttggactgtcaagaagaatatcaacgacatgtttgacgcctacattgttgtgtcctttgctaatgtcacacttgtgctctcaattggagagaccattgaagaagtcagcgacagccacttcctggacacgactcactcactggcagtttcgctcctcggtgaggactctctcatgcaggtccacccgaacgggatcagacatatcagggaggatggccgtgtcaatgagtggaggacgcctgggaagaaaactatcactaaggttgggtcaaaccggctccaggtggtaattgccctcagtggtggagagctcatctattttgagatggatatgacaggtcagctcatggaggtggagaagcaggacatgtctggtgatgtcgcatgcctggccattgctccggttcctgaagggaggcaaaggtcccgttttcttgcagttggctcctatgataacaccatcaggatactctcccttgaccccgatgactgcttgcagcctcttagtgtacaaagtgtgtcctctgcccctgaatctctcttgttcttagaagtacaggcatcagttggtggcgaggatggtgcagattatccagccaaccttttccttaatgctggtttgcagaatggtgtccttttccgaaccaatgttgatatggtcactggtcagctatcagacacacggtctcgattccttggtctgagacctccaaagctgtttccctgcatagttagccaccgacaagcaatgctttgcttgtccagccgcccctggcttggctatatacatcaaggtcacttcctcttgacaccactctcatgtgacacacttgagtctgctgcgtcgttctcttctgaccagtgctcagaaggtgttgttgctgttgctggtgacgctctgcgtattttcaccatcgaacgtctgggagagacattcaatgagacatctatccctctgcgttacaccccgaggaaatttgtgattctaccaaaaaagaaataccttgcagtcattgagagcgacaagggtgcatttagcgcagaacagcgagaagctgctaagaaggagtgccttgaggctgctggttcagcggaaaatggaaatggtaatggggatcaaatggagaatggtgatggtcaagaagatggtgaggagagtaacacacttcctgatgaacaatatggttatccaaaggcagaatcagagaagtgggtttcctgcattagaattcttgatccaaggagcagggacacaacttgtcttctggaattgcaggacaatgaggcggctgtcagtatttgcactgtgaatttccatgataaggagcatggtactcttctggctgttggtactaccaagggattgcagttctggccaaagaggagcctcgcttctggtttcatccacatatacaagtttgttaatgaagggaagtcacttgaacttcttcacaaaacacaagtggaggaagtgcctctttctttgtgccagtttcaaggacggttgcttgcaggtgttggttcagtgctcaggttatatgatcttgggaagagaaagttgctcagaaaatgtgaaaacaagcttttcccaaggacaatagtgtctattcatacttaccgtgataggatctatgttggtgatatgcaagagtcatttcattactgcaagtacagacgggacgaaaaccagctgtatatcttcgctgatgacagtgttcctagatggcttacagcagcaaatcacatagatttcgacactatggcaggagccgacaagtttgggaacatatattttgctcgtcttccccaggatctctcagatgaaattgaggaagacccaactggaggcaagattaaatgggagcaagggaagttaaatggtgctccaaacaaagtggaggagattgtgcagtttcatgttggtgatgttgtgacatgtttgcagaaggcttctttgatacctggcggaggtgaatgccttatttatgggactgtaatgggtagtgtcggagcactgcttgcattcacctcaagggaagatgttgacttcttctctcacttggagatgcatctccgccaggagcatccaccattatgtggaagagatcacatggcctacagatctgcttatttcccagtgaaggatgttattgatggtgatctctgtgagcagtatccgtccctcccagctgatatgcagaggaagattgccgatgagcttgaccgaactccaggtgaaatcctgaagaagctggaagacatcagaaacaaaatcatctagggtcatcgaatagcatgaatgaatctgactgtggaatgcgactgtcaagtcctcatcggtgtaaaatatttatctcctcacccagtacagccgttgtgtggcgtttttcttttgacacaacacagcattccataattcatgagtcaacggagtggacaggacccacaacccataatcgtcggatctggtgtaccgttgacattgttgacactggctcagtttgccttgtagattcaagcaagaacggacaattaaatggctgtaccagagtagtctttctgtacctgtttcaacaactgttatttggcctgatgtaactgaacttgtttgatgcagtggcttctttcctgatgcatcgcagaactttccaagttactgaggtactcttgagggttgttggtgtttcgttttggaaagttttctactactctttcctgatgcatcttagagctcaagagtagtagggtttttggtgtttcggtttggacatctgtcttgtctatgaagtttttgctgaatgtgcgtctcctcttgagttcactgacaacttggctctgcttagcaatttactaacttgattgaaa

SEQ ID NO: 1926 - DNA, 4102 bp, Triticum aestivum
cgccatgtacctctacagcctgacgctgcagcgggcgacgggcgccgtgtgcgccgtcatcggcagcttcagcggccgcgactcgaagaagtcgaacgccgcgggctcctccacgcaggagatcgccgtcgcccgcggcggcacgctcgatctcctccgcccggacccggagacgggccgcctccgcacgctcctctccgtcgacgtcttcggcgccatccgctcgctcgcccagttccgcctcacgggggccaccaaggactacctcgtcgtcggctccgactccggccgcctcgtcatcctcgagtactcccccgaccgcaaccgcttcgacaaggtccaccaggagaccttcggcaagtccggctgccgccgcatcgtgcccggccagctcctctccgtcgaccccaagggccgggcgctctgcatcgccgccctcgagaagcagaagctcgtctacgtcctcaaccgcggcgcctctgcccgcctcaccatctcctccccgcttgaggcgcacaagtcccacacgctcaccttcgccctcacggccctcgactgcggatttgacaaccctgtctttggtgccatcgagcttgaatacggtgactctgaccgtgaccccacagggcaggccgctagccacgcgcagaagctcctcaccttctacgagctcgacctggggctcaatcatgtttcccgcaaggtctccgagccgattgacaatggtgctaatatgctagtgacagtgcctggtggtgctgatgggcctagcgggcttcttgtttgctgtgacaactttgtcctgtaccggaatcagggccacccggaggttcgtgctgtcattccacgccgtgttgacctcccggctgagcgtggcgtcctcatagttgctgctgccacgcacaggcagaagagcttgttcttcttcttactacagattgagtatggtgatatcttcaaggttgacctggaccaccatggtgatactgttagtgagctcaggatcaaatattttgacaccatacctgtggcatctgctatctgtgtgctgcggtcaggcttcctctttgctgcttctgagtttggcaaccatgcactttaccaattccgtgatattggccgggatgtggatgttgagtcctcctctgcgacactgatggagacagaggaggggttccagccagtgttctttcagccgagggcactcaagaaccttgtccggattgatgagatagagagcctcatgccaatcatggacatgcgtattgcaaatttattcgacgaggaaacaccccaggtgtacacagcttgtggccgtggctcacgctccacgctgcgcatccttaggcctggccttgccatcagcgagatggcccgatcaatgctgcctgctgagcccattgctgtttggactgtcaagaagaatatcaatgacatgtttgacgcctacattgttgtgtcctttgctaatgtcacacttgtgctctcaattggagagaccattgaagaagtcagcgacagccagttcctggacaccactcactcactagcagtttcgctccttggtgaggattctctcatgcaggtccacccgaacggtatcaggcatatcagggaggatggccgtgtcaatgagtggaggacgcctgggaagaaaactatcaccaaggttggatcaaaccggctccaggtggtaattgccctcagtggtggagagctcatctattttgagatggatatgacaggtcagctcatggaggtggagaagcaggacatgtctggtgatgtcgcgtgcctggccattgcccccgttcctgaagggaggcaaaggtcccgttttctcgcagttggctcctatgataacaccatcaggatactctcccttgaccccgatgactgcttgcagcctcttagtgtacaaagtgtgtcctcggctccggaatctctcttgttcttagaagtacaggcatcagttggtggcgaggatggtgcagattatccagccaaccttttccttaatgctggtttgcagaatggtgtccttttccgaaccaatgttgacatggtcactggtcagctatcagacacacggtctcgattccttggtctgagacctccaaagctgtttccctgcatagttagccaccgacaagcaatgctttgcctgtccagccgcccctggcttggctatatacatcaaggtcacttcctcttgacaccactctcatgcgacacacttgagtctgctgcgtcgttctcttctgaccagtgctcagaaggtgttgttgctgttgctggagacgctctgcgtattttcaccatcgaacgtctgggagagacattcaatgagacatctatccctctgcgttacaccccgaggaaatttgtgattctaccaaaaaagaaataccttgcagtcattgagagtgacaagggtgcatttagcgcagaacagcgagaagctgctaagaaggagtgccttgaggctgctggtgcggcggaaaatggaaatggtaatggggatcaaatggagaatggtgatggtcaagaagatggtgaggagagtaacgcacttcctgatgaacaatatggttacccaaaggcagaatcagaaaagtgggcttcctgcattagaattcttgatccgaggagcagggacacaacttgtcttctggaattgcaggacaatgaggcagctgtcagtatttgcaccgtgaatttccatgataaggagcatggtactcttctagctgttggtactaccaagggattgcagttctggccaaagaggagcctcgcttctggtttcatccacatatacaagtttgtcaatgaagggaagtcgcttgaacttcttcacaaaacacaagtggaggaagtgcctctttctttgtgccagtttcagggacggttgcttgcaggtgttggttcagtgctcaggttatatgatcttgggaagagaaagttgctcagaaaatgtgaaaacaagcttttcccaaggacaatagtgtctattcatacttaccgtgataggatctatgttggtgatatgcaagagtcgtttcattattgcaagtatagacgggacgaaaaccagctgtatatcttcgctgatgacagtgttcctagatggcttacagcagcaaatcacatagatttcgacactatggcaggagccgacaagtttgggaacatatattttgctcgtcttccccaggatctctcagatgaaattgaggaagacccaactggaggcaagattaaatgggagcaagggaagttaaatggtgctccaaacaaagtggaggagattgtgcagtttcatgttggtgatgttgtgacatgtttgcagaaggcttctttgatacctggcggaggtgaatgccttatttatgggactgtaatgggtagtgtgggagcactgcttgcattcacctcaagggaagatgttgacttcttctctcacttggagatgcatctccgccaggagcatccaccattatgtggaagagatcacatggcctacagatctgcttatttcccagtgaaggatgtgattgatggcgatctctgtgagcagtatccggccctcccagctgatatgcagaggaagattgccgatgagctcgaccgaactccaggtgaaatcctgaagaagctggaagacatcagaaacaaaatcatctagggtcatcgcttagcatgaatgaatctgactgtcggaatgcgtctgtcaagtccgcatcgctgtaaaatattcatctcctcatccagtacagccgttatgtggtgtttttcgacacaacacagcattccataattcatgagtcaacagtggacaggacccgcaactcgtaatcgtcggatctgtataaccgttgacgttgttgacactggcccagtttgccttgtagattcaagcgagaacagagaattaaatggctgtaccagagtagtctttttgtacctgttagaacaactgttatttggcctgatgtagctgaacttgtttgatgcagtggcgtcttttctgatgcatagtagaactttccaagttaccgagttagtacagttgttggtgtttcgttttggacatctgtct

SEQ ID NO: 1927 - DNA, 4256 bp, Triticum aestivum
agcctgacgctgcagcgggcgacgggcgccgtgtgcgccgtcatcggcagcttcagcggccgcgactcgaagaagtcgaacgccgcgggctcctccacgcaggagatcgccgtcgcccgcggcggcacgctcgacctcctccgcccggacccggagacgggccgcctccgcacgctcctctccgtcgacgtcttcggcgccatccgctcgctcgcccagttccgcctcacgggggccaccaaggactacctcgtcgtcggctccgactccggccgcctcgtcatcctcgagtactcccccgaccgcaaccgcttcgacaaggtccaccaggagaccttcggcaagtccggctgccgccgcatcgtgcccggccagctcctctccgtcgaccccaagggccgggcgctctgcatcgccgccctcgagaagcagaagctcgtctacgtcctcaaccgcgacgcctccgcccgcctcaccatctcctccccgctagaggcgcacaagtcccacacgctcaccctcgccctcacggccctcgactgcggatttgacaaccctgtctttggtgccatcgagcttgagtacggtgactctgaccgtgaccccacagggcaggctgctagccacgcgcagaagctcctcaccttctacgagctcgacctggggctcaatcatgtttcccgcaaggtctccgagccgattgacaatggtgctaatatgctagtgacagtgcctggtggtgctgatgggcctagcgggcttcttgtttgctgtgacaacttcgtcctgtaccggaaccagggccacccggagatgcgtgctgtcattccccgccgtgttgacctcccggctgagcgtggcgtcctcatagttgctgctgcgacgcacaggcagaagagcctgttcttcttcttactacagactgagtatggtgatatctttaaggttgacctggaccaccatggtgatactgttagtgagctcaggatcaaatattttgacaccatacctgtggcatctgctatctgtgtgctgcggtcaggtttcctctttgctgcttctgagtttggcaaccacgcactttaccaattccgtgatattggccgggatgtggatgttgagtcctcctctgcgacactgatggagacagaggaggggttccagccagtgttctttcagccgagggcactcaagaaccttgtccggattgatgagatagagagcctcatgccaatcatggatatgcgtattgcaaatttattcgatgaggaaacaccccaggtgtacacagcttgcggccgtggctcacgctccacgctgcggatccttagacctggccttgccatcagcgagatggcccgatcaatgctgcctgctgagcccattgctgtttggactgtcaagaagaatatcaacgacatgtttgacgcctacattgttgtgtcctttgctaatgtcacacttgtgctctcaattggagagaccattgaagaagtcagcgacagccagttcctggacaccactcactcactggcagtttcgctccttggtgaggactctctcatgcaggtccacccgaacggtatcaggcatatcagggaggatggccgtgtcaatgagtggaggacgcctgggaagaaaactatcaccaaggttggatcaaaccggctccaggtggtaattgccctcagtggtggagagctcatctattttgagatggatatgacaggtcagctcatggaggtggagaagcaggacatgtctggtgatgtcgcgtgcctggccattgctccggttcctgaagggaggcaaaggtcccgttttctcgcagttggctcctatgataacaccatcaggatactctcccttgaccccgatgactgcttgcagcctcttagtgtacaaagtgtgtcctcggctccggaatctctcttgttcttagaagtacaggcatcagttggtggcgaggatggtgcagattatccagccaaccttttccttaatgctggtttgcagaatggtgtccttttccgaaccaatgttgacatggtcactggtcagctatcagacacacggtctcgattccttggtctgagacctccaaagctgtttccctgcatagttagccaccgacaagcaatgctttgcctgtccagccgcccctggcttggctatatacatcaaggtcacttcctcttgacaccactctcatgcgacacacttgagtctgctgcgtcgttctcttctgaccagtgctcagaaggtgttgttgctgttgctggagacgctctgcgtattttcaccatcgaacgtctgggagagacattcaatgagacatctatccctctgcgttacaccccgaggaaatttgtgattctaccaaaaaagaaataccttgcagtcattgagagtgacaagggtgcatttagcgcagaacagcgagaagctgctaagaaggagtgccttgaggctgctggtgcggcggaaaatggaaatggtaatggggatcaaatggagaatggtgatggtcaagaagatggtgaggagagtaacgcacttcctgatgaacaatatggttacccaaaggcagaatcagaaaagtgggtttcctgcattagaattcttgatccgaggagcagggacacaacttgtcttctggaattgcaggacaatgaggcggctgtcagtatttgcaccgtgaatttccatgataaggagcatggtactcttctggctgttggtactaccaagggattgcagttctggccaaagaggagcctcgcttctggtttcatccacatatacaagtttgtcaatgaagggaagtcgcttgaacttcttcacaaaacacaagtggaggaagtgcctctttctttgtgccagtttcagggacggttgcttgcaggtgttggttcagtgctgaggttatatgatctggggaagagaaagttgctcagaaaatgtgaaaacaagcttttcccaaggacaatagtgtctattcatacttaccgtgataggatctatgttggtgatatgcaagagtcgtttcattattgcaagtacagacgggacgaaaaccagctgtatatctttgctgatgacagtgttcctagatggcttacagcagcaaatcacatagatttcgacactatggcaggagccgacaagtttgggaacatatattttgctcgtcttccccaggatctctcagatgaaattgaggaagacccaactggaggcaagattaaatgggagcaagggaagttaaatggtgctccaaacaaagtggaggagattgtgcagtttcatgttggtgatgttgtgacatgtttgcagaaggcttctttgatacctggcggaggtgaatgtcttatttatgggactgtgatgggtagtgttggagcactgcttgcattcacctccagggaagatgttgacttcttctctcatttggagatgcatctccgccaggagcatccaccattatgtggaagagatcacatggcctacagatctgcatatttcccagtgaaggatgtgattgatggtgatctctgtgagcagtatccagccctcccagctgatatgcagaggaagattgccgatgagcttgaccgaactccaggtgaaatcctgaagaagctggaagacatcagaaacaaaatcatctagggtcatcgcctagcatgaatgaatctgaccgttggaatgcgactgtcaaagtcctcaccgctgtaaaatatttatctcctcatccagtacagccgttgtgtggcggtcttttttgacacaacacagcattccataattcatgaatcaacggagtggacaagacccgcaactcataatcatcggatctgtataaccgttgacgttgttgacactggcccagtttgccttgtagattcaagcgagaacagagaattaaatggctgtaccagagtagtctttttgtgcctgttagaacaactgttatttggcctgatgtaactgacttgttcgatgcagtggcttctttcctgatgcatcgtagaactttacagttactgaggtagtagagttgttgctgtttcgttttggacatctgtctttgcttatgaagttttctgctcaatgtgcggctcctcttaagttcactaacaacttagctctgcttagcaatttactgactgatgatgaaatgcctcgtgtatgatttttattactttagttgtgagattaaaacaacgaaaaatgtacagaattttaaactgtag

SEQ ID NO: 1928 - DNA, 3973 bp, Panicum virgatum
cttcggcgtcatccgctcgctcgcgcagttccgcctcaccggcgccaacaaggactacctcgtcgtcggctccgactcgggccgcctcgtcatcctcgagtactcccccgaccgcaaccgcttcgacaaggtccaccaggagacctttggcaagtccggctgccgccgcatcgtccccggccagctgctcgcggtcgaccccaagggccgcgcgctctgcatcgccgcgctcgagaagcagaagctcgtctacgtcctcaaccgcgacgccgccgcgcgcctcaccatctcgtccccgctcgaggcgcacaagtccaacactatcaccttctccctcaccgccctcgactgtggattcgacaaccccatcttcgccgccatcgagctcgagtatgctgagtctgaccgcgaccccacggggcaggctgctaaccaggcgcagaagctcctcaccttctacgagcttgacttgggcctcaaccatgtctcccgcaaggcctctgagcccattgataatggcgccaatcttcttgtgactgtccctggtggcggcgatggtccgagcggggttcttgtgtgctgcgataactttgtgctgtaccggaaccaggggcatccagaggttcgtgctgttattccacgccgtgctgacctgcctgctgagcgtggtgtcctcattgttgctgctgctacacacagacaaaagagtatgttcttcttcttactacagaccgagtatggtgacatcttcaaggtcgatctggaacatagtggggaaactgttactgagctcaggatcaagtacttcgacaccatacctgtggcatcagctacctgtgtgctgcggtctggtttactctttgctgcttctgagtttggcaaccatgcactttaccaattccgtgatattggccgggatgcggatgttgagtcatcttcagcaacactgatggagacagaggaggggttccagccggttttctttcagccaaggccactaaagaacctcatccgtatagatgagattgagagcctcatgccagtcatggatatgcgtattgcgaatttatttgatgaggagacaccccaattgttcacagcctgtggccgaggtccacgctccacgctgcgcatcctgaggcctggccttgccattagtgagatggcacgatcaatgctgcctgctgagcctattgccgtgtggactgtcaagaagaatatcaatgacatgtttgatgcctacattgttgtgtcctttgctaatgtcacgctcgtgctctctattggtgagaccattgaagaagtcagtgacagccagttcctggacaccactcactcccttgcagtcactctccttggtgaggactctctcatgcaagtccatccaaatggtatcaggcacatcagggaggatggccgtgtcaatgagtggagaactcctggaaagaaaactataacaaaggttggatcaaaccggctccaggtggtaattgccctcagtggcggagagctcatctattttgagatggacatgacgggtcagctcatggaggtggagaaacaggacatgtctggcgatgttgcatgcctggccattgcaccggttcctgagggtaggcaaaggtccagatttctcgctgtaggatcctatgataacaccatccgtatcctgtcgctggaccctgatgactgcctgcagcctctaagtgtgcagagtgtatcatccgcaccagagtcactcctattcctagaggtacaggcatcagttggtggtgaggatggtgcagactatccagccaaccttttcctcaatgctggcttgcagaacggtgttcttttccggaccaatgttgacatggttacgggccagctatcggacacacggtctcgattccttggcctcaggcctccaaagctgtttccctgtatagttagccacaggcaagcaatgctttgcctgtccagccgtccctggctgggctatatacatcaaggtcacttcctcttgacgcctctgtcttgtgatacactcgaatctgctgcatccttctcttctgatcagtgctcagaaggtgttgttgctgttgccggagatgccctacgcattttcaccattgaacgcctgggggagactttcaatgagacggccatccctctgcgctacaccccaaggaagtttgtgattctaccaaagaaaaaatatattgctgtcattgagagcgataagggtgcattcagcgcagaagagcgagaagctgctaagaaagagtgcctcgaggcttctggtgcaacagagaatggaaatgcgaacaatggggatccaatggagaatggtgatggtcaagaagatggtgctgaggagggcaacacatttcctgatgaacagtacggttatccaaaggcagaatcagagcggtgggtttcctgcattaggatcctggatccaaggagtagggacacaacctgtctgctggaattgcaggacaatgaagctgctgtcagtatttgcactgtgaatttccatgataaggagcacggcactcttcttgctgttggcactgccaagggattgcagttctggccaaagcggacccttgctggtgggttcatccacatatataagtttgtggatgaagggaagtcacttgaacttctacacaagacacaagtggaggaagtacctcttgcgttgtgccaattccagggacggttacttgcaggtgttggttcagtgctcagactatatgatctggggaagagaaaattgctcaggaaatgtgaaaacaagctttttcccagaacaattatatctattcatacctaccgtgataggatctatgttggtgatatgcaagagtcatttcactactgcaagtacagaagggatgaaaaccagctgtatatctttgctgatgacagtgttcccagatggcttacagcagctcaacacatagattttgacactatggctggagctgacaagtttgggaatatatattttgctcgtcttcctcaggatatctcagatgagattgaagaagatccaactggaggcaagattaaatgggagcaagggaagctaaatggtgcccctaacaaagttgaggaaatcgtgcagtttcatgttggtgatgttgtaacaagtttgcagaaggcctctttaattcctggtggaggtgaatgtcttatttatggaactgtgatgggcagtgtaggggcactgcttgcatttacctccagggaagatgttgacttcttctctcatttggagatgcatctccgtcaggagcatccaccattatgtggaagagatcacatggcttacagatctgcatattttccggtgaaggatgtgatagatggcgatctctgtgagcagtatccatcccttccagctgatatgcagaggaagatagctgatgagcttgacagaactcctggtgaaatccttaagaagctagaagacattaggaacaaaatcatctaagcccatggtgtagtttgaaagaactagggtaggtggcaatacaactgtctggtccttgatgcttcaaaacttgcatccagtttgagctgttgcagcacttcaagatgtgatgcagtattcaacaagtttggagcaagcttgtgatgtgtgattcctttcatgctaaccggaccagtctacgttttagagcgaatgaagcatagattacattgctgcaccagagtggtcttttgtatctcatagagcagagttcagctgatgtctcgactgtttgttccttggcttgatgtaattgatatcattcatgttggatgttttgtcggtagctgccttcgtaatgtaccatagaagtttctcgaagtgttggatgcctcagtgccatccctttcataatgttctgcctatggaatcctcaactgctacacctactcgatttattcattacattcagaacattactttccattaagttttttttgaaccgaa

SEQ ID NO: 1929 - DNA, 3775 bp, Panicum virgatum
acctcgtcgtcggctccgactccggccgcctcgtcatcctcgagtactccccggaccgcaaccgcttcgacaaggtccaccaggagaccttcggcaagtccggctgccgccgcatcgtccccggccagctgctcgccgtcgaccccaagggccgcgcgctctgcgtcgccgcgctcgagaagcataagctcgtctacgtcctcaaccgcgacgccgccgcgcgcctcaccatctcgtccccgctcgaggcgcacaagtccaacacgctcaccttctccctcaccgcgctcgactgtggattcgacaaccccgtcttcgccgccatcgagctcgagtacgctgagtctgaccgcgaccccacggagcaggctgcgaaccaggcgcagaagatcctcaccttctacgagcttgacctggggctcaaccatgtctcccgcaaggcctctgagccgattgataatggtgccaatctccttgtgactgtcctggtggaagcgacggtccgagcggggttcttgtgtgctgtgacaacttcgtgctttaccggaaccatgggcacccagaggttcgtgctgtcattccgcgccgtgctgacctcccagctgagcgtggtgtcctcattgttgctgcagctacacacaggcaaaagacactgttcttcttactgcagactgagtatggtgacatcttcaaggtggaccttgaacatagtggggatactgttactgagctcaggatcaagtactttgacaccatacctgtaacatcagctatctgcgtgctgcgatctggtttcctctttgctgcttctgagtttggcaaccatgcactttatcagttccgtgatattggccgggatgcggatgtcgagtcctcttcagcaacactgatggagacagaggaggggttccagcctgtattctttcagcccagggcactaaagaacctcatgtgcatagacaacatcgagagccttatgccagtcatggatatgcgtgtcgcgaatttgattgatgaggaaacaccccagttgttcacagcctgtggccgtggtccacgctccacactgcgcatcctgaggcctggacttgccatcagcaagatggcacgatcgatgctgcctgcagagcctattgctgtgtggactgtcaagaagaatatcaatgacatgtttgatgcctacattgttgtgtcctttgctaatgttacgcttgtgctctctattggtgagaccattgaagaagtcagtgacagccagttcctggatacaactcactccctagcagtcactctccttggtgaggactctctcatgcaggtccatccaaatggtatcaggcacatcagggaggatggccgtgtcaatgagtggaggacgcctggaaagaaaactattacaaaggttggatcaaaccggctccaggtggtaatcgctctcagtggcggagagctcatctattttgagatggacatgactggtcagctcatggaggtggaaaagcaggacatgtctggggatgttgcatgcctggccattgcgccggtccctgaggggaggcaaaggtccagatttctcgctgtaggatcctatgataacaccatctgtatcctctccctggaccctgatgactgcctgcagcctctaagtgtccagagtgtatcatctgcaccagagtcactcctattcctagaggtacaggcatcagttggtggtgaggatggtgcagattatcctgccaaccttttcctcaatgctggcttgcagaatggtgttcttttccggaccaatgttgacatggttacgggtcagctatcggacacaaggtctcgattccttggcctgagacctccaaagctatttccttgtatagttagccacaggcaagcaatgctttgcctgtccagccgtccctggctgggctatatacatcaaggtcacttcctcttgacaccattgtcctgtgatacactcgaatctgccgcatccttttcttctgatcagtgctcggaaggtgttgttgctgttgcgggagatgccctacgtattttcaccattgaacgcttgggagagactttcaacgagatggccatccctctgcgctacaccccgaggaagtttgtgattgtaccaaagaaaaaatatattgctgtcattgagagtgataagggtgcattcggtgcagaagagagaaactgctaagaaagagtgtctcgaggcttctggttcagcggagaatggaaatgcgaataatggggatccaatggagaacggtgatggacaagaagatggtgctgagggcaacacatttcctgatgaacagtatggttatccaaaggcagaatcggagcggtgggtttcctgcattaggatccttgatccaaggagtagggacacgacctgtctgctggaattgcaggacaatgaggctgctgtcagtatttgcactgtgaatttccatgataaggaacatggcactcttcttgctgttggcactgccaagggattacagttctggccaaagaggacccttgctggtgggttcatccacatatataagtttgtggatgaagggaggtcacttgaacttctacacaagacacaagtggaggaagtacctcttgcggtgtgccaattccaggggcggttacttgcaggtgttggttcagtgctcagactatacgatctggggaagagaaaactgcttagaaaatgtaaaaacaagctttttccaaggacaatagtgtctattcatacctaccgtgataggatctacgttggcgatatgcaagagtcatttcactactgcaagtacagacgagatgaaaaccagctctatatctttgctgatgacagtgtcccaagatggcttacagcagctcaacgcatagattttgacactatggctggagcagataagtttgggaatatatattttgctcgtcttcctcaggatatctcagatgagattgaagaagacccaactggaggcaagattaaatgggagcaaggaaagttaaatggtgcccctaacaaagttgaggaaatcgtgcagtttcatgtcggtgacgttgtcacatgtttgcagaaggcctctttaattcctggcggaggtgaatgccttatttacggaactgtgatgggcagtgtgggagcactgcttgcattcacctccagggaagatgttgacttctctcatttggagatgcatctccgtcaggagcatccaccattatgtggaagagatcacatggcttacagatctgcttattttccggtgaaggatgtgatagatggtgatctctgcgagcagtatccatccctaccagttgatatgcagaggaagattgctgatgagctcgacagaacacctggtgaaatcctgaagaagctagaagacatcaggaacaaaatcatctaagcccacgcacggtatagtttggaagaactagggtagcggcaaagcaactgtttgtctgtctgtctgtctggtcctcgatggtttcaaaagttccatctagtttgagctgttgcagcacttcaagatgtgatgcagcacccaacaagttcagagcaagcttgtgatgtgatttgtaaaaccctgtcctatgctaaccagtccagtccacattttagagccaatcaattagatcacattactctgcaccagagtggtcttttgtatcccttaagagcagattcagctgatgcctttgactgtttgttacttggcttgatgtaattgaggttattcatgttggatgcttattaggtggt

SEQ ID NO: 1930 - DNA, 3557 bp, Secale cereale
gaccttcggcaagtccggctgccgccgcatcgtgcccggccagctcctctccgtcgaccccaagggccgggcgctctgcatcgccgccctcgagaagcagaagctcgtctacgtcctcaaccgcgacgcctccgcccgcctcaccatctcctccccgctagaggcgcacaagtcccacacgctcaccttcgccctcacggccctcgactgcggatttgacaaccctgtctttggtgcaatcgagctcgagtacggtgactctgaccgtgaccccactgggcaggctgctagccacgcgcagaagctcctcaccttctacgagctcgacctggggctcaatcatgtttcccgcaaggtctccgagccgattgacaatggtgctaatatgctagtgacagtgcctggtggtgctgatggccctagcgggcttcttgtttgctgtgacaacttcgtcctctaccggaaccagggccacccggaggtgcgtgctgtcattccacgccgcgttgacctcccggctgagcgtggcgtcctcatagttgctgctgccacgcacaggcagaagagcttgttcttcttcttactacagactgagtatggtgatatctttaaggttgacctggaccaccatggtgatactgttagtgagctgaggatcaaatattttgacaccatacctgtggcatctgctatctgtgtgctgcggtcaggtttcctctttgctgcttctgagtttggcaaccacgcactttaccaattccgtgatattggccgggatgtggatgttgagtcctcctctgcgacactgatggagacagaggaggggttccagccagtgttctttcagccgagggcactcaagaaccttgtccggattgatgagatagaaagcctcatgccaatcatggacatgcgtattgcaaatttattcgatgaggaaacaccccaggtgtacacagcttgcggccgtggctcacgctccacgctgcgcatccttaggcctggccttgccatcagtgagatggcccgatcaatgctgcctgctgagcccattgctgtttggactgtcaagaagaatatcaacgacatgtttgacgcctacattgttgtgtcctttgctaatgtcacacttgtgctctcaattggagagaccattgaagaagtcagcgacagccagttcctggacaccactcactcactggcagtttcgctccttggtgaggactctctcatgcaggtccacccgaacgggatcaggcatatcagggaggacgggcgtgtcaatgagtggaggacgcctggaaagaaaactatcactaaggttggatcaaaccggctccaggtggtaattgccctcagtggtggggagctcatctattttgagatggatatgacaggtcagctcatggaggtggagaagcaggacatgtctggtgatgttgcgtgcctggccattgctccggttcctgaagggaggcaaaggtcccgttttctcgcagttggctcctatgataacaccatcaggatactctcccttgaccccgatgactgcttgcagcctctgagtgtacaaagtgtgtcctcggccccagaatctctcttgttcttagaagtacaggcatcagttggtggcgaggatggtgcagattatccagccaaccttttccttaatgctggtttgcagaatggtgtccttttccgaaccaatgttgacatggtcactggtcagctatcagacacacggtctcgattccttggtctgagacctccaaagctgtttccctgcatagttagccaccgacaagcaatgctttgcctgtccagccgcccctggcttggctatatacatcaaggtcacttcctcttgacaccactctcatgcgacacacttgagtctgctgcctcgttctcttctgaccagtgctcagaaggtgttgttgctgttgctggagacgctctgcgtattttcaccattgaacgtctgggagagacattcaatgagacatctatccctctgcgttacaccccgaggaaatttgtgattctaccaaagaagaaataccttgcagtcattgagagtgacaagggtgcatttagcgcagaacagcgagaagctgctaagaaggagtgccttgaggctgctggtgcggcggaaaatggaaatggtaatggggatcaaatggagaatggtgatggtcaagaagatggtgaggagagtaacacacttcctgatgaacagtatggttacccaaaggcagaatcagaaaagtgggtttcctgcattagaattcttgatccgaggagcagggacacaacttgccttctggaattgcaggacaatgaggcggctgtcagtatttgcactgtgaatttccatgataaggagcatggcactcttctggctgttggtactaccaagggattgcagttctggccaaagaggagccttgcttctggtttcatccacatatacaagtttgtcaatgaagggaagtctcttgaacttcttcacaaaacacaagtggaggaagtgcctctttcgttgtgccagtttcagggacggttgcttgcaggtgttggttcagtgctcaggttatatgatcttgggaagagaaagttgctcagaaaatgtgaaaacaagcttttcccaaggacaatagtgtctattcatacttaccgtgataggatctatgttggtgatatgcaagagtcattccattattgcaagtacagacgggatgaaaaccagctgtatatcttcgctgatgacagtgttcctagatggcttactgcagcaaatcacatagatttcgacactatggcaggagccgacaagtttgggaacatatattttgcccgtcttccccaggatctctcagatgaaattgaggaagacccaactggaggcaagattaaatgggagcaagggaagttaaatggtgctccaaacaaagtggaggagattgtgcagtttcatgttggtgatgttgtgacatgtttgcagaaggcttctttgatacctggcggaggtgaatgtcttatttatgggactgtaatgggtagtgtgggagcactgcttgcattcacctccagggaagatgttgacttcttctctcacttggagatgcatctccgccaggagcatccaccattatgtggaagagatcacatggcctacagatctgcgtatttcccagtgaaggatgtgattgatggcgatctctgtgagcagtatccggccctcccagctgatatgcagaggaagattgccgatgagctcgaccgaactccaggtgaaatcctgaagaagctggaagacatcagaaacaaaatcatctagggtcatcgcttagcatgaatgaatctgactgttggaatgcgactgtcaagtccgcatcgctgtaaaatatttatctcctcatccagtacagccgttatgtggtgtttttcgacacaacacagcattccataattcatgagtcaaccgagtggacagcacccgcaactcgtaatcgtcggatctgtataaccgttgacgttgttgacactggcccagt

SEQ ID NO: 1931 - DNA, 4265 bp, Ananas comosus
aattccatccgtccccatcctgcagtcgctagggttagagtttcttctgtatttcagctgtttcggtgcgttcgtgcgcgggggctcggcttcgagaaattccgatgtacttgtacagcctgacgctgcagcgggcgacaggcgtggtgtgcgccacgatcgggagcttcgtgggcggcgggaagagccaggagatcgtggtggggcgggggaagacgctggacctcctccgcccggacgagaacgggaagatccagacgctgcactcggtggaagtgttcggcgccatccggtccctcgcccagttccgcctcaccggctcccaaaaggactacgtggtggtcggctccgactcgggccgcatcgtcatcctcgagtacagcagggagcgcaactgcttcgacaaggtccaccaggagacctttggcaagtccggatgccgccgcatcgtcccgggccagtacctggctgtcgaccccaagggccgcgccgtcatgatcgcagcctgcgagaagcagaagctcgtctacgtcctcaaccgcgacaccgccgcacgcctcaccatttcctcccccctcgaggcccacaagtcccacaccgtcacctactctgttgtcggcgtcgactgcggcttcgacaaccccgtcttcgcagctatcgagctcgactactccgaggccgaccgcgacgcctctggccaagccgccgcggaggcccagaagcacctcacgttctacgagctcgacctcggcctcaaccatgtttcccgcaagtggtccgagccggtggacaacggcgccaacctcctcgtcactgtcccgggcggcggcgacgggcccagcggtgtcctcgtctgtgctgagaatttcatcatcttcaggaaccagggccaccccgaggtacgcgctgttatcccccgccgtgctgacctccctgctgagcggggcgtcctcatcgtctctgctgccacccaccgtcagaagtccatgttcttcttcctcctccagactgagtatggtgacatctttaaggtcacccttgagcatgagggcgaccgtgtgtccgagctcaagatcaagtactttgacactgtgcctgtcacctctgcaatctgcgtccttagggctggattcctctttgcggcctccgagtttgggaatcatatgctttaccagttcaaggccatcggggatggcgaagacgtggagtcgtcctcggcaacgctgatggaaaccgaggagggcttccagccggtcttcttccagccgcggccgctgaggaacctcctcaagatagagcacatggagagcctcatgcccatcatggacatgagggtcgtgaacctctttgaggaggagacgccccagatattcactctctgcggcaggggtccccgttcttctctgcgcattctgaggcccggtcttgcagttagcgagatggccgtctcacagctgcccggtattcccaacgcggtgtggacagtaaagaagaatgtgaatgacgagtttgatgcttacattgttgtgtcctttgcaaatgcgacgcttgtcctctccattggtgagacggtcgaggaggtcagcaacagcaagttccttgacaccactccttccctggctgtctctttgctgggagatgactctttgatgcaggtccatccaagtggcatcaggcacatccgggaggatggccgtgttaatgagtggaagacgcctgggaagaagactatcgtcaaggttggcttgaacagactccaagtggtgatcgccctcagcggtggggagcttatatactttgagatggatatgaccggccagctgatggaagtggataagcatgagatgcctggcgatgttgcttgcttggatatagcaccagttcctgaagggaggcagaggtcccggttccttgctgtcggttcgtacgacaacaccattaggattctctccttggaccccgatgactgcatgcacgtcctgagcgtccagagtgtttcctctcctcccgagtcgcttctgttgcttgaagtgcgggcctctaccggaggagatgatggtgcagctcatccaggcagcgtctttctcaatgctgggctgcaaaatggtgtacttttccgaactgtggttgatatggttactggtcagctctcagatcctagatctcgattcttaggtctgagagctcccaaactgttctccaccgtagtaaggggcagacaagcaatgctttgcctgtctagtcggccctggctcggctacatacatcaagggcatttcttgttaactcccctttcctatgaaacgcttgaatatgctgcatcgttttcctccgatcagtgtgccgaaggtgttgtcgcagtagctggagatgcattaagggtcttcacaattgagcggttgggtgagacgttcaacgagaccgtcattcctcttcgatacactccgcgaaagtttgtactattgaccaagcgaaagtatttggctattattgaaagcgaccaaggtgcattcactgcggacgagcgagaaactgccaggaaagagtgcttggcggctgcacggatgaatgaaaatggaaacacaaacaatcgggaccaaaaggagaatggtgcacgtgcagataatgaggaggaggcggaggaggaggatccttttcctgatgagcagtatggttatcccaaggcagagtcagacaagtgggtgtcttgcatcagaattcttgatcccagaattgggaatacaacctgtttgctggagcttcaggaaaatgaagctgccttcagcatttgtactgtgaacttccatgataaggagtatgggactctcttggctgttggtacagccaagggattgaacttttggcctaagaggtgtctcacctccggatttattcacatatataagtttgttgaagaagggaaatctcttgagcttgtgcataagacacaagtagaggaagttcctcttgcactatgccagtttcagggaaggttacttgcaggtatcgggccagtccttcgattatatgacttagggaagaggaaattgctaaggaagtgtgaaaataagctcttcccaaggacaatagtctctattcatacctaccgggataggatatacattggtgacatccaagagtctttccattactgcaagtatagacgggatgagaaccaactgtatatatttgcggatgattctgttcctagatggctgacagcatcgcatcacatagacttcgacaccatggcaggagcagacaaatttgggaacgtgtattttgtgcgactgccgcaggatgtgtcagacgagattgaagaagatccaactgggggcaagataaaatgggagcaagggaagttgaatggcgctcccaacaaagttgaggagattgtgcagttccatgtaggtgatgttgtcacgtgcttgcagaaggcctcgctgataccaggagggggtgattgcatcatatttggaactgtcatgggtagcctgggggcgttgcttgctttcacctctcgtgaagatgttgatttcttctctcacttggagatgcacatgaggcaggaacatccacctttgtgtggaagggatcacatggccttcagatctgcttactttccagtcaaggatgttatcgatggtgatctctgcgagcagtttccggcccttccacctgatttgcagaggaaaattgcggatgaactggaccggactccaggcgaaattttgaagaaactagaagacatcagaaataagattatctgaggcttttgccccaaatgaagtggaaactggggaggtgccaagtgaacattatttagttctgactacagagcgcttgtttgcttgctttcctgctcacgctaatgtgaatgattttagggttttgatcaccttgtacgcaacgacacaacagagtatggtactgtaggtgtgctgctcgtgatagttcattggaacgagttgttatgacgttgcttaggttttatgtctcgccgcctctttaaggcggcggctgtgattgctgtgcatcatggtttcatttgatgtatcttttaaccttttgtttttaccgcgggattttgcttgctgtttccagtcactgactcaaaaatttctgtagtgtgttcaggagaaaatattgcctacgtccggtgtcttgcaccatattagtggatatcaagctcaatttcgttggatgtattcacgacatttacaagatctataattagaattcatgagaattaaacacctatttct

SEQ ID NO: 1932 - DNA, 4121 bp, Musa acuminata
ctccccgccctctttcctccccgcaaaaccctaaccctaaatcccatccaaaaaattccatcgcttcccgcctctctgtcacaaggaaaggaaggaggacgagaagggggtgttattagggaaagatgtacctgtacagtttgacgctgcagcgaccgggcggcgtggtttgcgccacgaacggcaacttcgtgggagggaagacccaggagatcgtggtggctcgaggcaagacgctggacctgctccgccccgatgagtccggcaagctgcagactctcctctccgtcgaggtcttcggcgcgatccgctccctcgcccagttccgtctcacgggctcccagaaggactacgtcgtcgtcggctccgactccggccgcctcgtcatcctagagtactcccgcgagcgcaacgtcttccacaaggtccaccaggagaccttcggaaagtccggctgccgccgcatcgtccccggccagtttctcgcagttgatcccaagggccgcgccgccatggttgccgcctgcgagaagcagaagcttgtctatgtcctcaaccgtgacgccgccgcccgcctcaccatctcctcccccctggaggcccacaagtcacacaccatcacctactcagtcaccggcgtcgactgtggctttgataaccccgtcttcgccgccattgagctggactactccgaggcagatatcgaccctacgggccaggccgctgctgatgcccagaagcacctcacgttctacgagcttgacctggggctcaaccacgtctcccgcaagtggtctgagccagtcgacaatggcgccaacctcctcgtcactgtccctggaggcggcgacggccccagcggcgtcctcgtctgtgccgagaactttgtcatatacaagaaccagggccaccctgatgttcgtgccgtcatcccccgccgtgccgaccttccagcagagcgtggtgtccttgttgtctccgccgccacccaccgccaaaagtccatgttcttcttcctcctgcagaccgagtatggggacatctttagggtcaccctggaacatgaaggcgaccgcgtcaccgagctcaagatcaagtacttcgacaccatccccgtcacctcctccatgagcgtcctcaagaccggcttcctctttgccgcttctgagtttggcaaccatgcattgtaccagttccaggccattggggaggcggaggacgttgaggcctcctctgccactctgatggaaaccgaagagggattccaaccggtgttcttccagccccgaggcttaaagaatctggtgaggattgaccaggttgaaagccttatgcccatcatggatatgagggtcatgaatctctttgaggaggagacccctcaggtgtttaccctctgtggcagggggccccgatcctcgctgcggatcctgaggccagggttggctatcaatgagatggccgtgtcacagctcccgggtactcccagtgccgtgtggacagtgaagaaaaatgtgaatgatgagtttgatgcttacattgtggtgtccttcgtgaatgccacgcttgtgctctccattggtgaaaccatcgaagaagtcagtgacagcgggtttcttgacaccacgccttcgctctcagtatctttgttgggagatgattccctgatgcaggtccatcccaatggaattaggcatataagagaggatgggcgtattaacgagtggaagacacctgggaagaagaccattgtgaaggttgggttgaataggcttcaggtggtgattgctctgagcggaggagagcttatttattttgagatggacatgaccggccagttgatggaggtggagaagcatgagatgcctggggatgtggcttgcttggatattgcaccagttccagaggggagacacagatcccgcttccttgcagtcggttcttatgataacacaattcggattctgtcattggatcctgatgactgcatgcagatcttaagcgttcagagtgtgtcctcaccacctgaatccctcctattgcttgaggtacaggcttcgactggaggagaggatggagcagatcatccagctagtgtctttctcaatgctggcttgcagaacggtgttcttttccggacagttgttgatatggtaactggtcagctctctgatactcgatcccggttcttaggattgagagctcccaagctcttctcagctactgtgaggggtcggcaggcgatgctttgcttgtcaagtaggccctggcttggctatatacatcagggacatttcttgctgactcctctttcatacgaaacacttgaatatgctgcatcgttttcttccgaccagtgtgctgaaggtgttgtcgcagtcgccggtgaagctctgagaattttcacaattgagcggctaggggagacattcaatgagacagttgtacctttgcggtatactccaaggaaattcgtgctgcagcccaggtgcaaacatttagtcattattgagagtgatcaaggagcattcactgcagaggaaagagaagctgctagaaaggaatgcttggaagctgcaaagatgggtgaaaatggaaatgctaacaataggcagcagatggaaaatggtggtggggctggtgatgatgatgaggatgatgctctctctgacgagcaatatggttacccaaaggcagagtccgataagtgggtatcttgcatcagagttcttgatccaagaacaggcaacacaacttgtctgttggagcttcaagagaatgaggccgcattcagcctttgcacggtgaacttccatgataaggagtatggaactctcctcgctgtcggaactgcaaagggattacagttctggcctaagagaagtcttgctgctgggttcattcacatatataggtttgttgaagaaggaaagtctcttgagcttgttcacaagacacaagtagagggagttccactcacactgtgccagtatcaggggaggttgcttgcaggtattggctcggtgctcaggttgtatgacctgggcaaaaggagattactcaggaaatgtgaaaacaagctctttcctaataccattgtttccatgcacacatatcgtgataggatttatgtgggtgatatccaagagtcatttcattattgcaagtacagaagggatgagaatcaactgtacatttttgcagatgattctgttccaagatggctcactgcttcacatcatatagattttgacaccatggcaggggcagataagtttgggaatatatactttgtccgactgccgcaagatctatcggatgagattgaggaagacccaacagggggtaaaataaagtgggagcaagggaagttaaatggagctcccaataaaatggaggagatagtacagtttcatgtaggcgatgttgtgacatgcttgcagaaggcctcactgatacctggaggaggggaatgtgttatatatggaacagtgatgggaagtttaggtgcactacttccatttacctctagggaagatgtggacttcttctctcacttggagatgcacatgaggcaagaacatccaccattgtgtggtcgggatcatatggccttcagatctgcttattttcctgttaaggatgtaattgatggtgatctttgcgagcagttcccaacccttcctcctgatttgcagaggaagattgctgatgaacttgatagaaccccaggagaaatattgaagaagctcgaggatgtcagaaacaagataatttgaggattggaacaatgggttaggaagggttttttccagcaagctaaatgtttgtcatatcgtggtagtggcaattattacttaattgtggtgttaataatcagaggtaatttagctgctaatgctgttgtcatgttaggagagcaacctgctgcttttcccgtgatattttttagttgcattttgaatttaaatagtattgacatgcaaaacttctatcagttcaattagcttctcattagggacgctacatactgattcacagtgaatgcataagatactctttttgttcgctgttttttgtcggtaatatttcctacaagcagctaaatcttttgatagtgc

SEQ ID NO: 1933 - DNA, 3804 bp, Manihot esculenta
caactcttccctctctctcaatgtacctctacagtcttacgcttcaacgagcgaccggcatcatctccgcgatcaacggcagtttctccggtggcaagacccaagaaattgtagtagctcgcggaaaagtccttgatcttctccgccctgacgagaatggtaagcttcagactcttctttctgttgaaatattcggtgctattcgctctctagctcagttcagactaactggatctcaaaaggattatatagctgttgggtctgattcgggaagaatcgtaattcttgaatataacaaggagagaaatgtttttgacaaaatacaccaggaaacttttgggaaatctggttgccgccggattgttccagggcaatacttggccattgacccaaaaggaagagctgttatgataggtgcctgtgagaaacagaagttagtttatgttttgaatagagatactgctgctaggttgactatatcgtcaccgttagaagcacataagtctcacacaatagtatattcaatttgcggtgttgattgtgggtttgataacccaatatttgctgctattgagttggattattcagaggcagaccaggattcaacagggcaggctgccagtgaggcacagaaacatttgacgttttatgagcttgatttagggcttaatcacgtgtctaggaagtggtctgagcaggtggataatggggcaaatatgctcgttacagtgcctgggggtggtgatggaccaagtggagttttggtttgcgcagagaattttgtaatttataagaatgaggggcatccagatgtgagagcagtgattccaaggcgagcagatttacctgctgagagaggggttttggtagtttctgcagctactcataagcagaagtccatgtttttctttcttttgcagacagagtatggtgatatcttcaaggttacattggatcatgagaatgataaggtaaaggagttgaaaattaagtattttgatacaattcctgttactgcttctatgtgtgtgttgaaatcagggtttttgtttgctgcatcagagtttgggaatcatgcattatatcagtttcaggcgattggggaggaggctgatgtggaagcctcatcagctactttaatggaaactgaggaaggtttccagcctgtgtttttccagccaagaggtttgaagaatcttgttagaattgaccaggttgagagcttgatgcctattatggatatgaaggtttttaatctttttgatgaggaaacacctcaaatattttcactttgtggacgtggtcctcggtcttcattgaggatattgaggccaggtttagccattagcgagatggctgtttcacagcttccaggtgtaccaagtgcagtctggactgtgaaaaagaatgttaacgatgaatttgatgcatacattgttgtgtctttcaacaatgccacactagtactttcaattggagaaacagttgaggaagtcagtgacagtgggtttcttgatactacaccttcccttgctgtttctttgattggtgatgattctttgatgcaagttcacccaaatggcatcaggcatataagggaagatgggcgtataaatgaatggaggactcctggaaagagaacaattgtaaaggttggctccaatagacttcaagtggttattgctttaagtggaggggagcttatatattttgaggttgatgttactggtcagctaatggaggtggagaagcatgagatgtctggagatgtggcctgtttggatattgcacctgttccagaaggaagacagagatcccgattccttgcagttggttcatatgacaataccattcgtatcttgtccttggatcctgatgactgtatgcaaattttgagtgttcaaagtgtctcatcacctccagaatccctcctctttctcgaggttcaggcatcagtaggtggagaggatggtgctgatcaccctgctagccttttccttaatgctggtttgcagtctggggttctattcaggacagtggtagacatggtgacaggccagctttctgattctcgttcccggttcttgggcttgagggcaccaaaactcttctccattattgtgagagaccggcgtgcaatgttgtgcttatcaagtcgaccctggcttggttatattcaccaagggcatttccttttaacacccctttcatacgagactcttgaatttgctgcttcattctcatctgatcagtgtgcagaaggtgtggtagctgtagctggggatgccttgaggatttttaccattgaaaggttgggagaaacatttaatgaaactgcaatacctctaaggtacactccaagaaagtttgtggttctacctaagaagaagcttttggtagttattgagagtgatcaaggagcatatgcagcagaggagcgtgaagctgccaaaaaggagtgttttgaggctgctgggatgggggaaaatggaagtgcaaatgctgatcagatggagaatggtggtgatgatgaagacaaagatgatccactttctgatgagcagtatggttatccaaaggcagaatcagaaaagtgggtttcttgcatcagggttctagacccaaggacagcatccacaacttgtctgctggagcttcaggacaatgaagctgcatttagtgtgtgcacagttaacttccatgacaaggagcatggaactcttttagccgtcggtactgccaagggactccagttttggcccaaaagaagtttagttgctgggttcattcacatctataagtttgtggatgatggcagaaccctggaacttttgcacaagacacaagtggaaggtgtaccacttgccttatgccagtttcagggaagactgctcgctgggataggacctgtgctcagactgtatgacctagggaagaagaggttgcttaggaaatgtgagaataagctgttccctaacactattgtctctattcacacctaccgcgataggatatatgtgggtgatattcaagagtcgttccatttctgcaagtataggcgagatgaaaatcagctctatatatttgcagatgattgtgttccaagatggcttactgcaacatcgcacatagattttgatactgtggcaggtgccgacaagtttggaaacatctattttgtgcggttgccccaggatgtttctgatgagatagaagaagacccaactggtggaaagataaaatgggaacaggggaagcttaatggagctccgaacaaggtagaggagatagtacagtttcatgttggtgatgtcattactagcctgcataaggcatccttaattccaggtggtggagagtgcatcatatacgggacagtgatggggagcttgggggctctgcttccattcacctctcgcgatgatgttgacttcttttctcacttggagatgcatttgaggcaggaccacccaccattatgtggaagagaccatatggcatttagatctgcttattttccagttaaggatgtgatcgatggggatctatgtgagcagttcccaacacttccacttgatgcgcagagaaaaattgctgatgaattggatagaacacctggggagatactgaagaaactagaagaaattcgaaataagatcatctaaggaaggtcttttactctagagttcataagggtcattgtcggtggcaatcgaaggtgaaatgtgctgatctgtctaaaaaatgcagatgtgataattggacagtgccaggacttgacccaaagaccagccgggtgaattt

SEQ ID NO: 1934 - DNA, 3659 bp, Manihot esculenta
acccaaccatgtacctctacagtcttacgctgcaacgagctactggcatcgtctccgcaatcaatggcagtttttccggcggcaagacccaagaaattgtagtagctcgtggaaaagttcttgatctcctccgtcccgatgagaacggtaagcttcagaccattctctctgttgaaatcttcggtgctattcgctctctagctcagttcagactaactggagctcagaaggactatatagttgttgggtctgattcaggaagaatcgtaattctggaatataacaaggagagaaatgtttttgataaaatacaccaggaaacttttgggaaatctgggtgtcggcggattgttccaggtcagttcttggccattgacccaaaaggaagagctgtaatgataggtgcctgtgagaaacagaagctagtttatgttttgaatagagatactgctgctaggttgactatatcctcaccgttagaggcacataagtctcacacgattgtgtattctatttgtggtgttgattgtgggtttgataacccaatatttgcggctattgagttggattattcagaggcagaccaggattcgacagggcaggctgccagtgaggcacagaagcatttgacattttatgagcttgatttagggcttaatcatgtgtctaggaagtggtctgagcaggttgataatggggcaaatatgctcgttacagtgcctggagggggggatggacctagtggagttttggtttgtgctgagaattttgtgatttacaagaatgaggggcatccggatgtcagagcagtgatacctaggcgcgcagatttgcctgcagagagaggagttctgatagtttctgcagctactcataagcagaagtccatgtttttctttcttttgcagacagagtatggtgatattttcaaggttacattggatcatgagaatgataaggttaaggagttgaaaattaagtattttgatacaattcctgttacttcctcaatgtgtgtgttgaaatcagggtttttgtttgctgcatcagagtttgggaatcatgcattgtatcagtttcaggcaattggggaggaagctgatgttgaggcctcatcagctactttaatggaaactgaggaaggtttccagcctgtgtttttccagccaagagggttgaagaatcttgttagaattgaccaggttgagagcttgatgcctattatggatatgaaggttgctaatctttttgatgaggaaacacctcagatattctcactttgtgggcgcggtcctcggtcctcattgaggatattgaggccaggtttggccattagtgagatggctgtttcacagcttcctggtgtaccaagtgcagtctggactgtgaaaaagaatgttaatgatgagtttgatgcatacattgttgtgtctttcaacaatgcaactcttgtgctttcaattggagagacagttgaagaagtcagtgacagtgggtttcttgatactacgccttccatagctgtttctttgattggtgatgattctttgatgcaagttcatccaaatggcattaggcatataagggaagatgggcgtataaatgaatggaggactcctggaaagagaacaattgtgaaggttggttccaatagacttcaagtcgttattgctttaagtggaggggagctcatatattttgaggttgatgttactggtcagctaatggaagtggagaagcatgaaatgtctggagatgtggcctgtttggatattgcccctgttccagaaggaagacagaggtcccgattccttgcagttggttcatatgacaacaccatccgtatcttatctttggatcctgatgattgtatgcaaattctgagtgttcaaagtgtttcatcgcctccagagtccctcctctttcttgaggttcaggcatcagtaggtggggaggatggtgctgatcaccctgctagccttttccttaatgctggtttgcagtctggggttctattcaggacagtagtggacatggtgacaggccagctttctgattctcgttcccggttcttggggttgagggcaccaaaactcttctccatcattgtgagaggccggcgagcgatgttgtgcttatccagtcgaccctggctcggttatattcaccaggggcatttcctgttaacacctctttcatatgagactcttgaatttgctgcttcattctcatctgaccagtgtgcagaaggtgtggttgctgtagctggggatgctctgaggatttttaccattgaaaggttgggagaaacatttaatgaaactgcaatacctttgaggtatactccgagaaagtttgtgcttcaacctaagaagaaacttttgattattattgaaagtgatcaaggagcatatacagcagaggagcgtgaagctgccaaaaaggagtgctttgaggctgctgggatgggggaaaatggaagtgccaatgatcagatggagaatggtggtgacgatgaagataaagatgatccgctctctgatgagcagtatggttatccaaagacagaatcagaaaagtgggtttcttgcatcagagttcttgaaccaaggacagcatccacaacttgtctcctggagcttcaggacaatgaagctgcatttagtgtgtgcacagtgaacttccatgacaaggagcatggaacacttttagcggttggtactgcaaagggactccagttttggcccaaaagaagtttagttgctgggttcattcacatctataagttcgtggatgatggcagaaccctggaacttttgcacaagacacaagtcgaaggtgtaccacttgcattatgccagtttcagggaagactgctcgctggaataggatcggtgctcagactgtatgacctggggaagaagaggttgcttaggaaatgtgagaataagttgttccctaacagtattgtttctattcacacctatcgagataggatctatgtgggcgatattcaagagtcattccatttttgcaagtataggcgggatgaaaatcagctctatatatttgcagatgattgtgttccaagatggcttactgcatcataccacatagattttgatactatggcaggtgctgacaagtttgggaacgtctattttgtgcggttgcctcaggatgtttctgatgagatagaggaagatccaacaggtggaaagataaagtgggagcaggggaagctcaatggagctccaaacaaagtagaggagatagtacagtttcatgttggtgatgtgattactagcctgcataaagcatccctaattccaggtggtggagagtgcatcatatatgggacagtaatggggagcttgggggctctgcttccattcacctctcgagatgatgttgacttcttttcacacttggagatgcatttgaggcaggaccatccgccattgtgtggaagggatcatatggcatatagatctgcatattttccagttaaggatgtgattgatggggatttatgtgagcagttcccaacacttcctctagatatgcagagaaaaattgcagatgaattggatagaacccctggggagatactaaagaaacttgaagaagtacgaaataagataatttaaggtgggata

SEQ ID NO: 1935 - DNA, 4811 bp, Populus trichocarpa
gccaagtcaataatcagacgacaagtgatttttgtcgcagaaatccagtctctctctaactagctctcttctttaaaaccctaaaaccccgatccccaccatttcactcccactccaaaagccagcattaccatgtacctctacagcctcactctccaacgagctaccggaatcgtttccgccataaacggcaacttctccggcggcaaagcacaagaaatcgtagtcgctcgcggcaaagttctcgatctcctccgacctgacgagaacggtaagctacagacagttctctctgttgaaatattcggtgctattcgctcattagctcagtttagactaactggagctcaaaaagattatattgttgttggttctgattcgggcaggattgtaattttagaatataacaaggagagaaatgtctttgacaaaattcatcaagaaacttttggaaaatctggctgtcgccgtattgttccgggtcagtatttggctgtggatccgaaaggaagggctgttatgattggtgcctgtgagaaacagaagctagtttatgttttgaatagagatactgttgctaggttaaccatttcttcgcctttagaggcacataagtcgcatactatatgttactcagtatgcggtgttgattgtgggtttgataatccgatttttgctgcgattgagttggattattcggaagctgatcaggactcgacagggcaagctgctggtgaagcgcagaagaatttgacattttatgagcttgatctggggcttaatcatgtgtctaggaaatggtctgagcaggttgataacggcgctaatatgcttgttacagtacctggaggtggtgatgggccaagtggaattttagtttgtgcggagaatttcgtgatttataagaatcaagggcatcctgatgtgagggctgtgattcctaggcgtgctgatttgcctgctgaacgtggggttttgatagtttctgcagcaacacataagcagaaatcgatgtttttctttctgttgcagactgagtacggtgacatttttaaggttacattggatcatgagaatgacaaggttaaggaattgaagattaagtattttgacacgatcccagttacttcttcgatatgtgtgttgaaatcagggtttttgtttgctgcatcagagtttgggaatcatgcattgtatcagtttcaggccattggggaggaagaggatgtggaggcctcatctgctactttgatggaaactgaggaaggcttccagcctgtgtttttccagccaagagggttaaagaatcttgttaggattgaccaggttgagagcttgatgcctgttatggacatgaaggttgctaatatttttgatgaagaaacccctcagatattttcactttgtgggcgcggtcctcgctcctcattgaggatattgaggcctggtttggctattagtgagatggctgtgtcacagcttcctggtgtaccaagtgctgtttggactgtgaaaaggaatgctaatgatgagtttgatgcatatattgttgtgtcctttaacaacgcaactcttgtgctttcaattggagaaacagttgaggaagttagcgatagtgggtttcttgataccacaccttcccttgctgtttctttaattggtgatgattctttgatgcaaattcacccaaatggcataagacatattagggaagatgggcgtattaatgagtggagaactcctggaaagaggacaattgtgaaagttggctcaaatagacttcaagtggttattgctttaagtggaggagagcttatatattttgaggtggatatgaccggtcagctaatggaggtggagaagcatgagatgtctggagatgtggcctgtttggacattgcccctgttccagaaggaagacagaggtctcgattcctagcagttggttcgtatgataacaccatccgtgtcttgtctttggatcctgatgactgtatgcagattctgagtgtgcaaagtgtttcggcgcctccagaatccctcctgtttcttgaggttcaggcatcaattggtggcgaagatggtgctgatcaccctgccagtcttttcctcaatgctggtttgcagactggggttctatttaggacagtggtggatatggtgacaggccagctttctgactcccgttcccggtttttgggtttgagggccccaaaactttttgccattaatgtgagaggtcgacgtgcgatgctgtgcttatctagccgaccctggcttggttatattcaccaagggcattttctgttaacacccctttcatatgaaactcttgaatatgctgcttcattctcatctgatcagtgtgcagaaggtgtggttgctgtcgccggggatgcgttgaggatttttacaattgagagattgggagaaacattcaatgaaactgcaatacctctaagatacactccaagaaagtttgtgcttcaacctaagcggaaattgttggtcattattgagagtgatcaaggagcgtatacagcagaggagcgtgaagcagcaaaaaaagagtgcttcgaagctgctggaatgggggaaaatggaagtgccaatgctgagaagatggaaaatggtgatgatgatgataaagatgaccccctatctgatgagcagtatggttatccaaaggctgaggcagacaggtgggtttcttgcattagagtacttgacccaaggtcagctactactacttgcttgctggaacttcaggacaatgaagctgcttttagcgtatgcactgtaaatttccacgacaaggagcatggaactctcttagctgttggtacagccaagggactgcagttttggcccaaaagaagcttaattgctgggttcattcacatttataaatttgtggatgatggtaaaagcctggaactcttgcataagacacaagtagaaggagttccacttgctttgtgtcagtttcagggaagattacttgcgggaataggatcagtgctgagattgtatgacttggggaaaaaaaggttgcttagaaaatgtgagaataagctgttccccaactccattgtctctattcacacctatcgtgatcggatttatgtgggggacattcaagaatcatttcatttctgcaagtacaggcgggatgaaaatcagctgtatatttttgctgatgatagtgttccaagatggcttacagcatcataccacgtagattttgataccatggctggtgcagacaagtttgggaatatctactttgtgaggttgccacaggatgtttctgatgagatagaagaagatccaactggcggaaagataaagtgggagcagggaaagcttaatggagctccaaacaaggtagaggagatagtacagtttcatattggtgatgtggttaattccttgcagaaggcatctctaattccaggcggtggagaatgcatcatgtatgggacagtgatggggagtgtgggggccctacttccattcacctctcgagatgatgttgacttcttttcacacttggaaatgcatttgagacaagaccacccacctttgtgtggaagagatcatatggcatataggtctgcttattttcctgttaaggatgtgatcgatggagatctatgtgagcagttcccgactttgccacttgatgcacaaagaaaaattgcagatgagctggacagaactcctggggagatactcaagaaacttgaagaagttcgaaacaagatcatctgaggaaggattaacttgaaggggtcgttgtatctgaattaatgattgctttctgctagtcacagcgaggtgaagtgctctgggcatcagcttttctaattgaggtaaagataatttttttgaacagcagctagatagtgatggaggttgatgctagatcagttttcgttggtgatgaagaagtcgctgtagagagagcttagtttgttgtaagataaacagagagttgcaatgtcaatctctaagatggtaatatgttatcatttgtgaatttgatggctgcttagatttgttgtttcaagtagaaacgggcaaaggattttaaactgatggattaatgcaaccagcagagcatggcgtagaaaatatgaaaggtaggttagatctgctccccactgtgtgctcgctttttccactatttttggatcaattcgttgtcgtgttggggtccgtaattttgatcgtgctattttaggtccttcatctggttaagctctctattatctctttatttttttccttaccccaccggaaaactacctgcctgcctcgagattctctcatctacagtgctggaattagttgaattaatcacgaattttttatgcgatttttaagcatcatagcccatcaactagaaatggacatcaaccattttattgatcctacaatcacagcgaggtgaagtgctctgggcatcagcttttctaattgaggtaaagataatttttttgaacagcagctagatagtgatggaggttgatgctagatcagttttcgttggtgatgaagaagtcgctgcggagagagcttagtttgttgtaagataaacagacagttgcaatgtcaatctcctagatggtatattttatcatttgtgaatttgatggttgcttagatttgttgtttcaagtagaaacgggcaaagaattttaaactgatggattaatgcaaccagcagagcattgcgtagaaaatatgaaaggtaggttagatctgctccccactgtgtgctcgctttttccactatttcgtgactc

SEQ ID NO: 1936 - DNA, 4375 bp, Populus trichocarpa
ctcggaaatccagagacactctctagctagctctcttctttaaaaccctaaaaccccgattcccaccattttctcccacttcaaaacctaactttaccatgtacctctacagcctcactctccaacgagccactggaatcatctccgccataaacggcaacttctccggcggcaaagcacaagaaatcgtagtcgctcgcggcaaagtcctcgatcttctccgccctgacgagaacggtaagctccaaacagttctatctgttgaaattttcggtgcaattcgctcattagctcagtttagactaactggtgctcaaaaagattatattgttgttggttctgattcgggtaggattgtaattttagaatataacaaggagagaaatgtccttgacaaaattcatcaagaaacttttggaaaatccggttgtcgccggattgttccgggtcagtatttggcagttgatccgaagggaagagctgttatgattggtgcttgtgagaaacagaagttagtttatgttttgaatagagatactgttgccaggttaaccatttcttcacctttagaggcgcataagtctcatactatatgttactctgtatgtggtgttgattgcgggtttgataatcctatttttgctgccattgagttggattattcggaagcagatcaggattcgacagggcaatccgcgagtgaagcacagaagaatttgacgttttacgagcttgatttggggcttaatcatgtctccaggaaatggtctgagcaggttgataatggcgctaatatgcttgttacggtacctggaggtggtgatggtccaagcggggttttagtttgtgtggagaattttgtgatttataagaatcaagggcatcctgatgtgagggctgtgattcccaggcgtgctgatttgcctgctgaacgtggggttttgatagtctctgcggctactcataagcagaaatcaatgtttttctttttgttgcagacggagtatggtgacatttttaaggttatgttggatcatgagaatgacaaggtgaaggaattgaagattaagtattttgatacgatcccagtcacatcctcgatgtgtgtgttgaaatcagggtttttgtttgctgcatcagagtttgggaatcatgcgttgtatcagtttcaggccattggggaggaagaggatgtggaggcctcatctgctactttgatggaaactgaggaaggcttccagcctgtgtttttccagccacgagggttaaagaatcttgttaggattgaccaggttgagagcttgatgcctattatggacatgaaggttgctaatctttttgacgaagaaaccccacagatattttcactttgtgggcgtggtcctcgttcatcattgaggatattgaggcctggtttggccattagtgagatggctgtgtcacagcttcctggtgtaccgagtgcagtttggactgtgaaaaagaatatttatgacgagtttgatgcgtatattgtcgtgtcttttaacaatgcaactcttgtgctttcaattggagaaacagttgaggaagttagtgatagtgggtttcttgataccacaccttcacttgccgtttctttaattggcgatgattctttgatgcaaattcacccaaatggcataagacatatcagggaagatgggcgtattaatgagtggagaacccctgcaaagaggacaattgtgaaagttggctccaatagacttcaagtggttattgctttaagtggaggggagcttatatattttgaggtggatatgactggtcagctaatggaagtggagaagcatgagatgtcaggagatgtggcctgtttggacattgcccctgttccagaaggaagacagaggtctcgattcctagcagttggttcgtatgataacaccatccgtgtcttgtctttggatcctgatgactgtatgcagattctgagtgtgcaaagtgtttcagcacctccagaatccctcctctttcttgaggttcaggcatcaattggtggggaagatggtgctgatcaccctgccagtcttttccttaatgctggtttgcagactggggttctattcaggacagtggtggacatggtgacaggccagctttctgactctcgttcccgatttttgggtttgagggccccaaaacttttttccattaatgtgagaggtcgacgtgcaatgttgtgcttatctagtcgaccctggcttggttatattcaccaagggcattttctgttaactcccctttcatacgagactcttgaatatgctgcttcattctcatctgatcagtgtgcagaaggtgttgtttctgtcgccggggatgcattgaggattttcacaattgaaagactgggagaaacatttaatgaaactgcaatacctctaagatacactccaagaaagtttgtgcttcaacctaagcggaaattgttggtgattattgagagcgatcaaggagcatatacagcagaggagcgtgaagcagcaaaaaaggagtgttttgaagcttctggaatgggggaaaatggaagtgccagtgctgagcagatggaaaatggtgatgatgatgataaagatgaccccctatctgatgagcagtatggttatccaaaggctgagtcagacaagtgggtttcttgcattagagtccttgacccaaggtctgctgctactacttgcttgctggagcttcaagacaatgaagctgcatttagcttgtgcactgtaaatttccatgacaaggagcacggaactctcttagctgttggtacagccaagggactgcagttttggcccaaaagaagcttggttactgggttcattcacatttataagtttgtggatgatggcaaaagcctagaacttttgcataagactcaagtagaaggtgttccacttgctttatgccagtttcagggaagattacttgctggaataggatcggtgctgagattgtatgacttggggaaaaagaggttgcttaggaagtgtgagaataagctgttccccaacaccatcgtttctatccacacctaccgtgatcggatttatgtgggtgacattcaagaatcatttcatttctgcaagtacaggcgggatgaaaatcaactgtatatttttgctgatgatagtgtcccaagatggcttacatcatcataccatgtagattttgatagcatggctggtgcagacaagtttggaaatatctactttgcgaggctgccacaggatgtctctgacgagatagaagaagatccaactggtggaaagataaagtgggagcaggggaagcttaatggagctccaaacaaggtagaggagatagtgcagtttcatatcggtgacgtggttaacagtttgcagaaggcatctctaattccaggtggtggcgagtgcatcatatatgggacagtgatggggagtgttggggccctacttccattcacctctagagatgatgttgacttcttttcacacttggagatgcatttgagacaagaccacccacctttgtgtggaagagatcatatgtcatataggtctgcttattttcctgttaaggatgtgattgatggggatctatgcgagcagttcccaactctgccccttgatgcacaaagaaaaattgctgatgagctggacagaactcctggggagatactcaagaaacttgaagaagttcgaaacaagatcatctgaggaaagattaacttgaagtgtcaaattccatatgccatgtcaaccagtaaattgagaagcctggatcgcatagaagattgcttgagcaaccctcaaagaagcgcactacggaagggtttgattccaaccttctgggaccgtcagggagaggctggaagatttcaacgtcaaccctcctatccatgcagtggttctatcaagacttgttggcatggggcctgtatagtaacctgagtgtgattttctttagctccctgcaaatgcaagcgatcaagcttcactttttcaacaggtaaatgggaaatggatttgcttgtcatggtgcaccgccttctatccacctaatggtgtctgggtggtcttggcatgctgtgaaaccctatttacagctgaaggttgatacttgcagtcattatccgcctggttggcttgccactgactttctcgaagtaactttgtacctaatagtaggctcgtagcttgggtgcatatgcaactctagtaggttagcactcattggttaaaaggtttcacgatgatcagtttgtgaaacttcagttaaagaagccttcttgttttggtttcttccattttgtgaatttgatggttgctataattactcgatacatgccatc

SEQ ID NO: 1937 - DNA, 4538 bp, Vitis vinifera
ctaactcagatgttggcgcgggttgtccacaaatagcttgctagggttaatatgaagcccaccctcgtttctgcatctccgctctggtctctcccttctaaaccctaaacccaccgtactatttcagatcactcccagaaactctaattccaaaaccctaatttcccactttgaaccactatcaacctaatcttgtttccatcatctctcacattctcgttaagccccttcttcgcttttccaaaaacactagtgttttttttcttcccatttttgtcaagatttggttgttctctctctttgttttttgttcgttcctccaaaccttcgtttcgttgttagcattttgtcgaaaccctattgtattgacagcgttcgtcgccgttttgagctatgtatctctacagtcttacgctacagcaagccacaggcatagtttgtgcgattaatggcaacttctccggtggaaagtcccaagaaattgttgttgccagaggcaaagttctcgaccttttgcgccctgacgaaaacggtaagatccaaacgattctctctgttgagatttttggtgccattaggtctttagctcagtttaggctaaccgggtctcaaaaggactatatcgttgttgggtctgattcgggtcgaattgtaattcttgaatacaacaaagagaagaacgttttcgataaaattcaccaagaaactttcgggaaatcgggctgtaggcgaatagttccggggcagtatttggcaatagacccaaagggtcgtgctgttatgattggagcttgtgagaaacaaaaacttgtttatgtgttgaatcgagatacagtggcgaggttgaccatatcgtcgcccttggaggctcataagtcgcatactatagtgtattcgattactggggttgattgtggttttgataacccaatatttgctgcaattgagttggattactccgaggcggatcaggattcgactggacaggcagcaagtgaggcccagaaacaccttactttttatgagcttgatcttgggcttaaccatgtgtctaggaaatggtcggagcaggttgacaatggagcaaatatgcttgttacagttcctgggggtggggatggaccaagtggtgttcttgtgtgtgctgaaaattttgtgatttataagaatcagggtcacccagatgtacgagctgtcatacctaggcgggcagatttacctgcagaacgtggggtgcttatagtttctgctgcaacacataggcagaagtcgatgttcttctttcttttgcagacagaatatggagatgtttttaaggttactctggaacatgagaatgaccgcatctcagagttgaagattaaatattttgatacaatcccagttacatcttcaatgtgtgttctgaaatctgggtttttatttgccgcatcagagtttggaaaccatggtttgtatcaatttcaggcaataggggatgatgctgatgtggaatcttcatcggcttcattgatggaaacagaagagggtttccagcctgtgtttttccagcctagaggacttaagaaccttgttaggatagaccaagttgagagcttgatgccaataatggacatgaaagtctcaaacctcttcgaggaagaaacccctcaaatatttgcactttgtgggaggggtccacgttcatctatacggattctgaggccaggtttggccatcagtgagatggctgtttcgcagcttcctggtgtcccaagtgcagtttggacagtaaaaaagaatgtcaatgatgagtttgatgcatatattgttgtttcgtttgcaaatgctactcttgtgctttcaattggtgaaacagttgaagaagtaagtgatagtgggtttcttgataccacaccatcccttgctgtttctttgataggtgatgattccttgatgcaagttcatcctagtggtatccgacatataagagaagatgggcgtattaatgagtggagaactcctggaaagaggacaatcgttaaagttggttccaataggcttcaagtggttattgccctgagtggaggggagcttatatattttgaggtggatatgactggtcagttgatggaggttgagaagcatgaaatgtctggagatgtggcttgtttggacattgccccggttcctgaaggaagacagagatctcgttttctcgcagtcggatcatatgacaacactattcgtatcttgtctttggatcctgatgactgtatgcagattttgagtgtgcaaagtgtttcttctcctccagaatctcttctctttcttgaggttcaggcatcagtaggtggtgaggatggtgctgatcaccctgctagtctttttcttaatgctggtttgcagaatggtgttctgttcagaacagtggtagatatggtgacaggtcagctctctgatgctcgttcccgattcttaggactgagagccccgaagctattctctgttattgtgagaggccgacgtgcaatgctatgcttgtcaagccgcccttggcttggttatattcaccaagggcattttctgttgacaccgctttcttatgagacacttgaatttgctgcctcattttcatctgatcagtgtgctgaaggtgtggttgctgttgccggggatgcgctgagggtctttactattgaaagactgggtgaaacatttaatgaaactgtgattcctttaaggtatacaccgagaaagtttgttcttcaacccaagcgaaaattattggtagttattgagagtgatcaaggagcatttgcagcagaagagcgtgaagccgctaaaaaggaatgctttgaggctgctggaatgggggagaacgggaatggtaatgtggagcagatggagaatggtggtgacgatgaagataaggatgatcccctctctgatgaacagtatggttatccaaaggcagagtctgataagtgggtttcttgcatcagaattcttgatcctaggacagcaaccacaacttgtctgctggagcttcaggataatgaggctgcatttagcatatgcactgtgaatttccatgataaagagtatggaactcttttagctgtcggtacagcaaagtcactgcagttttggcccaaaagatcttttgatgcaggttatattcatatttataggtttttggaagatgggaaatcccttgaattattgcacaagacacaagtggaaggtgttcctcttgctttatgccagttccagggaagattacttgctggaataggatctgtgctcagattatatgatttggggaaaagaagattgctcaggaaatgtgagaataagctgtttccaaatacaatagtctctattcacacttatcgggacagaatttatgtaggcgacattcaagagtcattccattattgcaagtatagacgggatgaaaatcaactgtatatatttgctgatgatagtgttccaagatggttgacagcatcttaccacatagattttgacaccatggcaggagccgacaagtttgggaatatctattttgtgaggttgcctcaggatgtatcggatgaggttgaagaagatcccactggtgggaagataaagtgggagcaggggaagctgaatggtgctcccaacaaggtagaggagatagtacagttccatgttggtgatgtggtcacatgcttgcagaaggcatctctaataccaggtggtggagagtgcatcatctatgggacagtgatggggagcttaggggcattgcttgcgttcacctcgcgggatgatgttgacttcttttctcacttggagatgcatatgagacaggaacacccacctctgtgtggaagagatcacatggcttacagatctgcttattttcctgttaaggatgtgattgatggggatctatgtgagcagtttcctacactgcctctggatttgcagagaaaaattgcggatgaattggacagaactccaggggagatactgaagaaacttgaagaagttcgaaataagatcatttgagaagtatcagttcaaaggtgctctcttgagtttgtgttcaaaacggagaaacgccgtatggagttacactaacaaacgaagcatgctagttgttcctagacactagaatagataatcagaaggccatgagacacctatttacagatggaaaaaaatcagcgcctgggaaactagaagtgctgggaaagaaaaccccccgaaaaaaggaatagctgcagctcattaggcgagccttccatttcttatgttgtaattaagcaataacagattttattaggtctttctttttgtggatttgttgttgatgttgatcctcagattccgtctctgcatactctcttcttattctctggaacactacctgtcccatttcctctgcagaaaatagatgttcaagattttcttactaaccaaccaggtgattgaatggccatgatctccatcctctgttttcataattctcaccagctgcatgttgggatttgaaatctcttttttgt

SEQ ID NO: 1938 - DNA, 3963 bp, Nicotiana benthamiana
caccaactgctactcccaaaatgtatctctacagtctcacactccaaaaacccaccggcatactctgcgccatcaacggaagcttttccggtggcaaagtacaagaaatcgccgtcgcccggggcaaagtcctcgacctcctccgccccgacgataacggtaagctccaaaccttattatccgtcgaaatcttcggcgctatacgctccttagctcaatttcgattaaccggtgcacaaaaagattatattgtagtcgggtcggattcgggtcggatagtgatattagagtataataaagagaagaatgtttttgataaagttcatcaggagacttttgggaaatcgggttgtagacggatagttccgggtcagtatgtgggtattgacccgaaaggtagggctgttatgattggtgcttgtgagaaacagaagcttgtgtatgttttgaatagggatactgctgctaggttaaccatttcgtcacctttagaagctcataagagccacactattacgttctcgatttgtggtgttgattgtggatttgataaccccatatttgctgcgatcgagttggattacgcggaggcggatcaggatcctactggccaggctgcaaatgaggctcagaagcatttgacattttatgaattagatttagggcttaatcacgtgtcgaggaagtggagtgaacaggttgataatggtgctaatttgctcgttactgtacctggtggtggggatggtcctagtggtgtgcttgtttgcgcggagaatttcgtgatatataagaatcagggacaccctgatgttagggctgttattcccaggagggtggatttgccagcggaacgtggggttttgattgtttcagctgctatgcataagcagaagtcaatgtttttctttcttttgcaaactgaatatggagatatctttaaggtgacattggatcacgacaatgacagagttaaggagttaaagatcaaatattttgatacaattccagtcagttcttcgctgtgtgtcttgaagtcagggttcctctttgctgcgtcagagtttgggaatcatgcattgtatcagtttcaggcgataggagatgatcctgatgtcgaagcttcatcatcgacgttaatggaaactgaagaaggttttcagcctgtatttttccagccaagaaagctaaaaaatcttgttaggatcgatcagattgagagtttgatgccaatcatggacatgaaaatagtaaatctttttgaggaagaaactccacaaatattttcactttgtgggaggggtccccggtcttcgttgcgcatacttaggccaggtttagctgttagtgaaatggctgtgtcacagcttcctggtgttcctagtgctgtctggactgtaaaaaagaatgtcaatgatgagtttgatgcatacattgttgtatcttttgcgaatgcaactcttgtgctttctattggtgagacagtggaagaagttagcgacagtgggtttcttgatactactccatctcttgctgtttcattgattggtgatgattcattgatgcaagttcatcccagtggaataaggcatattagagaagatggccgtattaatgaatggagaactcctggaaagagaattattgtcaaggttggatctaataggcttcaagtggtaattgcactaagtggaggggagcttatatattttgaagtggatatgactggccagctgatggaagtcgagaagcatgagatgtcaggtgatgtagcttgtctggacattgcccctgttcctgagggaagacaaaggtcccgtttccttgcagttggatcatatgataacactattcgtatattgtcattggatcctgatgactgtatgcaggttctgagcctgcaaagtgtatcttcaccgccagagtctctcctttttcttgaagttcaggcctctattggtggagaagatggtgcagatcaccctgccagcctttttcttaatgctggtttacaaaatggggttttattcaggactgtggtggatatgataactgggcagctttcagatgcacgttcacgtttcttggggcttagagcccctaagctcttttccattgttgtgagaggacggcgtgctatgctttgcttgtcaagtagaccgtggctaggttatatacaccaagggcattttcttttgacgcctttatcatatgagactcttgaatttgcagcctcattttcatcggatcaatgtgcagaaggtgtagtagcggttgctggggatgcgttgagggtcttcacgatagagagattgggcgaaactttcaacgaaacagctatacctttaaggtatacaccaagaaggttcgttcttcaacctaaacggaagatggtgataatgatagagagtgaccagggagcatatactgcagaagagcgtgaagctgccaaaaaggagtgctttgagacagctgggaatggtgaaaatggaaatgcggaacaagtggagaatggtgaagatgaggatggtaatgatccactatctgatgaacaatatggttatcccaagtcggagtcaggaaggtgggtttcctgtatcagagtccttgacccaaggtcaacacaaaccacttgtctgctagagcttcaggataatgaggctgcgttcagcatatgcactgttaatttccatgacaaggagcatggagctctgttagctgttggtactgccaagggccttcagttttggcccaaaaaatcgtttgaagcagcatacattcatatatacaaatttaaagaagatgggaaggtcctcgagcttttgcacaagacacaggtagatggtgtgcctcttgcattatgtcagttccaaggaagactactagctggtgtggggtctgtccttaggttgtatgatttggggaaaaaaagattgctcagaaaatgtgagaacaagcttttccccaattcaatcacatctatccatacctatcgtgatcggatttatgtgggtgacatgcaagagtcattccactactgtaagtatagacgtgatgaaaaccaactgtacatatttgctgatgacatggttccgagatggctaaccgcagcacagcatgtagattttgacacagtggcaggagctgacaagtttgggaatatctactttgtgcgattacctcaggatgtctcagatgagattgaagaagaccctactggtggaaaaataaaatgggagcaggggaagctgaatggagccccaaacaaggttgaggaaatagtgcagtttcatgttggtgatgtggtctcttgcttgcaaagagcatcacttattccaggagggggtgaatgtgtaatttacgggactgtgatggggagcgttggggcaatgcttccatttacctcgagggatgatgttgacttcttctctcatttggagatgcatttgaggcaggagttcccacctttatgtggcagggatcacatggcctacagatctgcttacttcccagttaaggatgtgatagatggagacttgtgcgaacagttcccaaccttgccaatggatatgcagcgcaaaattgcagatgagttggacagaacaccaggcgagattttgaaaaagcttgaagaaataagaaacaaaattatttgagaacatgtttagatcaaggtgatggttttagtcttaatcaatccaagggaacagtcatgtggcgacttaagagggagcagtccagagagctatggatgtttcatttgatttgacctttgtggatgcaagaaaagagaccagcatgtactccaacctgtgctcactatagaagaatttgaggaaaagatgcagagcgatttgaagaaaagatgtggagtgaattattcctcagtttctctgttgtaattatgctgtagcgtcgctagtcatttcaactgattttgtagtaaactaccaataactgaat

SEQ ID NO: 1939 - DNA, 3962 bp, Eschscholzia californica
actagtccttttttttccgagtctgaggtttatatttccttccatggtttaagtttctagggtttttattcatctgaagttatagatttctaaggttttctcttagaattttgacatgtatctttatagtttaacactccaacaagctactgggattgtttgtgctactaatgggaacttcgtcggtgggaaatcacaagagattgttgtagctagaggtaaagttcttgatctacttcgtcctgatgaaaacggtaagatccaaactattctttcagttgaagtatttggagcaattaggtcattagctcagtttaggttaactggttcacagaaagattatattgttgtgggttctgattctggtaggattgttattcttgaatataataaagagaaaaatgtatttgataaagttcatcaagaaacttttggaaaatcgggttctcgtcgaattgttcctgggcaatacttagctgttgatccaaagggtcgtgctgttatggttggtgcttgtgaaaaacaaaaacttgtttatgttttgaatagagatactgctgctagacttacaatttcttcaccattagaagctcacaagtctcacacaattgtttattcgataactggtgtcgattgtggttttgataacccgattttcgctgcaattgaacttgattactctgaagctgatcaagattcgactgggcaggcagctaatgaagctcagaaacatcttaccttttacgagctcgatctaggactgaatcacgtctctaggaaatggtcggagccgatcgataatggagccaatatgctggttactgttccgggtggtggcgatggtcctagtggtgttcttgtctgtgccgagaatttcgttatttataaaaaccaaggacacccggatgtgcgggctgtcattcctcgaagagctgacttgcctgctgagcgcggagtcctcatcgtttctgctgctacccataggcaaaaggccatgttcttctttctgttacagacagagtatggggatgttttaaagttacacttgagcacgataatgatcgagttactgagctaaagatcaagtattttgatacaatgcctgttacttcagcaatgtgcgttcttaaaacagggtttttgtttgctgcctctgagtttggaaaccatggtttgtatcagtttaaagctattggagaagatgctgatgttgaagcttcgtctgctacactaatggaaaccgaagaaggttttcagccagtctttttccaacctagaggtcttaagaaccttgttagaattgaccaggtagagagcttgatgtctattatggatatgaaagttactaacctgtttgaggaggaaacacctcagattttcactctttgtggtcggggaccacgttcatccctacggatattaagacctggtttggctgtcagcgagatggccgtgtctcaacttcctggcattccaaatgctgtttggacagtgaagaaaaacataaatgacgagtttgatgcatatattgttgtgtcttttgctaatgcaacactagtgctctctattggtgagacggttgaggaagttagtgaaagtggatttctggatatcactccttcacttgccgtatcccttttgggagatgattctctaatgcaagtccatccaaatggtattaggcatataagggaagatggccgtattaatgagtggaaaactcctgggaagagaacaattgtgaaggtcgcctcaaacaggctgcaagtggttattgctctaaatggaggggagcttatctattttgagatggacatgactggtcaattgatggaggtggagaagtatgacacatcaggagatgtggcatgcttggacattgccccagttcctgaaggaagacagaggtcccgtttccttgcagttggttcctatgaccccgcaattcgtatcttatctttagaccctgacgattgcatgcaagttttgagtgtacaaagtgtttcttcagcaccagaatctctccttttacttgaagttcaggcatcaattggcggtgaagatggagctgatcaccctgccagtgttttccttaatgctggtttacaaaacggagttcttttcagaactgtggttgatatggtgacaggtcagctttccgacactcggtcacggttcttaggactcagagcacccaagctcttctctgccgttgtcagaggtcggcaggcaatgctttgcttgtcaagcaggccttggcttgggtatattcaccaaggtcatttcttgttgactcctctctcatatgaaaccctcgagtatgcagcgtcgttttcatctgatcaatgtgctgaaagtgtggttgctgttgctggggatgctcttagggtcttcactattgagcgattgggagagacattcaatgagacagttattcctttgaggtataccccacgaaaatttgttctgcacccgaagaagaagttattggtagtaattgaaagtgatcaaggggcgttcaccgcagaggagcgggaagctgcaaggaaggagtgttttgaagctgctggcatgggggagaatggaaatggtaatgtggaacagatggagaacggggccgatgacgaggagaaggatgatcctctttctgacgagcagtacggttatccgaaggctgagtcagagaagtgggtttcttgcataagagttcttgagccaaaaagtgcaaccacaacgtgtctgcttgagcttcaagataatgaagctgcatttagtgtatgcactgtgaatttccatgataaggaatatggaactcttttagctgttggtacagctaaggggttgcaattttggcccaagagaagcttttcagctggatttattcacatctatcggtttatggacgatgggaaacgccttgaactcttgcacaagacacaagtggaaggtgttcctcttgctttgtgccagttccaaggaagattacttgcaggaattggaccagtgctcagattgtatgacctggggaagagaagattgctcaggaaatgtgagaataagcttttccccaactctatcatctctattcagacgtaccgcgaccggatttatgtgggtgacatccaagagtcatttcattactgcaaatatagacgggatgaaaaccagctatacatatttgcagatgatagcgttcctcgatggcttacagcatcataccatatagattttgacaccatggctggagcagacaagtttggaaacgtctactttgtacgtctaccacaggatttatccgacgagatcgaagaagatccaactggtgggaagatcaagtgggaacaaggaaagctaaatggtgcacccaacaaggtagatgagattgtccagttccatataggcgacaacgtcacgtgcatgcaaaaagcatctcttataccaggaggtggtgagtgtctcatctatgggactgtaatgggaagcttgggagctctgcttgcatttacttcaagggaggatgtcgatttcttctctcacttagagatgcatatgaggcaagaacaccctcctttgtgtggacgagatcacatggcatacagatctgcttatttccctgtcaaggatgtgatcgatggagatctctgtgagcagtatccgactctgccttcagatttgcaaaggaagattgcagatgaacttgacaggacaccaggtgaaatactgaagaaacttgaagatatcagaaacaagataatatgagaaagaatcgttgctggtctgaagatcctgcttatcgaaatgttgtagttcggctggttttaaatagttgctgtataaaaatttgtactgagcttaagttctttatgcagcaaatacctagtattaacttctgttcgcagaagaggttctgttttggcttcactatgtaatgctttctggtagaaaatccaaaacaatacttt

SEQ ID NO: 1940 - DNA, 4181 bp, Cucumis sativus
ctatgtacctttacagtctcactttgcaacgagctaccgggattgtctcggctataaatggaaatttctccggtggtaaaacgcaggagatagtggttgccagagggaaggtcctggatctcattcgtcctgatgatagtggtaagatccaaactcttctttctgttgaaatctttggtgcgattcggtctttagctcaatttaggcttactgggtctcagaaagattatatagttgttgggtctgattccggtcgaattgttattctggagtataataaggataagaatgtatttgacaagatacatcaggagacttttgggaagtcgggttgtcgtcgtattgttccggggcaatatttggctattgaccctaaaggaagggctgttatgattggagcatgtgagaagcagaagcttgtttatgttttgaacagagatacagcagccaggcttactatttcttcaccactggaggctcataaatcccataccatagtatattcaatttgtggaattgactgtggatttgacaatcctatatttgccgcaattgagttggattactcggaggcagatcaggattctacaggggtggcagcaagtgaagcccagaagcatttaactttttatgaacttgatcttggtctcaatcatgtctccaggaagtggtcagaacctgttgataatggtgccaatatgcttgttactgttcctggaggtggggatggtcctagtggagtgttggtttgtgctgaaaattttgtgatttataaaaatcagggacatccagatgttagagctgtcattcctaggcgtgcagatttacctgctgaacgtggtgtgcttatagtttcagcagcaatgcataagcaaaaaacaatgtttttctttcttttacagacagagtatggagatatattcaaggttaccttggaacacaacaacgacagtgtcaaagaactgaagataaagtattttgatacaattccagttacagcttcaatgtgcgttctgaaatcaggatttctatttgctgcctcagaatttggaaaccactcactataccagttccaagccataggggaggatgctgatgttgagtcttcctcggctacactgatggaaactgaggaaggttttcagccagtttttttccagcctaggagacttaaaaaccttatgagaattgatcaagttgagagcttaatgcctataatggatatgaaaatcataaatctttttgaggaggaaacacctcagatttttactctttgtgggcgtggtcctcgatcatctttgcgaatattgagacctggcctggccatcagtgaaatggctgtgtcagaacttcctggtgttccaagtgctgtgtggactgtgaaaaagaacatcaatgatgagtttgatgcatacattgtggtgtcatttgcaaatgcaacactagttctttctattggtgagacagttgaagaagttagtgatagtgggttcctcgacactaccccttcccttgctgtttctttgataggtgatgattctctcatgcaagtccatccaaatggtattaggcatattagggaagatgggcgtattaatgaatggagaactccaggcaagaggaccattgttaaggttggttctaataggcttcaagtggtgattgccttaagtgggggagaacttatttatttcgaggtggacatgactggtcagttaatggaggtggagaagcatgaaatgtctggggatgtggcttgcttggacattgccccagtgcctgaaggaaggcaacgttcgcgtttcctagcagttggttcttatgataacacaatacgaattctatcattggatcctgatgactgtatgcaaattttaagtgtgcaaagtgtttctgcagctcccgaatctcttctgtttctagaagttttggcatcagtaggtggggaggatggtgcagatcatcctgctagtctttttctgaatgctgcattgcattctggggttttattcagaacagtagtggatatggtgacaggccagctttctgattcccgatcccgtttcttaggactaagagcacccaaactattttctgttgttttgagggggaggcgtgcaattctttgcctctcaagtagaccttggcttggatatattcatcaaggccattttctattgacccctctatcatatgaaactcttgaatatgcctcatcattttcatcagatcagtgtgcagagggtgtagttgctgtggctggaaatttcttgagggtttttaccattgagagattgggagaaacatttaatgaaactgtcattccacttaggtacaccccaagaaagtttgtgcttcaacctaggagaaaactattggttgttattgagagtgatcagggagcattcactgcagaagagcgagaagctgctaaaaaagaatgctttgaggctgcaggggctggggaaaatggaaatggcacaatggatcaaatggagaatggtggagatgatgaggataaggatgatcctctatctgatgagcattatggttatccaaaggcagagtctgaaaaatgggtttcatgcatccgagttcttgatcctaggtcagccactacaacttgtctgctggagcttcaggacaatgaagcggcatttagtgtgtgtactgtcaatttccatgacaaggagtatggaacccttttagctgttggtactgcaaaggggctgcagtttttccctaaacggagtttagttgctggatatattcatatttatcgttttctggaagatggaaaatcccttgagcttttgcacaagacacaagtggaaggtgttcctcttgctttagctcagttccagggaagattacttgcaggactaggatctgtgctcagattatatgatttggggaaaagaagactgcttaggaaatgtgaaaataagttgttccctaatacaattgtgtctattcaaacatatcgtgatcgaatttatgttggtgacattcaagagtcattccattattgcaagtataggcgggatgagaatcaactatatatatttgctgatgattctgttcctagatggcttacagcatcatatcatgtggattttgacaccatggctggtgctgataagtttggaaatatctattttgtgcggctaccacaagatgtctcagatgagatcgaagaagatccaacaggtggaaagataaaatgggagcagggaaagcttaatggagctcctaacaaggtagaggagatcatacaatttcacatcggtgacgtggtcacatcgttgcaaaaggcatctttgattccagggggtggagaatgcattttgtacggtacagtgatgggaagcttgggagctttgcatgctttcacctcccgtgacgatgttgatttcttttctcacttggagatgcatatgaggcaggaacatccacctttatgtggaagagatcatatgggttatagatcagcttattttcctgttaaggatgtgatcgatggggatctgtgtgagcagttcccatcccttcccttagatatgcagagaaagattgccgacgaactggaccgtactccaggagaaatactgaagaaacttgaagaagtacgaaataagattatttaagggacaaaccgccaaaggacagagttgccgcagctagctttagatggagtttttaatggctttgaagctgacattaatgaagtgaaataacaacctttgcacttgtcactccatggttaaagcggcagaggaagcaaatgaccatctgatttgagaaagatgtgttcttcagggtactttcaataaaggaagtggcctttattgaggggtaatttttatcattctaatagggaaacagacactttcatcaagagaagaggtcaagcaagtgggatacttgcaaaatgtagaatggtaatgtcttagaatgtagttgtttatagatttagccacaattgttactgatgttattgagttaatattacacttatccttttcttcagagttctgccttttaaacgtaaagaagcctttttgttgataaatttgaggtggaatgttcaatctgatatgttttatgccctttgaggctttgaacaggatgggaatctcatgttctagtgtgaatgatggaggtgaagaagaattcatttt

SEQ ID NO: 1941 - DNA, 4145 bp, Nicotiana benthamiana
acaccaactgctactcccataatgtatctctacagtctcactctccaaaaacccaccggcatactctgcgccatcaacggcagcttttccggtggcaaagtacaagaaatcgccgtcgcccggggaaaagtcctcgacctcctacgccccgacgataacggtaagctccaaaccttattatccgtcgaaatcttcggcgctatacgctccctagctcaatttcgattaaccggtgcacagaaagattatattgtagtcgggtcggattcgggtcggatagtgatattagagtataataaagagaagaatgtttttgataaaattcatcaggagacttttggtaaatcgggttgtagacggatagttccgggtcagtatgtgggtattgacccgaaaggtagggctgttatgattggtgcttgtgagaaacagaagcttgtgtatgttttgaatagggatactgctgctaggttaactatttcatcgcctttagaagctcataagagccacacgattacgttctcgatttgtggtgttgattgtggatttgataacccgatatttgctgcgatcgagttggattacgcggaggcggatcaggatcctactggccaggccgcaaatgaggctcagaagcatttgacgttttatgaattagatttagggcttaatcacgtgtcgaggaagtggagtgaacaggttgataatggtgctaatttgctcgtgaccgtacctggtggtggggatggtccgagtggtgtgcttgtttgcgcggagaatttcgtgatatataagaatcagggacaccccgatggacaccctgatgttagggctgttattcccaggagggtggatttgccagcggaacgtggggttttgattgtttcagctgctatgcataagcagaagtcaatgtttttctttcttttgcaaactgaatatggagatatctttaaggtgacattggatcacgacaatgacagggttaaggagttaaagatcaagtactttgatacaattccagtcagttcttcgctgtgtgtcttgaagtcagggttcctcttttctgcgtcagagtttgggaatcatgcattgtatcagtttcaggcgataggagatgatcctgatgtcgaagcttcatcatcgacgttaatggaaactgaagaaggttttcagcctgtatttttccagccaagaaagctaaaaaatcttgttaggatcgatcagattgagagtttgatgccaatcatggacatgaaaatagtaaatctttttgaggaagaaactccacaaatattttcactttgtgggaggggtccccggtcttcgttgcgcatacttaggccaggtttagctgttagtgaaatggctgtgtcacagcttcctggtgttcctagtgctgtctggactgtaaaaaagaatgtcaatgatgagtttgatgcatacattgttgtatcttttgcgaatgcaactcttgtgctttctattggtgagacagtggaagaagttagcgacagtgggtttcttgatactactccatctcttgctgtttcattgattggtgatgattcattgatgcaagttcatcccagtggaataaggcatattagagaagatggccgtattaatgaatggagaactcctggaaagagaattattgtcaaggttggatctaataggcttcaagtggtaattgcactaagtggaggggagcttatatattttgaagtggatatgactggccagctgatggaagtcgagaagcatgagatgtcaggtgatgtagcttgtctggacattgcccctgttcctgagggaagacaaaggtcccgtttccttgcagttggatcatatgataacactattcgtatattgtcattggatcctgatgactgtatgcaggttctgagcctgcaaagtgtatcttcaccgccagagtctctcctttttcttgaagttcaggcctctattggtggagaagatggtgcagatcaccctgccagcctttttcttaatgctggtttacaaaatggggttttattcaggactgtggtggatatgataactgggcagctttcagatgcacgttcgcgtttcttggggcttagagcccctaagctcttttccattgttgtgagaggacggcgtgctatgctttgcttgtcaagtagaccgtggctaggttatatacaccaagggcattttcttttgacgcctttatcatatgagactcttgaatttgcagcctcattttcatcggatcaatgtgcagaaggtgtagtagcggttgctggggatgcgttgagggtcttcacgatagagagattgggcgagactttcaacgaaacagctatacctttaaggtatacaccaagaaggtttgttcttcaacctaaacggaagatggtgataatgatagagagtgaccagggagcatatactgcggaagagcgtgaagctgccaaaaaggagtgcttcgagacagctggaaatggtgaaaatggaaatgctgaacaagtggagaatggtgaagatgaagatggtaatgatccactatctgatgaacaatatggttatcccaagtcggagtcaggaaggtgggtttcctgcatcagagtccttgacccaaggtcaacacaaaccacttgtctgctagagcttcaggataatgaggctgcgtttagcatatgcactgttaatttccatgacaaggagcatggagctctgttagctgttggtactgccaagggccttcagttttggcccaaaaaatcgttggaagcagcatacattcatatatacaaatttaaagaagatgggaaggtccttgagcttttgcacaagacacaggtagatggtgtgcctcttgcgttatgtcagttccaaggaagactactagctggtgtggggtctgtccttaggttgtatgatttggggaagaaaagactgctcagaaaatgtgagaacaagctcttccccaactcaatcacatctatccatacctaccgtgatcggatttatgtgggtgacatgcaagagtcattccactactgtaagtatagacgtgatgaaaaccaactgtacatatttgctgatgacatggttccgagatggctaaccgcagcacagcatgtagattttgacacagtggcaggagctgacaagtttgggaatatctactttgtgcgattacctcaggatgtctcagatgagattgaagaagaccctactggtggaaaaataaaatgggagcaggggaagctgaatggagccccaaacaaggttgaggaaatagtgcagtttcatgttggtgatgtggtctcttgtttgcaaagagcatcacttattccaggagggggtgaatgtgtaatttacgggactgtgatggggagcgtcggggctatgcttccatttacctcgagggatgatgttgacttcttctctcatttggagatgcatttgaggcaggaattcccacctttatgtggcagggatcacatggcctacagatctgcctacttcccggttaaggatgtgatagatggagacttgtgcgaacagttcccaaccttgccaatggatatgcagcgcaaaattgcagatgagttggacagaacaccaggcgagatattgaaaaagcttgaagaaataagaaacaaaattatttgagaacatgtttagatcaaggtgatggtttgtcttaatcaatccaagggaacagtcatgtggcggcttaagagggagcatgctgcagagaggtatggatgtttcgtttgatttgagctttgtggatgcaagaaaagagactagcatgtactccaacctgtgctcactatagatgtatttgaagaaaagatgcagagttaattattgctcagattctctgttgtaattatgctgtagcgtagctagtcatttcaactgattttgtagcaatctaccgataactgaattgtgtatttccagtttgtttatgagaaatgtattcacgatgcagtgattgatcggctaactttaaatttgtggacttttctactgagttggattttcagtctcttggttacattattgatcatttcatctctcttaatcatctatgtactactctgtataggttaaatagctgcgttcaaataagctgtgcc

SEQ ID NO: 1942 - DNA, 4217 bp, Ricinus communis
ccttttaaaatgaaatatcttccctctcaaaacccctaaaatctcatcatttcttaacttctccaaaaccctaaccctaacttcccaaagctaaccatgtacctttacaatcttacactccaacgagccaccggcataatcaccgccataaacggcaatttctccggcggcaagacccaagaaattgtagtagctcgcgggaaagtcctcgatctcctgcgtcccgacgaaaacagcggtaaacttcaaacgattctctctgttgaaatctttggtgcaattcggtctttagctcaatttagactaaccggatctcaaaaagattatattgttgtcgggtcggattcgggtcggattgtaattcttgaatataataaagagagaaatgtgttcgataaaattcatcaagaaacctttggtaaatctggctgtagaagaattgttcctggtcaatatttagctattgaccctaaaggtagagctgttatgattggtgcttgtgagaaacagaagttagtttatgttttgaatagagatactgctgctagattaactatttcgtcccctttagaagcccataagtcgcataccattgtttattctatttgtggcgttgattgtgggtttgataatcccatatttgcggctattgagttggattattctgaagctgatctagattccacgggtcaagctgcaaatgaagcgcaaaaggttttgactttttatgagcttgatttaggacttaatcatgtgtctaggaaatggtctgagcaagtagataacggagcaaatatgcttgttacagttcctggtggtggggatggaccgagtggtgttttagtttgtgctgagaattttgtaatttataagaatgagggacatccggatgttagagctgttattccacgtcgtgcggatttgcctgctgaacgaggggtcttgattgtttctgcagctactcataggcagaagagcatgtttttctttctgctgcagacagaatatggcgatatattcaaggtgactttggatcatgagaatgataaggttaaagagttgaagattaagtattttgatacgattccagtaacttcgtcaatgtgtgtgatgaaattagggtttctctttgctgcatcagaatttgggaatcatgcattatatcagttccaagcgattggggaggaagctgatgtggaggcctcatctgctactttaatggaaactgaggagggtttccagcctgtattttttcagcctagaggattgaagaatcttgttaggattgatcaggttgagagcttgatgcctattatggatatgaagattgctaatctttttgatgaagaaacaccacagatattttcactttgtggccgtggtcctcgatcctccttgaggatattgaggcctggtttggccattagtgagatggctgtttcacagcttcctggtgtaccaagtgcagtctggactgtgaaaaagaatgtaaatgatgagtttgatgcctatattattgtctctttcaacaatgcaactcttgttctttcaattggagagacagttgaggaagtcaataatagtgggtttcttgatactacaccttcccttgctgtttctttgattggcgatgattctttaatgcaagttcacccaaatggtatcaggcatatcagggaggatggacgtataaatgagtggagaactcctgggaagaggaccattgtgaaggttggctccaatagagttcaagtggtcattgccttaagtggaggggagcttatttattttgaggttgatataactggtcagctaatggaagtggagaagcatgagatgtctggagacgtagcctgtctggatattgctccggttccagaaggaagacagaggtctaggttccttgcagttggttcattcgacaacaccatccgtatcttatctttggatcctgacgactgtatgcagatactgagtgtccaaagtgtttcatcacctccagagtcactcctcttccttgaggttcaggcatctgtaggtagggaggatgttgctgatcaccctgctagtcttttccttaatgctggtttgcaatctggtgttttattcaggacactggtggacatggtgactggccaactttctgattctcgttctcgatttttggggttgagggcacccaaactcttctccattcttgtgagaggacggcgtgcaatgttgtgcttatctagtcgaccctggcttggttatattcatcaaggacatttccttttaacacctctttcatatgaaactctcgaatttgctgcttcattctcatctgatcagtgtgcagaaggtgtggtggctgtcgctggggatgcattgaggatttttaccattgaaagattgggagaaacattcaatgaaactgcaatacctcttaggtatactccaagaaagtttgtgcttcaacctaagaagaaacttttggttatcgttgagagtgatcagggagcatatacagctgaggagcgtgaagctgcaaaaaaggagtgttttgaggctgctggaatgggggaaaatggaagtgccaatgctgagcagatggagaatggtgatgatgaagataaagatgatcccctctctgatgagcagtacggttatcctaaggcagaggcagagaaatgggtttcttgcatcagagtcttggaccctaggacagcagcaacaacttgtctgctagagcttcaagacaatgaagctgcatttagtgtgtgcactgtgaacttccatgataaggagcatgggacattgttagctgttggtactgccaagggactgcagttttggccgaaaagaagtttatctgctgggtttattcacatttataagtttgtagatgatgggagagccctggaacttttgcacaaaacacaagtggagggcgtaccacttgctttatcccagtttcagggaagactgcttgctggaatagggcctgttcttagactatatgacttggggaagaagaggttgcttagaaaatgtgagaataagctgttccctaacagtattgtctctattcaaacctatcgtgataggatttatgttggtgatattcaagagtcatttcatttttgcaagtataggcgggacgaaaatcagctctatatatttgctgatgattgtgttccaagatggctaaccgcatcacaccatgtagattttgatactatggcaggtgcagacaagtttgggaatatctactttgtgcggttgccacaggatgtctctgatgagatagaagaagatccaaccggtggaaagattaagtgggagcaagggaagcttaatggagcaccaaacaaggtggaggagatagtacagtttcatattggtgatgtggttacgagcctgagtaaagcatctctgattccaggtgggggggaatgcatcatttatgggacggtaatggggagtgttggggcactgcttccttttacctctcgagatgatgttgacttcttctcgcacttggagatgcatttaagacaggatcacccacctttatgtggaagagaccatatggcgtatagatctgcttattttccagttaaagatgtgattgatggggatctatgtgagcagttcccaacactgcctctagatgcacaaagaaaaattgctgatgaattggatagaactcctggagagatactgaagaaacttgaagaagttcgaaataagatcatttgaggaaggatacacgtgaaggtatttctttccaacagagttcattcagcaaaggatctctgcctactgtagctaaggtgagatgaagtgtgctcggtattgtcttagaattgccaatagatggcggaagaccttaatgcaaggaccagccttatggttaagagaaggcaacctcaaattctatattggttgggaatgaagcaggagtcggaataggcaaaatatcaacttacaagaggaatttctgtagatttaaaattatctgtctctgaatgttatctcttgattttgttacttcctatacgtgttaaagattttaatggataatgtagtgagtatgagcgtagataattcctattcctagattccttccatgaaaggttgcagtgtagcaaagctaaatcccagcctcttgggggtgtcggccaattaagagaatttatttagcaatcaaatgttttaagagattatgccaaagt

SEQ ID NO: 1943 - DNA, 4407 bp, Eucalyptus grandis
aaaaaccagtgaaaatgtcgagcacctgaagctcctccctccttctctctctctctttctctctctctctctctctagctgcagcagcagcagctctgacctccgaagcggttcgccatgtacctctacaacctcaccctgcagaaggccaccggcatcgtgtgcgccatcaacggcaacttctccggcgggaagtcccaggagatcgtcgtcgcccgcggcaagatcctcgacctcctccgccccgacgacagcggcaagatccagaccgtcctctccgtcgagatcttcggcgccgtccgctccctcgcccagttccgcctcaccggcgcccagaaggactacatcgtcgtcggctccgattccggccgcatcgtcatcctcgagttcaaccgggagaagaacgtcttcgacaaggtccaccaggagacgttcggcaagtccggctgccgccgcatcgtgccgggccagtacctcgccatcgaccccaaggggagggccgtcatgatcggggcctgcgagaagcagaagcttgtttacgtcctgaatagggatacggcggctaggttgacgatctcgtcgcccctggaggcgcacaagtcgcacaccataacgtactcgatctgcggggtggactgcggcttcgataacccgatattcgctgcaatcgagctggattacttggaggccgaccaggattcgaccggtcaggcggcgagcgaggcgcagaagcacttgacgttctatgagctcgacttggggcttaaccatgtgtcgaggaaatggtctgagcctgtcgataacggcgctaacatgctcgttaccgtgcctggaggaggcgatgggcctagcggagtgttggtatgtgcggaaaatttcgtgatttataagaaccagggtcacccggatgtccgcgcggtcattccgagacgagctgatttgccggcggaacgcggcgtgctgatcatctcggctgccacgcacaagcagaagtctatgtttttcttccttttgcagacggagtatggcgatatatttaaggccacgttggagcatgatggtgaacatgttcaggagttgaagatcaagtatttcgatacgattccggttacttcttcgatgtgcgttttgaaatcagggtttctgtttgcggcatctgagtttggaaaccatgctctgtatcagttccaggcgataggtgaagaagctgatgtggaggcttcgtcggctacgctaatggaaactgaagaaggtttccagcctgtgttttttcagcctagaggccttaaaaatcttgttaggattgaccaggttgagagcttgatgcccataatggacatgaaagtagagaacctatttgaggaagaaacacctcagatattcacattgtgtggtcggggtcctcgatcttctttgaggatactgaggccgggtttggccattagtgaaatggctgtttcacagcttcctggtgtaccgagtgctgtttggactgtgaagaagaatgcgattgatgagtttgatgcgtacattgttgtgtcatttgcaaatgcaactcttgtgctttcgattggcgagacagtcgaagaagtaagtgacagtggatttcttgacactacaccgtcccttgcagtgtccctcatcggtgatgattctttaatgcaagttcaccccagcggtatcagacatatcagggaagatggccgtattaatgaatggagaactcctggcaagaggactatagtgaaggttggttctaacaggctacaagtggtgattgctctcagtggaggtgaacttatatacttcgaggtggatttgactggtcagttgatggaggtggagaagcttgaaatgtctggagatgtggcttgcttggacattgctcctgtgccagaaggaaggcaaagatctcgttttcttgcagtcggttcatatgacaacactgttcggatcttatctttggatccagatgattgcttgcagattctgagtgtccagagtgtttctgcagctccagaatctcttctctttcttgaagtccaggcatcaattggtggggaggatggtgctgatcatcctgccagtcttttcctcaatgctggtttaagtaatggagttctgtttaggacagtcgttgacatggtgactggtcagctttccgactctcgctccagatttttggggcttagagccccaaagctcttttctattgtcatcagaggcaggcgtgctatgctttgcttgtctagtcgtccatggctaggttatattcatcagggacattttcttttgacacctctttcttatgaggctcttgaatttgctgcttcattttcatctgaccaatgtgctgaaggtgtggttgctgtggctggggatgcattgagggttttcactattgagaggttgggagaaacatttaatgagaccgcaattcctttgaggtacactcctagaaagtttgtatttcataaaaagaaatccctgattatcattgaaagtgatcagggggcattcactgcagaagagcgtgaagctgggaaaaaggaattctttgagggtgctgacatgggtgaaaatggaaataacaacggtgatcagatggaaaatggtggtgatgatgaggacaagaatgatgctctgtctgatgaacagtacggttatccaaaggcagagtctgacaagtgggtttcttgcatcagagtgcttgacccaaagacatctaacacaacctgtctgttggaacttcaggacaatgaagctgcatatagtgtatgcactgtgaacttccgtgagaaagagtatggaacattgttggctgtcggcacggcaaaaggattgcagttctggccaaaaagaagtgtggcttctggattcattcatatttataggtttgtggatgatgggagagcccttgaacttttgcacaagacgcaagttgaaggtgttcctctagctttatgtcagttccagggaaggttacttgctgggataggctcagtcctgaggctctatgatttgggaaaaaaaagattgcttagaaaatgtgagaataagttgtttcccaacacaattgtgtctattcaaacctaccgtgatcgaatttacgtgggcgatatgcaagagtctttccattattgcaagtaccgacgagatgagaaccaactatatgtatttgctgatgattctgtaccaagatgggttacggcatcacaccacattgattttgacactatggcaggagcagacaaatttggcaatgtttattttgtccgtttaccccaggatgtctcagatgagattgaagaggatccaaccggtgggaagataaaatgggaacaggggaagttgaatggagcgccgaataaagtagaagagatagtgcagtttcacgtaggtgatgtagtcacttgcttgcagaaggcatccctgattcctggtggaggagattctgtcatctacgggacagtaatggggagtttaggagcgttacttccatttacatctcgtgatgatgttgacttcttctcgcacttggagatgcatttgaggcaggaatacccccccttgtgtggcagagatcacatggcttacagatctgcttattttcctgtcaaggacgtgatcgacggtgatttatgcgagcagtttccaaccctgcctatggatttgcaaagaaaaatagctgatgaattggatagaacaccagcggagatcctaaagaaattggaagaagtgagaaacaagattatctgagaaatgggatagtcagcctgaagctcaacattccaggttcttccacatggattggtttgtgcgatgtggatgttacgcttggacacgagatgcatgggaattggctttgggtgtaaggatgctacagcatcggggtatgaacagggtaaattgctcggagagtttgaagttccctgttcttacacctctcgtttccgttaactgggctacttagcgaatctggatttacttctgatgatgtagtacttctctcactctctccccttctctgtctgtagcaatatttatgacctctggcttaggttcccttccttgaaaaagatgcttgtatctttgagtcgacatgaagttataactggcaaaggcttgttggaacttttgtaagagatccagaaatgaaatcagaatcctgtagatgatgccagcacttctctttcgagcattcgaacgaactgcgtctatcctaactagggcatctttgttaacaagtcgatgacatgaaaggattgctatttttttttcctcttgttttccttatgatttcttttggttaggtttatctcaatgctccattggctatctcgcagatgttctcacagtcagagataattcaggacatttttcttccctttgaatagtaaatctgta

SEQ ID NO: 1944 - DNA, 4203 bp, Gossypium raimondii
ctctcattttatttttgaactttaccgcaagaaaattcccactgtttcatttctcaatttactctcactcactcacacaaaagcttcgaatgaacctcttttaaaacaataaccctaaaacccccattccaaatctaaaaaaccctaactaccgccatgtatctctacaatttaactcttcaacaagccaccggcatcgtttccgccataaatggaaacttctccggcggtaaaatccaagaaattgtcgtcgcccgtggtaagatcctttcccttctccgccccgacgatctcggtaagctccaaacgcttctttccgtcgaaattttcggttgcatacgttccctagctcagttccggctaactggagctcaaaaggactacattgttgtagggtccgattcgggtcggatcgttatacttgaatacaataaagagaagaacgtctttgataaagttcaccaagaaacttttgggaaatctgggtgtcgccggattgttccgggtcaatacttggctattgacccgaaaggaagagctgtaatgattggtgcttgtgagaagcagaaattagtttatgttttgaatagagatactgctgctaggttaaccatttcttcacctttagaagctcataaatcacatacgattgtttactctatttgtggtgttgattgtggtttcgataaccctatttttgctgccatcgagttggattactcggaggctgatcaggattccacgggagtggctgctggtgaagcacagaagcatttgacgttttatgaacttgatttagggcttaaccatgtgtctcggaagtggtcggaacaggttgacaatggggcaaatatgttggtcacagtgcctggtggtggtgatgggccaagtggggttttggtttgcgcagaaaattttgttatctataagaatcaggggcatcctgatgttagagcggtgattcctagacgggctgacttgccagaagaacgtggtgttttgattgtttcagcggctacgcataagcagaagtcgatgtttttctttcttttgcagacagaatatggggatatttttaaggttacattggaacatggaaatgaaggagtttcggaattgaagattaagtattttgatacaattccggttacgtcttcaatgtgtgtgttgaaaactggttttctatttgcagcttcagagtttggcaatcatgctttgtatcagtttcaggctattggggatgaccctgatgtggaatcatcatcatctacattgatggaaacagaagaaggttttcagccagtgtttttccagccgagagggcttaagaatctagttaggattgaccaagctgagagcctgatgccaataatggacatgaaaattgctaatctcttcgaggaagaaacacctcagatattttcactttgtggacgtggtcctcgttcatcattgaggatactaaggcctggtttggccatcagtgagatggctgtttcacagcttcctggtgtcccaagtgctgtgtggactgtgaagaaaaatgttaatgatgcctttgatgcatacattgtcgtgtcatttgccaatgcaacacttgttctttccattggtgaaacagttgaagaagttagcgatagtgggtttcttgatactacgccctctcttgctgtttctttaattggtgatgattcactgatgcaagttcacccaaatggtattaggcatataagggaagatggacgtattaatgagtggagaacacctgggaaaaggacgattgttaaagttggttcaaatgggcttcaagtagttattgcattgagtggaggtgagcttatatactttgaggtggatatgactgggcaacttatggaagttgagaagcatgaaatgtctggagatgtggcgtgtctggacattgcccctgttcctgaaggaagacagaggtcccgtttccttgcagttggttcctatgataatacaatccgtatattatctttggatcctgatgattgtatgcaggttctgagtgttcagagtgtgtcctcacctcctgagtctctccttttccttgaagttaaggcatcggtaggtggtgaggatggtgctgatcaccctgccaatcttttccttaatgctggtctgcagaatggagttctgtttcggacggtagtggatatggttacggggcaactttctgattcccgttcacgtttcttaggcctaagagcccccaagttgttctctgttaaagtaagaggccgacctgcaatgctttgcttgtctagtcgaccatggcttggttatattcaccaaggacattttctgttaacacccctttcttacgagacacttgaatttgctgcctcattttcatctgatcagtgtgccgaaggtgtcgttgctgttgcaggggatgcattgagagttttcaccattgagcgacttggagaaaccttcaatgagaccgctattcctttgaggtatactcctaggaggtttgttttgcaaccaaagcggaaattgttggtaattattgagagtgaccaaggatcatatactgcagaagagcgtgaagctgcaagaaaggagtgctttgaggctgcaggaatgggagaaaatggtaacggcaatatgaaccaaatggaaaatggtggtgatgatgaggacaaagaggatcccctctctgatgagcagtatggttatcctaaggcagagtcaaacaagtgggtttcttgcattagagttcttgatccgaggactgcttccacaacttgtcttttggagcttcaggacaatgaagctgctttcagtgtgtgtactgtgaatttccatgataaagagtatggaactctgttggctgttggcacggccaagggtctgcagttttggcccaaaagaagcttaactgcgggattcattcatatctataggtttttagaagatggcagatcgcttgaacttctgcacaagacacaagtggaaggtgttcctcttgctttatgccaatttcagggaagattacttgctgggataggatcggtgctccgattatatgacctggggaaaaggagactgcttaggaaatgtgagaataagcttttccctaacactattatctctatccaaacttatcgtgatagaatatatgttggggacatccaagagtcattccatttttgcaagtataggagggatgaaaatcaactgtatatattcgctgatgatgttgttccgagatggcttactgcatcataccatatagattttgacaccatggctggtgcagacaagttcgggaatgtctattttgtgcggctaccacaagatgtctcagatgaaatagaggaagacccaactggtggaaagataaaatgggaacaagggaggctcaatggagctcctaacaaggtagaggagatagttcagttccatgtcggggatgtggtaactagtttgcagaaggcatctcttataccaggtggtggagagtgtgttctttatggaactgtaatggggagcttgggggcattgcttccgttcacttcccgtgatgatgttgacttcttttcgcacctagagatgcatatgaggcaggaacaccctcccttgtgcggacgagatcatatggcttacagatctgcttatttccctgtcaaggatgtgattgatggggatttgtgtgagcagtttccgaccctacctttggatctgcagagaaaaattgcagacgagttggaccgtactcctggggagatactgaagaaactcgaagaagcccgaaacaagatcatttgagatagcagatagcatcaaaggtcaagttctcttttacccggattgcgggaaaccaattgcggttaagaaggctttagcacgttggaatccaaggcagatgaggaagaaattggacgatggagtcgaaagtcaagaacacgagaccaagaatgggagtattgtataagtagttatgagacaaactagttgtgttagtagaggcaaaaaatcagtattagttgctgcagattcgagtatttgctgctgttattgcagttttaagattgttgtatgtttgttaatttgatagatagagattgatctctaatgccctcttctaacttggacttagcattgtgattttaaaattaaataaaaaggtaaaaaaaaactaatgaaaaatattaaaaggaaaaagaaaaa

SEQ ID NO: 1945 - DNA, 4128 bp, Solanum phureja
tatgtatctctacagtctcactctccagcaacccaccggcgtaatctgtgctatcaacggcaacttttccggcggaaaagtacaagaaatcgtcgtcgctcgtggaaaagtccttgacctcctacgtcccgatgataatggtaagcttcaaactctattatctgttgaaattttcggggctatacgttccttagcacaatttcggttaaccggtgctcaaaaggattacattgtagttgggtcggattcaggtaggatagtgatattggagtataataaagagaagaactgttttgataaagtacatcaggagacttttggtaaatcgggttgtaggaggatagttccaggtcagtatttggctattgacccgaaaggtagggctgtgatgattggcgcttgtgagaagcagaagcttgtgtatgttttgaatagggatactgcagctaggttaacaatttcgtcacctttagaagctcataagagccatacgattacgttttcgatatgtggggttgactgtggatttgataacccgatatttgctgctattgaattggattattcggaggcagatcaggatccgacaggccaagctgcaaatgaggctcaaaagcatttgacattttatgaattagatttaggacttaatcatgtttcgaggaagtggtctgaacaagtcgataatggtgctaatttacttgttactgttcctggaggtggggatggtccaagtggtgtgcttgtttgtgcggagaattttgtgatatataagaatcagggacaccctgatgttagggctgttattcccaggagggtagatttaccagcagaacgtggagttttgattgtttcggctgctatgcataagcagaagacaatgtttttctttcttttgcaaactgaatatggagatatctttaaggtgacattggaccacgacaatgacagggttaaggagttaaagatcaagtattttgatacaattccggtcacttcttctctgtgtgtgttgaagtcagggttcctctttgcttcgtcagagtttgggaatcatgcgttgtatcagtttcaggctataggagatgatccagatgttgaagcttcatcatcgacgttgatggaaactgaagaaggctttcaacctgtatttttccagccaagaaagctaaagaatcttgttaggattgatcagattgagagcttgatgccaatcatggacatgaaaatcgtaaatctttttgaggaagaaactccacaaatattttcactttgtgggaggggtcctcggtcttcgttgcgcatacttaggccaggtttagctgttagtgaaatggctgtgtcacaacttcctggtgttccaagtgctgtctggactgtgaaaaagaatgttaatgatgagtttgatgcctacattgttgtctcttttgcaaatgcaactcttgtactttctattggtgagacagttgaagaagttagtgacagtgggtttcttgatactactccatctctttctgtttcattgattggtgatgattcgttaatgcaagttcatcctagtggtataaggcatattagagaagatggccgtattaatgaatggagaactcctggaaagagaactattgtcaaggttggatctaatagacttcaagtggtaattgcactaagtggaggggagcttatatattttgaagttgatatgactggccagttgatggaagttgagaagcatgagatgtcaggtgatgtagcttgtctggacattgcccctgttcctgagggaagacaaaggtcccgtttccttgcagttggatcatatgataacactatccgtatcttgtcgttggaccctgatgactgtatgcaggttctgagcctgcaaagtgtatcttcaccgccagagtctctcctttttctagaagttcaggcctctgttggtggagaggatggtgcagatcaccctgccagcctttttcttaatgctggtttacaaaatggagttttattcaggactgtggtggatatgaatggtgggcagctttcagatgcacgttcacgtttcttggggcttagagcccctaagctcttctccattgttgtgagaggacggcgtgctatgctctgcctatcaagtagaccatggctaggttacatacaccaagggcaatttcttttgacacctttatcatatgagagtcttgaatttgcagcctcgttttcatccgatcaatgtgcagaaggtgttgtagcggttgcaggggatgcgttgagggtcttcacaatagagagattgggcgagactttcaatgaaacagctatacccttaaggtatacaccaagaaggtttgttcttcaacccaaaaagaagatggtgataatgattgagagtgaccagggagcatatactgcagaagagcgtgaagctgccaaaaaagagtgctttgaggcagctgggaatggtgaaaatggaagtgcagaacaaatggagaatggtgaagatgaggatggtagtgatccactatctgatgaacaatatggttatcctaagtcggagtcaggaagatgggtttcctgcatcagagtccttgatccaaggacaacacagaccacttgtctgctagagcttcaggataatgaggctgcatttagcatatgcactgttaatttccatgacaaggagcatggagctctgttggctgttggtactgccaagggcctccagttttggcccaaaaaatcgtttgaagcagcatacattcatatatacaaatttaaagaggatgggaaggtcctagagcttttgcataagacacaggtagatggtgtgcctcttgcactatgtcagttccaaggtagactgctggctggtattgggtctgtccttaggttgtatgatttggggaagaaacggctgctccgaaaatgtgagaacaagctattccccaactcgatcacagctatccacacctatcgtgatcggatttatgttggtgacatgcaagagtcattccactactgtaagtataggcgtgatgaaaatcaactgtacatatttgctgatgacacggtcccgagatggctaactgcagcacagcatgtagattttgacactgtggcaggagctgataagtttgggaatatctactttgtgcgattatctcaggacgtttcagatgagattgaagaagatcctactggtggaaaaataaaatgggagcaggggaagctgaatggagccccaaataagcttgaggaaatagtacaatttcatgttggtgatgtggtctcttgcttgcaaaaggcatcacttattccaggagggggcgaatgtataatctacgggactgtgatggggagtgttggggcaatgcttccatttacctcgagggatgatgttgacttcttctctcatttggagatgcatttgaggcaggagttcccaccgttgtgtggcagggatcacatggcctacagatctgcctacttccctgttaaggatgtaatagatggagacttgtgtgaacaattcccaaccttgcccatggatatgcagcgcaaaattgcagatgagttggataggacgccaggcgaaattctgaaaaagcttgaagaaataagaaacaaaattatttgagaacatgtttagatgaaggtgatgattttagtcgtatccaagccaagggacactcacgtggcataagaaggcgtgctacagagagctatggatgttccatttgatttgagcttttgtagatgcaagaaaagagaccagcatgcgctccaagctgttgctcactatagacgtatttgaagaaacaaagcggagtgaatcatcgcccagcttctctgttgtaattatgctgtagcgtagcctagtcctttcaactgaattttttagcaaattgcccgttaactgaaattatgtatttccagtttgtgtccatgaaatgtagtcacgatgcagagattgaatacttgctttaaatttgtgaaggtctcttctactgatgggttttcgtagtctttaagggtgaggtaatgacgtgcgatatccctaaaagtgtctgaccttgaatttttgtcctcgttttataaatcacgaagatgaaaaaaaaaatcatttag

SEQ ID NO: 1946 - DNA, 4235 bp, Solanum lycopersicum
aaaaaaatttcatttctgaatctcacttctcctttctttcttctcactcaaaaccctaaatctcacaaactagggttttagcagtatgtatctctacagtctcactctgcagcaacccaccggaataatctgtgctatcaacggcagcttttccggcggaaaagtacaagaaatcgtcgtcgctcgtggaaaagttcttgacctccttcgtcctgatgataatggtaagcttcaaactctattatctgttgaaattttcggggctatacgttccttagcacaatttcggttaaccggtgctcaaaaggattacattgtagttgggtcggattcaggtagaatagtgatattggattataataaagagaagaactgttttgataaagtacatcaggagacttttggtaaatcgggttgtaggaggatagttccgggtcagtatttagctattgacccaaaaggtagggctgtgatgattggtgcttgtgagaagcagaagcttgtgtatgttttgaatagggatactgcagctaggttaacgatttcgtcgcctttagaagctcataagagccatacgattacgttttcgatatgtggggttgactgtggatttgataacccgatatttgctgctattgaattggattattcggaggcagatcaggatccgacaggccaagctgcaaatgaggctcaaaagcatttgacattttatgaattggatttaggacttaatcatgtttcgaggaagtggtctgaacaagtcgataatggtgctaatttacttgtgactgttcctggaggtggggatggtcctagtggtgtgcttgtttgtgcggagaattttgtgatatataagaatcagggacaccctgatgttagggctgttattcccaggagggtagatttgccagcagaacgtggagttttgattgtttcggctgctatgcataagcagaagacaatgtttttctttcttttgcaaactgaatatggagatatctttaaagtgacattggaccacgacaatgacagggttaacgagttaaagatcaagtattttgatacgattccagtcacttcttctctgtgtgtgttgaaatcagggttcctctttgcttcgtcagagtttgggaatcatgcattatatcagtttcaggctataggagatgatccagatgttgaagcttcatcatcaacgttaatggaaactgaagaaggctttcagcctgtatttttccagccaagaaagctaaagaatcttgttaggattgatcagattgagagcttgatgccaatcatggacatgaagatcgtaaatctttttgaggaagaaactccacaaatattttcactttgtgggaggggtcctcggtcttcgttgcgcatacttcggcctggtttagctgttagtgaaatggctgtctcccagcttcctggtgttccaagtgctgtctggactgtgaaaaagaatgttaatgatgagtttgatgcctacattgttgtctcttttgcgaatgcaactcttgtgctttctattggtgagacagttgaagaagttagcgacagtgggtttcttgatactactccatctctttctgtttcattgattggtgatgattcgcttatgcaagttcatcccagtggaataaggcatattagagaagatggccgtattaatgaatggagaactcctggaaagagaactattgtcaaggttggatctaatagacttcaagtggtaattgcactaagtggaggggagcttatatattttgaagttgatatgactggccagttgatggaagttgagaagcatgagatgtcaggtgatgtagcttgtctggacattgcccctgttcctgagggaagacaaaggtcccgtttccttgcagttggatcatatgataacactatccgtatcttgtctttggaccctgatgactgtatgcaggttctgagcctgcaaagtgtatcttcaccgccagagtctctcctttttcttgaagttcaggcctctgttggtggagaagatggtgcagatcaccctgccagcctttttcttaatgctggtttacaaaatggtgttttattcaggactgtggtggatatgaatggtgggcagctttcagatgcacgttcacgtttcttggggcttagagcccctaagctcttctccattgttgtgagaggacggcgtgctatgctctgcctatcaagtagaccatggttaggttacatacaccaagggcattttcttttgacacctttatcatatgagagtcttgaattcgcagcctcgttttcgtctgatcaatgtgcagaaggtgtggtagcggttgcaggggatgcgttgagagtcttcacgatagagagattgggcgagactttcaatgaaacagctatacccttaaggtatacaccaagaaggtttgttcttcaacccaaaaaaaagatggtgataatgattgagagtgaccagggagcatatactgcagaagaacgtgaagctgccaaaaaagagtgctttgaggcagctgggaatggtgaaaatggaaatgcagaacaaatggagaatggtgaagatgaggatgatagtgatccactatctgatgagcagtatggttatcctaagtcggagtcaggaagatgggtttcctgcatcagagtccttgatccaaggacaatgcaaaccacttgtctgctagagcttcaggataatgaggctgcatttagcatatgcactgttaatttccatgacaaggagcatggagctctgttggctgttggtactgccaaaggcctccagttttggcccaaaaaatcgtttgaagcagcatacattcatatatacaaatttaaagaggatgggaaggtcctagagcttttgcataagacacaggtagatggtgtgcctcttgcactatgtcagttccaaggtagactgctggctggtattgggtctgtccttaggttgtatgatttggggaagaaacggctgctccgaaaatgtgagaacaagttattccccaactcgatcacagctatccacacctatcgtgatcggatttatgttggtgacatgcaagagtcattccactactgtaagtataggcgtgatgaaaatcaactgtacatatttgctgatgacacggtcccaagatggctaactgcagcacagcatgtagattttgacactgtggcaggagctgataagtttgggaatatctactttgcgcgattatctcaggacgtttcagatgagattgaagaagatcccactggtggaaaaataaaatgggagcaggggaagctgaatggagccccaaataagctcgaggaaatagtacaatttcatgttggtgatgtggtctcttgcttgcaaaaggcgtcacttattccaggagggggcgaatgtataatctacgggactgtgatggggagtgttggggcaatgcttccatttacctcgagggatgatgttgacttcttctcacatttggagatgcatttgaggcaggagttcccaccgttatgtggcagggatcacatggcctacagatctgcctacttccctgttaaggatgtaatagatggagacttatgtgaacaattcccaaccttgcccatggatatgcagcgcaaaattgcagatgaattggataggacaccaggcgagattctgaaaaagcttgaagaaataagaaacaaaattatttgagaacatgttgagacgaagtcgtatccaagccaagggacactcgcgtggcattagaaggcatgatgtagagagctatggatgttccatttgatttgagtttttgtagatgcaaggaaaagagaccagcatgcgctccaagctgttgctcactatataagtatttgaagaaacgaagcagagtgaattatcgcccagcttctctgttgtaattatgctgtagcgtagcctagtcttttcaactgatttttttagcaaattgcctgttaactgaattatgtatttccagtttgtgtccatgaaaaaatgtagtcacgatgcagagattgtatacttgctttatatttgtgaacgtctgttctactgatgagttttcgtagtctctaagggcgagtaaacgatgtgcagtgaccctcgttgaattgttcggacgaactgttgttgcaaatcagacatggtgtccctagaacttatgtctgatattgttgcaatttttgcctatgagattgttttgtag

SEQ ID NO: 1947 - DNA, 4312 bp, Mimulus guttatus
tctcagaaaccccatctcccttcttcacttcacttcttcggagctcaccaattcttcaatcaccatgtacttgtacagcctaactcttcaaaaagccaccggaatcatttgcgccatcaacggcaacttctccggcggtaaatctcaagaaatagttgtcgcgcgtggcaaagtcctcgatctactccgccccgacgaaaatggtaagctccaatcccttctatctgttgaaatcttcggcgctattcgctccttagctcaatttcgcctcaccggcgcgcagaaagactacatcgttgtcggctcagattccgggcgcattgttatcctcgaatacaataaggaaaagaacaccttcgaaaaaattcaccaggaaacttttggtaaatctgggtgccggcggattgtccctggtcaatacttggccgttgaccccaagggtagggctgtaatgattggtgcttgcgagaagcagaagctcgtttatgttctgaacagggatacttcggctaggttgactatttcgtcgcctcttgaggcacataagagccacactatagtttattcgatttgtggggttgattgtgggttcgacaaccctatatttgcagcaattgaattggattattccgaggctgaccaggatcccactggacaggcagccaacgaggcgcagaagctattgaccttttatgaattggatttgggtcttaaccatgtttcgaggaaatggtccgagcaggttgataatggtgctaatttgcttgtgactgtgcctggtggtggagatggaccgagtggtgtgctcgtttgtgcggaaaattttgttatatataagaatcaagggcatccagatgtaagagcggttattccgagacgagaggacctgccagctgagcgtggggtgttgattgtctctgctgccatgcataagcagaaaaccatgtttttctttcttctgcaaactgagtatggtgatatttttagagtgacgttggaccacgataatgatagagtgaaagagttgaagatcaagtattttgatactattcctgtgacttcttcgctatgtgtgctgaagtcggggttcctttttgccgcgtcagagtttgggaaccatgccttgtatcagtttcaggctataggagatgatccagatgtagaggcctcgtcggctacactgatggaaaccgaagaaggttttcaacctgtttttttccagccgaggaaactgaagaatctagtcaggattgaccaggttgagagcttgatgtcgatgatggatatgaaagtttcaaacctctttgaagaagaaacccctcagatatttacactttgcggacgtggtcctcggtcatctctccggatattgaggccaggtttagctatcagtgaaatggcagtgtcacagttacctggtgttccaagtgctgtctggacagtgaaaaagaatgtcaacgatgaatttgatgcttatattgtcgtttctttcgcaaatgccactcttgtgctttccatcggtgagactgttgaagaagttagtgatagtggatttctcgacacaacaccttccctctccgtgtctttgattggggatgactctctaatgcaagtccatccaagcgggattagacatatcagagaagacgggcgtattaacgagtggagaactcctgggaagagaacgattgttaaggttgggtctaatagacttcaggttgtcattgctctgagtggtggggagcttatatattttgaagttgatatgactgggcagctgatggaggttgagaagcatgaaatgtcaggagatgttgcctgtttggatattgcccctgtccctgaaggaagacagagatcacggttccttgccgttggatcttacgacaatactatccgcatcttatctttggatcctgatgattgtatgcagattcttagcctgcaaagtgtttcttctcctcctgagtctctcctctttcttgaagtccaggcttctattggaggggaggatggagcagatcaccctgccagcctctttcttaatgctggtctacaaaatggtgtcttattcaggacagtagtggatatggtgactggtcagctttcagatgcccgctctcggttcttaggactcagagcaccgaagctcttctctattgctgtgagagggcgaagggctatgctttgcttgtccagtagaccttggctcggttatatacaccaaggacacttcctcctgacacctctgtcgtacgagactcttgaatttgctgcttcattttcatcagatcagtgtgcagaaggtgttgttgctgttgctggtgatgctttaagggttttcaccattgagagactgggagaatcgtttaacgaaactgctatacctttgaggtataccccgagaaagtttgtacttcaccccaaacgcaagctgttggtaacaattgagagtgaccagggagcatttactgcagaagagcgtgaagctgcgaaaaaagaatcatttgaagcggctggaatgggagaaaatgggaacgcaaatcagatagagaatggtgacgatgaggataacagtgatccactttccgatgaacagtatggttatccaaaggcagagtctggaaagtgggtttcttgcatcagagttctggatccaaggacagcacaaacgacctgtctactggagcttcaggacaatgaagctgccttcagcatgtgcactgtaaatttccatgataaggagtatggaactcttttagcagttggtacagcaaagggcctgcagttttggcccaaaagatcctttgaagctggatttatccatatatataggtttaaggaagatggaaaggtccttgaacttctgcacaagactcaagtggaaggtgttcctcttgcgttgtgccaattccaagggagattgctagctgggataggaccaatactcagattgtatgatttggggaaaaggaggttgctgaggaagtgtgagaataagctgtttccgaactctatcacctctatccacacttaccgtgatcgaatctttgttggtgatatgcaagagtcgttccactactgcaagtacagacgtgatgaaaaccagctgtacatatttgctgatgacactgttccaagatggctcactgcagcacaccacatagactttgacacaatggcaggcacagacaaattcggaaacgttttcttcgtacggttaccacaggatgtgtcagacgagatcgaagaagatccaactggtggtaagattaaatgggagcaagggaagttaaatggggctccaaacaaagtagaggagatagtccaattccacgtcggtgatgttgtcagttgcttgtataaggcaactctgattccaggcggtggagagtgcattttatacggaacggtaatgggcagtttgggcgcctttcttccattcgcttcgcgtgatgatgttgactttttctcccatttggagatgcacatgaggcaggagcatccacctttatgtggcagagatcacatggcctacagatcttcctatttccctgtgaaggatgtgattgatggagatttgtgtgagcagttcccaactttgccaatggatatgcaacgtaaaattgccgatgagctggatagaactcctggggagattttgaagaaactggaagaaataaggaataaaataatttgaggtaatgctcttggcaatggaaaaagtcttccgaaccattgaatttgaattatctgtgactttttaaattagtgttttgtcttctaattatttggttaaagatttatgtatcgttcctttggtgtaatagttcactgttttccgtgtatcaagtttcggcatgacatttagttgctatatcattttgatacaggttattactcgtgtgcttcttctgttcattgatttgaaatatgacagacatggcgaaagtgttatagccggattgtgccatatgtttcatagaaaaccggtctccaaacgcaagcgtggcatggaagagacaatgtaagaaaacagggaagtggatgttgtagctccaacttgcttagcaacggattaatatatattatgcctttttcttttcttttttttctcttcttttttgcgtgtgtaatttaaggtagtgtaattgcgctctcagttgactagtcaaccatagactaatatatttattttgaacttatttttctctacaagttacaatttgagagttttcttgtgtaaattttcacaatcagagtttctttgatttattaataataaaaagaatcgaaaactttgaaatcacat

SEQ ID NO: 1948 - DNA, 4297 bp, Phaseolus vulgaris
agaagtgaatggaagggaagcatagccaaaccccaaatagggtttttattcccgctcttccatcttcttcacccgtgaggactctcttactgtgaatgttcaattgaaaccaaaaccctaaattaaaccctaaccaacctacgccatgtatctctacagtctcactctgcagcgtcccaccggcatcatctgtgccatcaatggcagcttctccggcggcaagagccaggaaatcgtcgtcgcccgtggcaaggtcctcgatctcctccgtccagacgacaatggccggatccaaaccatcctctcagtcgaaatcttcggcgtcattcgctccctcgctcagttccgcctcatgggagctcagaaggactacatcgtcgtcggctccgactccggccgcatagtaatcctcgaatacaacaaagagaaaaacgtattcgacaaagtgcaccaagaaaccttcggaaaatctggttgccgcagaattgtcccaggtcagtacctcgccatcgatccaaagggtagggccgttatgattggagcctgcgagaagcagaaactcgtttatgttttgaatagggacactgctgctaggttaaccatttcttcccctttagaggctcataaatcgcacactttagttttttcaatttgcggcgttgattgtggctttgaaaaccctatttttgctgctattgaattggactactctgaggccgaccaggattccactggtacggctgcttctgaggctcagaagcatttgacattttatgagcttgatcttgggctcaaccatgtttcccggaagtggtctgagcaggttgataatggggccaatttgcttgttactgttcctgggggaggtgatggccccagtggggtgcttgtttgtgctgaaaattttgttatttataagaatcagggtcatccggatgttagggctgtgattccgcggcgggacgacttgccagctgagcgtggcgtgcttattgtctccgctgccatgcataaactgaagagcatgttcttcttcctcctgcagacggagtatggggatatttttaaggtcacattggagcacagtaatgaccgtgtatccgaattgaagattaaatattttgatactattcctgtgactgcttcgatgtgtgtgctgaagtcagggttcttgtttgctgcctcagagtatgggaaccatgctttgtatcaatttaagtctataggggatgaagatgatgtggaggcatcatcttctacgctgatggaaaccgaggaaggttttcagcctgtgtttttccagcccaggaggctgaaaaacctcgtcaggattgaccaggtcgagagtttaatgccaataatagatatgaaggtcagtaatctctttgaagaggaaactcctcagatttttactctctgtggacgcggtcctagatcctctttgaggattttgagaactggtttagcggttagtgagatggctgtatccaagcttcctggtgtaccaagtgctgtttggacggtgaagaagaacgttattgatgagtttgatgcttacattgttgtgtcattcacaaacgctactcttgtgctttccattggtgagactgtcgaagaagttagtgacagtgggtttcttgacactactccctcccttgctgtttctttgatcggagatgattctctcatgcaggttcacccaaatggtatcaggcatatcagggaggatggccgtattaatgaatggagaacgcctggaaagaggacaatctcaaaagttggatcaaatagacttcaagtggttattgcactcagtggaggggagcttatatattttgaagtagatgtaactggtcagttgatggaggtggagaagcatgaaatgtctggagatgttgcttgtttagacattgctccagttccagaaggcagacaaagatctcgatttctcgcagttggttcatatgacaagaccatccgcattttatcactggatcctgatgattgtatgcaagcactaagtgttcagagtgtttcttcacctccagagtctctactttttcttgaagttcaagcttctgttggtggtgaggatggtgcagatcatcctgctagccttttcttgaatgctgggctacagaatggtgtgttgtttagaactgtggtggatatggttacaggtcagctttctgattctcgttctcggttcttaggattgagagccccaaagctgtttcccatcattgtgagaggcaagcgggctatgctttgtttgtctagtcgaccttggcttggttacattcaccaaggacatttccttttaacacccctttcatatgaaacccttgaatatgctgcttcattttcatctgaccagtgtgtggaaggtgtagttgctgtagctggggaggccttgagaatttttaccattgaaaggttaggagaaacatttaatgaaactgtaattccattaaggtacacaccaaggaagtttgtgctgcaacccaaacgaaaactcctggtgatgattgagagtgatcagggagcattaactgcagaagagcgtgaagctgctaggaaagagtgttttgaggctgctcaagccggggagaatggtactggaagtgcagaccaaatggagaatggtggtgatgatgaagataaagatgatcccctatcagatgagcactatggttatccaaaagctgaatcagagaaatgggtttcatgcatcagagttcttgatccaaggacaggaaatacaacttgtcttttggagcttcaggagaatgaggctgctttcagcatatgcacagtaaatttccatgataaggaatatggaacccttttagctgttgggactgcaaagggactgcaatttttgcccaaaaggactgtaactgcaggatttattcatatttataggtttgtagaggatggaagatctcttgaacttcttcacaaaacacaggttgaaggtgttcctcttgctctgtgtcagtttcaaggaagattacttgcagggataggacctgtgcttaggctatatgatttgggaaaaagacgtctgttgagaaaatgtgagaataagctattccccaacacaattgtctctattcagtcatatcgtgatcggatttatgtgggtgatgttcaagagtctttccattactgcaaatataggcgggacgaaaaccaactttacatattcgctgatgattgtgttccaaggtggcttactgcatcgtaccacatagattttgacaccatggcaggtgcagacaagtttggaaatatctattttgtgcggctgccacaggatgtttcagatgagatagaagaagatcctactggtggtaggatcaagtgggagcagggaaagctgaatggagctcccaataaggtggaagaaattgtacagtttcatgttggtgatgtggtcacatgcttgcaaaaggcttctcttataccaggtggtggagagtgcattgtatttggaacagttatgggaagtgttggggcactacatgcctttacttcacgagatgatgtcgacttcttttctcatctggagatgcacatgaggcaggatcacccacctttgtgtggaagagaccacatggcatatagatctgcatattttcctgttaaggatgttattgatggggatctatgcgagcaatttccaacattgccaatggatttgcagagaaaaattgctgatgaattggacagaacccctggagagatactgaagaaacttgaggaagtgagaaataagattatttaagaaatggttgcatgaaaggtgatagtggaaatgtgtttttctagtaggtcatttgcccgccgcagataggtcaaatactaacaaagtgaagtaagcttgtgtatctcattaatacgggaaaggtgatttcttgtcctatttaattcgagggggatgaagggacctgacgataaatctgctctgtattggagtcaaacccacaagcctcagttggcaatttatgttgtaattagtcgtagttaactgttatcacgctttgtggatgtgataacgtgccacatcacttcttatctacaactcactcagcaacctgtcttttactcgatgagatgtttgatttaactggatttgaaagttagtgtagaatatcactgcttttaccatttcaacgagaagttggttctggttagttttccaaaatttaatgccattgcatttaatgtacctatcaaaattcatcctcaaacattatgcattaaaagaatgattacagaaatatttatttta

SEQ ID NO: 1949 - DNA, 4161 bp, Gossypium raimondii
tttacccaaaaaaaccaaagagagggaaaaatcatctcactgtgtcttcgtttcatttctcaattcactctcctcaaagctttggagatgtaccaaaaaccctaacccctaaccagcaatgtatctctacaacttaactcttcaacaagccaccggcatcgtctccgccataaacggaaacttctctggcggcaaagtccaagaaatcgtcgtcgcccgtggcaagatcctttcccttctccgtcccgacgatctcggtaagctccaaacacttcactctgtcgaaatctttggctgcatacgttctttagctcaattccggctaaccggcgcccaaaaggactatattgtagtagggtcggattctggtcggatcgttatccttgaatacaataaagaaaagaacgtttttgataaagttcaccaagaaacttttgggaaatctggatgtcgccggattgtcccgggtcagtacttagctattgaccctaaaggaagagctgtaatgattggtgcttgtgagaaacagaaattagtttatgttttgaatagagatactgccgctaggttaaccatttcgtcacctttagaagctcataagtcacatactattgtttattcgatttgcggtgttgattgtggcttcgataaccctattttcgcttccattgaattggattactcggaggctgatcaggattccacgggacaggctgctaatgaggcgcagaagcatttgacgttttatgaactcgatttagggcttaaccatgtgtctaggaagtggtcagaacaagttgataatggggcaaatatgttggtcacggtacctggtggtggtgatgggccgagtggggttttggtttgtgcagaaaacttcgttatttataagaaccaggggcatccggatgttagggccgtcattcctagacgtgctgacttgccggcagaacgtggtgttttgattgtttctgcggctactcataagcagaaatctatgttcttcttccttttgcagacagaatatggggacatttttaaggttacactggaacatggaaatgaaggagttacagaattaaagattaaatattttgatacaattcctgttacagcatcaatgtgtgtgttgaagactggtttcctatttgcagcttcggagtttggaaatcatgctttatatcagtttcaggctattggagatgaccctgatgttgagtcctcgtcatctactttgatggaaactgaagaaggtttccagccagtgtttttccagcctagagggcttaagaatctagttagaattgaccaagctgagagcctgatgccaataatggatatgaaaatttctaatctctttgaggaagaaacacctcagatattttcactctgtgggcgtggtcctcgttcatctttgaggatattaaggcccggtttggccatcagtgagatggctgtctcacagcttcctggtgtcccgagtgctgtgtggacggtgaaaaagaatgttagtgatgcctttgatgcgtacattgtagtgtcatttgccaatgctactcttgttctttccattggtgaaacagttgaagaagttagtgatagtggttttcttgataccactccttctcttgctgtttccttgattggtgatgattcactaatgcaagtccaccctaatggtatcaggcatataagggaagatgggcgtattaatgagtggagaactcctgggaaaaggacaattgttaaggttggctcaaatgggcttcaagtggttattgcattgagtggaggggagcttatatactttgaggtggatatgactgggcaattaatggaagtggagaagcatgaaatgtctggagatgtggcttgtcttgacattgcccctgttcctgaaggaagacagagatcccgttttcttgcagtgggttcatatgataatacaattcgtatattgtctttggatcctgatgattgtatgcagattctgagtgttcagagtgtgtcctcgcctcctgagtctctccttttccttgaagttaaggcatcagttggtggggaggatggtgctgatcaccctgccaatcttttccttaatgctggtttgcagaatggagtgttgttccgaacggtagtagatatggttacagggcagctctctgactcccgttcacggttcttagggctgagacccccaaagttgttctctgttaaagtgagaggccgacctgcaatgctttgcttgtccagtcggccatggcttggttatattcatcaaggacattttctgctaactccgctttcttatgagacacttgaatttgctgcctcattttcatctgatcagtgtgctgaaggtgttgttgctgttgctggggatgcattgagggttttcaccatcgagcgtcttggagaaacctttaatgagactgctattcctttgaggtatactcctaggaggtttgtcatgcaaccaaagaggaaattattggtaattatcgagagcgaccaaggatcatatactgcagaagagcgtgaagctgcgagaaaggagtgctttgaggctgctggaatgggtgaaaatggtaatggtaatgtgaatgaaatggaaaatggcggtgatgacgaggacaaagaggatcccctctctgatgagcagtatggttatccaaaggcagagtcgaacaagtgggtttcttgcattagaattcttgatccgaggactgctaccacaacttgtcttctggagcttcaggatagtgaagctgctttcagtgtatgcaccgtgaatttccatgataaagagtatggagctctcttggctgttggaactgccaagggcctgcagttttggccgaaaaaaagcttagttgcgggatttattcatatttataggtttctcgaagatggcaggtcacttgaacttttgcacaagacacaagtggaaggtgttcctcttgctttatgccagtttcagggaaggttacttgctggaataggatctgtgctccgattgtatgacttggggaaaaagagattgcttagaaagtgtgaaaataagcttttccctaacactattgtctctatccacacttaccgtgatcgaatatatgttggggacatccaagagtcattccatttttgcaagtacagaagggatgaaaatcaactgtatatttttgctgatgatgttgttccaagatggcttactgcatcataccatatagatttcgacaccatggctggtgcagacaagtttgggaatgtctattttgtgcggctaccacaagatgtatcagatgagatagaagaagacccaaccggtggaaagataaaatgggaacagggaaggctcaatggagctcctaacaaggtagaggagattgttcagttccatattggagatgtggtaacttgcttgcagaaggcatctctgataccaggtggtggagagtgtgttctttatggtacagtaatggggagcttgggggcattgcttccattcacttcccgtgatgatgttgacttcttttctcacctagagatgcatatgagacaggagcacccgcccttgtgtggacgagatcatatggcttatagatctgcatatttccctgtcaaggacgttattgatggggatttgtgtgagcagtttcctaccctacctttggatttgcagagaaaaattgcagatgagttggatcggactccaggggagatattgaagaaacttgaagaaatccgaaacaagattatctgagatagctaacggcatcgtgttaaagtgtacctggagttgtcagcaagagttgccggtagtcagtcgtggtgtcagagttgtgaggagcaattgcacatggcaagtcaagttgaaaacgcgaggtaacgagtcaagtcgagaagactaggcaactgagggggataattttatataatcaaacaaactagttggcgttagaagcaaaaaattagtgttagtattcgtagagatgacatttgttgttgtaattagttgggatcatcttgtgaatttgtatgatatattttgaagtttgatgttcacgcttcggttttgttttaaaaggaaaatatccagtcgtcgttgatagtcgaattgactcaaattaaatttctcccatgcaacattggttcagtttt

SEQ ID NO: 1950 - DNA, 4344 bp, Glycine max
ggaaacccaaatcaaacgaaaccccaggtagggtttttaattcccgctttgctcactcacactgataacgagtcgagtgagtctctcttcaattttcacaccatccgcgactctgttcaattgaaaccacaaaaccctaacctaaaccctaacgaaccaaccgcaccgtcatgtatctctacagtctcactctgcagcgtcccaccggcatcatctgcgccatcaacggcaacttctccggcggcaagagtcaggaaatcgtggtggcccgtggcaaggtcctcgatctcctccgccccgacgacaacggccggatccaaaccatcctctccgttgaaatcttcggcgccatccgctccctcgcccagttccgcctcatgggtgcccagaaggactacatcgtcgtcggctccgattccggtcgcatcatcatcctcgaatataacaaggagaagaacgtcttcgacaaaatccaccaagaaaccttcggcaaatccggttgccgacgaattgtccccggccagtacctcgccatcgatcccaagggtagggccgttatgattggcgcctgcgagaagcagaaacttgtttatgttttgaatagagacaccgctgctaggttaaccatttcttcccctttagaggctcataaatcccacactttagtttactcaatttgtggcgttgattgtggctttgagaaccctatttttgctgctattgaattggattactccgaggctgaccaggattccactggccaggctgcttctgaggctcagaagcatttgaccttttatgagcttgatcttggccttaaccatgtctctaggaagtggtctgagcaggttgataatggggcgaatttgcttgttactgttcctggaggtggtgatggccccagtggtgtgcttgtttgtgctgagaattttgttatttataagaatcagggacatccggaggttagggctgtgattcctcggcgggccgacttgccggctgagcgtggcgtgcttattgtgtcggctgctatgcataaattgaagaacatgttcttcttcctcctgcagacggagtatggggatatttttaaggtcaccttggaacacaataatgatcgcgtctcggagttgaagattaagtattttgatacgattcctgttacagcttcaatgtgtgtgctgaagtcggggttcttgtttgcagcgtcggagtttgggaaccatgctctgtatcagtttaagtctataggggatgatgatgatgtggaggcatcgtctgccacgttgatggaaactgaggaaggttttcagcctgtgtttttccagcccaggaggctgaagaaccttgttaggattgaccaggttgagagtttgatgccgatcatggatatgaaggtcagtaatctctttgaagaggaaactcctcagatttacactctctgtgggcgtggtcctcgatcctctttgaggatcctgagaactggtttagcagttagtgagatggctgtgtccaagcttcctggtatacctagcgctgtttggacagtgaagaagaatgttattgatgagtttgatgcatacattgttgtgtcattcacaaacgctacacttgtgctgtccattggtgagactgttgaagaagtcagtgacagtgggtttcttgacactactccctcccttgctgtttctttgataggagatgattctctcatgcaggttcacccaaatggtattaggcatattagggaggatggccgtattaatgaatggagaactcctggaaagaggagtatttcaaaagttggatcaaatacacttcaagtggttattgcactcagtggaggggagcttatatattttgaaatggatgtaacgggtcagttgatggaggtggagaagcatgaaatgtctggtgatgttgcttgtttggacattgctccagtacctgaaggcagacaaagatctcgatttcttgcagttgggtcatatgacaagaccatccgcatcttatcacttgatcctgatgattgtatgcaggctctaagtgtacaaagcgtttcttcagctccagagtctcttctttttcttgaagttcaagcatctgttggcggtgaggatggtgcagatcatcctgctagccttttcttgaacgccggcttacagaatggtgtcatgtttagaactgtggtggatatggttacaggtcagctttctgattctcgttcccgattcttaggattgagagctccaaagctgtttcctattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacgaaaacttcttgtgatgatcgagagtgatcaaggagcattaactgcggaagagcgtgaagctgcaaggaaagagtgttttgaggctgctcaagctggggaaaatggtactggaagtgcagaccaaatggagaatggtggcgacgatgaagataaagatgatccactttcggatgagcattatggttatccaaaagctgaatctgataaatgggcttcctgcatcagagttcttgatccaaggacatcaaatactacttgtcttttggagcttcaggagaatgaggctgctttcagcatttgcaccgtaaatttccacgataaggaatacggaactcttttagctgttggcacagcgaagggactgcaatttttgcccaaaaggactgtaactgctggatttattcatatttataggttcgtagaggatggaagatctcttgaacttctacacaaaactcaagttgaaggtgttcctcttgctctatgtcaatttcaaggaagattacttgcagggataggacctgtgctcaggctgtatgatttggggaaaaaacgattgttaagaaaatgtgagaataagctattccctaacacaatcatctccattcatgcgtatcgtgatcggatttatgttggtgatgtccaagagtctttccattattgcaagtataggcgtgatgaaaaccaactttacatatttgctgatgattgcgttccaaggtggcttactgcatcataccacatagattttgacaccatggcaggtacagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcatgttggtgatgtggtcacatgcttgcaaaaggcatctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgtgagcaatacccaacattgccaatggatttgcagagaaaaattgctgatgaattggacagaacccctggagagatactgaaaaaacttgaggaagtgcgaaataagattatttaagaaatggtagcctgagaggtcatagtggaaatgtgttttttctggtaggccatttgcccgcagttaggtcactactaacaaagtgaagccaacttgcgtatctctcattcatacgggaacggtgatttcttgtcctatttaattcaagcggggagaaggaccatacggtcggtgactttgtactctagtgaagtgagacccataagccccagttggcaatttatgttgtaattactatttagttgcaattagctgtaatcaccctttttcttgtactcaatgagatgtttgatttaacttgatttgaaatttatagtctagaatatcaccgttttaccatttcaacgaaaagtaggttctagttctactgagttataatagagcagtttttcaaaatttaacacatgtattgtacctatcaaaatacatccgcattatgcatgaaagcgttgtttgaggacaaatatttattttattgttatgcaaatgtagtgttaaccgattgattattggggttttggtattgaaa

SEQ ID NO: 1951 - DNA, 4339 bp, Lotus japonicus
cttctctaaaaccctcaaccatgtatctatacagtctcaccctacagcgacccaccggcatcgtctgcgccatcaacggcaacttctccggcggcaaggtacaagaaatcgccgtcgccagaggcaaggttctcgatctcctccgccccgacgacaacggcaggatccaaaccatcctctccgttgaggtcttcggcgccatcaggtccctcgcccagttccgcctcaccggcgctcagaaggactacatcgtcgtcggttccgactccggcagaatcgtcatcctcgactacaacaaggagaagaatgtcttcgacaaagtccaccaggaaacgttcggtaaatctggctgccgacgcatcgtcccggggcagtacctcgccgtggatcccaaaggcagggccgtcatgatcggtgcttgtgagaagcagaagctggtttatgtgctgaatagggatactgctgctaggttaacgatttcttcccctttagaagctcataagtctcatactttagttttttccatttgtggggttgattgtggttttgagaaccccatttttgctgctatagagttggattactctgaggctgatcaggattctactggtatggctgcttctgaagctcagaagcatttgactttctatgagcttgatttgggtctcaaccatgtttctaggaagtggtctgatcaggttgataatggtgctaatttgcttgttactgttcctggtggtgctgatggccctagtggggtgcttgtttgtgctgagaattttgttatttataagaatcaggggcatcctgatgttagggctgtgattcctcgacgtgctgatttgccggctgagcgtggggttcttattgtgtcggctgccatgcataagctcaagaccatgttcttcttcctgctgcagactgagtatggggacatttttaaggtcaccttggataatgatggtgaccatgtatctgagttgaagattaagtattttgatactattcccgttacggcttccatgtgtgtgctgaagtcagggttcttgtttgcagcctctgagtttggaaaccatgctttgtatcagtttaaggcaataggggatgatgatgatgtggaggcttcgtctgctacgctgatggaaactgaagaaggttttcagccggtgtttttccagcccagaaggctgaagaaccttgttaggattgatcaggttgagagtttaatgccagttatggatatgaaggtcagtaacctctttgaagaggaaactcctcagatttttacactctgtggccgtggtcctcgatccactctgaggattttgagaactggtttagctgttagtgagatggcagtttccaggcttcctggtgtacctagtgctgtttggactgttaagaggactgtgtttgatgagtttgatgtgtatatcgttgtttcgttcacaaatgccacgcttgtgctttccattggtgagacagttgaagaagttgatgacagtggatttcttgacactactccctccctcgccgtgtctttgataggtgaagattctctgatgcaggtccacccgaatggtattaggcacattaggtcggataggcgtgtgaatgagtggagaactcctggaaagaggacgatttcaaaagtaggatcaaacagacttcaagtggttattgcactgagtggaggggagcttatctattttgaagtggatgtaactggtactggtcagttgttggaggtggacaagcatgaaatgtctggagatgttgcttgtttggacattgctccagtgcctgaaggcaggcaaaggtctcgttttcttgcagttggctcatatgacaagacaattcgaatcttatcactggatcccgatgattgtatgcagacactgagtgtacaaggcgtttcttcacctccagagtctctacttttcctcgaagtccaagcatctgttggtggtgaggatggtgcagatcatcctgctagccttttcctgaacgctggtttacagaatggtgtcttatttaggactgtggtggatatggttacaggtcagctttctgattctcgttccagattcttaggattgagagccccaaaactttttcccattgttgtaagagggaagcgtgctatgctttgcttatcaagtcgaccttggctaggttatattcaccaaggacatttccttttaacacccctttcatatgaaacccttgaatatgctgcctctttttcatctgaccaatgtgtggaaggtgtagtttctgttgctggtgaggcattgagaatttttaccattgaaagattaggagaaacattcaatgagactgtaattccgctaagatacacaccaaggaaatttgtgctacaacccaaacggaagcttttggtgatgattgagagcgatcaaggagcttttacggcagaagagcgtgaagctgcaaggagagaatgttttgaggctgctcaagctggggaaaatgggaatggaaatgcagaccaaatggagaatggtggggaggatgaggatagagatgatccgctctcggatgagcattatggttatcctaaagctgaatcagacaagtgggtttcctgcatcagagttcttgatcctaggtcaggaactacaacctgtctcttggagcttcaggagaatgaggccgcattcagcatatgcacagtaaatttccatgataaggaatatggaactcttttagctgttggcactgcaaagggactgcaatttttgcctaaaaagagtttagctgccggatttattcatatatataggtttgtagacgagggaagatctcttgaacttcttcacaaaacccaggttgaaggtgttcctcttgctctatgtcagtttcaaggaagattacttgcaggaataggacctgtgctcaggctatatgatctaggaaaaaggagattattaagaaaatgtgagaataagctattcccaaacacaattgtctctattcagacatatcgtgatcgaatttatgttggtgacatccaagagtctttccattattgcaagtatagacgggatgaaaaccaactttacatatttgctgatgattgcgttccaagatggcttactgcttcataccacatagatttcgacaccatggctggtgcagacaagtttggaaatatctattttgtgcggttgccgcaggatgtttctgatgagatagaagaagatcctactggtgggaggatcaagtgggagcagggaaagctgaatggagctcccaataagatggaagaaattgtacaatttaatgttggtgatgtggtcacaagcttgcaaaaggcatctcttatacctggtggtggagagtgtattgtatatggaacaattatgggaagtattggggcattgcatgcttttacttcacgtgatgatgttgatttcttttctcatttggagatgcatctgaggcaggactatccacctttgtgtggaagagatcacatggcttatagatctgcctattttcccgttaaggatgtgattgatggtgatctatgcgagcaattcccaacattgccaatggatttgcagagaaaaattgctgatgaattagacagaactccggcagagatactgagaaaactagaggaagtgcgaaataagattatttaagaaatgatcatctcagaggcgataacggaactgtttatcgtttgcccatagttagtcactaaccaagtgaagaaagctcgtgtttcccattcatacggggaagcaatgatttcttgtgcgctactttatgcaagagggaagattcgtccgtgactatttgtactctgtattgttaacatgaaacccatatcctcggttggcaatttatgttgtaattaatcgtaatttttttgttctgttaattaaggaagggtttggaaaaccacttctccggtttgtaacttttcgagacaaaacctaaggatgaacacatctttcaatgaaaagaggtttttttagtttcaatgaatgaaactttagtacaaacaggtactaaggtcatgtttgaatgcttgttgacatcaatgcaaatagatgtaagcagctaccttagagatcaaaaaaatgaacggaacataaaagagatgtttgtggaaaaatatattagatcctcgattgtgcaagattattggagttttgtactaactgggatgattgtcatgacctatctgaaaccttgcttttactactgagatcagctagttctcttttcttgcagataacaatgattttagtttttttctcattcatttttaagatctataattgaattgtaactgacaaatact

SEQ ID NO: 1952 - DNA, 4409 bp, Glycine max
ccgaaatattagtgacatataattgaagagaagggaaacccaaatcaaacgaaaccccaggtagggtttttaattcccgctttgctcactcacactgataacgagtcgagtgagtctctcttcaattttcacaccatccgcgactctgttcaattgaaaccacaaaaccctaacctaaaccctaacgaaccaaccgcaccgtcatgtatctctacagtctcactctgcagcgtcccaccggcatcatctgcgccatcaacggcaacttctccggcggcaagagtcaggaaatcgtggtggcccgtggcaaggtcctcgatctcctccgccccgacgacaacggccggatccaaaccatcctctccgttgaaatcttcggcgccatccgctccctcgcccagttccgcctcatgggtgcccagaaggactacatcgtcgtcggctccgattccggtcgcatcatcatcctcgaatataacaaggagaagaacgtcttcgacaaaatccaccaagaaaccttcggcaaatccggttgccgacgaattgtccccggccagtacctcgccatcgatcccaagggtagggccgttatgattggcgcctgcgagaagcagaaacttgtttatgttttgaatagagacaccgctgctaggttaaccatttcttcccctttagaggctcataaatcccacactttagtttactcaatttgtggcgttgattgtggctttgagaaccctatttttgctgctattgaattggattactccgaggctgaccaggattccactggccaggctgcttctgaggctcagaagcatttgaccttttatgagcttgatcttggccttaaccatgtctctaggaagtggtctgagcaggttgataatggggcgaatttgcttgttactgttcctggaggtggtgatggccccagtggtgtgcttgtttgtgctgagaattttgttatttataagaatcagggacatccggaggttagggctgtgattcctcggcgggccgacttgccggctgagcgtggcgtgcttattgtgtcggctgctatgcataaattgaagaacatgttcttcttcctcctgcagacggagtatggggatatttttaaggtcaccttggaacacaataatgatcgcgtctcggagttgaagattaagtattttgatacgattcctgttacagcttcaatgtgtgtgctgaagtcggggttcttgtttgcagcgtcggagtttgggaaccatgctctgtatcagtttaagtctataggggatgatgatgatgtggaggcatcgtctgccacgttgatggaaactgaggaaggttttcagcctgtgtttttccagcccaggaggctgaagaaccttgttaggattgaccaggttgagagtttgatgccgatcatggatatgaaggtcagtaatctctttgaagaggaaactcctcagatttacactctctgtgggcgtggtcctcgatcctctttgaggatcctgagaactggtttagcagttagtgagatggctgtgtccaagcttcctggtatacctagcgctgtttggacagtgaagaagaatgttattgatgagtttgatgcatacattgttgtgtcattcacaaacgctacacttgtgctgtccattggtgagactgttgaagaagtcagtgacagtgggtttcttgacactactccctcccttgctgtttctttgataggagatgattctctcatgcaggttcacccaaatggtattaggcatattagggaggatggccgtattaatgaatggagaactcctggaaagaggagtatttcaaaagttggatcaaatacacttcaagtggttattgcactcagtggaggggagcttatatattttgaaatggatgtaacgggtcagttgatggaggtggagaagcatgaaatgtctggtgatgttgcttgtttggacattgctccagtacctgaaggcagacaaagatctcgatttcttgcagttgggtcatatgacaagaccatccgcatcttatcacttgatcctgatgattgtatgcaggctctaagtgtacaaagcgtttcttcagctccagagtctcttctttttcttgaagttcaagcatctgttggcggtgaggatggtgcagatcatcctgctagccttttcttgaacgccggcttacagaatggtgtcatgtttagaactgtggtggatatggttacaggtcagctttctgattctcgttcccgattcttaggattgagagctccaaagctgtttcctattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacgaaaacttcttgtgatgatcgagagtgatcaaggagcattaactgcggaagagcgtgaagctgcaaggaaagagtgttttgaggctgctcaagctggggaaaatggtactggaagtgcagaccaaatggagaatggtggcgacgatgaagataaagatgatccactttcggatgagcattatggttatccaaaagctgaatctgataaatgggcttcctgcatcagagttcttgatccaaggacatcaaatactacttgtcttttggagcttcaggagaatgaggctgctttcagcatttgcaccgtaaatttccacgataaggaatacggaactcttttagctgttggcacagcgaagggactgcaatttttgcccaaaaggactgtaactgctggatttattcatatttataggttcgtagaggatggaagatctcttgaacttctacacaaaactcaagttgaaggtgttcctcttgctctatgtcaatttcaaggaagattacttgcagggataggacctgtgctcaggctgtatgatttggggaaaaaacgattgttaagaaaatgtgagaataagctattccctaacacaatcatctccattcatgcgtatcgtgatcggatttatgttggtgatgtccaagagtctttccattattgcaagtataggcgtgatgaaaaccaactttacatatttgctgatgattgcgttccaaggtggcttactgcatcataccacatagattttgacaccatggcaggtacagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcatgttggtgatgtggtcacatgcttgcaaaaggcatctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgtgagcaatacccaacattgccaatggatttgcagagaaaaattgctgatgaattggacagaacccctggagagatactgaaaaaacttgaggaagtgcgaaataagattatttaagaaatggtagcctgagaggtcatagtggaaatgtgttttttctggtaggccatttgcccgcagttaggtcactactaacaaagtgaagccaacttgcgtatctctcattcatacgggaacggtgatttcttgtcctatttaattcaagcggggagaaggaccatacggtcggtgactttgtactctagtgaagtgagacccataagccccagttggcaatttatgttgtaattactatttagttgcaattagctgtaatcaccctttttcttgtactcaatgagatgtttgatttaacttgatttgaaatttatagtctagaatatcaccgttttaccatttcaacgaaaagtaggttctagttctactgagttataatagagcagtttttcaaaatttaacacatgtattgtacctatcaaaatacatccgcattatgcatgaaagcgttgtttgaggacaaatatttattttattgttatgcaaatgtagtgttaaccgattgattattggggttttggtattgaaatgaatctcgaagcagactttccttttctgatt

SEQ ID NO: 1953 - DNA, 3789 bp, Ocimum basilicum
acttcacttcactccccaaatactagggtttctctaaaccctctctcttcccaaatctgatactcttgctctctgctaattatcatgtatctatacagcctgacccttcagcaatccaccggcataatctgtgccataaatgggagcttctccggcggcaaatctcaagaaatcgcggtggcgcgcggcaaggtcatcgaccttctgcggccggacgacaacggtaagcttcagtctctcctctctgttgagatattcggtgctattcgttcattagctcaatttcgcctcactggtgctcaaaaagactacatagttgttgggtcagattcggggcgcattgttattcttgagtataataaagaaaagaacacgcttgataaaattcaccaggaaacatttggaaagtcggggtgccgtaggatagtaccggggcagtacttggcaattgaccctaaaggtagagctgtaatgatcggtgcctgtgagaagcagaaacttgtttacgttttgaatagagatacttcagctaggttgactatttcatcgccgttggaggcgcataagagccatacaatagtttactcgatttgtggggtggattgtgggtttgataatccaatatttgcggccatagagttggattactctgaagcggaccaggaccctactggtcaagctgctaatgaggcacagaagcatttgaccttctatgaattggatttggggcttaaccacgtgtctaggaaatggtctgaacaggttgacaatggtgctaatatgttagtgacagtgcctggtggtggggatggacccagcggcgtgcttgtgtgtgcagaaaattttgttatatataagaatcagggccacccggatgtcagggcagtaattccgagacgtgtggacttgcctgcagagcgtggggtcttgattgtctcagctgctatgcacaagcagaaatctatgtttttcttcctcttgcaaactgaatatggggatatcttcaaagtgacgctggaccatgagaatgatagagtaaaggaattaaagattaaatattttgatactattcccgtcacgtcttccttgtgtgtcttgaagtctgggtttctgtttgctgcatcagagtttggaaaccatgccttgtatcagtttcaggcgattggtgatgatcctgatgtggaggcctcctctgctacactgatggaagtagaagaaggttttcatccggtgttcttccagcctaggaaactgaagaatcttgttcggattgatcaagttgagagcttgatgcctattatggatatgaaagttgtaaatctatttgaggaagaaactcctcaaatattttcactttgtgggcgtggacctcgttcttctctgcggatactgagaccaggtttggctattagtgaaatggcagtttcacaattaccgggtgttccaagtgctgtttggactgtaaaaaagaatgtgaacgatgagtttgacgcctatattgttgtttcttttgcaaatgccactcttgtactttccattggtgagaccgttgaggaagttagtgatagtggatttcttgacactacaccatctcttgctgtctctttgattggggatgactccttaatgcaagttcatccaaatggtatcaggcatatcagagaagatggacgtatcaatgaatggaggactccgggaaagagaacaattgttaaggttgggtctaacagacttcaggtcgtcattgcactaagtgggggtgagattatatattttgaggttgatatgacggggcagctgatggaggttgggaaacatgaaatgtctggggatattgcctgtttagatattgcccctgttccagaaggacgtcagagatctcgctttctggctgttggatcttatgacaatacaatccgcatcttgaatttagatcatgatgacattatggctattctaagtcttcagagtgtttcatctcctccggaatccctactctttcttgaagttcaggcttcattaggaggcgaggatggagccgaccaccccgctaacctatttttgaatgctggtctgcaaaatggagttttgttcaggacagttgtggatatggtaactggcactctctctgacaacagatctcggttcttaggccttagagctccgaagctcttttctattgttgtaagagggcggcaagctatgctttgcttgtcaagtagaccttggcttggctatatacaccaaggacacttccttctcactcccctgtcgtatgagacacttgaatatgctgcctccttttcgtcagatcagtgtgcagaaggtgttgttgctgttgctggcgatgcattgagggttttcactattgagagattaggagaatcatttaatgaaactgctatacctctgaggtatacacccaggaagtttgtagttcagcccaagagaaagcttttggttatgattgagagcgatcagggagcattcaccgcagaggagcgtgaagctgccaaaaaagaatcatttgaggctgctggaatgggagagaatggaactgatgcacatatggagaatggtgatgatgaggagaacaacgatcctctttctgatgaacagtatggttaccccaaggcagaggctggaaggtgggtttcttgcatcagagttttggacccgaggacaactcagacaacctgtttacttgagcttcaagataacgaagcagcatttagcatttgcactgtcaattttcatgataaggagtatggaactcttttagctgtaggcacagctaaggggctacagttttggcccaaaagatccttcgaggctgggtatatacatatatataggttcaaggaagacgggaaggttcttgaacttctgcataaaacacaagtggaaggggtccctcttgcactggcccagtttcaaggaagattactggctggaataggacctgtgcttagactttatgatttggggaaaagaaggttgcttaggaagtgtgagaataagttgttccctaactcaattacatccatccagacataccgtgatcgcatatatgttggtgatatgcaagagtcattccactactgcaagtacagacgcgatgaaaaccagctgtacatatttgccgatgacacggtacctagatggcttactgctgcacaacatgtagattttgacaccatggcaggagcagacaaatttggaaatgtttactttgtgcgattgccacaagatgtgtctgatgagattgaagaagacccaactggtggtaagataaaatgggagcaagggaagctgaatggggcaccgaataaagtggaggaaatagtccaattccacgttggtgatgtagtctcttgcttgcagaaggcatctttgattccgggaggtggagagtgccttatttatggtactgtaatggggagtttgggggcattcctcccattcacatcacgtgatgatgttgatttcttctcccatttggagatgcacttgagacaggagcacccacctttgtgcggtagagaccacatggcgtttagatcttcctacttcccagtgaaggatgtgatcgatggagatttatgcgaacagttcccaactttgcctatggatatgcagcgcaaaatcgcagacgagctggacagaactcccggggagattatgaagaaactggaagaaataagaaacaaaatcatctgagatgatttttgatgatcacgaattgctttggctaaagcctacatctttgttttcaatatgtattgcagg

SEQ ID NO: 1954 - DNA, 4151 bp, Theobroma cacao
agtctctctaaagcttcgaaggagcctcttttgaaaaacccaaaacccctccaaatctcaaaaaccctgaaaaccctagccctaactgaccatgtatctctacaacttaactctccaacaggccaccggcatcgtttccgccataaacggcaacttctccggcggaaaaatccaagaaatcgtcgtcgcccgtggcaagatcctttccctactccgccccgacgatctcggtaagctccaaacacttcattccgtcgaaatattcgggtccatacgttccctagctcaatttcgcctgaccggagcccaaaaagactacatagtagtcgggtctgattcgggtcggattgtaatcctcgaatacaacaaagaaaagaacgtctttgataaaattcaccaagaaacttttgggaaatccgggtgtcgccggattgtcccaggtcaatacttagctgttgacccgaaaggaagagctgtaatgattggtgcttgcgagaaacagaaattagtttatgttttgaatagagatactgctgctaggttaaccatttcgtcgcctttagaagctcataagtcgcacacgatagtttactccatttgtggtgttgattgtggtttcgataaccctatattcgctgccattgagttggattacttggaagccgatcaggattccacagggctggctgctggtgaggcacagaagcatttgacgttttatgaacttgatttagggcttaaccatgtgtctaggaagtggtcggaacaggttgacaatggggcgaatatgttggtcactgttcctggtggtggtgatgggccgagtggggttttggtttgtgctgagaattttgttatttataagaatcagggacatccggatgttagggcagtgattcctagacgggctgatttgccagcggaacgtggggttttgattgtttctgcggctacacataagcagaagtctatgtttttctttcttttgcagacagagtatggggatatttttaaggttacattggattatggaaatgatggtgtgacggagttgaagattaaatattttgattcaattccagtcacatcttcaatgtgtgtcttgaaaactggttttttgtttgcggcttcggagtttggaaatcatggtttgtatcagtttcaggctattggggatgaacctgatgttgagtcttcgtcttctacattgatggaaacagaagaaggtttccagccagtgtttttccagcctagagggcttaagaatctagttaggattgatcaagctgagagcctgatgccaataatggacatgaaaattgctaatctctttgaggaagaaacacctcagattttttcactctgtggacgtggtcctcgttcatctttgagaatactaaggcctggtttagcaatcagtgagatggctgtctcgcagcttcctggtgtcccaagtgctgtgtggacagtgaaaaagaatgttaatgatgcctttgatgcgtacattgtcgtgtcatttgccaatgcaacccttgttctttccattggtgaaacagttgaagaagttagtgatagtgggtttcttgatactactccttctcttgctgtttccttgattggtgatgattcgcttatgcaagttcacccaaatggtattaggcatataagggaagatggacgtattaatgagtggagaactccggggaaaagaacaattgttaaggttggctcaaatggccttcaagtggttattgcattgagtggaggggagcttatatactttgaggtggatatgactgggcaactgatggaagtggagaagcatgaaatgtctggagatgtggcttgtctggacattgcccctgtacctgaaggaagacagaggtctcgttttcttgcagttggttcatatgataatacaatccgtatattgtctttagatcctgatgattgtatgcagattctgagtgtgcagagtgtgtcttcacctcctgagtctctccttttccttgaggttaaggcatctgttggtggggaggatggtgctgatcaccctgccagtcttttccttaatgctggtctgcaaaatggagtgctgtttcggacagtagtggatatggttacagggcagctttctgattcccgttcacgattcttagggctgagagccccaaagttgttctctatcaaagtgaggggccgacctgcaatgctttgcttgtctagtcgaccgtggcttggttatattcaccaaggacattttctgctaacacccctctcttatgagacacttgaatttgctgcctcattttcatctgatcagtgtgctgaaggtgtcgttgctgttgctggggatgcattgagggttttcaccatcgagcgtctgggagaaacctttaatgagactgctattcctttgaggtatactcctaggaagtttgttctgcaacccaagcggaaactgttggtaattattgagagtgaccaaggatcatatactgctgaagagcgtgaagttgcaagaaaggagtgctttgaggctgctgggatgggagaaaatggtaatggtaatgtggaccaaatggaaaatggtggtgatgatgaggacaaagaggatcccctctctgatgagcagtatggttacccgaaggcggagtcggacaagtgggtttcttgcattagagttcttgatccaaggacagctacaacaacatgtcttttggagcttcaggacaatgaagctgctttcagtgtatgcactgtgaattttcatgataaagagtacggaactctcttggctgttggcacagccaagggtctgcagttttggcccaaaagaagcttagttactggatttattcatatttataggtttctggaagatggcagatcgcttgagctcctgcacaagacacaagtggaaggtgttcctcttgctttgtgccagtttcagggaagattacttgctgggataggatctgtgctccgattatatgacttggggaaaaagagactgcttagaaaatgtgagaataagcttttccctaacactattgtctgcatccacacttatcgtgatcgaatatatgttggggacatccaagagtcattccatttttgcaagtacaggagggatgaaaatcaactgtatatatttgctgatgatgttgttccacgatggcttactgcatcataccatatagattttgacaccatggctggtgcagacaagtttggtaatgtctattttgtgcggctaccccaagatgtatcagatgagatagaagaagatccaactggtggaaagataaaatgggaacaagggaggctcaatggagctcctaacaaggtagaggagatagttcagttccatattggcgatgtggtaacttccttgcagaaggcatctctgataccaggtggtggagaatgtgtcctttatggaacggtaatggggagcttgggggcattgcttccattcacttcccgtgatgatgttgacttcttttcccacctagagatgcatatgagacaggaacaccctcccttgtgcggacgagatcatatggcttatagatctgcgtattttcctgtaaaggacgtgattgatggggatctgtgtgagcagtttcctaccctgcctatggatttgcagagaaaaattgcagacgagttggatcgaactcctggggagatactgaagaaacttgaagaagtccgaaacaagattatttgagatagctgatagcatcaagtctaaggttgttttacctggatttatcagcccggatcaccagttgcgagttgtggttaagacagctaaagcatgtcagacagactcccaaggcagatgaggagatattgcaagttgttcaagttgaaagcacgaggcatggatggaagtattgtataagtctaagttttgaaacaaactagttgtattagaggccaaaaatcagagattgacatttgctgctgttgtaattaatcagatcctcttgtgcatttgtatgttcattagtagatagggattgatttttccatgctctctcctttcccctcttccctttgaggtaagaggtattgtttatatcaagcctttattttttttatttatgtcaatcaagtccttcacttagcatatgatcaaa

SEQ ID NO: 1955 - DNA, 4382 bp, Prunus mume
ctaaaataaaaggggcctaaacctcgcaaggtcctaactctacttcaccactatccaaaaccctaaattgcacactctgtgaaaccccaaattcctctgccatgtatctttacagcctcactcttcagcgagcgacgggcatagtctgtgccatcaatggcaatttctccggcggaaaggcccaagagattgtcgtcgccagaggcaaagttctcgaccttattcgacccgacgaaaatggtaagatccagactctactctctgttgaaattttcggcgtcattaggtctttagctcagtttaggctcactggttctcagaaagactatattgttgttgggtccgattcgggtcgaatagtaattcttgagtataacaaggaaaagaatgtctttgataaagtccaccaagaaactttcggtaagtcgggttgtcgccggatagttccgggccagtatttggccattgaccccaaggggagggctgttatggttggggcctgtgaaaagcagaagcttgtttacgttttgaatagggatacatctgcaaggttaactatatcatcccccttggaggcccacaagtcgcatactattgtgtattcaatttgtggggttgattgtgggtttgataaccccatatttgctgccattgagttggattattcagaagccgatcaggactctactgggcaggcggcaaacgaggctcagaagcatttgactttctacgagctcgaccttgggcttaaccatgtatctaggaagtggtcggatcaggttgataatggtgcaaatttactggtcacagttcctggaggtggggatgggccaagtggtgtattggtctgtgcggaaaattttgtgatttacaagaatcaggataaaccggatcttagggccgtgattcctaggcgtgcagatttgccagctgagcgtggggttcttatagtttcagcagctatgcacaagcagaagtcaatgttctttttccttttgcagacagagtatggggatatatttaaggttactctggaccatgataatgacaaggtctcagaattgaagataaaatattttgatacaattccagttacaacttcaatgtgtgtgttaaaatctgggtttttgtttgctgcgtcagagtttgggaatcactctttgtaccagttccgagcaataggtgaagatcctgatgtggagtcttcctcagctacattgatggaaactgaagaaggtttccaacctttgtttttccagcctagaagacttaagaaccttgttaggattgatcaggttgagagcttaatgccgataatggatatgaaggtcaataatctctttgaggaagaaacacctcaaatatttacactttgtgggcggggccctcgttcatccctcaggattctaaggcccggtttagctatcagtgagatggctgtgtcagagcttccaggtgtaccgagtgcagtctggacagtaaaaaagaatgtatctgatgagtttgatgcatacattgtggtgtcatttgcaaatgctacccttgtgctttcaattggtgagactgtggaagaagttagtgacagtgggtttcttgacactaccccatcacttgcagtttctttgataggtgatgattctctcatgcaagttcacccaaatggaattaggcatattagggaagatggacgtattaatgaatggagaactcctggaaagagaacgatcgtcaaggttggctctaatagacttcaagtggttattgctctgagcggcggagaacttatatattttgaagttgatatgacgggtcaattgatggaggtggagaagcatgaaatgtctggtgatgtagcttgtctggacattgcccctgtacctgaagggagacagagatctcgtttccttgcagttggttcatatgacaacactattcgtattttgtcattggatcctgatgactgtatgcagattctgagtgtgcaaagtgtttcttcaattccagaatctctcctatttcttgaggttcaggcatcaattggtggggaggatggtgctgaccatcctgccagccttttccttaatgctggtttacgtactgggattctgttcaggacagtggtagatatggtgacaggtcagctttctgattcccgttcacgattcttaggactaagagctccgaagctattttctgttagtgtgagaggcaagcatgccatgctttgtttgtcaagtcgaccctggctcggttatattcatcaaggacattttctgttaacacccctatcttatgagacacttgaatatgccgcctcattttcatctgatcaatgtgcggaaggtgtagttgctgttgctggaaatgctttgagggtttttactattgaaaggttgggagaaacctttaacgaaactgtggttccactgaggtacactcccagaaagtttgttgttcaactcaaacgaaagcttttagtaattattgaaagtgatcaaggagcattcacagcagaagagcgtgaagctgcaaaaaaggagtgctttgaggctgcaggaattggtgaaaatggaaatggtaatgttgatcagatggaaaatggtggtgataatgaggatgatcccctctccgatgagcactacggctatcctaaggcagagtctgagaaatgggtttcttgcattagagttcttgaccccaagacagcaactacaacttgtctgctggagcttcaggataacgaagctgcattcagtatatgcacagtgaatttccacgacaaggagtatggtacgcttttagctgtcggtacagcaaagggactgcagttttggcccaaaagaagtgtaacggcagggtatattcatatctatagatttctagatgatggaaagtcccttgaacttttgcacaagacacaagtggatggtgttcctcttgctttatgccagtttcagggaagattactagcaggcataggaccagtgctcagactgtatgatttggggaaaaaaagattgcttagaaaatgtgagaataagctgtttcccaactccattatatctattcaaacctatcgtgataggatttacgtaggtgacattcaagagtcatttcactactgcaagtacagacgggatgagaatcagttgtatatctttgctgatgattgtgttccaagatggcttacagcgtcatatcatatagattttgacaccatggcaggtgcagacaagtttggaaatgtctattttgtgcggttaccacaggatgtttcagatgagatagaagaggatccaacaggtgggaggataaaatgggagcaggggaagttgaatggcgctcccaacaaagtagaggagatagtgcagtttcatgttggtgatgtggtcagctgtgtgcagaaggcatctctaattccaggtggtggggaatgcatcatctatgggacagtgatgggtagcttgggtgcattgcttgcattcacctctcgtgatgatgttgacttcttttctcacctggagatgtatatgaggcaggagcatccgcccttgtgtggtagagatcacatggcttatagatcagcttattttccggttaaggatgtgattgatggagatctgtgcgagcagttcccaacattgcctatggatctgcagagaaaaattgcggatgagttggatagaactcctggagagatactgaagaaacttgaggaaattcgaaataagatcatttaaggaagagcaagctcaaaaatacctgcctgaattttaccgtaccttcgggtttagcatgcatacatcagataaaatcgttctgtcaaaaggttcaagtggacgaatgcttgatactaatgagaatttggttgacgtgcagtttctcgagtcaattttgcttcgattgctgctgactgtagttacactaacaggacaagcatgctagtgattgtcttttcctaatattgcaggagtggatgaatgtttctgattcaataaattcagacgctgatggttgagactaagccaagtacatcgtaagaagcgacatgcatctttacagccatttagacagcattccttgttgttgtaattattcagaatagattccccccccctcccctcccctcctttttccttctcagttgaacaatgttaagcaagattgattgatgctaccttttctctgtacctgttagtaagccattctggaatcttgcactgaacttagatattgttgttgatgtcttgtgatatttgaattcattgagagtctatttgaaacgtgagattcgacttctattttagtaatgtataatttggatttgaatgaaggaaaaagaattaaatatttcaaattcaaaacgttatattcaatgtcaa

SEQ ID NO: 1956 - DNA, 4159 bp, Prunus persica
aaaccccaaattcctctgccatgtatctttacagcctcactcttcagcgagcgacgggcatagtctgtgccatcaatggcaatttctccggcggaaaggcccaagagattgtcgtcgccagaggcaaagttctcgaacttattcgacccgacgaaaatggtaagatccagactctactctctgttgaaatttttggcgtcattaggtctttagctcagtttaggctcactggttctcagaaagactatattgttgttgggtccgattcgggtcgaatagtaattcttgagtataacaaggaaaagaatgtctttgataaagtccatcaagaaactttcggtaagtcgggttgtcgccggatagttccgggccagtatttggccattgaccccaaggggagggctgttatggttggggcctgtgaaaagcagaagcttgtttacgttttgaatagggatacatctgcaaggttaactatatcatcccccttggaggcccacaagtcgcatacgatagtgtattcgatttgtggggttgattgtgggtttgataaccccatatttgctgccattgagttggattattcggaagctgatcaggactctactgggcaggcggcaaacgaggcacagaagcatttgactttctacgagctcgaccttgggcttaaccatgtctctaggaagtggtcggatcaggttgataatggtgcaaatttactggtcacagttcctggaggtggggatgggccaagtggcgtattggtctgtgcggaaaattttgtgatttacaagaatcaggataaaccggatcttagggccgtgattcccaggcgtgcagatttgccagctgagcgtggggttcttatagtttcagcagctatgcacaagcagaagtcaatgttctttttccttttgcagacagagtatggggatatatttaaggttactctggaccatgataatgacaaggtctcagaattgaagatcaaatattttgatacaattccagttacaacttcaatgtgtgtgttaaaatctgggtttttgtttgctgcgtcagagtttgggaatcactctttgtaccagttccgagcaataggcgaagatcctgatgtggagtcttcctcagctacattgatggaaactgaagaaggtttccaacctttgtttttccagcctagaagacttaagaaccttgttaggattgatcaggttgagagcttaatgccgataatggatatgaaggtcaataatctctttgaggaagaaacacctcaaatatttacactttgtgggcggggccctcgttcatccctcaggattctaaggcccggtttagctatcagtgagatggctgtgtcagagcttccaggtgtaccgagtgcagtctggacagtgaaaaagaatgtatctgatgagtttgacgcatacattgtggtgtcatttgcaaatgctacccttgtgctttcaattggtgagacagtggaagaagttagcgacagtgggtttcttgacactaccccatcacttgcagtttctttgataggtgatgattctctcatgcaagttcacccaaatggaattaggcatattagggaagatggacgtattaatgaatggagaactcctggaaagagaacgatcgtcaaggttggctctaatagacttcaagtggttattgctttgagcggcggagaacttatatattttgaagttgatatgacgggtcaattgatggaggtggagaagcatgaaatgtctggtgatgtagcttgtctggacattgcccctgtacctgaagggagacagagatctcgtttccttgcagttggttcatatgacaacactattcgtattttgtcattggatcctgatgactgtatgcagattctgagtgtgcaaagtgtttcttcaattccagaatctctcctatttcttgaggttcaggcatcaattggtggggaggatggtgctgatcatcctgccagccttttccttaatgctggtttacgtactgggattctgttcaggacagtggtagatatggtgacaggtcagctttctgattcccgttcacgattcttaggactaagagctccgaagctattttctgttagtgtgagaggcaagcatgctatgctttgtttgtcaagtcggccctggctaggttatattcatcaaggacattttctgttaacacccctatcttatgagacacttgaatatgccgcatcattttcatctgatcaatgtgcggaaggtgtagttgctgttgctggaaatgctttgagggtttttactattgaaaggttaggagaaacctttaacgaaactgtggttccactgaggtacactcccagaaagtttgttgttcaactcaaacgaaagctattagtaattattgaaagtgatcaaggagcattcacagcagaagagcgtgaagctgcaaaaaaggagtgctttgaggctgcaggaattggtgaaaatggaaatggtaatgtggatcagatggaaaatggtggtgataatgaggatgatcccctctccgatgagcactatggctatcctaaggcagagtctgagaaatgggtttcttgcattagagttcttgaccccaagacagcaactacaacttgtctgctggagcttcaggataatgaagctgcattcagtatatgcacagtgaatttccacgataaggagtatggtacgcttttagctgttggtacagcaaagggactgcagttttggcccaaaagaagtgtaacggcagggtatattcatatctatagatttctagatgatggaaagtcccttgaacttttgcacaagacacaagtggatggtgttcctcttgctttatgccagtttcagggaagattactagcaggcgtaggaccagtgctcagactgtatgatttggggaaaaaaagattgcttagaaaatgtgagaataagctgtttcccaactccattatatctattcaaacctatcgtgataggatttacgtaggtgacattcaagagtcatttcactactgcaagtacagacgagatgagaatcagttgtatatctttgctgatgattgtgttccaagatggcttacagcgtcataccatatagattttgacaccatggcaggtgcagacaagtttggaaatgtctattttgtgcggttaccacaggatgtttcagatgagatagaagaggatccaacaggtgggaggataaaatgggagcaggggaagttgaacggcgctcccaacaaagtagaggagatagtgcagtttcatgttggtgatgtggtcagctgtgtgcagaaggcatctctaattccaggtggtggggaatgcatcatctatgggacagtgatgggtagcttgggtgcattgcttgcattcacctctcgtgatgatgttgacttcttttctcacctggagatgtatatgaggcaggagcatccgcccttgtgtggtagagatcacatggcttatagatcagcttattttccagttaaggatgtgattgatggagatctgtgcgagcagttcccaacattgcctatggatctgcagagaaaaattgcggatgagttggatagaactcctggagagatactgaagaaacttgaggaaattcgaaataagatcatttaaggaagagcaagctcaaaatttctcgagtcaattttgcttcgattgctgctgactgtagttacactaacaggacaagcatgctagtgattgtcttttcctaatattgcaggagtggatgaatgtttctgattcaataaattcagacgctgatggttgagactaagccaagtatatcgtaacaagcgacatgcatctttgcagccatttagacagcattccttgttgttgtaattattcagaatagatttcctccccctttttccttctcagttgaacgatgttaagcaagattgattgatgctaccttttctctgtatctgttagtaagccactctggaatctggcgctgaacttagatattgttgttgatgtctgtgatatttgaattcattgagagtctatttgagacgtgagattcgacttctattttagtaatgtataatttggatttgaatgaaggaaaaagaattaaatatttcaaattcaaaacgttatattca

SEQ ID NO: 1957 - DNA, 4433 bp, Cajanus cajan
cgctcctctcactcaataacagtctctctgaatgttccgttgaaacccaaacccaaaccctaaactaaaccctaaaccaccgcaatgtatctctacagtctcactctccaacgccccaccggcatcatatgcgccatcaacggcagcttctccggcggcaagacgcaggaaatcgtcgtcgcccgcggcaaggtcctcgatctcctccgccccgacgacaacggcaggatccaaaccatcctctccgtcgaaatcttcggcgccatccgctccctcgcccagttccgcctcatcggcgctcagaaggactacatcgtcgtcggctccgactccggccgtatcgtcattctcgagtacaacaaagagaagaacgttttcgacaaaattcaccaggaaaccttcggcaagtccggttgccgccgaattgttcccggtcagtacctcgccatcgatcccaagggtagggctgttatgattggcgcttgcgagaagcagaaactcgtttatgttttgaatagggacactgctgctaggttaaccatttcttcccctttagaggctcacaaatcccacactttagtttattcaatatgtggtgttgactgtggctttgagaaccctatttttgctgctattgaattggattactctgaggccgaccaggattccactggccaggctgcttccgaggctcagaagcatttgaccttttacgagcttgatcttggcctcaaccatgtttccaggaagtggtctgagcaggttgataatggtgccaatttgcttgttactgttcctggaggcactgatggccccagtggcgtccttgtctgtgctgagaatttcgttatttataagaatcagggacatccggatgttagggctgtcattcctcggcgggctgacttgccggctgagcgcggcgtgcttattgtgtctgctgccatgcataaattgaagggcatgttcttcttcctactgcagactgagtatggagatatttttaaggttaccttggaacacaataatgaccgtgtctcggagttgaagatcaagtattttgataccattcctgtcacggcttcaatgtgtgtgctgaagtccggattcttgtttgcggcatcggagtttgggaatcatgctctgtatcagtttaagtccataggggaggaagatgatgtggaggcctcgtctgctacgctgatggaaactgaagaaggttttcagcctgtgtttttccagcccaggaggctgaagaaccttgttaggatagaccaggttgagagtttgatgcccataatggatatgaaggtcagcaatatctttgaagaggaaactccccagatttttactctttgtgggcgtggtcctcggtcctctttgaggattctgagaacgggtttggcagttagtgagatggctgtatccaagcttcctggtatacctagtgctgtttggacagtgaagaagaatgttattgatgagtttgatgcgtacattgttgtgtcattcacaaatgctacgcttgtgctttccattggtgaaactgttgaagaagttagtgacagtgggtttcttgacactactccttcccttgctgtttctttgataggagatgattctctcatgcaggttcacccaaatggtattaggcatattagggaggatggtcgtattaatgaatggagaactcctggaaagaggacaatttcaaaagttggatcgaatagacttcaagtggttattgcactgagtggaggggagcttatatattttgaagtggatgtaactggtcaattgatggaggtagagaagcatgaaatgtctggagatgttgcttgtttggacattgctccagtacctgagggaagacaaagatctcgatttcttgcagttggttcatatgacaagaccatccgaatcttatcactggatcctgatgattgtatgcaggctctaagtgtacaaagtgtttcttcagccccggagtctcttctttttctagaagttctggcatctgttggtggcgaggatggtgcagatcatcctgccagccttttcttgaatgctggtttacagaatggtgtcttgtttagaactgtggtggatatggttacaggtcagctttctgattctcgatcccgattcttaggattgagagccccaaagttgtttcccattattgtgagaggcaagcgtgctatgctttgcttgtctagtcgaccttggcttggttatattcaccaaggacatttccttttaacacccctttcatatgaaacccttgaatatgctgcctcattttcatctgaccagtgtgtcgaaggtgtagttgctgttgctggtgaggccttgaggatttttaccattgaaaggttaggagaaacatttaatgaaactgtaattccattaaggtacacacctaggaaatttgtgctgcaaccaaaacggaaacttctggtgatgattgagggtgatcagggagcattaaatgcggaagagcatgaagcaaagagtgttttgaagcagctcaagttggggaaaatggtactggaagtgcagatcaaatggagaatggtggtgaggatgaagataaagatgacccactttcagatgagcattatggttatccaaaagctgaatcagagaaatgggtttcctgcattagagttcttgatcccaggacaggaaatacaacttgtcttttggagcttcaggataatgaggctgctttcagcatatgcaccgtaaatttccatgataaagaatatggaacacttttagctgttggaactgcaaagggactgcaatttttgcctaaaaggagtgtaactgctggatttattcatatttataggtttgtagaggatggaagatctcttgaacttcttcacaaaactcaggttgaaggtgttccccttgctctatgtcagtttcagggaagattacttgcagggataggacctgtgctcaggctgtatgatttgggaaaaagacgattgttaagaaaatgcgagaataagctattccccaacacaattgtctctattcatgcatatcgtgatcggatttatgttggtgatgtccaagagtctttccattactgcaagtataggcgagacgaaaaccaactatacatatttgctgatgattgtgttccaaggtggcttactgcatcataccacatcgattttgataccatggcaggcgcagacaagtttgggaatatctattttgtgcggttgccacaggatgtttcagatgagatagaagaagatcctaccggtgggaggatcaagtgggagcagggaaagctgaatggagctcccaataaggtggaagaaattgtacagtttcatgttggtgatgtggtcacctgcttgcaaaaggcttctcttataccaggtggtggagagtgcattgtatttggaacagttatgggaagtgttggggcattacatgccttcacttcacgggatgatgttgatttcttttctcatttggagatgcatatgaggcaggatcacccacctttgtgcggaagagaccacatggcctatagatctgcttattttcctgttaaggatgttattgatggggatctatgcgagcaattcccaacattgccgatggatttgcagagaaaaattgccgatgaattggacagaacccctggagagattctgaagaaactcgaggaagtgagaaataagattatttaagaaaatttgaaaggtgatagtggaatgtattcttctggtaggtcctttgcctgcagataggtcactacaaacacagtgaagtaagcttgcgcatctcattcatacgggaacagtgatttcttgtcctatttaattcacaagggagggtgagggactggacggtgactgtactcttctgtattgttgaagtgaaacccgtaagcctcagttggcaacttatgttgtaattaatcgtaattagctgttatcactctttgtggatgtgataacgtgccccagctctccatctgcatctcacattctcacccccccctgtattgtactcaatgagatgtttgatttaacctgatttgaaatttgtagtttggaatatcacttatttacagtttcaaccaagagtaggtccaagatcgaacacatttagtgtacctatcaatataaaaatttgaaaacgttcgatctcgtatcatctacatcattcgtggaagagatgttttggtgttgagtttgtggctccttttttcatggttgttattattcaatgagattattgtttaaaagaatctcggtgcagagactgttcatttcagattacctaattcttacagttcatcccaatgtatctttttttattttttattttatgtaaacttccatttagttttaggtaatttaagatagatctgcataagtaaataaaatgtgcaagtc

SEQ ID NO: 1958 - DNA, 4024 bp, Allium cepa
aacaaatttatcctccaaaccctaaaatttccaccaccgtcttcgcatgtctatgttcttctcctccatctccagccaataaaatcctaaatcctacttctatcccttctcttcttcgtcttctccattaatttttatctatatcaatacccacaaataaacaaaatcagtctctcaaatcaataaaagatgtacctgtacaacctaacgctgcaggactcaactggaatcctctccgctataaacggaaatttctcgggcacaaaaacgcaagaaatcctcgttgcccgcggaaaatccctctcccttctccgcccagacgattcgggaaagctacagacacttctttcaatccagatctttggcgcaatccgctctcttgcccacttccgtctaactggctcacagaaagatttcatcatagtcggttctgactccggcagaatcgtcatcctagagtatttcaaagaccgtaatgtgttcgataaactccatcaggaaacttttgggaagtctggatgccgcaggattgttcccggacaatatctagctgttgatccaaaaggtcgtgctgttatgattgctgcgtgcgagaagcagaaactggtctatgttctaaacagagatacagcagctaggctgactatttcaagtcccttagaggcgcataagagtcataacattacatactcagttgtgggtgtggactgtggattcgataacccggtttttgcagccattgaattggattactcggaagcggatatggatccgactggagatgctgctagtgaggctcagaagtgtttgactttttatgagcttgatttgggactgaatcatgtttcaaggaagtggagtgaaccggtcgataatggggcaaatatgcttgtgacggtgccaggtggaggagatgggcctagtggggttttagtttgtgcagagaattttgttatttataagaatcagggtcatccggatgtgaggtgtttgattccaaggagggcggatttgcctgcagagaggggtgtacttatagtttctgcagctacacataagatgaagtccatgtttttctttttgttgcaaacggagtatggtgatatatttaaggcaactttggtttatgaaggtgatagggttagcgagttgaaaattaagtattttgatacgattccagttacttctagcatgtgtttgatgaagacaggttatttgtttgctgcctctgagtttgggaatcatgggttgtaccagtttcaggctattggggatggtgatgacgtggaggcatcatcagaaagtttgatggaaactgaggaagggtttcagcctgtgttttttcaaccaagagggttgaaaaatcttttgaggattgatcaggttgcaagtcttatgcctattatggatatgagaattacgaacttctttgatgaagagacgtctcagatatatgctttgtgtgggcgtggcccacgttcttctcttaggattttgaggcctgggttggccattagtgaaatggctgttgagcgtttgcctgatgtgcctaatgcagtatggactgtaaagaagaatgtaactgatgagtttgatgcctatattgttgtgtcttttccaactgctacacttgtgctttctattggtgagactgttgaagaagttagcgatagtgggtttcttgacacgaccacttctcttgctgtttcattgcttggagatgattctttaatgcaagttcatcctaatggaattaggcatattagagaagatggtcgtattaatgagtggaagacacctggaaagaagacaatagtgaaagtgggttctaataggcttcaggtagttattgctttaagtggcggtgaacttatttactttgaaatggatatgactggtcaattgatggaagtagaaaagcatgagatgcctggtgatgtggcttgtctagatattgcgcctgttccagaaggaaaacaaagatctcgatttcttgcagtagggtcatatgacaacacaattagaatattatcattagatcctgatgattgtatgcaagttttaagtgttcaaagtgtttcatcttctcctgaatctcttcttttacttgaggttcaggcctcagttggaggcgaagatggtgctgaccatcctgctagtgtgtttcttaatgcaggtttgcagaatggggtattgttcagaactgtagtagatatggtaacgggtcagttatctgatacccgttctagattcttaggtttgagagcaccgaagttgttttccgctactgttaggggaaggcaagcaatgctttgcttatcaagtcgcccatggttagggtacatacatcaagggcatttcttgttgactcctctttcatacgaaacacttgaatttgcagcctccttttcctctgatcagtgtgctgaaggagttgttgcagtggctggagatgctttgagagtctttactatagaaaggttgggtgaaacctttaatgagacggttatacctttgcgctacactccaaggaagtttgttcttatacctaagaaaaaacttgcggttattatagagagtgatcaaggggctttcaatgcagaagagagggaagctgcaaggaaagaatgctttgaagctgcagatggagttggagagaatggaaatgcaaataatgttgaaaatatggaaaatggtgaagaagaagaaaaagaagatcctcttatcgatgagcagtatggttatccgaaagcagaatcagacaaatgggcctcttgtattagagttcttgatcctagatcggggaacactacatgtttactcgaactgcaagataatgaagccgcctttagcttgtgcactgtaaattttcatgacaaagagtatggtacattacttgctgtaggtacggcaaaaggtttgcaattttttccaaagaggacattcactgctgggtttattcatatttatagattcgtggaagatggaaaatcactggagttgttgcataagacacaagttgaaggtgttccactagcattgtgccagtttcaaggtagacttcttgcaggaattggtccggtgcttaggctgtatgatttagggaaaaagagattgcttcggaaatgtgagaacaagctctttcctaagaccattgtttctattcatacataccgcgataggatttatgttggtgacatccaagagtcattccattattgcaagtacagacgagacgaaaaccaactatatatatttgcagatgattctgttccaagatggttaactgcagcatatcatgttgattttgacaccatggctggtgctgacaagtttggtaacatttattttgcaaggctaccgcaagatttgtccgatgaaatcgaagaagatccaacaggcggtaaaataaaatgggaacaagggaaattgaatggcgcccccaataaaatagaagagattgttcagtttcatgtaggagatgtagtcacatcattgcaaaaagcttcattagtacctggtggtggtgaatgtattatttatggaactgttatgggaagcttaggtgcactacttgcattcacatctagagaggatgttgatttctttaatcatttggagatgcacatgagacaggaacatcctcctttgtgtggcagagatcatatggcttatagatccgcatattttccggtcaaggatgtaattgatggtgatttgtgcgagcaattccctaccctcccaccggatttgcagagaaagattgcagaggaattggatagaaccccaggagaaattctcaagaaattagaagatgctagaaacaagatcatctgagtaactactatccaagcactgtctaacttagcttgtttttactgttttaggattgttctttttccctccaagcgttctgtttctattttctgaagagaatacgcagtcaatatttttgtaacgttggatgtgccataaagtataattttgtatccttgtttgctatatgatctgcctgagaaataaa

SEQ ID NO: 1959 - DNA, 3993 bp, Flaveria ramosissima
caccatcaccatgtacctctacaacctcactctccaacaagccaccggcatcgtctgcgccatcaacggcagcttctccggcggcaacaagtcccaagaaatcgtcgtcgcccgcggcaaagtcctcgaactcctccgccccgacgaaacggtaagatccagaccatcctctccgttgatgttttcggtgctattagatctctagctcagtttaggttaaccggtgctcaaaaggactacatcgtcgttggctccgactccggtcgtatcgttattcttgagtataataaggagaagaatgtgtttgataaggttcatagggagacttttggcaaatctggatgccgtaggattgttcctggtcagtatcttgctattgatcccaaaggtcgtgctgttatgattggggcttgtgagaagcagaagctggtttatgttttgaatagggatacggctgctaggctgacgatttcgtcgccgttggaggcgcataagtcgcacacgattacttactcgattgctggggtggattgcgggtttgataacccgatttttgctgctattgagttggattattcggaggcggatcaggactctacgggtcaggcggcgaacgaggcgcagaagcatcttacgttttatgagttggatttggggcttaatcatgtttcgaggaagtggtcggagcaggttgataatggggctaatatgctggttacggtccctggtggtggggatggtccgagtggtgttcttgtttgtgctgagaattttgttatttataagaatcagggtcatccggatgttcgtgcggtgattcctagaagggcggatttgcctgctgagcgtggggttcttattgtttcggctactatgcataaacagaagtctatgtttttctttcttttgcaaactgaatatggggatatctttaaagtcacacttgatcatgataacgagcgtgttacagagctgaaaattaagtattttgataccatacctgtgtcatctgctatgtgtgtcatgaaattaggttttctgtttgctgcttctgagtttgggaatcatgctttgtatcagtttcaagctataggagctgatcctgatgtagagtcatcatcagctacattgatggaaacagatgaaggattccagccagtatttttcaagcctagagggttgaaaaatcttgttagaattgatcaagtggagagcttgatgcccattatggacatgaaagttgtaaatctttttgaagaagaaacccctcaaatatttacactttgtggtcgaggacctcgttcttctcttagaattctaagaccgggacttgctataagtgaaatggctgtttcacagcttcctggggtccccagtgcagtttggacagttaaaagaacgttaatgatgagtttgacgcttttattgttgtttcttttgcaaatgcaactcttgttctctctattggagaaactgtagaagaagttagtgatagtgggtttcttgatacaacaccttcacttgctgtttcacaaataggtgatgattcgttaatgcaagtgcatcctagtggtattagacatataagggaagatggtcgtgttaatgagtggagaactcctggaaaacgaactatagttaaggttggatcgaatagacttcaggtggttgttgcattgagtggaggggagattatatactttgaggtggatatgactggacagttgatggaagttgagaaaaatgaaatgtctggtgatgtggcatgtttggatatagctcctgtacctgagggaaggcagaggtctcgctttctagctgttggatcgtatgataataccattcgaatattatctttggatcctgatgactgtatgcaggttcttagcttgcaaagtgtttcttctcctcctgagtcacttctctttcttgaggttcaggcttctgtaggtggtgaagatggtgctgaccaccccgctagcttgtttctgaatgcaggtcttcaaagtggggttctttttaggaccgttgtggacatggtcacgggccaactttcagatgcacggtctcggtttttaggacttcgggctccgaagttgttttctgttttggtgagaggaagacgggctatgctttgcttgtcaagtagaccatggttaggttatgttcaccagggtcattttcttttgacacctctttcatatgaaacacttgagtatgcagcttcgttttcatctgatcagtgtgctgaaggtgtggtagctgttgctggggatgctttaagagttttcacaattgaaagattaggtgagactttcaatgaaactgctataccgttgaggtatactcctagaaaatttgtgttccatcctaaaaagaaactcctggtaacaattgagagtgatcagggtgcctttccagctgaattgcgtgaaagtgctaaaaaagagtgctttgaggctgcgggtcagggagaaaatggtaaaatggaaatagaaaatggtggtgatgatgaagataaagatgacccgttatctgatgaacaatatgggtaccctaaagctgaatcagataaatgggtatcttgcattcgggttcttgaccctaagtcatccgagacaacgtgtcttctagagctccaagataatgaggcggctttcagtatatgcactgtgaacttccatgataaagagtatggtacccttttagctgtgggtacagcaaagggtcttcaattttggcccaaaagatctttaacagctggatatattcatatttatcggtttgtaaaggatggaaaatcgcttgagcttctgcacaaaacccaagttgatggtgttccgcttgcattatgccagtttcagggaagattgcttgctggaatcgggtcaattcttaggctgtatgatttagggaaaaaaagactgcttagaaagtgtgagaataagctattcccaaacacaatcaattcgattcatacatatcgtgatcgaatttatgtaggagacattcaggagtcgtttcactattgcaagtacagacgggatgaaaaccagctatatgtgtttgctgatgactcggttccgagatggctgacagcagcataccatgtagactttgacaccatggcaggtgctgacaagtttggaaacatctactttgtgcggttgccacaggacgtatcagatgaaattgaagaagatccaactggcgggaagattaaatgggagcaggggaagcttaatggagcaccaaataaggttgaagagattgtgcagtttcatgttggtgatgtggtgacatgtatgcagaaagcatctttaattccaggtggtacggagtgtgtgatgtatggaacagtgatgggtagtttaggggcgttgctggcatttagctcacgtgatgatgtggacttcttttctcacttggagatgcatatgagacaggaacacccgcctttgtgtggaagagatcatatggctttcagatctgcttattttcctgttaaggatgtgattgacggggacctttgtgaacaataccccacattgcctatagatttgcagcggaaaattgcagatgaattggatagaactccagcagaaattctcaagaaactggaagaagttagaaacaaaattgtttgagatagatagatcatgtttgggagatgggtgacagccaaaagcatatcaactataacaggtaccagaaagttgaaagtggttgagatcatagaggttaatttgtattatgcattcaacttgttttaacagtctactgtcttttagatgtttttgttgtaagtatgcagatttcttcttaatgaaatttactcaattgtttgtgagactcatgttgttagagttgacttttgtggtattagtttacttgctatgaaccagcttccacagagttgggtgtggatgaaagttacatctgtcattctctaggagacttgtgtgtataattgttgttatatcactcttattc

SEQ ID NO: 1960 - DNA, 4375 bp, Glycine max
agagagccaaatgaaaggaaagcccaggtagggttttgttattcccggtctgctcactgacactgataacgagtctctcttcagtcttcattcaccctctgtcagtgaatgttcaattgatacaacaaaaccccaacctatacccaaccaccgccatgtatctctacagtcttactctgcagcgccccaccggcatcatctgcgccataaacggcaacttctccggcggcaagagccaggaaatcgtggtggcccgcggtaaggttctcgatctcctccgccccgacgacaatggtcggatccaaaccattctctccgtcgaaatctttggcgccatccgctccctcgcccagttccgcctcatgggcgcccagaaggactacatcgtcgtcggctccgactccggccgcatcgtcatccttgaatacaacaaggagaagaacgtcttcgacaaaatccaccaagaaaccttcggcaaatccggttgccgccgaattgtccccggtcagtacctcgccatcgatcccaaaggtagggccgttatgattggcgcctgcgagaagcagaaactcgtttatgttttgaatagggacactgctgctaggttaaccatttcttcccctttagaggctcataaatcccacactttagtttactcaatttgtggcgttgattgtggctttgagaaccctatttttgctgccattgaattggattactctgaggctgaccaggattccactggcctggctgcttctgaggctcagaagcatttgaccttttacgagcttgatcttggccttaaccatgtttccagaaagtggtccgagcaggttgataatggggccaatttgcttgttactgttcctggaggtggtgatggccccagtggtgtgcttgtttgtgctgagaattttgttatttataagaatcaggcacatccggaggtcagggctgtgattcctcggcggaccgacttgccggccgagcgcggcgtgcttattgtgtcagctgctatgcataaattgaagaacatgttcttcttcctcctgcagacagagtatggggatatttttaaggtcaccttggagcataataatgatcgtgtctcggagttgaagattaagtattttgataccattcctgttacagcttcgatgtgtgtgctgaagtcggggttcttgtttgcggcatcggagtttgggaaccatgctctgtatcagtttaagtctataggggatgaggatgatgtggaggcgtcgtctgccacgttgatggaaactgagcaaggttttcagcctgtgtttttccagcccaggaggctgaagaaccttgttaggattgaccaggttgagagtttgatgccgataatggatatgaaggtcagtaatctttttgaagaggaaactcctcagatttatactctctgtgggcgtggtcctcgatcctctttgaggatcctgagaactggtttagcagttagtgagatggccgtgtccaagcttcctggtatacctagcgctgtttggactgtgaagaagaatgctattgatgagtttgatgcatacattgttgtgtcattcacaaatgctacacttgtgctttccattggtgagactgttgaagaagtcagtgacagtgggtttcttgacactacaccctcccttgctgtttctttgataggagatgattctctcatgcaggttcacccaaatggtattaggcatattagggaggatggccgtattaatgaatggagaactcctggaaagaggactatttcaaaagttggatcaaatagacttcaagtggttattgcactgagtggaggggagcttatatattttgaagtggatgtaactggtcagttgatggaggtggagaagcatgaaatgtctggggatgttgcttgtttggacattgctccagtgcctgaaggcagacaaagatctcggtttcttgcagttgggtcatatgacaagaccatccgcatcttatcgcttgatcccgatgattgtatgcaggctctaagtgtacaaagtgtttcttcagctccagaatctcttctttttctcgaagttcaagcatctgttgggggtgaggatggtgccgatcatcctgctagccttttcttgaatgctggcttacagaatggtgtcatgtttagaactgtggtggatatggttacaggtcagctttctgattcacgttcccgattcttgggattgagagccccaaaattgtttcccattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacggaaacttctggtgatgattgagagtgatcaaggagcattaactgcagaagagcgtgaagctgcaaggaaagagtgttttgagtctgctcaagctggggaaaatggcactgaaagtgcagaccaaatggagaatggtggtgaggatgaagataaagatgatccactttcagatgagcattatggttatccaaaagctgaatcagataaatgggcttcctgcatcagagttcttgatccaaggacaggaaatactacttgtcttttggagcttcaggaaaatgaagctgctttcagcatttgcaccataaatttccatgataaggaatacggaactcttttagctgttggcactgcgaagggactgcaatttttgcccaaaaggaccataactgctggattcattcatatttataggttcgtagaggatggaagatctcttgaacttcttcacaaaactcaggttgaaggtgttcctcttgctctatgtcaatttcaaggaagattacttgcagggataggacctgtgctcaggttgtatgatttgggaaaaagaagattgttaagaaaatgtgagaataagctattccccaacacaattgtctccattcatgcatatcgcgatcggatttatgttggtgatgtccaagagtccttccattattgcaagtataggcgtgatgaaaaccaactttacatatttgctgatgattgtgttccaaggtggcttactgcatcataccacatagattttgacaccatggcaggtgcagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcacattggtgatgtcgtcacatgcttgcaaaaggcttctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgcgagcaatacccaacattgccaatggatttgcagagaaaaattgccgatgaattggacagaacccctggagagatactgaagaaacttgaggaagtgcgaaataagattatttaagaaatggtagcctgagaggtcatagtggaaatgtgcttttctggtaggtcatttgcccacagttaggtcactactaacaaagtgaagcaagcttgtgtatctcattcatacgggaacggtgatttcttgtcctattgaaacggggtgaaggaccggacggtgactttgtactctattgaagtgaaacccataagcctcagttggtaatttacgttgtaattactaatagtagcaattaactgttatcacgcgttgtagatgtgataacatgctccatctctcttctacgactctcccactcagcatcctgtcttgtactcaatgaaatgtttgatttaacttgatttgaaatttatagtctagaatatcaccgtttaactaccattttaacgaaacctaggttaggttctagttctactgagttatcgtagagcagtttttcaaaatttaacacatgtagtataccctatcaaaatacatcaacattatgcatgaaagagttgtttgaggctaaatatttattttattgttgtgcaaatgtaatgttaaccgatagatgattcgggttttggtac

SEQ ID NO: 1961 - DNA, 4182 bp, Lactuca sativa
gctagagacggtgaaacatattttgttctattttttactcgattagaagttaaattatggagatgggttgatacttgatggttctaacttctaaaacccccgtccccctcctccctctttctcccgatctcatactaaaagccctagttttgtcactcattgaacatttggtctccctacttcctcacaacttagggttttagcaacccattaccatgtatctctacaatctcaccctccaacaagccaccggcatcgtatgtgccatcaacggcagcttctccggtggtaacaaatcccaagaaatagtcgtcgcccgcggaaaagtccttgaactcctgcgccccgacgaaaacggtaagatccaaactattctctccgttgatgtttttggtgctattagatccctagctcagtttaggttaaccggtgcccaaaaagactacatcgttgtcggctccgactctggtcgtatcgtcattctcgaatataacaaggagaaaaatgtgttcgacaaaattcaccaggaaactttcgggaaatctggaagtcgtagaatcgtcccggggcagtatttagcaattgacccgaaaggtcgagctgttatgattggtgcttgtgaaaagcaaaagctcgtttatgttcttaacagagatacggctgcgaggttaactatttcttctccattagaggcacacaagtcacacacaattacttactccatagcaggggttgattgtgggttcgataatcctatatttgctgctatagagttggattattcagaggctgatcaggattccaccggtcaggctgcaaacgaggctcaaaaacatcttaccttctatgaactagatttggggcttaatcatgtttcaaggaaatggtctgagcaagttgataatggtgctaacatgctggtaactgtacctggtggtggtgatggtccaagtggtgtccttgtttgtgctgaaaatttcgtcatctacaagaatcaaggtcatccagatgttcgagcagtgattcctagaagggcagatctgcctgctgaacgtggggttcttatcgtttcagccactatgcacaagcaaaagtcaatgttcttctttcttctccaaacagagtatggggatgtcttcaaggtcacacttgatcatgataacgaacgagttacagagttaaaaataaagtattttgataccatacctgtctcatcttcaatgtgtgtcatgaaactagggtttctatttgctgcttcagaatttggcaatcatgctttgtatcaattccaagccattggagctgatcccgatgtagagtcatcatcagctacattaatggaaaccgatgaaggattccaaccagtgttcttcaagcctagaggtcttaaaaaccttgttagaatcgaccaagttgaaagcttaatgcccattatggacatgaaagttgtaaatcttttcgaagaagaaactcctcaaatttttaccctttgtggtcggggcccacgttcatctcttagaatactaagaccagggttagccatcagtgaaatggctgtgtcacaacttcccggtgttccaagtgcagtatggactgtcaagaagaatgtgaatgatgaatttgatgcttacattgtggtctcatttgcaaatgcaacacttgttctttctattggtgaaactgttgaagaagttagtgacagtgggtttcttgatacaacaccttcacttgctgtttcattaataggtgatgattctttaatgcaagtacatccaagtggtattagacatataagagaagatgggcgtataaacgaatggagaacacctggaaaaagaactattgtgaaagttggatcaaatagacttcaagttgttatcgcattaagtggaggtgagattatatactttgaagtagatatgactggacagttgatggaagttgaaaagaacgaaatgtcgggtgacgtggcatgtttggatatagctcctgtccctgaaggaagacaaagatcccggtttcttgcagttggatcatatgataaaaccatcagaatcttgtctttagatcctgatgactgtatgcaggttttaagcttacaaagtgtctcttcacctcctgaatcacttctgtttcttgaagttcaagcttctataggtggtgaagatggtgcagatcatcctgcaagtttgtttttaaacgcgggtttacagagtggggttctttttaggacagtggtggacatggtgacaggtcagctttcagatgccagatcccgatttctagggcttagagctcctaaattgttttctattttggtgagagggagacgtgctatgctttgtttgtctagtagaccatggttaggttatgttcaccagggtcactttcttttaacccctctttcatatgaaaccctagaatatgcagcttctttttcatccgatcaatgtgctgaaggtgttgttgcggttgctggtgatgctttaagggttttcacaatcgaaagattaggtgaaacttttaatgaaacctctattcctttaagatacactccaagaaaatttgtgtttcatcctaaaaagaaacttttggtgacaattgaaagtgatcaaggggcgtttccggcagaattacgtgaaagtgcgaaaaaggagtgttttgaagcagctggtcaagggcaaaacggtaaaatggagagtgaaaacggtaatgatgatgaagataaagacgacccgttatccgatgagcaatacgggtacccgaaagctgaagcggataaatgggtatcttgtattagggttcttgacccaaagtcaactgaaactacttgtttattggagcttcaagatgatgaggcagcttttagtctttgtactgtgaattttcatgataaggagtatgggacacttttagctgtggggacagcaaaaggtttacagttttggcctaaaaaatctttagttgctggatatattcatatttatagatttgtaaaagatggaaggtcgcttgaacttttacataaaacacaagttgatggggtcccacttgctttgtgtcagtttcaaggaagattgcttgctggaatcggatctattcttaggctttatgatttggggaaaagaaggctgcttagaaaatgtgaaaacaagttgtttccaaacaccatcaattccattcatacatatcgtgatcgaatctatgtgggagacattcaagagtcatttcactattgcaaatacagacgcgatgaaaaccagctgtatgtatttgctgatgactctgttccaaggtggctaacagcagcataccatgtggactttgacaccatggcaggtgcagacaaatttgggaacatttactttgttcgtttgccacaagatgtttcagatgagattgaagaagatccaactggtgggaagattaaatgggaacaagggaagcttaatggagctccaaataaagtcgaggagattgttcagtttcatgttggtgatgtggtcacatgtttgcagaaagcatctttgattccaggtggagtggagtgtgtcatgtatggaactgtcatgggtagtctaggggcattattggcatttagctcgcgtgatgatgtggacttcttttcacatttggagatgcatatgagacaggagcatccgcctttgtgtgggagagaccatatggcgtatagatctgcttattttcctgttaaggatgtgattgatggagacctgtgtgaacaatttccgacattgcccttggatatacagaggaaaattgcggatgaattggataggactccaggagaaattatgaagaaattggaagaagttagaaataagattgtttaagataaagatgagatgatgctattatgagtgccaaaagcatagggtgactatacgaggttaaattggaattgactttgattttattatagcagccttcccttcgcttctatctgttagatgttttcttgtaattatacatatgtttttatggaatttactcaattgtttgtgaatccttgtagaatcgctacttattttagttctgtgttttgttaaagaaccaaggctaaagattttggctctgtagtctgtagtgaagtgcatttatctgtaacactctttttaaaccttttgaatggtgattatttacttacctctggaatgctca

SEQ ID NO: 1962 - DNA, 4500 bp, Glycine max
tttaagaatactaaaaaaaaagtactttgtctcatttaagccaaaataacagtgaagagagccaaatgaaaggaaagcccaggtagggttttgttattcccggtctgctcactgacactgataacgagtctctcttcagtcttcaccctctgtcagtgaatgttcaattgatacaacaaaaccccaacctatacccaaccaccgccatgtatctctacagtcttactctgcagcgccccaccggcatcatctgcgccataaacggcaacttctccggcggcaagagccaggaaatcgtggtggcccgcggtaaggttctcgatctcctccgccccgacgacaatggtcggatccaaaccattctctccgtcgaaatctttggcgccatccgctccctcgcccagttccgcctcatgggcgcccagaaggactacatcgtcgtcggctccgactccggccgcatcgtcatccttgaatacaacaaggagaagaacgtcttcgacaaaatccaccaagaaaccttcggcaaatccggttgccgccgaattgtccccggtcagtacctcgccatcgatcccaaaggtagggccgttatgattggcgcctgcgagaagcagaaactcgtttatgttttgaatagggacactgctgctaggttaaccatttcttcccctttagaggctcataaatcccacactttagtttactcaatttgtggcgttgattgtggctttgagaaccctatttttgctgccattgaattggattactctgaggctgaccaggattccactggcctggctgcttctgaggctcagaagcatttgaccttttacgagcttgatcttggccttaaccatgtttccagaaagtggtccgagcaggttgataatggggccaatttgcttgttactgttcctggaggtggtgatggccccagtggtgtgcttgtttgtgctgagaattttgttatttataagaatcaggcacatccggaggtcagggctgtgattcctcggcggaccgacttgccggccgagcgcggcgtgcttattgtgtcagctgctatgcataaattgaagaacatgttcttcttcctcctgcagacagagtatggggatatttttaaggtcaccttggagcataataatgatcgtgtctcggagttgaagattaagtattttgataccattcctgttacagcttcgatgtgtgtgctgaagtcggggttcttgtttgcggcatcggagtttgggaaccatgctctgtatcagtttaagtctataggggatgaggatgatgtggaggcgtcgtctgccacgttgatggaaactgagcaaggttttcagcctgtgtttttccagcccaggaggctgaagaaccttgttaggattgaccaggttgagagtttgatgccgataatggatatgaaggtcagtaatctttttgaagaggaaactcctcagatttatactctctgtgggcgtggtcctcgatcctctttgaggatcctgagaactggtttagcagttagtgagatggccgtgtccaagcttcctggtatacctagcgctgtttggactgtgaagaagaatgctattgatgagtttgatgcatacattgttgtgtcattcacaaatgctacacttgtgctttccattggtgagactgttgaagaagtcagtgacagtgggtttcttgacactacaccctcccttgctgtttctttgataggagatgattctctcatgcaggttcacccaaatggtattaggcatattagggaggatggccgtattaatgaatggagaactcctggaaagaggactatttcaaaagttggatcaaatagacttcaagtggttattgcactgagtggaggggagcttatatattttgaagtggatgtaactggtcagttgatggaggtggagaagcatgaaatgtctggggatgttgcttgtttggacattgctccagtgcctgaaggcagacaaagatctcggtttcttgcagttgggtcatatgacaagaccatccgcatcttatcgcttgatcccgatgattgtatgcaggctctaagtgtacaaagtgtttcttcagctccagaatctcttctttttctcgaagttcaagcatctgttgggggtgaggatggtgccgatcatcctgctagccttttcttgaatgctggcttacagaatggtgtcatgtttagaactgtggtggatatggttacaggtcagctttctgattcacgttcccgattcttgggattgagagccccaaaattgtttcccattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacggaaacttctggtgatgattgagagtgatcaaggagcattaactgcagaagagcgtgaagctgcaaggaaagagtgttttgagtctgctcaagctggggaaaatggcactgaaagtgcagaccaaatggagaatggtggtgaggatgaagataaagatgatccactttcagatgagcattatggttatccaaaagctgaatcagataaatgggcttcctgcatcagagttcttgatccaaggacaggaaatactacttgtcttttggagcttcaggaaaatgaagctgctttcagcatttgcaccataaatttccatgataaggaatacggaactcttttagctgttggcactgcgaagggactgcaatttttgcccaaaaggaccataactgctggattcattcatatttataggttcgtagaggatggaagatctcttgaacttcttcacaaaactcaggttgaaggtgttcctcttgctctatgtcaatttcaaggaagattacttgcagggataggacctgtgctcaggttgtatgatttgggaaaaagaagattgttaagaaaatgtgagaataagctattccccaacacaattgtctccattcatgcatatcgcgatcggatttatgttggtgatgtccaagagtccttccattattgcaagtataggcgtgatgaaaaccaactttacatatttgctgatgattgtgttccaaggtggcttactgcatcataccacatagattttgacaccatggcaggtgcagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcacattggtgatgtcgtcacatgcttgcaaaaggcttctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgcgagcaatacccaacattgccaatggatttgcagagaaaaattgccgatgaattggacagaacccctggagagatactgaagaaacttgaggaagtgcgaaataagattatttaagaaatggtagcctgagaggtcatagtggaaatgtgcttttctggtaggtcatttgcccacagttaggtcactactaacaaagtgaagcaagcttgtgtatctcattcatacgggaacggtgatttcttgtcctattgaaacggggtgaaggaccggacggtgactttgtactctattgaagtgaaacccataagcctcagttggtaatttacgttgtaattactaatagtagcaattaactgttatcacgcgttgtagatgtgataacatgctccatctctcttctacgactctcccactcagcatcctgtcttgtactcaatgaaatgtttgatttaacttgatttgaaatttatagtctagaatatcaccgtttaactaccattttaacgaaacctaggttaggttctagttctactgagttatcgtagagcagtttttcaaaatttaacacatgtagtataccctatcaaaatacatcaacattatgcatgaaagagttgtttgaggctaaatatttattttattgttgtgcaaatgtaatgttaaccgatagatgattcgggttttggtactgaatttgtggtacctgctttttccacggtttgttattgattgcgactactgttgaaatgagtctagaagcaga

SEQ ID NO: 1963 - DNA, 3962 bp, Allium cepa
caccgtcttcgcatttctacgttctcctccatctccagccaataaattcctgaatcctacttctacccttttttcttcttctccattgattttgctctatatttccacctattaataaacaaaaccctagtctctcaaatcaataaagtatgtacttgtacaatctaacgctgcaggattcaactggaatcctctccgctataaacggaaatttctcgggcacaaaatcccaagaaatcctcgttgcccgcggaaaatccctctccctcctccgcccagacgatgcaggaaagctacagacgctactttcaatccagatctttggcgcaatacgctctcttgcccacttccgtctaaccggttctcagaaggacttcatcattgtcggttctgactctggcagaatcgtcatcctagagtatttcaaagaccgcaacgtgttcgataaacttcatcaggaaacttttgggaagtcaggatgccgcaggattgttcccggacaatatctagccgttgatccaaaaggtcgtgctgttatgattgctgcgtgtgaaaagcagaaactggtctatgttctaaacagagatacagcagctaggctgactatttcaagtcccttagaggcgcataagagtcataacatcacatactcagttgtgggtgtggactgtggattcgataacccggtttttgcagccattgaattggattactctgaagcggatatggatccgactggagatgctgctagtgaggctcagaagtgtttgactttttatgagcttgatttgggactgaatcatgtttcaaggaagtggagtgaaccggttgataatggggcaaatatgcttgtgacagtgccaggtggaggagatgggcctagtggggttttagtttgtgcagagaattttgttatttataagaatcagggtcatccggatgtgaggtgtttgattccaaggagggcggatttgcctgcagagaggggtgtacttatagtttctgcagctacacataagatgaagtccatgttttctttttgttgcaaacggagtatggtgatatatttaaggcaactttggtttatgaaggtgatagggttagcgagttgaaaattaagtattttgatacgattccagttacttctagcatgtgtttgatgaagacaggttatttgtttgctgcctctgagtttgggaatcatgggttgtaccagtttcaggctattggggatggtgatgacgtggaggcatcatcagagagtttgatggaaactgaggaagggtttcagcctgtgttttttcaaccaagagggttgaaaaatcttttgaggattgatcaggttgcaagtcttatgcctattatggatatgagaattacgaacttctttgatgaggagacgtctcagatatatgctttgtgtgggcgtggcccacgttcttctcttaggattttgaggcctgggttggccattagtgaaatggctgttgagcgtttgcctgatgtgcctaatgcagtatggactgtaaagaagaatgtaactgatgagtttgatgcctatattgttgtgtcttttccaactgctacacttgtgctttctattggtgagactgttgaggaagttagcgatagtgggtttcttgacacgaccacttctcttgctgtttcattgcttggagatgattctttaatgcaagtgcatcctaatggaattaggcatattagagaagatggtcgtattaatgagtggaagacacctgggaagaagacaatagtgaaagtgggttctaataggcttcaggtagttattgctttaagtggcggtgaacttatttactttgaaatggatatgactggtcaattgatggaagtagaaaagcatgagatgcctggtgatgtggcttgtctagatattgcgcctgttccagaaggaaaacaaagatctcgatttcttgcagtagggtcatatgacaacacaattagaatattatcattagatcctgatgattgtatgcaagttttaagtgttcaaagtgtttcatcttctcctgaatctcttcttttacttgaggttcaggcctcagttggaggcgaagatggtgctgaccatcctgctagtgtgtttcttaatgcaggtttgcagaatggggtattgttcagaactgtagtagatatggtaacgggtcagttatctgatacccgttctagattcttaggtttgagagcaccgaagttgttttccgctactgttaggggaaggcaagcaatgctttgcttatcaagtcgcccatggttagggtacatacatcaagggcatttcttgttgactcctctttcatacgaaacacttgaatttgcagcctccttttcctctgatcagtgtgctgaaggagttgttgcagtggctggagatgctttgagagtctttactatagaaaggttgggtgaaacctttaatgagacggttatacctttgcgctacactccaaggaagtttgttcttatacctaagaaaaaacttgcggttattatagagagtgatcaaggggctttcaatgcagaagagagggaagctgcaaggaaagaatgctttgaagctgcagatggagttggagagaatggaaatgcaaataatgttgaaaatatggaaaatggtgaagaagaagaaaaagaagatcctcttaacgatgagcagtatggttatccgaaagcagaatcagacaaatgggcctcttgtattagagttcttgatcctagatcggggaacactacatgtttactcgaactgcaagataatgaagccgcctttagcttgtgcactgtaaattttcatgacaaagagtatggtacattacttgctgtaggtacggcaaaaggtttgcaattttttccaaagaggacattcactgctgggtttattcatatttatagattcgtggaagatggaaaatcactggagttgttgcataagacacaagttgaaggtgttccactagcattgtgccagtttcaaggtagacttcttgcaggaattggtccggtgcttaggctgtatgatttagggaaaaagagattgcttcggaaatgcgagaacaagctctttcctaagaccattgtttctattcatacataccgcgataggatttatgttggtgacatccaagagtcattccattattgcaagtacagacgagacgaaaaccaactatatatatttgcagatgattctgttccaagatggttaactgcagcatatcatgttgattttgacaccatggctggtgctgacaagtttggtaacatttattttgcaaggctaccgcaagatttgtccgatgaaatcgaagaagatccaacaggcggtaaaataaaatgggaacaagggaaattgaatggcgcccccaataaaatagaagagattgttcagtttcatgtaggagatgtagtcacatcattgcaaaaagcttcattagtacctggtggtggtgaatgtattatttatggaactgttatgggaagcttaggtgcactacttgcatttacatctagagaggacgttgatttctttaatcatttggagatgcacatgagacaggaacatcctcctttgtgtggcagagatcatatggcttatagatccgcatattttcctgtcaaggatgtaattgatggtgatttgtgcgagcaattccctaccctcccaccggatttgcagagaaagattgcagaggaattggatagaaccccaggagaaattctcaagaaattagaagatgctagaaacaagatcatctgagtaactactatccaagcactgtctaacttagcttgtttttactgttttaggattgttctttttccctccaagcgttctgtttctattttctgaagagaatacgcagtcaatatttttgtaacgttggatgtgccataaagtataattttgtatccttgtttgctat

SEQ ID NO: 1964 - DNA, 3978 bp, Amborella trichopoda
ccatgtacctctacggattgaccctgcaacaggccactggcgtggtttgtgcaacctatggaaacttcgtaggtggaaaatcacaagagatcattgtagcgagaggcaaagttctcgatcttcttcgacctgatgatagaggtaagctccaaactctactctcagttgaggtttttggggccattcgatctctggttcagttccgactcaccggttcacaaaaagactacatagttgtgggctctgattcaggtcgaatagtgatcttagagtacaacaaagagaagaatatctttgagaaaattcaccaagaaacatttgggaaatcaggttgccgaagaatcgttcctggccaatatctggcagttgatcccaaggggcgagcggttatgattggggcttgtgaaaaacaaaagttagtctatgttttgaatcgtgatacctcagctaggctcacaatttcatcaccccttgaagctcacaaatctcacactgtagtatactccattgctggtgttgattgtggttttgataacccaatctttgcagctatcgagcttgattactctgaagctgatcaggactcgactggtcaagcagctagtgaggcccaaaagcacctaactttttacgagcttgatcttgggttaaaccatgtctcccgcagatggtcggagcctattgataatggggcaaatatgctggtcaccgtaccaggaggtggtgacggcccaagcggcgtcttagtctgcgccgaaaattttgtaatttacaagaaccagggacatccggatgtgcgggcagttatcccaaggcgtgctgatttgcctgctgaacggggggttttgattgtttctgctgcaacacataggataaagtctatattctttttcctcttgcaaactgagtacggtgatatattcaaggtgacattggagcatgataacgatagggtatcagagttgaaaattaagtattttgatactattccagtcactacggcaatgtgcttgctcaagtcggggtttttgtttgcggcttcagagtttgggaaccatgcattgtatcaatttcaggggattggggatggcgatgatgttgaggcttcatcggctacgatcatggagacagatgaggggtttcagcctgtgttttttcaaccacggggcctaaagaaccttattaagattgatcaggtagagagcttgatgcccattatggatatgaaggtgattaatctctttgaggaggagacaccccaaattttcaccttgtgtggtcgcggtccccgatcgtcattgcggatcctacggccgggtttggctgtgagtgagatggccgtgtcacagctccctggtgtcccaagtgcagtgtggacagtgaagaagagtgcaagtgacgagttcgatgcttacattgtggtttctttcgcaaatgcgacacttgttctatcaattggagagacagttgaagaagttagcaatagtgggtttctcgatactactccctctcttgctgtttcccttttgggtgaggattctttaatgcaagttcaccctggtggcattagacacatcagggaagatggtcgaattaatgagtggaaaacaccgggaaaaaagacgattgttaaggtgggttcgaatagatctcaagtggtgattgctttgagtggtggggagctcatttattttgagatggatgagacaaggcagcttatggaggtcgagaagcacgagatgacaggtgatgtcgcatgccttgacatcgccccggtacctgaaggaaggaaaagatcacgttttttggcagtaggctcttatgatagcaccattcgcattctctctttagaccccgacgactgtatgcaagtgttgagcatgcaaagtgtgtcttctccacctgagtcccttctattgctcgaggttcaagcttcagttggtggtgaagatggggccgatcgcccagctagtgtttttttaaatgctggtctccaaaatggtgtgctttatcgaaccgaggttgatatggtcaccggtaacctctcggatactcgttctcgctttttgggtcttaggcctcccaagctatttgcttgtatggttcgaggtcggagagccatgctgtgcctttcaagtaggccatggcttggatacattcatcgtggccattttttgcttaccccactttcatatgagaccttggaatatgcagcttcattctcttccgatcagtgtgctgaaggtgttgttgcagttgcaggggatgcattgagggtctttacaattgaaaggttgggtgaaactttcaatgaaacagtggttcctttgaggtatacccctcgaaaatttgttctccatccaaaaaagaagcatttggttatagtggagagtgatcaaggggctttcacagccgaggagagagaggcagcgaggaaggagtgcttagaagctgctggtctaggggaaaatggcaatgccaatgctgatcaaatgcaagagaatggggatgatgaagagaaggaagatccacttcctgatgagcaatatgggtacccaaaggcggaatcagacaagtgggtctcatgtattagggttctcgacccaaggtccggaaacacaacgtgtttattggaacttcaggacaatgaggcagcatttagtgtgtgcactgtgaatttcagtgacaaggagtatggaactcttgtggctgttggtacggccaagggactgcagttttggccaaaaaggcaagtttcagtggggtttatccatatatatagatttgttgaagatggcaaggcacttgaacttttgcataaaacgcaagtggatggggttcctctagctttatgccagtttcaagggaaattactggctggtataggtccagtgctgaggttatatgacttggggaaaaggaagttgcttcgaaagtgtgagaataagctgttcccaaataccatagtatctatccacagttaccgtgatcgtatttatgttggcgacatccaggagtcattccattatgtaaaataccgaagggacgagaaccaactctacattttcgcagatgattctgtccctcgatggttgaccgcatcataccacatagatttcgacacaatggcaggatctgacaagtttgggaacatctactttgtgaggttgccacaagatgtttctgatgagattgaagaagacccaactggtggaaagatcaagtgggagcaaggaaggcttaatggggctcctaacaaaatggaagagattgttcagttccacgtgggtgatgtggtgacttgccttcaaaaggcatcactaattcctggtggtggtgagtgcatcatttatggcacagttatggggagcctgggagctttgcttgccttcacttcgagagaagatgttgacttctttgcgcacttggagatgcatatgaggcaggaacacccccctctttgtggaagggaccatatggcctatcgatctgcttatttccctgttaaggatgtgattgatggtgatctttgtgagcaattcccaacgctcgccccagatttgcagaggaaaattgcagacgaactcgatagaaccccaggcgagatcctcaagaagcttgaagatgtcaggaacaggatcatctagtttagatgatacgctaggctccttgacgacccactaaattttgtaaaattatgcctctctctctctctctcatagccaatctgttgatttaagggcaaaggcactatttgtgaaaattgtgggaggagcctcaaactgatggtacagaattgttgattgtatgctcttgttgatggtttaagcgctaactggttgtgtattgcattggctccttgagttatgacatgagtgcatgctccttacctgaatacaaatctcgctgtagtctgttgagtcttttggcatgtagtttggactatgatgttataattgtggcattaggagttgttta

SEQ ID NO: 1965 - DNA, 3902 bp, Citrus clementina
tcaaaaccctaaccctaagcctaagcctaagcctaaccccaccactaccatgtacctctacagtctcaccctccagcaacctaccggcataatagccgccattaacggcaacttctccggcaccaaaacccccgaaatcgtcgtcgcccgcggcaaggtcctcgagcttctccgccccgaaaactccggcaggatcgaaaccctcgtctccaccgaaatctttggcgctattcgctcccttgcccagttccgccttaccggctcgcaaaaagactacatcgtcgtcggttcggactcgggtcggatcgtaatccttgaatacaatccgtcaaagaatgtcttcgataaaattcatcaagagactttcgggaagtcgggttgccgtcggatcgttccgggtcagtacttggccgttgaccccaagggtcgagccgttatgattggtgcttgtgaaaagcaaaaattagtttatgttttgaatagagacactgctgctaggttaacaatctcttcgcctttagaagcacataaatcacacacgatagtttattcaatatgcggaattgattgcgggtttgataaccctattttcgctgccattgagttggattactctgaggctgaccaggattctactgggcaggctgcaagcgaggcacagaagaatttgacattttatgagctagatttagggcttaatcatgtttccaggaaatggtcagaaccagtggataatggggctaatatgttagttacggtgcctggaggaggggatgggcctagtggagttttggtttgtgctgagaattttgttatttataagaatcagggtcatccggatgttagggctgtgattcctagacgagcggatttgccagccgaacgtggggttttgattgtttcagccgcgactcataggcagaaaacattgtttttctttttgttgcagactgagtatggggatatatttaaggttactttggagcatgataatgagcatgttagtgagttgaagattaagtattttgatactattccggtgactgcatcaatgtgtgtgttgaagtcagggtatttgtttgctgcttctgagtttgggaaccatgctttgtatcagtttcaagcaattggggctgaccctgatgtagaggcctcatcttctacgttgatggagactgaagaaggatttcagcccgtgttttttcagcctagagggttgaagaatcttgtgaggattgagcaagttgaaagtctgatgccaataatggatatgaggattgcgaatttgtttgaggaggaagcgccccagatatttacattatgtggacgtggtcctcgttcgtctcttaggatactgaggccaggtttggctgtgagtgagatggctgtgtcgcagcttcctggtgtcccaagtgctgtttggactgtgaaaaagaatgttaatgatgagtttgacgcatacattgttgtttctttcaacaatgccactcttgtgctttcaattggtgaaactgttgaagaagttagtgatagcgggtttcttgataccaccccttcacttgctgtttcactaataggtgatgactctctgatgcaagttcatcccagtggtattaggcatattagggaagatggtcgtattaatgagtggagaactccaggaaagaggacaattgttaaggttggttccaatagacttcaggtggttattgcactgagtggaggggagcttatttacttcgaagtagatatgaccggacaactgttggaagtggagaagcatgaaatgtctggagatgtggcatgtttggatattgcttcagttcctgaaggaaggaagagatcccgtttccttgctgtgggttcgtatgacaatacaatacgtatcttatcattggatcctgatgactgtatgcagatactgagtgtccaaagtgtgtcatcacctccagagtcgctccttttccttgaagtgcaggcatcggttggtggagaggatggtgctgatcatcctgctagtcttttcctcaatgctggtttgcagaatggggttctgtttagaacagtggtagatatggtgacaggtcagctttcagattcgcgttccagattcttgggattgagacccccaaagctcttttctgttgttgtgggaggccgggctgcgatgctttgcttgtctagtcgaccatggcttggttatattcatcgaggacggttccttttaacacctttatcttatgagactcttgaatacgctgcctcattttcatctgatcagtgtgtggagggtgttgtttctgttgctgggaatgcattgagggtttttaccattgagcgactaggagaaacctttaatgaaacagctcttcctttaaggtacacaccaagaagatttgttcttcaacctaagaagaaattgatggtaattattgagactgatcaaggagcactcactgcggaagagcgtgaagctgcgaaaaaggagtgctttgaggctgctggaatgggggaaaatggaaatggtaatatggaccagatggagaatggtgacgatgagaataagtatgatcccctctccgatgagcaatatggttatccgaaggcagaatcagacaagtgggtttcttgcattagagttcttgatccaagatcagctaatactacttgcctactagaacttcaggacaatgaggctgccttcagcatttgtactgtgaattttcatgataaggagcatggaactctcttggctgttggtacagctaagggactgcagttttggcccaaaagaaacattgttgctggttatattcatatttataggtttgtggaagaggggaaatcccttgaactactgcacaagacacaagtagagggcattcctcttgctttatgccagtttcagggtagattacttgctggaataggccctgtgctgagattgtatgacttggggaagaagagattgcttagaaaatgtgagaataagctgtttcctaacactattgtctcaattaacacctatcgtgatcgaatctatgtaggtgacatccaagagtcattccatttctgcaagtatagacgggatgagaatcaactctatatttttgctgacgattctgttccaagatggctcactgcagcacatcacatagattttgacaccatggccggtgccgacaagtttggtaatatctattttgtgcgactaccacaggatgtttctgatgagatagaagaagatccgactggtgggaagataaagtgggagcaggggaagcttaacggagctcccaacaagatggaggagatagtacagtttcatgttggtgatgtggtcacatccttgcagaaggcatccctggttccaggtggtggggagagtgtcatttatggaacagtgatgggtagcttgggagctatgcttgcattttcatcccgtgatgacgttgacttcttttctcaccttgagatgcatatgaggcaggaacatccacctttatgtggtcgtgatcacatggcttacagatcagcttatttccctgttaaggacgtgattgatggggatctatgtgagcagttcccaaccctgtctttagatttgcaaagaaaaattgccgatgaattggataggactcctggagagatcctcaagaaacttgaagaaatcagaaacaagatcgtttgagagaagaagaaactatttggatgtagcgtttattgttgttattttatttgttgtatatacgggcagcaatcttgtgatttgctaaagtaggattttagcttgtattgttgaaatttttctgtgttcctctgtactgctacttggtactcttaactaatgccggaacctgttcaagtgtccttccttgaatgattacaaatgcttcaattcc

SEQ ID NO: 1966 - DNA, 4224 bp, Echinacea purpurea
tgaaaatcttcatccttccgcatgaccaccaccaccaccatgtacctctacaacctcactctgcaacaagctactggaatcgtctgcgccatcaacggcagcttctccggcggcaacaaatcccaagaaatcgtcgtcgctcgcggcaaggtcctcgaactcctccgtcccgacgaaaacggtaagatccagaccattctttccgttgatgttttcggtgctattagatctctagctcagtttaggttaaccggtgctcaaaaggactatattgttgttggttctgattccggccgtattattattcttgagtataataaggagcaaaatgtgtttcatcaagttcataaggagacctttggcaagtctggctgtcgtaggattgttcctggtcagtatttagctattgatcctaaaggtcgtgctgttatgattggtgcttgtgagaagcagaagttggtttatgtgctgaatagggatacggctgctaggttaacgatttcgtcgccgttagaggcgcataagtcacacactattacttactcgattgctggggtggattgcgggtttgataatcccatatttgcggcgattgagttggattattcggaggcggatcaggattcgactgggcaggctgctaacgaggcgcaaaagcatcttacgttttatgagttggatttagggttgaatcatgtttctaggaagtggtctgagcaggtagataatggggctaatatgttggtgactgttcctggtggtggagatgggccgagtggtgtgcttgtttgtgctgagaattttgtgatttataagaatcaggggcatccggatgttcgggctgtgattcctagaagggcggatttgcctgctgaacgtggggtgcttattgtttcggctactatgcataaacagaaatctatgtttttctttcttttgcaaactgagtatggggatgtgtttaaggtcacacttgatcatgataacgagcgtgttactgagctgaaaataaagtactttgataccatacctgtgacatctgccatgtgtgttatgaagttaggttttctgtttgctgcttctgagtttggaaatcatgcgttgtatcagtttcaagctataggagctgatccggatgtagagtcatcatcagctacgttaatggaaactgatgaaggattccagccggtgttttttaagcctagagggttgaaaaatcttgttagaattgaccaagtggagagcctgatgcccattatggacatgaaagttgtgaatctttttgaagaagaaacccctcagatatttacactttgtggacgaggccctcgttcttctcttaggattctaagaccaggacttgccatcagtgaaatggcagtttcacagcttcccggggttcccagtgcagtttggacagttaaaaagaacgttaatgatgaatttgatgcttttatcgttgtgtcttttgcaaatgcaactcttgttctctctattggagaaactgtagaagaagttagtgacagtgggtttcttgataccacaccttcacttgctgtttcattaataggtgacgattctttaatgcaagtacaccctagtggtattagacatataagggaagacgggcgtgttaatgagtggagaactcctggaaaacgaactattgtgaaggttggatataatagacttcaggtggttgttgcattaagtggaggggagcttatatactttgaggtggatatgactggacagttgatggaagtcgagaaaaacgaaatgtctggtgatgtggcatgtttggatatcgctcctatacccaaagataagaaaagatctcgttttctagctgttggatcttatgataataccattcgtatcttatctttggatcctggtgactgtatgcaggttcttagcctgcaaagtgtttcttcacctcctgagtcacttctctttctagaggttctggcttcttcaggtggtgaagatggtgcggcccacccggctagcctgtttctgaacgcgggtcttcaaagcggggttctgtttaggaccgttgtggacatggtcacgggccagctttcagatgcacggtctcggtttttaggacttcgggctcctaagttgttctcgattatggtgagaggaagacaggctatgctttgcttgtcgagcagaccatggttaggttatgttcaccagggtcattttcttttgacacctctttcatatgaaacacttgaatttgcagcctcgttttcatctgatcagtgtgctgaaggtgtggtagctgttgcgggggatgctttaagagttttcacaatcgaaagattaggggagacttttaatgaaactgctataccgttgaggtatactccaagaaaatttgtgtttcatcctaaaaagaaacttttggtaacaattgagagtgattcgggtgcttttcctgccgagttacgtgaaagtgctaaaaaagagtgctttgaggccgcgggtcagggggaaaatggtaaaatggaaatagaaaatggtggtgatgatgaagataaagatgacccgttatccgatgaacagtatgggtaccctaaagctgaatctgataaatgggtttcttgcattcgggttcttgaccccaagtcaactgagacaacatgccttctagagcttcaagataatgaggctgctttcagtatatgcactgtgaacttccatgataaagagtatggtacccttttagctgtgggtacagcaaagggtcttcagttttggcccaaaagatctttgacagctggatatattcatatataccggtttgtgaaagatggaaagtcacttgaacttctgcacaaaacccaagttgatggtgttccccttgcattatgccagtttcagggaagactgcttgctggaattggttcgattctcaggctttatgatttggggaagaaaagactgcttagaaagtgtgagaataagctgttcccaaacacaattaattcaattcatacatatcgtgatcgaatttatgtaggagacattcaagagtcgttccactactgcaagtacagacgggatgaaaaccagctatatgtatttgctgatgactctgttccaagatggctgacagcagcacaccacgtagactttgacaccatggcaggtgccgacaagtttggaaacatttactttgtgcggttgccacaggatgtatcagatgaaattgaggaagatccaaccggtgggaagattaaatgggagcaggggaagcttaatggagcaccaaacaaggttgaagagattgtgcagtttcatgttggtgatgtggtgacatgtatgcagaaagcatctttaattccgggtggcagcgagtgtgtcatgtatggaacagtgatgggcagtttaggggcgctgctggcatttacctcacgtgatgacgtggacttcttttctcacttggagatgcatatgcgacaggaacatccacctttgtgtggaagagaccacatggcatatagatctgcgtattttccggttaaggacgtgattgatggggacctttgtgaacaattcccgacgctatctctagacatgcagcggaaaatcgcagatgaattggatagaactccagcagaaattctcaagaaactggaagaagttagaaacaaaattgtttaagatgagaagatgatgctaagactagacgggtgcgagccaaagcatgtttaactactggaaacttgaaagtcttttgagatcatagaggttaatttttactagacattcattcactatcctttagatgttttttgttgtaagtatgcagatcttaatgaaattgtttgtgaaacattgtaaacatatgttgcagagttgactcttttttcctggctgtgttttggatccggtagtagtttacttgttatggaccaaggttatagttttcaaatgattcttgcctggagaaaatttagtcatcgaaagcttctgtatgcataattacagtgatatcttcttcttagggtggagggcgtgtctaactcagagtcatgtgggttgggtgggtgcaccacagcaagtcttgcggggtagcggcgggtttcaagttttgcaagttacacaacccgggtgaaggagacgttattatggcgaatttcaagtttcgcaaggtgcacaacccaggtgccttggtatgcccacccgatcgccgaagcaattttgtga

SEQ ID NO: 1967 - DNA, 3957 bp, Citrus sinensis
agcttcttcactaaccttcactcgttttccctcaaaaccctctccttctactctcaaaaccctaaccctaagcctaagcctaagcctaaccccaccactaccatgtacctctacagtctcactctccagcaacctaccggcataatcgccgccattaacggcaacttctccggcaccaaaacccccgaaatcgtcgtcgcccgcggcaaggtcctcgagcttctccgccccgaaaactccggcaggatcgaaaccctcgtctccaccgaaatctttggcgctattcgctcccttgcccagttccgccttaccggctcgcaaaaagactacatcgtcgtcggttcggactcgggtcggatcgtaatccttgaatacaatccgtcaaagaatgtcttcgataaaattcatcaagagactttcgggaagtcgggttgccgtcggatcgttccgggtcagtacttggccgttgaccccaagggtcgagccgttatgattggtgcttgtgaaaagcaaaaattagtttatgttttgaatagagacactgctgctaggttaacaatctcttcgcctttagaagcacataaatcacacacgatagtttattcaatatgcggaattgattgcgggtttgataaccctattttcgctgccattgagttggattactctgaggctgaccaggattctactgggcaggctgcaagcgaggcacagaagaatttgacattttatgagctagatttagggcttaatcatgtttccaggaaatggtcagaaccagtggataatggggctaatatgttagttacagtgcctggaggaggggatgggcctagtggagttttggtttgtgctgagaattttgttatttataagaatcagggtcatccggatgttagggctgtgattcctagacgagcggatttgccagctgaacgtggggttttgattgtttcagccgcgactcataggcagaaaacattgtttttctttttgttgcagactgagtatggggatatatttaaggttactttggagcatgataatgagcatgttagtgagttgaagattaagtattttgatactattccggtgactgcatcaatgtgtgtgttgaagtcagggtatttgtttgctgcttctgagtttgggaaccatgctttgtatcagtttcaagcaattggggctgaccctgacgtagaggcctcatcttctacgttgatggagactgaagaaggatttcagcctgtgttttttcagcctagagggttgaagaatcttgtgaggattgagcaagttgaaagtctgatgccaataatggatatgaggattgcgaatttgtttgaggaggaagcgccccagatatttacattatgtggacgtggtcctcgttcgtctcttaggatactgaggccaggtttggctgtgagtgagatggctgtgtcgcagcttcctggtgtcccaagtgctgtttggactgtgaaaaagaatgttaatgatgagtttgacgcatacattgttgtttctttcaacaatgccactcttgtgctttcaattggtgaaactgttgaagaagttagtgatagcgggtttcttgataccaccccttcacttgctgtttcactaataggtgatgactctctgatgcaagttcatcccagtggtattaggcatattagggaagatggtcgtattaatgagtggagaacgccaggaaagaggacaattgttaaggttggttccaatagacttcaggtggttattgcactgagtggaggggagcttatttacttcgaagtagatatgaccggacaactgttggaagtggagaagcatgaaatgtctggagatgtggcatgtttggatattgcttcagttcctgaaggaaggaagagatcccgtttccttgctgtgggttcgtatgacaatacaatacgtatcttatcattggatcctgatgactgtatgcagatactgagtgtccaaagtgtgtcatcacctccagagtcgctccttttccttgaagtgcaggcatcggttggtggagaggatggtgctgatcatcctgctagtcttttcctcaatgctggtttgcagaatggggttctgtttagaacagtggtagatatggtgacaggtcagctttcagattcgcgttccagattcttgggattgagacccccaaagctcttttctgttgttgtgggaggccgggctgcgatgctttgcttgtctagtcgaccatggcttggttatattcatcgaggacggttccttttaacacctttatcttatgagactcttgaatacgctgcctcattttcatctgatcagtgtgtggagggtgttgtttctgttgctgggaatgcattgagggtttttaccattgagcgactaggagaaacctttaatgaaacagctcttcctttaaggtacacaccaagaagatttgttcttcaacctaagaagaaattgatggtaattattgagactgatcaaggagcactcactgcggaagagcgtgaagctgcgaaaaaggagtgctttgaggctgctggaatgggggaaaatggaaatggtaatatggaccagatggagaatggtgacgatgagaataagtatgatcccctctccgatgagcaatatggttatccgaaggcagaatcagacaagtgggtttcttgcattagagttcttgatccaagatcagctaatactacttgcctactagaacttcaggacaatgaggctgccttcagcatttgtactgtgaattttcatgataaggagcatggaactctcttggctgttggtacagctaagggactgcagttttggcccaaaagaaacattgttgctggttatattcatatttataggtttgtggaagaggggaaatcccttgaactactgcacaagacacaagtagagggcattcctcttgctttatgccagtttcagggtagattacttgctggaataggccctgtgctgagattgtatgacttggggaagaagagattgcttagaaaatgtgagaataagctgtttcctaacactattgtctcaatcaacacctatcgtgatcgaatctatgtaggtgacatccaagagtcattccatttctgcaagtatagacgggatgagaatcaactctatatttttgctgacgattctgttccaagatggctcactgcagcacatcacatagattttgacaccatggccggtgccgacaagtttggtaatatctattttgtgcgactaccacaggatgtttctgatgagatagaagaagatccgactggtgggaagataaagtgggagcaggggaagcttaacggagctcccaacaagatggaggagatagtacagtttcatgttggtgatgtggtcacatccttgcagaaggcatccctggttccaggtggtggggagagtgtcatttatggaacagtgatgggtagcttgggagctatgcttgcattttcatcccgtgatgacgttgacttcttttctcaccttgagatgcatatgaggcaggaacatccacctttatgtggtcgtgatcacatggcttacagatcagcttatttccctgttaaggacgtgattgatggggatctatgtgagcagttcccaaccctgtctttagatttgcaaagaaaaattgccgatgaattggataggactcctggagagatcctcaagaaacttgaagaaatcagaaacaagatcgtttgagagaagaagaaactatttggatgtagcgtttattgttgttattttatttgttgtatatacgggcagcaatcttgtgatttgctaaagtaggattttagcttgtattgttgaaatttttctcagtgttcctctgtactgctacttggtactcttaactaatgccggaacctgttcaagtgtccttccttgaatgattacaaatgcttcaattcc

SEQ ID NO: 1968 - DNA, 3838 bp, Daucus carota
caaaatcctcgatcctccaactcagagattcactcgtgacattttcacctccttacctaaaaccctttgcttcaaatctccccttttatgatttctagggttttataacatttccccaattactatctctctgcaaaccctaattcccttttgctccgacaatttctagggtttagtaaaatcatgtatctctacaatctcacacttcaacaagctacaggcattgtttgtgcaatcaatggcagcttcactggtggcaagtcccaagaaattgttgtagctcgtggcaaagttcttgatcttttaaggcctgatgataatggtaagattcaaactattttatctgtcgaaattttcggtgctattcgttctttagctcagtttcgattaacgggtgctcataaagattatattgttgttggttctgattctggtagaattgttatattggaatataataaggagaagaatgtgtttgataaaattcaccaagagactttcgggaaatcagggtgtaggaggattgttccggggcagtatttggggattgacccgaaagggagggcggtaatggttggtgcgtgtgagaagcaaaagttggtttatgtgttgaatagggacacgtcggctaggttaactatttcgtcgcctttagaggcgcacaagtcgcatacgattgtgtattcgattgttggggtggattgtgggtttgataatccgatttttgcggcaattgagttggattattcggaggcagaccaggattcgacggggcaggcggctagtgaggcgcagaagcacttgacgttttatgagctggatttagggcttaatcatgtctcgaggaagtggtcggagcaggttgacaatggggcgaatatgcttgttacggtgcctggtgggggagatgggcctagtggtgtgcttgtttgtgcggagaattttgtgatttataagaatcaagggcatcctgatgtaagggctgtgattcctagacgagctgatttgcctgctgagcgtggggttttgattgtttcggctgctatgcacaaacagaagtcaatgtttttctttttgttacagacagagtacggtgatgtttttaaggttacacttgaccatgataatgaacgtgtttctgagctaaaaattaagtattttgacactatcccggttacctcttctttgtgtgtgctgaaactggggtttctctttgctgcatctgagtttggaaatcatggtttgtatcagtttcaagcaattggagatgatcctgatgtggaatcttcatctgctactttaatggaaacagaagaaggttttcaacctgtattttttcaacctagaggactgaagaaccttgtcaggattgatcaggtggagagtttgatgccaataatggatatgaaagtaacaaatcttttcgaggaagagactcctcaaatattttcgctttgcgggagagggcctcggtcttcactacgtatactaagaccaggtttagcaatcagcgaaatggctgtgtcccagcttcctggtgttcctagtgcagtctggactgtgaaaaagaatgtaaatgatgaatttgatgcatatatcgttgtttcatttactaatgctactctcgtcctttctattggtgagacggtcgaagaagttagtgatagtgggttccttgataccaccccttctcttgatgtatcattgataggcgatgattcgctgatgcaagttcatccgactggtatcaggcatataagagaagatggacgtataaatgagtggagaactcctggaaaaagaacaattgttaaggttggttccaatagacttcaggttgtagttgcattgagtggaggagaacttatatactttgaggtagatatgactggccagcttatggaggtagagaaacatgaaatgtcgggggatatagcttgtttggacattgcacctgtacctgaaggaagacagagatcccgctttctagcagtgggatcatacgacaacactatccgtatcttatcattagatcctgatgattgtatgcaggttctgagcctgcaaagtgtatcatcacccccagattctctcctttttcttgaagttcaagcatctattggtggtgaggatggtgcagaccaccctgctagcctttttctcaatgcaggtttgcagagtggtgttctattcagaacagtggttgatatggtgacaggccagctgtcagatgcccgatctcgtttcttagggcttagagcaccaaagctcttttctgttgctgtgaggggacgccgtgctatgctctgtttgtcaagtagaccatggcttggttatatccaccaaggacattttttgctgactcccttgtcgtatgagactcttgaatatgcagcctcattctcatccgatcagtgtgccgaaggtgttgttgctgttgctggagatgcgttgagagtttttaccatagagaggttgggtgaaacgtttaatgaaacaacgatccctttacggtacacaccaagaaaatttgtgattcaaaacaagaggaagcttttggttatcattgagagtgatcaaggagcatttgctgcagaagaccgtgaagctgcaagaaaggaatgttttgaggcagctggaatgggtgaaaatggtaaaacggagacggagaatggtgctgatgatgaggataaggatgatcccctctcagatgagcagtatggttatcctaaagcagagtcggacaaatgggtttcttgtataagagttcttgatccaaggacaacggaaacaacttgtctgcttgagcttcaggacaatgaagctgccttcagtatatgcacggtaaatttccatgataaagagtatggaactcttctagctgttggtacagccaaaagcttgcagttctggccaaagagatctttctcggctggatatattcatatttatcgtttcctgaaagatggtaaatcgcttgaactactgcataagacacaagtggatggtgtacctcttgcattgtcccaatttcaaggaagattacttgctggaataggaccagttctcagattgtatgatttggggaaacggagactgcttaggaaatgtgagaataaattatttcccaacacaattaactctattcatacatatcgtgaccggatttatgtgggtgatattcaggagtcgttccattattgcaagtataggcgtgacgaaaatcaactatatatattcgctgatgattctgtcccaagatggctcactgcatcataccatatagactttgacacgatggcaggtggagacaagtttgggaacatctattttgtgagactaccacaagatgtatctgatgagattgaagaagatccaactggtggaaagataaaatgggagcagggcaagctgaatggagccccaaacaaagttgaagaaatagtgcaatttcatgttggcgatgttgtaacatgcttgcagaaagcatctcttattcctggaggtcaagaatctcttatatatggaactgtaatgggaagcttaggggcattgcttgcattcagctcaagagatgatgttgactttttcaatcatttggagatgcatatgagacaggaacacccacctttatgtggaagagatcacatggcttatagatctgcgtattttcctgttaaggatgtggtcgatggagatctgtgtgagcagtttccaactttgcccatggatttgcagcgaaaaattgctgatgaattggataggactccaggagagatactgaaaaaacttgaagaaatacgcaataaaattgtctgagatatttagatcaaaggtt

SEQ ID NO: 1969 - DNA, 4158 bp, Lupinus angustifolius
actcactccgaattctgaaccccaacgttcctcttttgttttcttagtcaagtgaatgttaaattgaaaacactgaactaacttatctaaaaccctaaccctaaatcacaccatgtatctctacaatctcactctacagcaacccaccggcatcgtctgcgccatcaacggcagcttttccggcggcaagtcccaagaaatcgtcgtcgccagaggcaaagttctcgatctcctccgccctgatgacaacggtcgcatccaaaccatcctctccgtcgaaatcttcggttccatcaggtccttagctcaattccgtctcaccggtgcccagaaggactacatcgttgttggttcagattccggtcgcatcgtaattcttgattacaataaggagaagaacgtattcgataaaattcaccaagaaactttcggtaaatcgggttcccgccgcatcgttccgggtcagttcatagctatagatccaaagggtagggctgttatgattggtgcttgtgaaaaacagaagcttgtttatgttttgaatagggatactgctgctaggttaactatttcttcgcctttagaagctcacaagtctcatacattagtgtattcaatttgtggggttgattgtggttttgagaatcctatttttgctgctattgagttggattactctgaggctgatttggattccactggccaggccgcgtccgaagctcagaagcatttgacgttttatgagcttgatttagggttgaatcatgtgtctaggaagtggtctgaacaggttgataatggtgccaatttgcttgtcactgttcctggtggtggcgatgggcccagtggagtgcttgtttgtgctgagaattttgtgatttataagaatcaaggacatcaggaagttagggctgtgattcctcggcgtgctgatttgcctagtgagcgcggtgttcttattgtctcggcagctatgcataagttgaagtccatgtttttcttccttttgcagaccgagtatggagatatttttaaggttaccttggagcatgatggtgaccgtgtctcggagttgaagattaagtattttgatactattcctgttacagcttcaatgtgtgtgctcaagtcgggcttcttgtttgcagcctcagagtttggcaatcatgctctgtatcagtttaaggcgattggggatgatgacgatgtggaggtgtcatcagctacattggaggaaactcaggatgggtttaagccagtatatttcagaccgagaagactgaaaaatcttatcaggattgaccaggtggagagtctaatgccaataatggatatgaaggtcagcaatctcttcgaagaggaaaccccccagatttttactctctgtggacgtggtcctcgttcatctttgaggatcctgagaactggtttagcagttagtgagatggcagtatcaaggcttcctggtatacctagtgctgtttggactgtgaagaagaatgttatcgatgagtttgatgcatatattgttgtgtcattcacaaatgctacgcttgtgctttccattggtgagacagttgaagaagttagtgacagtgggtttcttgacaccacaccctcccttgctgtttccttgataggtgatgattctctcatgcaggttcaccctaatggtattagacacattagggaggatgggcgtattaatgagtggagaactcctggaaagaggacaattgccaaagttggatataatagacttcaggttgttattgcactgagtggaggggagcttatatattttgaagtggatgttactggtcagttgatggaggttgaaaagcatgaaatgtctggagacgttgcttgtttggacattgctccagtacccgaaggcagacaaagatcccgttttctggcagtaggctcatatgacaagactatccgcatcttatcactggatcctgatgattgtatgcaggctcttagtgttcaaagtgtttcttcagctccagaatctcttctttttcttgaagttcaagcttctgttggcggcgaggatggtgcagatcatcctgctagccttttcttgaatgctggtttgcagaatggtgtcttgtttagaacggtggtggatatggttacaggtcagctttctgattctcgttcccgattcttaggattgagagccccaaagttgtttcctattattgtaagaggcaagcgtgccatgctttgcttgtcaagtcgaccatggcttggttatattcaccagggacatttcctattaacacctctttcatatgaaacccttgaatatgcggcttcattttcgtctgaccaatgtgtggaaggtgtagttgctgttgctggtgaggcattgaggatttttaccattgaaagattgggagaaacatttaatgagactgtaattccattaagatatacaccaagaaagtttgtgctgcatcccaaacggaagcttttggtgatagttgagagtgatcaaggagcattaactgcagaggagcgtgaatctgcaagaaaagagtgttttgaggctactcaggcaggggaaaatgggactggaagtgacccaatggagaatggtggcgaggatgaggataaagatgatgcactctctgatgaacattatggttacccaaaaactgaatcggataaatgggtttcctgcattagagttcttgatccaaggacaggaaacacaacatgtcttctggagcttcaggagaatgaagctgcattcagtgtatgcacagtaaatttccatgataaggaatatggaaccctgttagctgttggcacagcaaagggactgcaatttttgcccagaaggactttaactgctggatatattcatatatataggtttgtagaggatggaagatctcttgaacttcttcacaaaactcaggttgaaggtgtccctcttgctctatgtcagtttcaaggaagattacttgcaggaataggacctgtgctcaggctatatgatttaggaaaaagacgactgttaaggaaatgtgaaaataagctattccccaacacaattgtctctattcatgcgtatcgtgatcgtatttatgtaggcgacatgcaagagtctttccattactgcaagtataggcgggatgaaaaccagctttacatttttgcggatgattgtgttccaagatggcttactgcatcataccacatagattttgacaccatggcaggtgcagacaagtttgggaatgtctattttgtgcgcttgccacaggatgtttcagatgaaatagaagaagatccaactggtgggaggatcaagtgggagcagggaaagctgaacggagctcccaataaggtggaagaaattgtacaatttcatgttggtgatctgatcacgtctttgcaaaaggcatctcttataccaggtggtggagagtgcattttatatggaacaactatgggaagtattggggcattgcatgcttttacgtcacgggatgatgttgatttcttctctcatttggagatgcatttgaggcaggatcatccacctttgtgtggaagagaccacatggcttatagatctgcttatttccctgttaaggatgtgattgatggagatctatgtgagcaatacccaacattgccaatggatttgcagcgaaaaattgctgatgaattggacagaacccctggagaaatactgaagaaacttgaggaagtacgaaacaaaattatttgagagatgatcttcagaaaggtcccagcggtaatagatcatttgcacttgtagtgaggtcactaactaagcgtagaaagtttgttcttccatttcttgcagaagggaggagtagaaagtggatgtttgtactctgtattttttgaatgaaatctaagttggcaatcaatgttgtaattattggtaattgaattttatcacgctgattgtggatgtgatagtagcaatgccttttcatattacggagttttaatttttcaaaatttcttgatagttctggaaaagaggtatctgttttcacgtatcatcaaccctgtgcaagatatgtttttttgggggaaataccacattttattgattgtgctacagtaaaactattcatgattggggttttctattgaatttgt

SEQ ID NO: 1970 - DNA, 4342 bp, Panax ginseng
actgttacttgggtttctcaccgactttcttttgcttaaacccttccctctctcttcacgaagagtttatgttgccttttatcatttttgatttctagggttttagtatttcttccaagtatttctatataaaccctagctttttttttcaaatttatttcgagtggtttagctatgtatctctacaatctcactctgcaacaagccaccggcatagtctgcgccattaacggcagcttcaccggcggaaaatcccaagaaatcgtggtcgctcgcgggaaagtccttgatctcttgcgccctgacgataatggtaagatccaaaccattctctcagttgaagtatttggtgctattcgttctttagctcaatttcgtttaactggtgcccaaaaagattacattgttgttggttctgattcgggtcgaataataatccttgaatacaacaaagaaaaaaatgtatttgataaaattcaccaggaaacttttggaaaatcaggctgtcgccggattgttccgggtcagtacttggcaattgacccaaaaggtcgtgccgtaatgattggtgcttgtgaaaagcagaagcttgtttatgtgttgaatagagatacttctgctaggttaactatttcgtcgcctttagaagcacataagtcacatacaattgtgtattctattactggggttgattgtggttttgataatccaatatttgcggcgattgagttggattattcggaagctgaccaggattcaactgggcaggctgcaagtgaggcacaaaaacaccttacattttatgaattagatttagggcttaaccacgtttcaaggaagtggtcggagcaggttgacaatggtgctaatatgcttgttacggtaccgggtggtggggatggccctagtggtgtacttgtctgcgctgaaaattttgtgatatataagaatcagggttatccggatgtgcgagctgtgattcctagacgggcagatttgccagctgaacgtggggttcttatagtttctgctgctatgcacaaacaaaagtccatgtttttctttctcttgcaaacggagtacggggatgtctttaaggtcacattggaacatgataatgaacgtgtttccgagttgaaaattaagtattttgataccatccctgttacgtcttcgttgtgtgtactgaaatcggggtttctctttgctgcatcagagtttgggaatcatggtttgtatcagttccaggcaattggagatgatcctgatgtggaatcttcgtcttctacattaatggaaacagaagaaggttttcagcctgtgttttttcagcccagagggctgaagaacctggttaggatcgaccaagttgagagcttgatgccaattatggacatgaaagtatcaaatctctttgaggaagaaactcctcaaatattttcactttgtgggcggggtcctcgttcttcgctacgaatactaagacctggtttggctattagtgaaatggctgtgtcccagcttcctggtgttccaagcgcagtttggactgtgaaaaagaatgttaatgatgaatttgatgcttatattgttgtttcatttgctaatgctactcttgtcctttctattggtgagacagttgaagaagttagtgatagtgggttccttgatactaccccttctcttgctgtatctttgataggcgatgattctctaatgcaagttcatccaactggtattagacatataagggaagatgggcgtataaatgaatggagaacccctggaaaagaaccatcgttaaggttgggtctaataggcttcaggtggtaattgcactgagtggaggggaacttatatactttgaggtggatatgacaggccagttaatggaggttgagaaacacgaaatgtctggggatgtagcttgtttggacattgcacctgtacctgagggaaggcagagatctcgatttcttgcagtaggatcctacgacaacactattcgtatcttatcattagatcctgatgactgtatgcagattctgagcctgcaaagtgtctcatcatccccagaatctctcctctttcttgaagttcaggcctctgtaggtggtgaggatggtgcggaccatcctgccagtctttttcttaatgcaggtttacaaagtggggttttattccgaactgtggtggacatggttacaggtcagctgtcagatgctcgctcccggttcttaggactgagagccccaaagctcttctctgttgctgtgagaggacggcgtgccatgctttgtttgtcaagtagaccatggcttggttatatccaccaaggacattttttgcttactcccctgtcatatgagactcttgagtatgcagcctcattttcgtctgatcagtgtgccgaaggtgttgttgctgttgctggagatgcattaagggtgtttaccattgagagattaggagaaacatttaatgaaactaccattcctttgaggtacactccaaggaagtttgtgcttcaaccaaagaagaaacttttagtaataattgagagtgatcagggagcatttgctgcagaagagcgtgaagctgcaagaaaggagtgctttgaggctgctggaatgggtgacactggaaaaatggagacggaaaatggtggtgatgatgaggataaggatgatcccctctctgatgagcagtatggttatcctaaagcagagtcagataagtgggtttcttgcattagagtccttgacccaagaacaacagaaacaacttgtctgctggagcttcaagataatgaagctgccttcagtatatgcacagtgaacttccacgataaagagtatggaactcttttagctgttggtacagcaaaaggcctgcaattttggcccaaaagatctttctcagcaggatatattcatatttatcgctttataaaagatgggagatctattgaacttttgcacaagacacaagttgatggtgtccctcttgcattgtcccagttccaaggaagattacttactggaataggacctgtgcttagattgtatgatttgggaaaacggagattgcttagaaaatgtgaaaataaattatttcccaacacaattacctctattcacacatatcgtgatcggatttatgtcggtgacattcaggagtcattccactattgcaagtataggcgtgatgaaaatcagctctatatatttgctgatgattctgtgccaagatggcttactgcagcgtaccatatagattttgataccatggcaggtggagacaagtttgggaatatctattttgtgcggctacaacaggatgtttctgatgagattgaagaagatccaactggtggaaagatcaaatgggagcaggggaagctgaatggagccccgaacaaagtagaagaaatagtgcagtttcatgttggtgatgttataacaagcttgcagaaagcatctcttattcctggaggccaggagtctatcatttatggaactgtgatgggcagcttaggtgcattgcttgcattcaattctagggatgatgttgactttttcaatcatttggagatgcatatgaggcaggaacacccacctttatgcggaagagaccacatggcatacagatctgcctattttcctgttaaggatgtggttgatggtgatctgtgtgagcagttcccaacattgcccttggatttgcagcggaaaattgcagatgaattggatagaactccaggagagatcctgaaaaaacttgaagaaattcgcaataaaattgtctgaaatgcgtagatcaaaggttacgaagttatggcccttgtctcaacacacagatttactgatttcacggattttagctgtagtgaagcatgctacatcattcattgatttgtgtaattgagtgagttctcatatcaagaatggaagaatgcatgcccccatgaagatgcaagatgcagcaagcgacatctctaggccctaatatgtatttcttgctgtctttggatattttgttgttgtagttgcattatgttgtgcaacttctgaatattatgttactctgtagaattctctctcctcttatagtacagtcaagtaaatttttctgcattttctaatatgtaattctagtcttaaagaatctatttgagctatttttttttcacttttcttaataattattattggtagaaaaacttaaaaaaaaaaaagaaaaaaaaaaaagaaaaaaaaaaaaagaaaaaaaaaaagaaaaaaaaaaaagaaaaaaaaagaaaaaagaaaagaagaagagaagagagagagagagagagggg

SEQ ID NO: 1971 - DNA, 4308 bp, Panax ginseng
cagtggtatcaacgcagagtacatggggaaatcagtaggttctgaagagctctttactgttacttgggtttctcaccgacttatttttgcttaaacccttccctctctcttcacgaagagttttatgttgccttttatcatttttgatttctagggttttagtatttcttccaagtatttctatataaaccctagtttttttttttcaaatttatttcgagtggtttagctatgtatctctacaatctcactctgcaacaagccaccggcatagtctgcgccattaacggcagcttcaccggcggaaaatcccaagaaatcgtggtcgctcgcgggaaagtccttgatctcttgcgccctgacgataatggtaagatccaaaccattctctcagttgaagtatttggtgctattcgttctttagctcaatttcgtttaactggtgcccaaaaagattacattgttgttggttctgattcgggtcgaataataatccttgaatacaacaaagaaaaaaatgtgtttgataaaattcaccaggaaacttttgggaaatcaggctgtcgcaggattgttccgggtcagtacttggcaattgacccaaaaggtcgtgccgtaatgattggtgcttgtgaaaagcagaagcttgtttatgtgttgaatagagatacttctgctaggttaactatttcgtcgcctttagaggcacataagtcgcatacaattgtgtattctattactggggttgattgtggttttgataatccaatatttgcggcgattgagttggattattcagaagctgaccaggattcaactgggcaggctgcaagtgaggcacaaaaacaccttacattttatgaattagatttagggcttaaccacgtttcaaggaagtggtcggagcaggttgacaatggtgctaatatgcttgttacggtgccgggtggtggggatggccctagtggtgtacttgtctgcgctgaaaattttgtgatatataagaatcagggttgtccggatgtgcgagctgtgattcctagacgggcagatttgccagctgaacgtggggttcttatagtttctgctgctatgcacaaacaaaagtccatgtttttctttctcttgcaaacggagtatgggggatgtctttaaggtcacattggaacatgataatgaacgtgtttccgagttgaaaattaagtattttgataccatcccggttacgtcttcgttgtgtgtactgaaatcggggtttctctttgctgcatcagaatttgggaatcacggtttgtaccagttccaggcaattggagatgatcctgatgtggaatcttcgtcttctacattaatggaaacagaagaaggttttcagcctgtgttttttcagcccagagggctgaagaacctggttaggatcgaccaagttgagagcttgatgccaattatggacatgaaagtatcaaatctctttgaggaggaaactcctcaaatattttcactttgtgggcggggtcctcgttcttcgctacgaatactaagacctggtttggctattagtgaaatggctgtgtcccagcttcctggtgttccaagcgcagtttggactgtgaaaaagaatgttaatgatgaatttgatgcttatattgttgtttcatttgctaatgctactcttgtcctttctattggtgagacagttgaagaagttagtgatagtgggttccttgatactaccccttctcttgctgtatctttgataggcgatgattctctaatgcaagttcatccaactggtattagacatataagggaagatgggcgtataaatgaatggagaacccctggaaaaagaaccatcgttaaggttgggtctaataggcttcaggtggtaattgcactgagtggaggggaacttatatactttgaggtggatatgacaggccagttaatggaggttgagaaacacgaaatgtctggggatgtagcttgtttggacattgcacctgtacctgagggaaggcagagatctcgatttcttgcagtaggatcctacgacaacactattcgtatcttatcattagatcctgatgactgtatgcagattctgagcctgcaaagtgtctcatcatccccagaatctctcctctttcttgaagttcaggcctctgtaggtggtgaggatggtgcggaccaccctgccagtctttttcttaatgcaggtttacaaagtggggttttattcagaactgtggtggacatggttacaggtcagctgtcagatgctcgctcccggttcttaggactgagagccccaaagctcttctctgttgctgtgagaggacggcgtgccatgctttgtttgtcaagtagaccatggcttggttatatccaccaaggacattttttgcttactcccctgtcatatgagactcttgagtatgcagcctcattttcgtctgatcagtgtgccgaaggtgttgttgctgttgctggagatgcattaagggtgtttaccattgagagattaggagaaacatttaatgaaactaccattcctttgaggtacactccaaggaagtttgtgcttcaaccaaagaagaaacttttagtaataattgagagtgatcagggagcatttgctgcagaagagcgtgaagctgcaagaaaggagtgctttgaggctgctggaatgggtgacactggaaaaatggagacggaaaatggtggtgatgatgaggataaggatgatcccctctctgatgagcagtatggttatcctaaagcagagtcagataagtgggtttcttgcattagagtccttgaccctagaacaacagaaacaacttgtctgctggagcttcaagataatgaagctgccttcagtatatgcacagtgaacttccacgataaagagtatggaactcttttagctgttggtacagcaaaaggcctgcaattttggcccaaaagatctttctcagcaggatatattcatatttatcgctttataaaagatgggagatctattgaacttttgcacaagacacaagttgatggtatccctcttgcattgtcccagttccaaggaagattacttgctggaataggacctgtgcttagattgtatgatttgggaaaacggagattgcttagaaaatgtgagaataaattatttcccaacacaattgcctctattcacacatatcgtgatcggatttatgtcggtgacattcaggagtcattccactattgcaagtataggcgtgatgaaaatcagctctatatatttgctgatgattccgtgccaagatggcttactgcagcgtaccatatagattttgataccatggcaggtggagacaagtttgggaatatctattttgtgcggctacaacaggatgtttctgatgagattgaagaagatccaactggtggaaagatcaaatgggagcaggggaaactgaatggagccccgaacaaagtagaagaaatagtgcagtttcatgttggtgatgttataacaagcttgcagaaagcatctcttattcctggaggccaggagtctatcatttatggaactgtgatgggcagcttaggtgcattgcttgcattcaattctagggatgatgttgactttttcaatcatttggagatgcatatgaggcaggaacacccacctttatgcggaagagaccacatggcatacagatctgcctattttcctgttaaggatgtggttgatggtgatctgtgtgagcagttcccaacactgcccttggatttgcagcggaaaattgcagatgaattggatagaactccaggagagatcctgaaaaaacttgaagaaattcgcaataaaattgtctgaaatgcgtagatcaaaggttacgaagttatggcccttgtctcaacacacagatttactgatttcacggattttagctgtagtgaagcatgctacatcattcattgatttgtgtaattgagtgagttctcatatcaagaatggaagaatgcatgcccccatgaagatgcaagatgcctctaatatgtatttcttgctgtctttggatattttgttgttgtagttgcattatgttgtgcaacttctgaatattatgttactctgtagaattctctctcctcttatagtacagtcaagtaaattttttttgcattttcttaatatgtaattctagtcttaaagaatctatttgagtcatttttttttcactttcttaataattattattgggtgaacttaatggtaaattctcttaatgttaaaaacaataaataaatttgtat

SEQ ID NO: 1972 - DNA, 3948 bp, Aquilegia formosa
tttgtacaatttctcattcgatgtatctttatagtttaactcttcaacaagctactggtatagtttgtgctacaaatgggaacttcatcggtggaaaatcacaagaaatcgtagttgcaagaggtaaagttcttgatctattacgtccagatgaaaatggtaagttacaaacaattttatctgttgaagtttttggagcaattaggtcattatctcattttaggttaactggatctcaaaaagattatatagttgttggttctgattctggtagaattgttattcttgaatataataaagagaagaatgtatttgatcaaatccatcaagagacttttgggaagtcgggttgtcgcagaattgttccaggccagtatattgctgttgatcctaaagggcgtgctgttatgattgctgcttgtgaaaaacagaaattggtgtatgttttgaatagagattctactgctagattgacaatttcgtcaccgttagaagctcataagagtcatactattgtgtattctattgcgggagttgattgtggttttgataatcctatttttgcgtctattgagcttgattatttggaagctgatcaggattcaactggtcaatctgcaaatgaagctcaaaaacatctgacattttatgagcttgatttggggttgaatcatgtttctcggaaatggtcagagcctattgataatggtgctaatatgcttgtaactgttcctggaggtggtgatggacctagtggcatccttgtatgtgctgagaactttgtgatttataagaatcagggccacccagatgttcgtgctgtcattcctcgaagggctgacttgcctgcggagcgtggggtacttatagtgtcagcggctactcatagacatagggctactttcttctttttgttgcagaccgagtatggagatgtatttaagtgcacactagagcacgacaatgatcgtgtgaccgagttgaagatcaagtatttcgatacaatacctgttacaatttctatgtgtgttctgaaaactggttttttgtttgctgcttcggagtttggaaatcatgggttgtatcagtttagggcaattggagaggaagcggacgttgaatcttcatcgtctactttaatggaaacggaggaaggttttcaacctgttttttttcagccgaggggccttaagaacctcattaggattgaccaagttgacagcttgatgccaattatggacatgaaggttgccaatttgtttgaagaagaaactcctcagattttcactctttgtgggcggggacctcgttcttccctacgaatactgaggccaggtttggctgtcagtgagatggctgtttctcaactccctggtatcccaattgctgtttggactgtgaagaagaatataaatgatgagtttgatgcttacattgttgtttcctttgcaagtgccactcttgtactttctatcggtgagacagttgaagaagtcagtgatagcggctttcttgatactactccttcgcttgctgtttccttattaggtgatgactctctgatgcaggtccacccaaaaggcattagacatattagggaggatggacgtatcattcaatgggaaactcctgggaagagaacaattgtgaaggttgctactaatagagttcaggtagttattgccctgagtggaggagagctggtatattttgagatggacataacaggcaagttaatggaggttgaaaagcatgaaatgtcgggtgatgtggcttgtttagacattgccccggttcctgaaggaagacagaggtcgcgtttccttgcagttgggtcctatgacaacaccattcgtatcttatctctagatcctgatgattgcatgcaggtattgagtctacaaagtgtatcatcacctccagaatcacttcttttgctcgaagttcaggcttcagtaggtggggaggacggcgctgatcaccctgctagcgttttccttaatgctggtttacagaatggcgttttattcagaactgtggttgatatggttactggtcaactttcggatacacgttctcgtttcttaggattaagagccccaaaactcttttccgctgttgtgaggggtcggagggcaatgttatgcttgtcaagtcgcccttggcttgggtatattcaccaaggacattttttgctgactcctctctcatacgagactcttgaatatgcagcctccttttcatctgatcaatgtgcagaaggtgttgttgctgttgctggggatgcattgagggtcttcactattgaacgactgggagagacgttcaatgaaaccgtgattcctttaagatatactccaaggaaatttgttcttcaccccaagagaaaattgttgatagtgattgaaagtgatcagggagcattcaccgctgaagaacgtgaagctgccagaaaggaatgcttggaggccgctgggatggaagagaatggaaatggaaatattgatgagatggaaaatggtgctgagaacgaagagaatgaccctctttcagatgaacagtatggttatccaaaggcagaagcagagaaatgggtttcttgcatcagagtttttgagccaaggacaacaaccactacatgtctgctagagcttcaggataacgaagctgcttttagtgtgtgtaccgtaaacttctctgataaggaatatggaactcttttggcagtgggtacagcaaaatcgttgaagttttggcccaaaagaagttttgcagcaggatttattcatatatataggtttatagaagatggaaagggccttcaacttttgcacaagacccaagttgaagggattcctcttgccctgtgccagttccaaggaaaactacttgctggtattggatcagtgcttagattgtatgatttggggaagaggaagttgcttcggaaatgtgaaaataaactttttcccaacacaatcatctctcttcacacctatcgagaccggatatatgtcggtgacatccaagagtccttccattattgcaagtatagacgcgacgaaaatcagctgtacatatttgcagatgatagtgttcccagatggcttacagcctcatatcacatcgattttgacacgatggcaggtgcagacaagtttgggaatgtttactttatgcgtctacctcaggatctctctgatgaaattgaagaagatccaactggtgggaagataaagtgggaacagggaaagctgaatggtgcaccaaacaaggtagaagagattgtgcagttccatgtaggtgacgtcgttacatgcttgcagaaaacatctctcataccaggaggtggcgagtgccttatttatgggactgtaatgggatgcttaggggcattgcttgcttttacatctagagaggatgttgacttcttttctcacttagagatgcatatgaggcaggaacacccacctctctgtggaagagatcacatagcatacagatctgcttattttccagtaaaggatgtgatcgatggcgatctttgcgagcaatttcccactttgcctgctgatttgcaaaagaagattgctgacgaactggatagaactcctggtgaaataatgaagaaactggaagatgttagaaataggataatttgagaaggcttcatcataggctgctcgtggcacttgggattcaagaactgcgagtaatcaactttaactttgttagttttgtatgacatttgtaacaaatactcatggcagaggaaaaatatgaaaatctttagtccatttagttggggttctgcgttgtcatttgatatgatggcattttgatgtaatatttcagtacaatcaacatggtgaaatattttagttattttctgtttgtacttgattgggtatttcagatgttttctctttatctcataatgttatttac

SEQ ID NO: 1973 - DNA, 4121 bp, Chrysanthemum coronarium
accgccccaaaaatcttcacttcacttaaaaccccaattccctcttcactcaaacccctaatttcaaaccctaaccctaaacaaccaccatcaaccaccatgtacctctacaacctaaccctccaacaagccaccggcatcgtaacggccatcaccggcaccttctccggccaatccaaatcccaagaaatcatcgtcgcacgtggcaaatccttaaccctccttcgccccgacgaaaacggtaaaatccaaactatcttatctcatgatgttttcggttctattagatccttagcccagtttaggttaaccggtggttccaaagactacatcgttgtcggttcggactccggtcgcgtagttattctagaatataataaggaaaagaatgtttttgataaggtccatcaggagacttttgggaagagtgggagtagaaggattgttccgggtcagtatttagcggttgacccgaaagggcgcgcggttatgattggggcgtgtgagaagcagaagcttgtttatgttttgaatagggatactgctgctaggttgactattagttcgccgctagaggcgcataagagccatactatttgtttttgtatttgcggggtggatgttgggtttgataatccggtttttgctgcgattgagctggattatagtgaggcggatttggatagtagcggtgcggctgtgcacgaggcgcagaaggttttgactttttatgagcttgatttggggttgaatcatgttagtaggaagtggagtgagagtgtggataacggggcgaatttgcttgtgactgttcctggtgggggagatgggccgagtggggtgttggtttgtgcggagaattttgtgatttataagaatcaagggcatccggatgtgagagctgttataccgagacgagtggatttgccggctgagcgtggggttcttattgtttcggcgacgatgcataagcagaagtctatgtttttctttctgttgcagactgagtatggggatgtgttcaaggtcacgcttgagcatgataatgaacgggtttcggagttgaagattaaatactttgatacgataccggttacttctgctatgtgtgttatgaagttggggtttctgtttgcggcgtcggagtttgggaatcacgcgttgtatcagtttcaggcgattggtgctgatcctgatgtggagtcctcgtctgcgacgttaatggaaaccgaagatgggttccagccagtgttttttaagccgagagggttgaaaaatctcgtcaggattgaccaagttgagagtttgatgccgataatggatatgaaagtggtcaatttcttcgaagaagaaacgcctcagatttttacgctttgtggtcgaggtcctcgttccactcttaggattctgagaccgggacttgctatcagtgaaatggcggtttcacagcttcctggtgttccaagcgcagtgtggactgttaaaaagaatgttaatgatgagtttgatgcttatattgtggtatcttttgcaaatgccacccttgttctttctattggtgagactgttgaagaagttagtgacagtgggtttctcgacactacaccatcacttgcggtttcgttaattggtgatgattctctgatgcaagtgcatccaagcggaattaggcacattagggaagacgggcgtattaatgagtggagaactcctggaaagagaactattgttaaggttggatccaataggcttcaagtggttatcgcattgagtggtggagaaatcatatactttgaggttgatatgactggacagttgatggaagttgagaaaaacgaaatgtcgggtgacgtggcgtgtttggatatagctcctgttcctgaaggacgacagagatctcgtttcttggctgttggatcatatgataatacaattcgtatactgtctttggatcccgatgactgtatgcaggttctcagcctgcaaagtgtcaccgcggctcctgagtcgctcttatttcttgaggttcaggcttctgtcggtggggaggacggtgcagaccacccggctagcctctttctgaatgctggtcttcaaaatggggtcctctttaggaccgtagtggatatggttactggtcagctctcggatgcacggtctagatttctaggacttagagctcctaaattgttctctatcctggtgagaggacgacgagctatgctttgcttgtcaagtagaccatggctcggttatgttcaccaaggtcattttcttttgacaccactttcttacgaaactcttgagtacgcagcttcatttacatctgatcagtgtgctgaaggtgtggttgctgtcgctggggatgctttaagagtgtttacaattgaaagattaggggaaacatttaatgaaacagctatacctttgaggtacacgccaagaaagtttgtgtttcaccctaaaaagaaacttctggtaacaattgagagtgatcagggtgcatttacagctgaactgcgtgaaagtgcaaagaaagagtgttttgaagatgctggtcaaggagaaaacggtagaatggagattgagaatggcggcgatgatgaagacaaagaggaccctctttctgacgagcagtatggttaccctaaagcagaggctgataagtgggtgtcttgcattagggttcttgatccgagatcagctgaaacaacatgtcttcttgagcttcaagataacgaggctgctttcagtatatgcactgtaaatttccatgataaggagtatggaacacttctagctgtgggtacagcaaagggtctacagttctggccgaaaagatctttggttgctggatacattcatatatatcggtttgtaaaagatggaagatcgcttgaacttcttcacaaaacccaagttgacggtgttcctcttgctttatgccagtttcagggaaggttgcttgcgggaattggtcctattcttaggctttatgatctggggaagaaaaggttacttagaaagtgtgaaaacaagatgttcccaaacactattaattcaattcatacctatcgtgatcggatttatgtaggagacattcaagagtcgtttcactattgcaagtacagacgtgatgaaaatcagctatatatatttgccgatgattctgttccaagatggctaacagcggcataccatgtggactttgacactatggcgggtgcggataagtttggaaacatttatttcgtgcggttgccacaggatgtgtccgatgaaattgaagaagatccaactggcgggaagattaaatgggagcaggggaaacttaatggagccccgaataaggttgatgaaattgtacaatttcatgttggggatgtggtaacgtgcatgcagaaagcatcattgatccctggtggcgtagagtgtgtcatgtatggcaccgtaatgggtagtttaggggcattgctagcatttagctctcgggatgatgtggacttcttttcacatcttgagatgcatatgaggcaggaatatccaccactgtgcggaagagatcacatggcatacaggtcttcctatttccctgttaaggatgttattgatggagacctatgtgaacaataccccacattgcctctagatgcgcagcggaaaatcgcagatgagttggatagatctcctgcagaaattctgaagaaattggaagacgttagaaacaagattgtttaaagatcatgttatgaggtaaggctcggttgggtgcaagccaaaaggtaactacacatggaaaaaactttcgacacttccaagttgctgagatctctagagaggttaaactgtactagacttttgtcctactttagcaggtcttctatcgtttagatgttttgttgtaattatgcagcttttatcgtatggaattcactcgagattgtgtgtgaatcactttcgatttatgtggtgagagggtgtcatgatagctgactttctagatatgtttctcttggtagttaaatggttatgaactaatgttgaagctttcagaagatttgacatggaaatgcatttattaaattcccatcatttatttatgattattatacgagtagtgt

SEQ ID NO: 1974 - DNA, 3885 bp, Aquilegia formosa
tttgtacaatttctcattcgatgtatctttatagtttaactcttcaacaagctactggtatagtttgtgctacaaatgggaacttcatcggtggaaaatcacaagaaatcgtagttgcaagaggtaaagttcttgatctattacgtccagatgaaaatggtaagttacaaacaattttatctgttgaagtttttggagcaattaggtcattatctcattttaggttaactggatctcaaaaagattatatagttgttggttctgattctggtagaattgttattcttgaatataataaagagaagaatgtatttgatcaaatccatcaagagacttttgggaagtcgggttgtcgcagaattgttccaggccagtatattgctgttgatcctaaagggcgtgctgttatgattgctgcttgtgaaaaacagaaattggtgtatgttttgaatagagattctactgctagattgacaatttcgtcaccgttagaagctcataagagtcatactattgtgtattctattgcgggagttgattgtggttttgataatcctatttttgcgtctattgagcttgattatttggaagctgatcaggattcaactggtcaatctgcaaatgaagctcaaaaacatctgacattttatgagcttgatttggggttgaatcatgtttctcggaaatggtcagagcctattgataatggtgctaatatgcttgtaactgttcctggaggtggtgatggacctagtggcatccttgtatgtgctgagaactttgtgatttataagaatcagggccacccagatgttcgtgctgtcattcctcgaagggctgacttgcctgcggagcgtggggtacttatagtgtcagcggctactcatagacatagggctactttcttctttttgttgcagaccgagtatggagatgtatttaagtgcacactagagcacgacaatgatcgtgtgaccgagttgaagatcaagtatttcgatacaatacctgttacaatttctatgtgtgttctgaaaactggttttttgtttgctgcttcggagtttggaaatcatgggttgtatcagtttagggcaattggagaggaagcggacgttgaatcttcatcgtctactttaatggaaacggaggaaggttttcaacctgttttttttcagccgaggggccttaagaacctcattaggattgaccaagttgacagcttgatgccaattatggacatgaaggttgccaatttgtttgaagaagaaactcctcagattttcactctttgtgggcggggacctcgttcttccctacgaatactgaggccaggtttggctgtcagtgagatggctgtttctcaactccctggtatcccaattgctgtttggactgtgaagaagaatataaatgatgagtttgatgcttacattgttgtttcctttgcaagtgccactcttgtactttctatcggtgagacagttgaagaagtcagtgatagcggctttcttgatactactccttcgcttgctgtttccttattaggtgatgactctctgatgcaggtccacccaaaaggcattagacatattagggaggatggacgtatcattcaatgggaaactcctgggaagagaacaattgtgaaggttgctactaatagagttcaggtagttattgccctgagtggaggagagctggtatattttgagatggacataacaggcaagttaatggaggttgaaaagcatgaaatgtcgggtgatgtggcttgtttagacattgccccggttcctgaaggaagacagaggtcgcgtttccttgcagttgggtcctatgacaacaccattcgtatcttatctctagatcctgatgattgcatgcaggtattgagtctacaaagtgtatcatcacctccagaatcacttcttttgctcgaagttcaggcttcagtaggtggggaggacggcgctgatcaccctgctagcgttttccttaatgctggtttacagaatggcgttttattcagaactgtggttgatatggttactggtcaactttcggatacacgttctcgtttcttaggattgagagccccaaaactcttttccgctgttgtgaggggtcggagggcaatgttatgcttgtcaagtcgcccttggcttgggtatattcaccaaggacattttttgctgactcctctctcatacgagactcttgaatatgcagcctccttttcatctgatcaatgtgcagaaggtgttgttgctgttgctggggatgcattgagggtcttcactattgaacgactgggagagacgttcaatgaaaccgtgattcctttaagatatactccaaggaaatttgttcttcaccccaagagaaaattgttgatagtgattgaaagtgatcagggagcattcaccgctgaagaacgtgaagctgccagaaaggaatgcttggaggccgctgggatggaagagaatggaaatggaaatattgatgagatggaaaatggtgctgagaacgaagagaatgaccctctttcagatgaacagtatggttatccaaaggcagaagcagagaaatgggtttcttgcatcagagtttttgagccaaggacaacaaccactacatgtctgctagagcttcaggataacgaagctgcttttagtgtgtgtaccgtaaacttctctgataaggaatatggaactcttttggcagtgggtacagcaaaatcgttgaagttttggcccaaaagaagttttgcagcaggatttattcatatatataggtttatagaagatggaaagggccttcaacttttgcacaagacccaagttgaagggattcctcttgccctatgccagttccaaggaaaactacttgctggtattggatcagtgcttagattgtatgatttggggaagaggaagttgcttcggaaatgtgaaaataaactttttcccaacacaatcatctctcttcacacctatcgagaccggatatatgtcggtgacatccaagagtccttccattattgcaagtatagacgcgacgaaaatcagctgtacatatttgcagatgatagtgttcccaaatggcttacagcctcatatcacatcgattttgacacgatggcaggtgcagacaagtttgggaatgtttactttatgcgtctacctcaggatctctctgatgaaattgaagaagatccaactggtgggaagataaagtgggaacagggaaagctgaatggtgcaccaaacaaggtagaagagattgtgcagttccatgtaggtgacgtcgttacatgcttgcagaaaacatctctcataccaggaggtggcgagtgccttatttatgggactgtaatgggatgcttaggggcattgcttgcttttacatctagagaggatgttgacttcttttctcacttagagatgcatatgaggcaggaacacccacctctctgtggaagagatcacatagcatacagatctgcttattttccagtaaaggatgtgatcgatggcgatctttgcgagcaatttcccactttgcctgctgatttgcaaaagaagattgctgacgaactggatagaactcctggtgaaataatgaagaaactggaagatgttagaaataggataatttgagaaggcttcatcataggctgctcgtgccacttgggattcaagaactgcgagtaatcaactttaactttgttagttttgtatgacatttgtaacaaatactcatggcagaggaaaaatatgaaaatctttagtccatttagttggggttctgcgttgtcatttgatatgattggcattttgatgtaatatttcagtacaatcaacatggtgaaatattttagtt

SEQ ID NO: 1975 - DNA, 4126 bp, Petroselinum crispum
ccctaattcaaattaaaattcacaaaatcaaatctgcttgaaattcaatctctatatatattcatactctccctacctaaaaccctttctctcacacacatgctttctagggtttgtaaaccaattttaattaccctcttttcataaaccctagtttcttaaaattcaaattactctagggtttaagtaaaatcatcatgtatctatacaatctgacactccaacaagctacaggcattgtgtgtgcaatcaatggcagcttcactggtggcaaatcccaggaaattgttgtagctcgtggcaaagttcttgatcttttaaggcctgatgataatggtaagattcaaaccattctttctgttgaagttttcggtgttattcgttctttagctcactttcgattaacgggtgctcataaagattacattgttgttggttctgattctggtagaattgttattcttgaatataataaagaaaagaatgtgtttgataaaattcatcaagaaactttcgggaaatcggggtgtaggaggattgttcccgggcagtatttagggattgatccgaaagggagggcggttatggttggggcttgtgagaagcagaagttagtttatgtgttgaatagggatacgtcggctaggttgactatttcgtcgcctttggaagcgcataagtcgcataccattgtgtattcgattgttggggtggattgtgggtttgataatccgatttttgcggcgattgagttggattattcggaggcggatcaggattcgacagggcaggctgcgagtgaggcgcagaagcatttgacgttttatgagttggatttagggttgaatcatgtgtcgaggaaatggtcggagcaggttgataatggggctaatatgcttgttactgtaccgggtggtggagatgggcctagtggtgtgcttgtttgtgcagaaaactttgtgatttataaaaatcaagggcatccggatgtgcgagctgtgattcctagacgggcggatttgccggctgaacgtggggttttgattgtttctgctgctatgcacaaacagaagtcgatgtttttctttttgttgcaaacggagtatggtgatatctttaaggttactcttgaccatgacaatgaacgtgtttctgagctcaaaattaagtattttgatacgatcccggtcacttcttctttgtgtgtgatgaaactggggtttctctttgctgcatcagagttcggaaatcatggtttgtatcagttccaggctattggagatgatcctgatgttgaatcttcatctgctacattaatggaaacagaagaaggttttcaacctgtattttttcaacctagaggactgaaaaacctggttaggattgatcaggtggagagcttgatgccaataatggacatgaaagtaacaaatatctttgaggaagaaactcctcagatattttcactttgcgggcgagggcctcggtcttcacttcgtatattaagaccaggtttagcaatcaccgaaatggctgtgtcccagcttcctggtgttcctagtgctgtatggactgtgaaaaagaatgtaaatgatgaatttgatgcatatattgttgtatcatttactaatgctactcttgtactttctattggtgagacagttgaagaagttagtgatagtgggtttcttgataccaccccttctcttgaggtatcgttgataggtgatgattcactgatgcaagttcatccaactggtattaggcatataagggaagatggacgtataaatgagtggagaactcccggaaaaagaaccattgttaaggttggttctaataggctccaggttgtggttgcattgagtggaggagaacttatatactttgaggtagatatgactggccagttaatggaagtggagaaacatgacatgtccggggatgtagcttgtttggacattgcacctgtacctgaaggaagacaaagatcccgcttcctagcagtaggatcatatgacaacactattcgtatcttatcattagatcccgatgattgtatgcagattctgagcctgcaaagtgtatcatcacccccagattctctcctttttcttgaagttcaagcatctataggtggcgaggatggtgcggaccatcctgctaacctttttcttaacgcaggtttgcaaagtggtgttttattcagaacagtggtcgatatggtgacgggccagctgtcagatgctcgatcacgtttcttaggactaagagcgccaaagctcttttctgttgctgtgaggggacgccgtgctatgctctgtttgtcaagtagaccatggcttggttatattcaccaagggcatttcctgctgactcccctgtcatatgagactcttgaatatgcagcctcattctcatctgaccagtgtgccgaaggtgttgttgctgttgctggagatgcattgagagtttttaccatagataggctaggtgaaacgtttaatgaatcaacgattcccctgagatacacaccaagaaaatttgtgattcagtccaagaggaagcttttggttatcattgagagtgatcaaggagcatttgctgcagaagatcgtgaagctgcaagaaaggagtgctttgaggcagctggaatgggtgcaaatggtaaaattgaggcggagaatggtggtgatgatgaggataaggatgaccccctctctgatgagcagtatggttatcctaaagcagagtcagacaagtgggtatcttgtataagagttcttgatccaaagacaacggaaacaacttgtcttctggagcttcaggataatgaagctgccttcagtatatgcacagtaaatttccatgataaagagcatggaactcttcttgctgttggtacagccaaaggcttgcagttttggccagaaaaatctttctcggctggatatattcatatttatcggtttcttaaagatgggaaatcacttgaacttctgcataagacacaagtggatggtgtacctcttgcattgtcccaattccaaggaaggttacttgcgggaataggaccagttctcagattgtatgatttggggaaaagaagattgcttcggaaatgtgaaaataaattattccccaacacaattaactctattcatacatatcgtgaccggatttatgtgggtgatcttcaggagtcattccattattgcaagtataggcgtgatgaaaatcaactatatatatttgctgatgattctgtcccaagatggcttactgcatcataccatatagacttcgacacgatggcaggtggagacaagtttggcaacatctattttgtgcgactaccacaagatgtatctgatgagattgaagaagatccaactggcggaaagataaagtgggagcagggcaagctgaatggagccccaaacaaagttgaggaaattgtgcaatttcatgttggcgatgttgtaacatgcttgcagaaagcatctcttattcctggaggtcaggagtctcttatatatggaactgtgatgggaagcttaggggcattgcttgcattcagttctagagatgatgttgacttttttaatcatttggagatgcatatgagacaggaacacccgcctttgtgcggaagagatcacatggcttatagatctgcatattttcctgttaaggatgtggttgatggagatctgtgtgagcagttcccaactttgcccatggatttgcagcgaaaaattgcagatgaattggacaggacaccaggagagatactgaaaaaacttgaagaaatccgcaataaaattgtctgagatgtttagattaaaggtacaagttatggccctcagcacaacgcgttggttatggatttatagcgtttttgaagatcgctgtctgctcggaaatgatcgaattcacagaatatttacccagatgatgttaatgtgaatgtgcactgtgaggaagacaaacactgacatttaacacctccacttgacgtcttgagcccaataaatgttttgttgtagctacatttgcagcaatgtcatttccaaatattatgctagagactgatgttattaacatatatacaatgtgtcagcga

SEQ ID NO: 1976 - DNA, 4056 bp, Petroselinum crispum
aaattcaatctctatatatattcatactctccctacctaaaaccctttctctcacacacatgctttctagggtttgtaaaccaattttaattaccctcttttcataaaccctagtttcttaaaattcaaattactatagggtttgagtaaaatcatcatgtatctatacaatctgacactccaacaagctacaggcattgtgtgtgcaatcaatggcagcttcactggtggcaaatcccaggaaattgttgtagctcgtggcaaagttcttgatcttttaaggcctgatgataatggtaagattcaaactattctttctgttgaagttttcggtgttattcgttctttagctcactttcgattaacgggtgctcataaagattacattgttgttggttctgattctggtagaattgttattcttgaatataataaagaaaagaatgtgtttgataaaattcatcaagaaactttcgggaaatcggggtgtaggaggattgttcccgggcagtatttagggattgatccgaaagggagggcggttatggttggggcttgtgagaagcagaagttagtttatgtgttgaatagggatacgtcggctaggttgactatttcgtcgcctttggaagcgcataagtcgcataccattgtgtattcgattgttggggtggattgtgggtttgataatccgatttttgcggcgattgagttggattattcagaggcggatcaggattcgacagggcaggcggctagtgaggcgcagaaacatttgacgttttatgagttggatttagggttgaatcatgtgtcgaggaagtggtcggaacaggttgataatggggcgaatatgcttgttacggtgccgggtgggggagatgggcctagtggtgtgcttgtgtgtgcagagaattttgtgatctataagaatcaagggcatcctgatgtaagggctgtgattcctagacgggctgatttgccggccgaacgtggggttttgattgtttctgctgctatgcacaaacagaagtcgatgtttttctttttgttgcaaacggagtatggtgatatctttaaggttactcttgaccatgacaatgaacgtgtttctgagctcaaaattaagtattttgatacgatcccggtcacttcttctttgtgtgtgatgaaactggggtttctctttgctgcatcagagttcggaaatcatggtttgtatcagttccaggctattggagatgatcctgatgttgaatcttcatctgctacattaatggaaacagaagaaggttttcaacctgtattttttcaacctagaggactgaaaaacctggttaggattgatcaggtggagagcttgatgccaataatggacatgaaagtaacaaatatctttgaggaagaaactcctcagatattttcactttgcgggcgagggcctcggtcttcacttcgtatattaagaccaggtttagcaatcaccgaaatggctgtgtcccagcttcctggtgttcctagtgctgtatggactgtgaaaaagaatgtaaatgatgaatttgatgcatatattgttgtatcatttactaatgctactcttgtactttctattggtgagacagttgaagaagttagtgatagtgggtttcttgataccaccccttctcttgaggtatcgttgataggtgatgattcactgatgcaagttcatccaactggtattaggcatataagggaagatggacgtataaatgagtggagaactcccggaaaaagaaccattgttaaggttggttctaataggctccaggttgtggttgcattgagtggaggagaacttatatactttgaggtagatatgactggccagttaatggaagtggagaaacatgacatgtccggggatgtagcttgtttggacattgcacctgtacctgaaggaagacaaagatcccgcttcctagcagtaggatcatatgacaacactattcgtatcttatcattagatcccgatgattgtatgcagattctgagcctgcaaagtgtatcatcacccccagattctctcctttttcttgaagttcaagcatctataggtggcgaggatggtgcggaccatcctgctaacctttttcttaacgcaggtttgcaaagtggtgttttattcagaacagtggtcgatatggtgacgggccagctgtcagatgctcgatcacgtttcttaggactaagagcgccaaagctcttttctgttgctgtgaggggacgccgtgctatgctctgtttgtcaagtagaccatggcttggttatattcaccaagggcatttcctgctgactcccctgtcatatgagactcttgaatatgcagcctcattctcatctgaccagtgtgccgaaggtgttgttgctgttgctggagatgcattgagagtttttaccatagataggctaggtgaaacgtttaatgaatcaacgattcccctgagatacacaccaagaaaatttgtgattcagtccaagaggaagcttttggttatcattgagagtgatcaaggagcatttgctgcagaagatcgtgaagctgcaagaaaggagtgctttgaggcagctggaatgggtgcaaatggtaaaattgaggcggagaatggtggtgatgatgaggataaggatgaccccctctctgatgagcagtatggttatcctaaagcagagtcagacaagtgggtatcttgtataagagttcttgatccaaagacaacggaaacaacttgtcttctggagcttcaggataatgaagctgccttcagtatatgcacagtaaatttccatgataaagagcatggaactcttcttgctgttggtacagccaaaggcttgcagttttggccagaaaaatctttctcggctggatatattcatatttatcggtttcttaaagatgggaaatcacttgaacttctgcataagacacaagtggatggtgtacctcttgcattgtcccaattccaaggaaggttacttgcgggaataggaccagttctcagattgtatgatttggggaaaagaagattgcttcggaaatgtgaaaataaattattccccaacacaattaactctattcatacatatcgtgaccggatttatgtgggtgatcttcaggagtcattccattattgcaagtataggcgtgatgaaaatcaactatatatatttgctgatgattctgtcccaagatggcttactgcatcataccatatagacttcgacacgatggcaggtggagacaagtttggcaacatctattttgtgcgactaccacaagatgtatctgatgagattgaagaagatccaactggcggaaagataaagtgggagcagggcaagctgaatggagccccaaacaaagttgaggaaattgtgcaatttcatgttggcgatgttgtaacatgcttgcagaaagcatctcttattcctggaggtcaggagtctcttatatatggaactgtgatgggaagcttaggggcattgcttgcattcagttctagagatgatgttgacttttttaatcatttggagatgcatatgagacaggaacacccgcctttgtgcggaagagatcacatggcttatagatctgcatattttcctgttaaggatgtggttgatggagatctgtgtgagcagttcccaactttgcccatggatttgcagcgaaaaattgcagatgaattggacaggacaccaggagagatactgaaaaaacttgaagaaatccgcaataaaattgtctgagatgtttagattaaaggtttgcagacttattgcataaacatgaccctagttgcattggatttcgtaatttctagttcagatttggattctatttactgtaattgggaagtgtaacctatgatatgtattttgatttatgtgaaactttctgaactatctgatatatctcagtaattggtatatgtgtgggtctgttaagtattgaatacgacggggtttcatgtgtgtaggtacaagttatggccctcagcacaacgcgttgg

SEQ ID NO: 1977 - DNA, 3721 bp, Eutrema parvulum
gaaatgtatctgtacagccttactctacagcaggcgaccggaatcatctgcgcaatcaacgggaacttctccggcgggaagacacaggagattgcggttgcacgcggtaagattctcgatcttctccggccggacgagaacggtaagatccagacgattcactctgtggaagtattcggtgctattagatccttagctcagtttaggttgactggtgcgcagaaggactatatcgtggttggttcagattcgggtaggattgtcatactagagtacaacaaggagaagaatgtgttcgataaagttcatcaggagacttttggcaagtcaggttgccgaagaattgtgccaggccagtacctggctgttgatcccaaaggtagagcagtaatgataggagcatgcgagaaacagaagctcgtgtacgtattgaacagagatactgctgctaggttaaccatttcttctcccttggaggctcacaagtctcataccatttgctattctatctgcggtgtggactgtggcttcgataacccgatctttgcagctattgagcttgattactctgaggcggatcaggacccaactggtcaggccgcaagtgaggctcagaagcatttgactttctatgagctcgatctggggctcaaccatgtctctagaaaatggtcagaaccggtcgacaatggtgccaatatgcttgttactgttcctggcggagctgatgggccgagcggagttttggtttgcgctgaaaattttgttatttacaagaatcagggtcatccggatgtgagagccgtgattcctagacgagctgatttgcctgctgagagaggcgttttggtagtttctgctgccatgcacaagcaaaaaactatgttcttctttctgcttcagactgagtatggtgatgttttcaaggttactctggatcatgatggcgatcatgtatccgagttgaagatcaaatattttgacacaattcctgtcgctgcatcaatatgtgtgttgaagctggggtttcttttctcagcttcagaatttggtaaccatggtttgtatcagtttcaggcgataggggaggaacccgatgtggagtcttcatcctctaatctgatggagactgaagagggttttcagcccgtcttttttcagccaagacgactgaagaaccttgttaggattgaccaagtcgagagtctgatgccgctcatggacatgaaaatcctaaacctttttgaggaagaaacccctcagatcttttcactttgtgggcggggtccacgctcctctctaaggatactgagacctggtttggccatcagcgagatggccgtttctcagcttccgggtcagccaagtgcggtgtggacggtgaagaagaacgtgagtgatgagtttgatgcgtatattgttgtctcttttaccaatgctactctggttctttcaattggtgaaacagttgaagaagtcaatgacagtgggtttcttgatactacaccttccctggccgtctctctgatcggtgatgattcgctcatgcaagtccatcccaatggtatccgccacataagggaagacgggcgcattaatgaatggagaactcctggcaagaggtcgattgttaaagttgggtataatcggcttcaagtggtcattgcgttgagtgggggagagctaatatattttgaggcagatatgactggtcagctgatggaggtggagaaacatgaaatgtctggagatgtggcctgcctggacattgcgcctgttcctgaaggaaggcagagatctcgctttcttgcggtgggatcttatgataatactgtgcgcattctatctctggaccccgatgactgtctgcagattctcagcgtgcagagtgtctcttccgctccagagtctctgctgtttctcgaagttcaagcatcagttggtggggatgatggtgcggatcacccggcgagtctcttccttaactcaggtctgcagaacggtgttcttttcagaacagtggttgatatggtgactggtcagctttctgattctcgttctcggttcttggggctgaagccgcccaagttattctccattgctgtgagaggccggtctgcgatgctatgtttgtctagtcgaccttggcttggttatattcatcggggacacttccacttgacgcctctctcttatgagactttggaatttgctgcccctttttcatctgatcagtgtgctgaaggtgttgtctctgttgccggggatgctctcagaattttcatgtttgaccgtcttggggaaacgttcaacgaaaccgtggtccctctgaggtacacgcctagaaagtttgttgtccagcccaagaggaagctgttggttatcatcgagagtgaccagggtgcattcaccgcagaagagcgtgaagcggcaagaaaggaatgtttcgaggctggtggagcgggagagaatggtaacggcggtgcagatcagatggagaatggcgcagatgatgaggataaggaagacccgctctctgatgagcagtatggttatccgaaagcagagtcagaaaagtgggtttcttgcatcagagttgttgaccccaagacagctgctacaacttgtttattggaacttcaggacaacgaagctgcctacagtgtctgcacggtgaatttccatgataaagagtacggtactttgctggctgttggcacggtcaaagggatgcaattctggccgaaaaagaatctagtggctgggttcatacatatttataggtttgtggaggaagggagatctcttgagctgctccataagacgcaagtggaaggtgttcctcttgcactatgccagttccagggaagactgctggcaggaatcggacctgtcctcagattgtatgatttggggaaaaagagactgcttaggaaatgtgaaaacaagctcttcccaaacaccatcatctctatccaaacataccgtgaccgtatttacgttggtgacattcaggagtcattccattactgcaagtacaggcgcgatgagaatcagctatacatatttgcggatgactgcgtgccgagatggctgacagcatcgcaccatgtggatttcgacaccatggcaggtgcagataagtttgggaatatatactttgtgcggttgcctcaggatgtgtcggaggagatagaagaagacccgacaggtgggaagatcaagtgggagcaaggaaagctgaatggagcaccaaacaaagtggacgagatagtacagttccatgtcggggacgttgtgacgtgcttgcagaaagcttcgatgatcccgggtggatcggagtccatcatgtatggaacagtgatgggtagcattggagcattgcatgcattcacatcccgcgatgatgtcgatttcttctctcatctggagatgcacatgaggcaggagtatcctcctctctgtgggagggaccacatggcttacagatctgcctattttccggtcaaggatgtaatagatggagatctgtgtgagcagtttccgacacttccaatagatttgcaaaggaaaatagcagacgagttggatagaacacctgcagagattctcaagaagcttgaagacgctaggaacaaaatcgtttaataagatttttttttgttttttaatgtagtttgatgttcatatgattggaaattttcctcttaaatgttttgtt

SEQ ID NO: 1978 - DNA, 1486 bp, Saccharum officinarum
gaagttcagcccttgtccgcctcataacatcagtcggtgtattacaggtctgtgtttgtgcagtccgtgtggcgtgttttagaggtcttgtatttgagctgtctgcctgtgtatcttacggctgtatttctgcaccagatacaactgagtgctgccttgactcttcacgcaggccgctcgcacccgtgagatgctggttatacaacatgttctggtgactgcaatcgcactggtaaggtaaaaaccaagctgtaaccccagttggtcggtcggtccatccccgagcccggttcgttccttggcgatggaggaaaccctagccgtcgaatccgccgccggcgagacggcgtccgcgcaggcgcctgagcggaaggaagagacgcttgaggaggttctctcgaggcacaggaaagagaaatcaaaactccaggataaggaaacaagcctcaagaaagctgctgcaaaaggaagcaaagctgagcagaaggcaaagaaaaagcaggtagaggaagagattacacgcctctctagagagttagaggcgaatcatgctgcagagcttgcttcctttgggtacaaaccctctggcagctcagagaagggaaaccttgacaacttagtgaaggccatagctggtgtttcagtttccagcaattcagattccacaaagcccagcaagggagcacgacggcgagagaagaaggcgaaggaggaagctgctcgagagcagcggatccaagaagagcaaagcaatctcgtgagcgaccgcgtgctagaaaacgagaagcttgaaaggaagcttgagcccttggggctgaccattcaagagataaagccggacggtcactgcctgtaccgtgctgtcgaaaaccagctattgctccattccaatggcgctgcacggtacagttaccaggacctacggcaaatggcagccaaatacatgagggagcacgctgctgatttcctcccgttttacttagcggaaggcaaggccgatattggaccagatcccatggagagcttcgagaagtactgcaaggagatggaatccactgcagcgtggggtgggcagctcgaacttggtgcgctgacccactgcctgaagaaacatatcgtggtctactctggctccttcccggacgtggagatgggcaaagaatacaaatctggatccggaggtagtggtgccggtgatgcaagcatcaggttgtcgtttcacaggcatgcctatgggcccggcgagcactacaactcggtgattccagccgaatcatcttaacaagagaatggtctgacagtctctaatacggtttgaatgtttacggggggtgcttggctgagtctgaacacaatagatgacttttttttactgggtgctgtaatcttcccatctgtcgatgaagaatgaatgtaccaatcaaagctgaattggggagttggttcccaacaaatttgctttcataaatgtattgttgggggttgg

SEQ ID NO: 1979 - DNA, 2991 bp, Zea mays
gcccaggagcttggttatcagatctatctcatgagagatatgaagttagagagaagaagagttctaaaaaggtaccctgcatatagatatctttgttttgcttaaagaaagaagtacattttgtacctgagagactgagacctctcaatttaactccaaattgacattctcttaatgcccgttgctgatatgagtgaaacaacctgcagagggctagaggcttgaaggctttgagcatggcgagtgattcagaatagagtttgaggcgaatggatttttggacttgactttagctggtggcaagaatctgtagttaggtggcactgccttctgcctgtcagacaaacctctgcatctaatttggtgctatgagtgctctgatcaaggtctattgatgtcaacagcaaagatgatattagattcctgatctagtgaggtgcagctccatctttctgggtagtgggcgcctttgtgggagagaaaatggagggtgggatacaatagatggtttctcaaaaccacagaggaagtaatgttcaactgttgggaaacattgaaagctggatgttggctgagaaccaatgaatcatgatgtttaatcgtcataaacttgtagctgtaagacttatggtgaccattctgtccattcaatcaagactgaccaaaattttcaaatgtggacttgcatgccgtatgtatgagctcaggctgaaattacgtgccataggaatgctatttctttcatcctacctaagggcctgtttctttcatctacctgtctaaggctgtttctttcatattcatgcctaaagctgtttcagccttgtgtatgaaacagacggagccttgtggatgaaacagacaggccctgaattcccagagttttctgaagtctcatcactcaggagcatgtgacatcgttatagaatatgtgttagtccttcaccttgaaattactaagttttctaggacaaacctttggccaaaaggaaaccatttttttattcatactatgaggttcgtatagaaaaaatgtttgcttacgattatcatttatcatacaaattacatcaatagaataattgctggtcaaaagacttgtcttcaacgaatgaaataaggctttgtaaatttgttaagctttgttttgttgctgtaaatcttgtggttgtatgcctgtatttcagatttgtgacttgaacgatttgtgggccggtcgttaaaccgctacaggtgtctgggcctgatgggccagctccctccccatagcgcttctattctcccccgcccaccgcggcaccgccgccgactccgatctcggtcgacctacccagtccgccaccgtctaccgccgcccccacgacgatccagtctctgtcgctgccccgcctcccctcctcttcccgctgcctctctcggtctccctgccccgcgcgcaaccggatccaggtgactccggcctggacacgtcaccagacttcctctccgccgtctgatcgggttagcaaaaggaaaaccggcctgcttcgcgaggataagaaaaggtagcaatagcacgggtaagtaaaaacgagctgtagctgtctgccggtcggtctgtccggtccatccccgagacccgactgcgttccttctccttgtcgatggaggaaaccctagccgtcgaatccgccgccggcgagacggcggccgcgcaggcgcctgagctgaacgaagagacgctcgaggaggtgctctcgaggcatagaaaagagaaatcgaaactccaggataaggaaacgagcctcaagaaagctgctgcaaaaggaagcaaagctgagcagaaggcgaagaaaaagcaggtagaggaagagatcacacgcctctcatctgagttagaggcgaaccatgctgcagagcttgcttcctttgggtacaaaccctctggtagctcagagaagggaaacctcgacaacttagtgaaggccatagccggtgtttcagtttccagcaattcggattcagcaaagctcagcaagggagcacgccggcgagagaagaaggcgaaggaggaagctgcccgagagcagcggatccaagaggaacaaagcaatctcgtgagcgaccgcatgctagaaaacgagaagctcgaaaggaagctcgagcccttggggctgaccgtccaagagataaagccggacgggcactgcctgtaccgagcagttgaaaaccagctgtcgctccactccaatggcgctgcacggtacagttaccaggacctacggcagatgacggccaagtacatgagggagcacgccgccaatttccttcccttctacttagcggaaggcaaggccgatgttggaccagatcccatggcgagcttcgagaggtactgcgaggagatggagtccaccgcagcttggggcgggcagctcgaactcggcgcgctgacccactgcctgaagaaacatatcgtcgtctactcaggctccttcccggacgtggagatgggtaaggagtacaaatctggacctggaggtagtggcgccggcggtgcgagcatcaggctgtcgttccacaggcacgcctatggtctcggcgagcactacaactcggtggttccagccggatcatcctagcaagagaaaggtggatgctctgatggcctctaatacttcttgatttgattgtttacgggtggcacttgtctgagtctgaaacacaataggccacttttctttttcccagttgctgtaatccctgtcatgagtagatgaaggttgagtgtaccaatcaaagctgtaccggggagtttgtttcccaaacaattttgctctcatcagttttatgtctgtggtttgatttgaagttgtgtgctgctacttatgtacaaaaaggaggaaacaaaacgtctgacatccatcaaaagtgcaaaaaggagacatgggggaaaagccatgccatgcttctcttcagaagccatcctggcactaatgaaaagagaacaaa

SEQ ID NO: 1980 - DNA, 1194 bp, Echinochloa colona
agcctcccttgccgatggaggaaaccctagccgccgaatccaccgccggtgaggcacccgccgcggtggcgccggagaggaaggaagagacgctcgaggaggtgctctccaggcacaggaaagagaagtccaaactgcaggataaggagacaagcctgaagaaagctgctgccaaaggaagcaaagctgagcagaaggcaaagaaaaagcaggtagaagaagagattacacgcctgtcagctgagttagaggcaaaacatgctgcagagcttgcttcttttgggtacaaaccctcaggcagtagttcagaaaagggtaaccttgacaacttagtgaaggccatagctggtgtttccatgtccagcaattcggagtctgcaaaacccagcaagggtgcacggaggcgagagaagaaggcaaaggaggaagctgctcgagagcagcggatccaagaagaacagagcaatcttgtcagcgaccgcatggtagaaaatgagaagctcgaaaggaagctcgagcccctggggctgaccattcaagaaataaagccagatggccactgcctgtaccgtgctgtcgaaaaccagctgctgcttcattccaatggcggtgcacggtacagttaccaagacctgcggcaaatgacagccaagtacatgagggagcacgcagccgatttcctcccgtttttcttagcagaaggcaaggtcgagatcggaccagacccctcggagagcttcgagaggtactgccaggagattgagtccactgctgcctggggcgggcaactcgagctcggtgcactgacccactgcctcaagaagcatatcgtggtctactcgggctccttccctgatgttgaaatgggcaaagaatacaaatctggatctgttggaggtagtagctcgggtgacgctagcatcaggctgtcctttcacaggcatgcctatggtctcggtgagcactacaactcggtgattccagttgagtcatcataacaaaaagaaattcgactctaatatgtttgattgaatactggtgttgcctgtcggagtttaaacacaatagatgacttgttttggttgctgttacgtttttccatcttctcatcggtccatgatggttgagtgtaccaatcaaacctgtactcgggaggttgtttcccaaacaattttgctctcacagtcgtcgtgt

SEQ ID NO: 1981 - DNA, 1435 bp, Panicum virgatum
gtcccggcaccgctgccatcgcccgagcgccgcccgcgcaaccgaatccaagtgggtccggccccgacacgtcatcacattttccccgccgtctgatcgagatcagttttaggaaaggaaacccgacttgcttgttaaccaaagttgtgctagcctttctgtctgtccgccaccgagaggcgagagcccccgtgtgttgctttcctcgccgatggaggaaaccctagccgtcgaatccgccgccggcgaggcgcccgccgcagtggcgtcggagcggaaggaagagacgctcgaggaggtgctctccaggcacaggaaagaaaaatccaaactccaggataaagaaacaagcctgaagaaagctgctgccaaaggaagcaaagcggagcagaaggctaagaaaaagcaagtagaagaagagattacacgcctgtcagctgagttagaggcgaaacatgctgcggagcttgcttcttttgggtacaaaccctcaggcagctcagaaaagggtaaccttgacaacctagtgaaggccatagctggtgtttccatgtccagcaatttggattccgcaaagcccagcaagggtgcacggcgacgagagaagaaggcaaaggaggaagctgctcgggagcaacggatccaagaagaacaaagcaatcttgtcagcgaccgcatgctggaaaaggagaagcttgaaagtaagcttgagcccttggggctgaccattcaagaaataaagccagatggccactgcctgtaccgtgctgtcgaaaaccagttgttgctccattccaagggcactgcacggtacagctaccaggacctacgacagatgacagccaagtacatgagggagcacgcagacgacttcctcccgtttttcttagcagaaggcaaggctgagactgggtcagatccctctgagagctttgagaagtactgccaggagatcgagtccacggcagcctggggtggacagcttgagcttggtgcgctgacccactgcctcaagaagcacatcgtggtctactcaggctccttcccagatgtggaaatgggccaggaatacaaatctggatccggaggtagtagtgtgggggatgctagcatcaggttgtcctttcataggcatgcgtatggtcttggtgagcactacaactcggtgattccaactgagtcatcataacaaaagaaaatcactctctgatatgtttgattgtttactggtcttgcatgttggagtttaaagtttaaacacagtagatgacttgtttttggttgctgctaaattttccatctcgtcggtcgttgatggttgagtgtaccaatcaaagctgtactcgggaggttgcttcccaaacaattttgctctcaccagtattatgttgcaatcagtgatgtgtttttccattggctatatcttggtgctgct

SEQ ID NO: 1982 - DNA, 1293 bp, Setaria italica
ttgtctgtccgccaccgtgttgcgttccttgccgatggaggaaaccctagccgccgaatccgccgccggcgagacgcacgccgcggtggagacggagcggaaggaagagacgctcgaggaggtgctcgccagacacaggaaagagaaatccaaactccaggataaggaaacaagcctgaagaaagctgctgccaaaggaagcaaagctgagcagaaggcaaggaaaaagcaggtagaagaagagattacacgcctgtcagctgagttagaggcgaaacatgctgcggagcttgcctcttttgggtacaaaccctcaggcagctcagaaaagggtaaccttgacaacttagtgaaggccatagctggtgttaccatgtccagcaattcagagtctgcaaagcccagcaagggtgcaaagcggcgacagaagaaggcaaaggaggaagctgctcgagagcaacggatccaagaagaacaaagtaatctcgtcagcgaccgcatgctggaaaacgataagctcgaaagtaagcttgagcccttggggctgaccgtccaagaaataaagccagatggccactgcctgtaccgtgctgtagaaaaccagctttcgctccattccaatggcactgcacggtacagctaccaggacctacggcaaatgacagccaagtacatgagggaacacgcagccgatttcctccccttcttcttagcagaagggaaggcagagactgggtcggatccctctgagagcttcgagaagtactgccaggagatcgagtccactgcagcgtggggtggacatctcgagcttggcgcgctgacccactgcctcaagaagcacatcgtggtctactcgggctccttcccagacgtggaaatgggccaagaatacaaatctggaggtagtagtgctggcgatgctagcatcaggctgtcctttcatagacatgcctacggtctcggtgagcactacaattcggtgattccgaccgagtcatcataacaaaaggaattcaatagtctctaatatgtttgactgtttactggcgctgcccgttggagttcaaacacagtagatgacttgttttcggcccctcttaacgtttttccatcttctcatcggtcgatgatggttgagtgtgtaccaatccaatcaaagctgtattcgggaggttgcttcccaaacaattttgctctcaccagtaatatgtttcatcagtgattttttttttccatcggatgtagcttgttgctgcttttgagcggaatcctaaaaaatttgtattccct

SEQ ID NO: 1983 - DNA, 1328 bp, Oryza sativa
ctcttttctttttccttcgcctgaactgagttttgcatcgtttgccaatggacgaaaccctagccgacgaatccgccgccggcggcggcgaggcagccgcggcggagccagcgcaggaatcgcagcaagagacgctcgaggaggtgctctcgaggcataggaaagagaaatccaaactccaggataaggaaacaagcctcaagaaagcagccgctaaaggcagcaaagctgagcagaaggccaagaagaagcaggtagaggaggagatttcacgcctctcagctgagttagaggcgaaacatgccgcagagctcgctacttttgggtacaaatcctcaggcagctcagaaaaggggaacatggacaccttagtaaaggctatagctggtgtttctgtgaccagcaacgcggattccgcgaagcctagcaagggtgcacggcgtcgagagaagaaggcaaaggaagaggccgctagagagcagcggattcaagaagagcaaaacaatcttgtcagtgaccgcatgatagaaaatgaaaagcttgagaagaagcttgagcccatgggactgaccattcaggagataaagccagatggccactgcctgtaccgtgctgttgagaaccagctgtcactctattccagagaaaccacacaatacaattaccaggagctgcggcaaatgactgccaattatatgaaagagcatgcggcagattttctcccatttttcctatcagagggcaaggtcgagtctggaccagatcccttggagagcttcaagaggtactgtgaggaggttgagtcaactgctgcttggggtgggcaacttgagcttggtgctctaacccactgcctgaagaagcacattgttgtatactcgggctcatttccagatgtggaaatgggcaaagaatacaaattggattcaggtggtaaagatggccctagcattaggttgtcctatcacagacatgcctatggtcttggtgagcactacaactcggtggttcctgcttagttatctaaaaggggaaaaaaagaaatttaacagtcttggtctcagtatgatatgttttccagtcatccagtgataaccgtctcttaacacaatggatgacttgcttacagctgctgttgtgtttccatcttctcgtcaatcaatgatggtcgagtccttgagtgtaccaaagttttacctgggaatttacttcccaaacagttttgcttgtaaaactgaagtatgtctcattatcttagtttcctgttgaggctgttttaccacctactaatttcatcgagctataatttgttactgcaattctctgca

SEQ ID NO: 1984 - DNA, 1448 bp, Triticum aestivum
cacctttggctccccagctcttcgtccttgccggagtctcgcgccgccgaaaaccctcctcctcccgccggagcctgcctgccatctcgggccgagggaactcttcctcctcccacccatccacccggacgcggttcctctcgctggtaaggcagccctagccggctagccccgcgccaagccgatggacgaaaccctagccgccgaagccggtgccgccgccgcgacggaggagaaggcggtcccggagcgggagccggagacgcttgaggaggtcatctcgaggcataggaaggagaaatccaaactccaggataaggaaacaagtctgaagaaagcagctgccaaaggcagcaaagctgagcagaaggccaagaaaaagcaggtcgaggaagagatatcgcgcctctcagctgcattagaggcgaaacatgctgcagagcttgcttcttttgggtacaaacccgcagaaagctctgaaaaggggaacctcgacaccttagtgaaggccatagctggcgtttctgtttctagcaatgcagattctgcgaagccggggaaggctgcaaaacggcgagagaagaaggcaaaggaagaagctgctcgagagcagcgaattcaagaagaacaaaccaatcttgtcagtgatcgcatgttagaagacgagaaacttggaaggaggcttgagcccttggggctgaccattcatgagataaagccagacggccattgcttgtaccgtgctatcgagaaccagctgtcactccattccaagggcactacacagtacaatcaccaggagctacggcaaatgacagccaagtatatgagagagcatgccgcagatttcctcccatttttcctatcggagggcaaagccgagtctggaccagacccctcggagagtttcgaaaagtactgcgaggagatggagtccaccgctgcttggggcgggcaactcgagcttggtgctctgacgcactgcctaaagaagcacatcgtcgtatactctggctcctttccagatgtagaaatgggcaaagaatacaacaagtcaggaccaggaggtgaccctagcatcaggctttcctaccacaggcatgcctatggcctcggcgagcactacaactcggtgatccccactgagttatcttgaggcaggaaaccaaatgtacttggcctgtgtttacccatgagaagtctttctggtcattctctggttgagtgtaccaaatcatagaatatgtttaaatgggattttacttcccaaacaattttgcctgtaaaacagttttgtttacttattttgctgtggctgcgtactgtgttgactcttctcatcagctatagtatgtttccttcctataaattactgatatgcatttgcctctgtacttcttgtttgcttacttatagaaaggcaaaggcaatcagcattgtcatcgttt

SEQ ID NO: 1985 - DNA, 1381 bp, Oryza sativa
tttctcttttctttttccttcgcctgaactgagttttgcatcgtttgccaatggacgaaaccctagccgacgaatccgccgccggcggcggcgaggcagccgcggcggagccagcgcaggaatcgcagcaagagacgctcgaggaggtgctctcgaggcataggaaagagaaatccaaactccaggataaggaaacaagcctcaagaaagcagccgctaaaggcagcaaagctgagcagaaggccaagaagaagcaggtagaggaggagatttcacgcctctcagctgagttagaggcgaaacatgccgcagagctcgctacttttgggtacaaatcctcaggcagctcagaaaaggggaacatggacaccttagtaaaggctatagctggtgtttctgtgaccagcaacgcggattccgcgaagcctagcaagggtgcacggcgtcgagagaagaaggcaaaggaagaggccgctagagagcagcggattcaagaagagcaaaacaatcttgtcagtgaccgcatgatagaaaatgaaaagcttgagaagaagcttgagcccatgggactgaccattcaggagataaagccagatggccactgcctgtaccgtgctgttgagaaccagctgtcactctattccagagaaaccacacaatacaattaccaggagctgcggcaaatgactgccaattatatgaaagagcatgcggcagattttctcccatttttcctatcagagggcaaggtcgagtctggaccagatcccttggagagcttcaagaggtactgtgaggaggttgagtcaactgctgcttggggtgggcaacttgagcttggtgctctaacccactgcctgaagaagcgcattgttgtatactcgggctcatttccagatgtggaaatgggcaaagaatacaaattggattcaggtggtaaagatggccctagcattaggttgtcctatcacagacatgcctatggtcttggtgagcactacaactcggtggttcctgcttagttatctaaaaggggaaaaaaagaaatttaacagtcttggtctcagtatgatatgttttccagtcatccagtgataaccgtctcttaacacaatggatgacttgcttacagctgctgttgtgtttccatcttctcgtcaatcaatgatggtcgagtccttgagtgtaccaaagttttacctgggaatttacttcccaaacagttttgcttgtaaaactgaagtatgtctcattatcttagtttcctgttgaggctgttttaccacctactaatttcatcgagctataatttgttactgcaattctctgcatggatttctcttatactcctgtggatgaacttgtttctcttttctacggc

SEQ ID NO: 1986 - DNA, 1397 bp, Secale cereale
ttaaccttcttcggctccccagctcttgtgtggccggagtctcgcgccgccgaaaacccccctcctcctctcgccggagcctgcctgctctctcgggccgagggaactattgctccccccactcatccacccgggcgcggttcctatcgctggtaaggcagccctagccggctagccccgcgccaagccgatggacgaaaccctagccgccgaagccggtgccgccgccgcgacggaggagaaggcggtcccggagagggagccggagacgcttgaggaggtcatctcgaggcataggaaggagaaatccaaactccaggataaggaaacaagtctgaagaaagcagctgccaaaggcagcaaagctgagcagaaggccaagaaaaagcaggtcgaggaagagatattgcgcctctcagctgcattagaggcgaaacatgctgcagagcttgcttcttttgggtacaaacccgcagaaagctctgaaaaggggaacctcgacaccttagtgaaggccatagctggcgtttctgtttctagcaatgcagattctgcgaagccggggaaggctgcaaaacggcgagagaagaaggcaaaggaagaagctgctcgagagcagcgaattcaagaagaacaaaccaatcttgtcagtgatcgcatgttagaagacgagaaacttggaaggaggcttgagcccttggggctgaccattcatgagataaagccagacgggcattgcttgtaccgtgctatcgagaaccagctgtcactccattccaagggcactacacagtataatcaccaggagctacggcaaatgacagccaagtatatgagagagcatgccgcagatttcctcccatttttcttatcggagggcaaagccgagtctggaccagacccctcggagagttttgaaaagtactgcgaggagatggagtccaccgctgcttggggcgggcaactcgagcttggtgctctgacacactgcctaaagaagcacatcgtcgtatactctggctcctttccggatgtagaaatgggcaaagaatacaacaagtcaggaccaggaggtgaccctagcatcaagctttcctaccacaggcatgcctatggcctcggcgagcactacaactcagtgatccccactgagttatcttgaggcaggaaacataaatgtacttggcctgtgtttacccatgagaagtctttctggtcagtctctcgttgagtgtaccaaatcatagaatatgtttaaatgggattttacttcccaaacaattttgcctgtaaaacatttttgtttacttacttagctgtggctgcttactgtgttgattcttctcatcagctatactttgttccttcctacaaattactgatatgcatttgccttc

SEQ ID NO: 1987 - DNA, 1361 bp, Leymus cinereus x Leymus triticoides
gacctgggcccaaagttaacctcaccccagctcttcgtcctggccggagtctcgcgccgccgaaaaccctcctcctcccgccggagcctgcctgccacctcgccccgaggaaactcttccccctcccacccatccacccggacgcggttcctatcgctggttaggcagtccaagccggctagccccgcgccaagccgatggacgaaaccctagccgccgaagccggtgccgccgtcgccgccgccgccgccgcgacggaggagaaggcagtcccggagagggagctggagacgctcgaggaggtcatctctaggcataggaaggagaaatccaaactccaggataaggaaacaagtctgaagaaagcagctgctaaaggcagcaaagctgagcagaaggccaagaaaaaacaggtcgaggaagagatatcgcgcctctcagctgaattagaggcgaaacatgctgcagagcttgcttcctttgggtacaagcccgcaggaagctctgaaaaggggaacctcgacaccttagtgaaggccatagctggcgtttctgtttctagcaatgcagattccgcgaagcctgggaaggctgcaaaacggcgagagaagaaggcaaaggaagaagctgctcgagagcagcgaattcaagaagaacaaaccaatctcgtcagtgatcgcatgttagaagacgagaagcttggaaggaagcttcaacccttggggctgaccattcatgagataaagccggatggccattgcttgtaccgtgctgtcgagaaccagctgtcactccattccaacggcaccacacagtacaatcaccaggagctacggcaaatgacacccaagtatatgagagagcatgccgcagatttcctcccatttttcctatcagagggcaaagcggaggccggaccagatccctcagagagctttgaaaggtactgtgaagagatcgagtccaccgctgcctggggtgggcaactcgagcttggtgctctgactcactgcctaaagaagcacatcgtcgtatactctggctcctttccagatgtagaaatgggcaaagagtacaccaagaagtcggaaccaggaggtgaccctagcatcaggctttcctaccacaggcatgcctatggcctcggcgagcactacaactcagtgatccccactgagttatcttgactcttgaggcaggaaacctaatgtacttggcctgtgtttacccgtgagaagtctttctgatcagtctctggttgagtgtaccaaatcatagagtttgtttaaatgggagtttacttcccaaacaattttgcctgtaaaacggtgttattatttacttattgtacctttggcaaa

SEQ ID NO: 1988 - DNA, 1120 bp, Panicum virgatum
gtttaatgtgtctgaaacaggaaagaaaaatccaaactccaggacaaagaaacaagcctgaagaaagctgctgccaaaggaagcaaagctgagcagaaggctaagaaaaagcaagtagaagaagagattgcacgactgtcagctgagttagaggcgaaacatgctgcggagcttgcttcttttgggtacaaaccctcaggcagctcagaaaagggtaaccttgacaacctagtgaaggccatagctggtgtttccatgtccagcaatttggattccgcaaagcccagcaagggtgcacggcggcgagagaagaaggcaaaggaggaagctgctcgggagcagcggatccaagaagagcaaagcaatctcgtcagcgaccgcatgctggaaaacgagaaggttgaaaataaacttgagcccttggggctgaccattcaagaaataaagccggatggccactgcctgtaccgtgctgtcgaaaaccagttgttgctccattccaagggcactgcacagtacagctaccaggacctacggcagatgacagctaagtacatgagggagcatgcagatgacttcctcccgtttttcttagcagaaggcaaggctgagactgggtcagatccctctgagagctttgagaagtactgccaggagatcgagtccacagcagcctggggtggacagcttgagcttggtgcgctgacccactgcctcaagaagcacatcgtggtctactcgggctccttcccggatgtggaaatgggccaggaatacaaatctggatccggaggtaatagtgctggggatgctagcatcaggctgtcctttcataggcatgcctatggtcttggtgagcactacaactcggtgattccaactgagtcatcataacaaaagaaattcgatactggtttctaatatgtttgattgtttactggtcttgcctgtcggattttaaacacagtagatgacatgtttttggttgctgctatatttttccatcttctcaacgccgttgatggttgagtgtaccaatcaaagctgtacttgggaggttgtttcccaaacaattttgctctcaccagtattatgttgcaatcagtgatataattttcca

SEQ ID NO: 1989 - DNA, 1456 bp, Brachypodium distachyon
accgtttgagctttcggcttctgctcccaaactgacctcaccttttggttttggtttttggttcgccctccccggccggagtcgctcgcgccgccggaaaccttcccctctcccccggctgccacctccaatcgtaggagctcctcctcctacccggaggcggctccttgtgccggcaaggaagaagccctagccccagggtcaagcaatccgatggaggaaaccctagccgtcgaagcccccgccaccgccgtggggcaagaggaggcggcgccggagcgggagccggagacgctcgaggaggtcatctcgaggcataggaaagagaaatccaaactccaagataaggaaacgagcctaaaaaaagcagctgccaaaggcagcaaagctgagcagaaggccaagaaaaagcaggtcgaggaagaaatatcacgcctctcagctgaattagaggcaaaacatgctgcagagcttgcttcatttgggtacaaacccacaggaacctccgaaaaggggaaccttgacaccttggtgaaggccatagctggtgtttctgtttccagcaatgcagaatccatgaagcctgggaaggctgcacggcggcgagagaagaaggcgaaggaagaagccgctcgagatcagcgaattgaagaagaacaagccaatctcgttaccgatcgcatgttagaagatgagaagcttgaaaagaagctcaagcccttggggttgaccattcgtgagataaagccagatggccactgcttgtatcgtgctattgagaaccagttgtcgctccattcgaaaggcactacacaatacaatcaccaggagttgcggcaaatggcagccaagtacatgagagatcatgctgcagacttcctcccttttttcctatcagagggcaaagctgagtctgggccagatccctcggaaagcttcgaaaagtactgcgaagagatggaatccactgctgcttggggtgggcaactcgagctcggtgctctgacccactgcctgaagaagcacatcatggtctactcgggctcctttccagatgtagaaatgggcaaagagtacagcaagaagtcagaatcaggaagtgaccctagcatcaggctgtcctaccacaggcacgcctatggtctcggcgagcactacaactcggttatccccaccgagttatcttgatgcggggaaacctaatgttcctggcctatggtctttactcatgagaggagtctgtaaacaccccccaaatagatgaagacttgtttactgttgctgttatgtttccatcttttgatcagtctggtgatatggttgagttgagtgtaccaatcctagtatgtttagtcgggagttcacttcccaaacaattttgcctgtaaaactgataatatctatgtggcagagtgtacggttttgactgctctctcattggctatactgtgttgtg

SEQ ID NO: 1990 - DNA, 1425 bp, Hordeum vulgare
aaagttaaccccacattgtttggctccccagctcttcgtccttgccggagtctcgcgccgccgaaactcctcctcctaccgccggagcctgcctgccatctcgcgccgtgggaacccttcctcctcccacccatccacccggacgcggttcctctcgctggtcaggcagccctagccggctagccccgcgccacgccgatggacgaaaccctagccgccgaagccggtgccgccgccgccggcgcgacggaggagaaggcggtgccggagcggcagccggagacgctcgaggaggtcatctcgaggcacaggaaggagaaatccaaactccaggataaggaaacaagtctgaagaaagcagctgccaaaggcagcaaagctgagcagaaggccaagaaaaagcaggtcgaggaagagatatcgcgcctatcagctgcattagaggcgaaacatgctgcagagcttgcttcttttgggtacaaacccgcagaaagctctgaaaaggggaacctcgacaccttagtgaaggccatagctggcgtttctgtttctagcaatgcagattctgcgaagccggggaaggctgcaaaacggcgagagaagaaggcaaaggaagaagctgctcgagagcagcgaattcaagaagaacaaaccaatcttgtcagtgatcgcatgttagaagacgagaaacttggaaggaggcttgagcccttggggctgaccattcatgagataaagccagacggccattgcttgtaccgtgctatcgagaaccagctgtcactccattccaagggcactacacagtacaatcaccaggagctacggcaaatgacagccaagtatatgagagagcatgctgcagatttcctcccatttttcctatcggagggcaaagccgagtccggaccagatctctcagagagcttcgagaagtactgcgaggagatggaatccaccgctgcttggggtgggcaactcgagctaggtgctctgacgcactgcctaaagaagcacatcgtcgtatactctggctcctttccagatgtagaaatgggcaaagaatacaacaagaagtcggaaccaggaggtgaccctagcatcaggctttcctaccacaggcatgcctatggccttggcgagcactacaattcagtgatccccactgagttatcttgaagcaggaaacctaaatgtacctggcctttgtttagccatgagaagtctttctggccagtctctggttgagtgtaccaaatcatagaatatgtttaaatgggattctacctcccaaacaattttgcctgtaaaacggttttgtttacttattttgttgtgactctatactgtgttgattcttcccatcagctatactttgtttccttcctacaaattactgctatgcatttgcctttctgtccttgt

SEQ ID NO: 1991 - DNA, 1138 bp, Lolium multiflorum
ccccgccggagtgtcgcgccgccgccaaaacccgccgcctcccacccaagggcgcctgctagcgaaggtcctcccatccaccaatcgacccatccgtacgcgcctccctttgccctagccccgtgtcaagccgatggacgaaaccctagccgccgccgccgcccccttgccggagcaggcggcaccggagcgggagaaggagacgctcgaggaggtcatgtccaggcacaggaaagagaaatccaaactccaggataaggaaacaaacctcaagaaagcagctgccaaaggcagcaaagctgagcagaaggcgaagaaaaagcaggtggaggaagagatatcacgcctctcagctgaattggaggcgaagcatgctgcagagcttgcttcttttgggtacaaggctgaaggcagctctgagaaggggaaccttgacaccttagtgaaggctatagctggtgtttctgtctccagcaatgcagattccgcaaagcagcctgggaaggctgcaaaacggcgagagaagaaggcaaaggaagaagctgctcgagagcagcgaattcaagaagaacagaccaatctcgtgagtgatcgcatggtagaagacgagaaacttgaaaagaggctcgagcccttggggctgaccattcatgagataaagccagatggccactgcttgtaccgtgctattgagaaccagctgtcgctccattccaaaggcactacacagtacagtcaccaggagctacggcaaatgacagccaagtacatgagagagcacgctgcagatttcctcccatttttcctttcagagggcaaagctgaggctggaccagatccttccaagagcttcgagagctactgtgcggagatcgaatccaccgctgcttggggcgggcaacttgagctcggtgctctcacacactgcctaaagaagcacatcgtggtctactcgggatcatttccagatgtagagatgggcaaagagtacaacaagaagctggaagcaggaggtgaccctagcatcaggctttcctaccacaggcatgcctatggtctaggcgagcactacaactcagtgatccctgctgagttggaaacctgatgttttttggtctctacttaatgtgttctaccc

SEQ ID NO: 1992 - DNA, 1089 bp, Panicum virgatum
ccaaactccaggacaaagaaacaagcctgaagaaagctgctgccaaaggaagcaaagctgagcagaaggctaagaaaaaacaagtagaagaagagattgcacgcctatcagctgagttagaggcgaaacatgctacggagcttgcttcttttgggtacaaaccctcaggcagctcagaaaagggtaaccttgacaacctagttaaggccatagctggtgtttccatgtccagcaatttggattccgcaaagcccagcaagggtgcacggcggcgagagaagaaggcaaaggatgaagctgctcgggagcagcggatccaagaagagcaaagcaatctcgtcagtgaccgcatgctggaaaacgagaagcttgaaaataaacttgagcccttggggctgaccattcaagaaataaagccagatggccactgcctgtaccgtgctgtcgaaaaccagttgttgctccattccaagggcactgcacagtacagctaccaggacctacggcagatgacagctaagtacatgagggagcatgcagatgacttcctcccgtttttcttagcagaaggcaaggctgagactgggtcagatccctctgagagctttgagaagtactgccaggagatcgagtccacagcagcctggggtggacagcttgagcttggtgcgctgacccactgcctcaagaagcacatcgtggtctactcgggctccttcccggatgtggaaatgggcctggaatacaaatctggatccggaggtaatagtgctggggatgctagcatcaggctgtcctttcataggcatgcctatggtcttggtgagcactacaactcggtgattccaactgagtcatcataacaaaagaaattcgatactggtctctaatatgtttgattgtttactggtcttgcctgtcggattttaaacacagtagatgacatgtttttggttgctgctatatttttccatcttctcatcgccgttgatggtcgagtgtaccaatcaaagctgtactcggggggttgtttcccaaacaattttgctctcaccagtattatgttgcaatcagtgatataattttcca

SEQ ID NO: 1993 - DNA, 2334 bp, Saccharum officinarum
tgagtgtgctcggtccctccctcctccagtcctccactcctcagcgcctctccctctcgtgtctcgtctcgtcccgggaagcggacaaagcgaggcgctgcagatttcgatccggttcccaatgcctcccatgcccgccgtcgtcctgtgctagctcccgtctccgctcctcccacctgccgcggcgcgccgcctggatccggcgagcgcgcggctaggagcctcagatccgagcgaaacccagccgtcccgggtgacatcttcgctctagctccagattggcggctgccatttcccctcttcttcttgctgctgaaggtttcaaggcgagtctgttaactctggtgggttttcgggttgctcctggttttcttcgattgggttgcacccgccggcgtggtccagatttagctgcattttccgggctgtgctcgtctgtgccagaaatctcagcttgttagcctagagcttatagatatcttttgggagtaatcctgttcttgctccattcccgtgctagtcttgatgtattagtggcaaggtttactgttgccatgctattggtgtgacggcgccaccaaggttttgtggaagatgtggaagcagttcctcagcaagctgccccggaagtcgtcggcctccggggactcagggcagtgcagcaatggcaccgggatacagcgcacgagcagctgcgggagcatcccgcctggccgtccggcttcagccatccggcgcatgtcatccgccgtcttcccatctactgttgtggctggtattgagccgctggtctcgttcaaggatgtccccaactcggagaagcagaacctgtttgtgagcaagctgagcctgtgctgtgtcgtctttgatttctcggacccgaacaagagttcagtggagaaggatatcaagaggcaggcgttgctggatcttatagagtttgtcgagtcgaccaatgctcgcttctcggaggcggcgattgcggcctgctctaggatgtgtgccatcaacctgttccgggcgttccctccaaattgcaggtctggctcatcaggtggtggtgagggcgacgaggacgagccaatgtttgatcctgcgtggtgccatctgcagcttgtttatgagctgctactgaaatttattggatcatcatccttggatgcaaagatagggaagaagcactttgatcactcattcatcgtgaagctccttaatcttcttgactcagaggatccaagagaaagggattgcttgaaaactattctgcacagggtatatgggaagttcatggtacaccgtcctttcattcgcaaagcagtgagcaatatattctaccagtttgtctttgagactgatcggcataatgggattgctgagctgctggaggtctttggcagtgtcattagtgggtttgcattgcctctgaaagaagaacacaagatctttctttggagggttttggttcctctacacaaaccgaaatctgttggtgtgtatcttcagcagttgacctactgtgtgacacagtttatagaaaaggacccaaagcttgcaagctcagtgataattggtttgttaagatattggccaataacaaattgtcagaaggaagtgatgtttctcagtgagattgaagagatcttggagtctaccagccaggcagaattccagaaatgtatggtaccattgtttaggcgcattgctcattgtatcacgagttctcacttccaggttgctgaaagagcgctcttcgtatggaataatgatcacattatcagcttgattgcacaaaaccgccaagtgatcatgcctcttgttgttccagcactagagcacaacattcagaatcactggaaccaagcagtcctgaatctgactgtgaatgtcaagaaaatgttttctgagatggacgatgatctctcctcatcatgcctggccaagtacaaggaggaagaagaaaaacgtgtgtcgatagaagcgaagcgtaagcttacctgggagaagcttgaggcagctgcagctttccagccagtgactggccatactgccgtcctagtaggccaccagccgtcagcaaatatgatcgccaccctgatctagctcatgtatgcaggagaagcaaagttgctcttcccccttttggtgaagcgcagcaagtctagtgttctctattttgcttttgcttattttttttttgcatttgttggtatgagtaatcagtgtagtaagttgtaactatttccggatgtttatgttcataaggcaagaatacctgtaatgtaagactgctgagtgctggcactctttacatgtgtctttgcctatttatggatg

SEQ ID NO: 1994 - DNA, 2217 bp, Zea mays
aaacaggcacagccctcccctcctccactcctcgccctctctctctctctctctctcatcccgtcccgagaagcggacaaagcgcggcgctgcagatttcgatccggttcccaatgcctcccatgctcgccgtcgccccgtgctagctcctctcccgtctccgcttcctccacctgccgcgccagcgccacgccgcctggatccggcgagcgcgtggccgggagcctcagatccgagcgaaacccagccttcccgtggtgacggccttcgctctagctccagattggctggcggctgccattcctcctcctcctcttctcgctcgaggtttcaaggcgggtccgttcagctctgtgctggcgtgacagtggaaaggcttactgttgccatggtattggtgtgacgaacccgtcaaggttttgcgcaagatgtggaagcagctcctcagcaagctgccccggaagtcgccggcctgcggggattcgggccagtgcagcaatggcaccggtatacagcgcacgagcagctgcgggagcatcccgcccggccgcccggcctccgccatccggcgcatgtcatccgccgtcttcccctcgagtgtcgtggccggtatcgagccgctggtctcgttcaaggatgtccccaactcggagaagcagaacctgttcgtcagcaagctgagcctgtgctgcgtcgtcttcgatttctcggacccgaacaagagctcagtggagaaggatatcaagaggcaggcattgctggatcttatagagtttgtcgagtcgaccaacgctcgcttctcggaggcagccatcgcggcctgctctaggatgtgtgccatcaacctgttccgggcgttccctccgagttgcagatctggctcatcaggtggtggtgagggcgacgaggaagagccaatgttcgaccccgcgtggtgccacctgcagcttgtttatgagctgctgctgaaatttatcggatcctcgtccttggacgcgaaggtagggaagaagcactttgatcactcattcatcgtgaagctccttaatcttcttgactccgaggatccaagagagagggattgcttgaaaactattctgcacagggtatatgggaagttcatggtacaccgtcctttcatccgcaaagcagtgagcaacatattttaccagtttgtctttgagactgatcggcacaatgggatcgcggagctgctggaggtctttggcagtgtcattagtgggtttgcattgcctctgaaagaagaacacaagatctttctttggagagttctgattcctttacacaaaccaaaatctgttggtgtgtatcttcagcagttgacctactgtgtaacacagtttctggaaaaggacccaaagcttgcaagctcagtgataattggtttgttaagatattggccgataacaaactgtcagaaggaagtgatgtttctcagtgagattgaagagatcttggagtctaccagccaagcagaatttcagaaatgtatggtaccgttgtttcggcgaattgctcattgtattaccagttcccacttccaggttgctgaaagagcgctcttcgtatggaacaatgatcacattatcagcttgattgcacaaaaccgccaagtgatcatgcctcttgtcattccagcgctagagcaaaacattcagaatcactggaaccaggcggtcctgaatctgaccgtgaatgtcaagaaaatgttatctgagatggacgacgatctcttctcgtcatgcctggcgaagtacaaggacgaagaagaaaaacgcgtgtcgctagaagcgaagcgtagacttacgtgggagaagctcgagtcagctgcagctttccagccagtgactggccatacagccgtcctagtaggccaccggccgtcagcaaatctgatcgccaccatgatctagctcatgcatgtatgccgaacaagcgaatgtggtgctctcccccccttttggtgaggcgcagcaagtgtagtgttctctattttgctcctgcttattattattttccttttgctggtatgggtaatcagtgtagtagtaagttgtaactatttccggatgtttatgttcttaaggcaaggatacctgtaacttaagactgccgagtgctgacactctacatgtatctttgcctgtttatggatgaacaggtgtcctacagtttaatttcactttccagcttgcc

SEQ ID NO: 1995 - DNA, 2828 bp, Panicum virgatum
ccgtgcggggtcgcgcgcctcccccgatccgacggacggccgggatctccccgtccggcccgtgaccagccacgggcctttcgaattaaagcgctggaccgccggctcggtcccgtgcccaaggacaaggacgccgattaaagcctacccatatgcaaatcggcccctgcagtttctcacaatttcgttacatgaagtgtgatttcgaagtaaagccaggatccaggctttaaggaagcccccggatttggggtgatttgctactaatcagcacgggcctcgtgagccgtacatcgcgatggcggcataaatggtcttgtccgtacatgccccgtgataaacaaaccaatttcccgcacgaaacaacaagcaggcccttcccttccactccccttctcatccgctccccctctccctcggcccccctgctcctcactctcccgtctcccccttcccgagaagcggacaaagcgcggcgctgcagatttcgatccggttcccaatgcctcccaggcccgtcgtcctgtagctcccgcctccgcttctccatctgccgcggcggccagggaacggcgcctggatccggcgagcgcctggcctgaagccccagatccgagcgaagacgagctttccgtggcggcctctcggctctagctcggggttggcagctgccattgcccccctccccttcttcttcgagatttcaaggccggtctgtccatctttggtggcatttgaggttgttcgtggtttttcttcgatttagtttgcctctgcatggtccagatttagctgcattccccggattgtgctcctccgtgacaaaaatctaagcttgtttcctcggaagtgtcttgctatcgcattagagtagcgttagatctttttggttagtagccctggttcttgctccatcacgtgctaatcttggtacattggcgacgagctctactgttgccatggtgttggtgtgaaaaaagggttttatttttatcgaagatgtggaaacaatttctcagcaagctgccccggaagtccccggcctccggggactcaggtcagtgcagcaatggcaccgggatacagcgcacaaccagctgtggaagcatcccgcctggccggccggcttccgccattaggcgcatgtcgtctgccgtcttcccctcaagtgttgtggctggcattgagccgttggtttccttcaaggatgtcccaaactcggagaagcagaacctgtttgtgagcaagttgagcctgtgctgtgtcgtctttgatttctcagacccgaacaagagttcggtggagaaggatatcaaaaggcaggcattgttggatcttatagagtttgttgaatctagcagcgctcgcttctcggaggcggcgattgctgcctgtgctaggatgtgtgccatcaacctgttccgggcattccctccaaattacaggtctggttcatctggtggtggtgagggtgatgaggacgaaccgatgtttgatcctgcatggtgtcatctgcagcttgtgtatgagctactgctgaaatttattggatcctcatccttggatgcgaaggtagggaagaagcactttgatcattcattcattgtgaagctccttaatcttctcgattccgaggatccaagagaaagggattgtttgaagaccatcctgcacagggtatatgggaagtttatggtacaccgtcctttcatccgcaaagcagtgagcaatatattctaccagtttgtctttgagactgatcggcataatgggatcgctgagctgctggaggtatttggcagtgtcattagtggctttgcattgcctttgaaggaagaacacaagatctttctttggagagttttgattcctttacacaaaccgaaatcagttggtttgtatctccagcagttgacctactgtgtgacacagtttctagaaaaggacccgaagcttgcaagctcagtaataattggtttgttaagatattggccaataacaaattgtcagaaggaagtgatgtttcttagtgagatcgaagagatcttggagtctaccagccaggcagaatttcagaaatgtatggttccattgtttcggcggattgctcattgcatcaccagttctcatttccaggttgctgaaagagcactctttgtatggaacaatgatcacattatcagcttgattgcgcaaaaccgccaagtgataatgccactcgttgttccagcactagaacagaatattcagaatcactggaaccaagcagtcctgaatctgacaatgaatgtaaagaagatgttctctgagatggacgaggatctcttctcatcatgcctggataagtacaaggaggacgaagaaaagcgagcgtcgttagaagtgaagcggaagctgacctgggagaagcttgagtcagctgcagctttccagccagtgaccggccatacagccgtcctagtaggacaccagctgtccgcaaaaatgatcgccaccctgatctagcttatgccttatgcatgcgggggagaatcaacggtgctcttcacccttttggcgaagtgcagcaagtgtagcgtttgctatttggttcttgtttattgttccatttgtcagtatgagtaatcagtgttgtaagttgtaactattttcatatgtttatgctctctaggcaagcatacctgtaatgtaagactgctgagtgctggcactctttacatgtatccttgcctgcctatggatgagcaagtgtcctacaattaaatttcattttcagctctcatatatggttgattttgccaataaaaatggattcttgcaaataaaaa

SEQ ID NO: 1996 - DNA, 2379 bp, Setaria italica
acgaaacaacaaacaggcccttccctcccactccgcttctcatcccactccctccctctccctctgcggctctgctcctcacactctctctgtgtctgtcctcccgagaagcggacaaagcgcggcgctgcagatttcgatccggttcccaatgcctcccaggcccgtcgtcctgtagcccccgcctccgctcctccacctgccgcggcggccacggcacggcgccctggatccggcgagcgcgcggcctcaagccccagatccgaccgaagccgagctttccgtggtggcctcctgccggctcgggattggcagctgcccatttccccctcctcttcttggtcgtgatttcaaggctagtctgtccaactttggtggttgttcgtggttttcttcggttcagtttgcatctgcatggtccagatttagctgcattcaccaggattgtgctcttctgtggcaaaaatctaagcttgtttcctcggaagtgtgtggctgtcgcattagagtagagttagatcttttggttagtagccctggttcttgctccatcctgtgttggcaagctctactgttgccatggtagtggtgtgaaaaaaaaaggttttgtggaagatgtggaaacagtttctcagcaagctgccccggaagtcctcggcctccggggactcaggtcagtgcagcaatggcaccgggatacagcgcacgagcagcttgggaagcatcccacctagccgcccggcttccgccattaggcgcatgtcgtctgccgtcttcccctcaagtgttgtcgctggcattgagccgttggtttccttcaaggatgtcccaaactcggagaagcagaacctgtttgtgagcaagttgagcctgtgctgcgtcgtctttgatttctcggacccgaacaagagttcggtggagaaggatatcaaaaggcaggcattgctggatcttatagagtttgttgaatctagcaatgctcgcttctcagaggcctcgattgctgcctgcgctaggatgtgtgccatcaacctgttccgtgcatttcctccaaattacaggtctggttcatgtggtggtgagggtgatgaggacgagccgatgttcgatcctgcatggtgccatctgcagcttgtgtatgagctactactgaaatttattggatcctcatccttggatgcaaaggtagggaagaaacactttgatcactcattcattgtgaagctccttaatcttctcgattccgaggatccaagagaaagggattgtttgaaaactattctgcacaggatatatgggaagttcatggtacaccgtcctttcatccgcaaagcagtgagcaatatattctaccagtttgtctttgagactgatcggcacaatgggattgctgagctgctggaggtctttggcagtgtcattagtggctttgcattgcctttgaaggaagaacacaagatttttctttggagagttttgattcctttacacaaaccaaaatcagttggtttgtatctccagcagttgacctactgtgtgacacagtttctagaaaaggacccaaagcttgcaagctctgtcattattggcttgttaagatactggccaataacaaattgtcagaaggaagtgatgtttcttagtgagatcgaagagatcttagagtctaccagccaggcagaattccagaaatgtatggttccattatttcgacggattgctcattgcatcaccagttctcacttccaggttgctgaaagagcactcttcgtatggaacaatgatcacattatcagcttgatcgcacaaaaccgccaagtgatcatgcctctcgttgttccagcactagaacagaatattcagaatcactggaaccaagcagtcctgaatctgactctgaatgtaaagaagatgttttctgagatggacgaggatctcttctcatcatgtctggctaagtacaaggaggatgaagaaaagcgggtttcattcgaagtgaagcggaagctgacctgggagaagctcgagtcagctgcagctttccagccagtgactggccatacagccgtcctagtaggccaccagccgtcagcaaatatgactgccaccctgatctagcttatgccttatgcgcgctggagaatcaacggtgctcttcccccttttggtgaagtgcagcaagtgtagtgtttgctattttgctcttgtttattattttatttgtcggtatgagtaatcagtgttgtaagctgtaactatttgcatatgtttatgctctcaaggcaagcatacctgtaatgtaagactgctgagtgctgacactctttacatgtattcttgcctggctatggatgagcaagtgtcctacagttattttca

SEQ ID NO: 1997 - DNA, 1788 bp, Pennisetum glaucum
cagtggtgtgataaaaaggttcagggaagatgtggaaacagtttctcagcaagctgccccggaagtcctcggcctctggggactcaggtcagtgcagcaatggcaccgggatacagcgcaccagcagcttgggaagcatcccgcctagccgcccggcttccgccattcggcgcatgtcgtctgccgtcttcccctcaagtgttgtggctggtattgagcctttggtttccttcaaggatgtcccaaactcggagaagcagaacctgtttgtgagcaagttgagcctgtgctgcgtcatctttgatttttcggacccgaacaagagttccgtggagaaggatatcaaaaggcaggcattgctggatctgattgagtttgttgaatctagcaatggtcgcttctcagaggcttcaattgctgcctgtgcaaggatgtgtgccatcaatctgttccgggcattccctccgaattacaggtctggttcatctggtggtgagggtgatgaggacgagccgatgttcgatcctgcatggtgccatctgcagctagtgtacgagctacttctgaaattcattggatcatcatccttggactcaaaggtagggaagaaacactttgatcactcattcattgtgaagctccttaatcttctcgattccgaggatccaagagaaagggattgtttgaaaactattctgcacagggtatatgggaagttcatggtacaccgtcctttcatccgcaaagcagtgagcaatatattctaccagtttgtcttcgagactgatcggcacaatgggattgctgagctgctggaggtctttggcagtgtcattagtggctttgcattgcctttgaaggaagaacacaagatttttctttggagagttttgattcctttacacaaaccaaaatcagttggtttgtatctccagcagttgacctactgtgtgacacagtttctagaaaaggacccaaagcttgcaagctcagtcatacttggtttgttgagatattggccaataacaaattgtcagaaggaagtgatgtttcttagtgagatcgaagagatcttggagtctaccagccaggcagaattccagaaatgtatggttccattgtttcgacggattgctcattgcatcaccagttctcacttccaggttgctgaaagagcactcttcgtatggaacaatgatcacattatcagcttgatcgcacaaaaccgccaagtgatcatgccccttgttgttccagcactagaacagaatattcagaatcactggaaccaagcagtcctaaatctgactctgaatgtaaaaaagatgttttctgagatggacgaagatctcttctcatcatgtctggctaagtacaaggaggatgaggaaaagcaggtttcattagaagtgaagaggaagctgacctgggagaagctcgagtcagctgcagctttccagccagtgactggccatacagccgtcctagtaggccaccagccgtcagcaaatatgatcgccaccctgatctagcttatgccttatgcacgctggagaatcaacggtgctcttcccccttttggtgaagtgcagcaaatgtagtgtttgctattttgctcttgtttgtctttttctttcatgtgtcggtatgagtaatcagtgttgtaagttgtaactatttgcatatgtttatgctctcaaggcaagcatacctgtaatgtaagactgcttagtgctgaaactatttacatgtatccttgcctggctatggatgagcaagtgtcctaca

SEQ ID NO: 1998 - DNA, 3814 bp, Panicum virgatum
taattttcaggaaatgtgaaattaaaatcaccaccgggaaacagccttagcccccgtgctcaagctacttcttcacaaatctgtgacatgtctgccaaaaatcctacttcgggacgcatttaatgtgtattattatgatagaacagtgccccggggcgctgctaggtcatttttggacaactgtgtatcctgcctttttgtatagtccgtggggccgtagcccacctcctcatcacagcttgtacgaggaccatgctgccgctgatgaggcaatgaacacggatcatgccctctgtttcgtgagcacgaatgtacgatggaggtacagccgcgtgggtggaggacctacgaccggaccagagccaagatggtcgggactgaagaatgttggagtttgggtttttaaaattcttggagagtttgaactttggccgccactcgtcaaactattccatcaaactccatcggcaagtttttctctttttttttgagcggccacatgtatagcacaatccgcggcctacccctgctgtcttgctttcgctcttggtctcggactctctcggtggttttgcatcagtaactcattttcatcactgttgttttcacaacacgcctcaaaattccgagactgggagaggtactagcaccgtgtttatgacgcatcacggatagatgcgtctccctgccgtagcggaccatgcttcaggccgccgcacatgccgagtgtctattgacacccatttcattctccctcccgacgccgagcccagcggacgggacggacggtctcgctctcgccgctgcagcccggcagcacccctgcggcgagacagcgacggagccgcacgggccggactggtccggcgagtacccgtgccgtcaccgcctgttttaccgccggtgccccaccccaccgccgtgtgctgaggtcacgggcgacggggccgcggccgtccatctgcccccgtccgtgcggggtcgcgcgcctcccccgatccgacgacggacggccgggatctccccgtccggtccgtgaccagccacgggcctttcgaattaaagcgcccgatcgccggccggtcccgtgccgtgcccaaggacaaggacgccgattaaagcctaccaggttttgcaaatgggcccctgcggtttctcgcaatcacgttctgctaatcgttggtgaagtgttgatttcgaagtaaagccaggatcctggctttaagaaagccccggatttggggtgatttgctaatcagcacgggcctcgtgagccgtacatcgcgatggcggtcttgtccgtacatgccccgtgttaaacaaaccaattcccgcacgaaacaacaagcaggcccttcccttccactccccttctcatcccgctccccccccccctctccctcggccgctctgctcctcactccctcccccttcccgagaagcggacaaagcgcggcgctgcagatttcgatccggttcccaatgcctcccaggcccgtcgtcctgtagctcccgtctccgctcctccatctgccgcggcggtcacgtcacggcgcctggatccggcgagcgcctggcctgaagccccagatccgagcgaagccgagctttccgtggtgacctctcggctctagctcggggttggcagctgccatttccccctccccttcttgttcgagatttcaaggctggtctgtccatctttggtggcatttgaggttgttcgtggttttcttcgattcagtttgcatctgcatggtccagatttagctgcatttcccggattgtgctcctccgtgacaaaaatctaagcttgttgcctcggaagtgtcttgctatcgcattatagtagagttagatctttttggttagtaaccctggttcttcctccatcatgtgctaatcttggtatattggcggcgagctctactgttgccatggtgttggtgtgaaaaaaaagggttttgtccaagatgtggaaacaatttctcagcaagctgccccggaagtcctcggcctcagcggactcaggtcagtgcagcaatggcaccgggatacagcgcacaaccagctgtggaagcatcccgcctggccgcccggcttccgccattaggcgcatgtcatctgccgtcttcccctcaagtgttgtggctggcattgagccgttggtttccttcaaggacgtcccaaactcggagaagcagaacctgtttgtgagcaagttgagcctgtgctgtgtcgtctttgatttctcagacccgaacaagagttcggtggagaaggatatcaaaaggcaggcattgctggatcttatagagttcgttgaatctagcagtgcacgcttctccgaggcagcgattgctgcctgtgctaggatgtgtgccatcaacctgttccgggcattccctccaaattacaggtccggttcatctggtggtggtgagggtgatgaggatgagccaatgttcgatcctgcatggtgtcatctgcagcttgtgtacgagctactaatgaaatttattggatcctcatccttggatgcgaaggtagggaagaagcactttgatcactcattcattgtgaagctccttaatcttctcgattctgaggatccaagagaaagggattgtttgaagactatcctgcacagggtatatgggaagtttatggtacaccgtcctttcatccgcaaagcagtgagcaatatattctaccagtttgtctttgagactgatcggcataatgggattgctgagctgctggaggtctttggcagtgtcattagtggctttgcattgcctttgaaggaagaacacaagatctttctttggagagttttgattcctttacacaaaccgaaatcagttggtttgtatctccagcagctgacctactgtgtgacacaatttctagaaaaggacccgaagcttgcaagctcagtaataattggtttgttaagatattggccgataacaaattgtcagaaggaagtgatgtttctgagtgagatcgaagagatattggagtctaccagccaggcagaatttcaaaaatgtatggttccattgtttcggcggattgctcattgcatcaccagttctcacttccaggttgctgaaagagcactctttgtatggaacaatgatcacattatcagcttgatcgcgcaaaaccgccaagtgatattgccactcgttgttccagcacttgaacagaatattcagaatcactggaaccaagcagtcctgaatctgacaatgaatgtaaagaagatgttttctgagatggacgaggatctcttctcgtcatgcctggataaatataaggaggacgaagaaaagcgagcatcgttagaattgaagcggaagctgacctgggagaagcttgagtcagctgcagctttacagccagtgaccggccatgcagccgtcctagtaggacaccagctgtcagcaaatatgatcgccaccctgatctagcttatgcattatgcatgctggagaatcaacggtgctcttcacccttttggcgaagtgcagcaagtgtagcgtttgctattttgctcttgtttatttttccatttgtcagtatgagtaatcactgttgtaagttgtaactatttcatatgtttatgctctctaggcaagcatacctgtaatgtaagactgctgagtgctggcactctttacatgtatccttgcctgcctatggatgagcaagtgccctacaattaaatttcattttcagctcgcctatatggttgattttgccaataaaggtgactgatatgtggaaccatcaagtgcaatttaat

SEQ ID NO: 1999 - DNA, 2658 bp, Zea mays
tcgtccgtacatggccccgtgataaacaaaccattccccgcaagaaacagcaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggtgggggtggggggtggaatctgcggtggagtcttgccgtcgctcgctgtaaacgtagagctctctctctctcttggcgagtaatcttggttcttgctccatttccgtgttagtgctggcgtgtgagtggcaaggtttacgtgtaagatgtggaaacagttcctgagcaagctgccccggaggtcgtcggcctccggggactcgggacattgcagcagtggcgccggcatacagcgcacgagcagctgcggcagcatcccgccgggccgccccccggcctccgccattcggcgcatgtcatccgccgtcttcccctcgagcgtcgtggctggcatcgagccgctggtctcgttcaaggacgtgcccagctcggagaagcagagcctgttcgtgagcaagctgagcctgtgctgcgtcgtgttcgatttctcggacccggacaggagttcggtggagaaggatatcaagcggcaggcactgctggatcttatagagttcgtcgagtcgaccaacgctcgcttctcggaggcggcggtcgtggcctgctctaggatgtgcgccgtcaacctgttccgggcgttccctgcaagttgcaggtctggcggctcatcaggcgtcggtgagtgcgacgaggacgagccaatgttcgatactgggtggtgccatctgcaccttgtttatgagctgctactgaagtttatcggatcctcgtccttggatgcaaagatagggaagaagcactttgatcactcgttcattgtgaagctccttgatcttcttcactccgaggatccaagggaaagggattgcgtgaaaaacattctgcacagggtgtatgggaagttcatggtgcaccgtcctttcattcgcagagcggcgagcaacgtattctaccagttcgtcttcgagactgatcgacataatgggatcgcagagctgctggaggtctttggcagtgtcattagtgggtttgcactgcctctgaaagaagagcacaagacctttctttggagagttttggttcctttgcacaaaccaaaatctcttggtgcgtaccttcagcagttgacctactgtgtgacacagtttatagaaaaggatccagagctcgcaagcccagtgataattggtttgttaaggtactggccaataacaaattgtcagaaggaagtgatgtttctcagcgagatcgaagagatcttggaggctaccagccaggcagaattccagaaatgtatggcaccattgtttcggcgaattgctcattgtatcaccagtgctcacttccaggttgctgaaagagcgcttttcatgtggaacaatgatcacattgtcagcttgatagcacaaaaccgccaagtgatcatgtctcttgttgttccagcgctagagcagaacattcagaatcactggaaccaagcggtcctgaatctggctgtgaatgtcaagaaaatgttttctgagatggatggtgaccatttctcgtcgtgcctggccaggtacaaggaggaagaagaaagacttgtgtcgctagaagcgaagcgtaaacttacctgggagaagcttgagtcagctgcagccttccagccagtgactggccaaacagccgtcctagtaggccaccagccgtcagcaaatatgatcgccaacctgatcttctagcccatgcatgccgaacaagcaaatgtgctcttccccccttttggtgaagcgcagcaagtgtaggtgttccctaattttctcatgcttttttttttgcatttgttggtgcgagtaatcagtgtagtaagctgtaactatttctggatggttatgttcatcaggcaagaatacctgtaatgtgagactgctgagtgctggcactccttacatgtatctttgccaatttgtggatgaacaaattgtcctacagttgaatttcacctcagcttgcctattatgattggctgacgcagaatcatcaagtgctatttttatttccaaaatgtctgaagctttggtttgaattcaatccattctcacagcttaccactgcgattcaattttgaaatggacatgttgttagactgtttgtgtgttctgggcctagagtccacttagggcttgttcgtttccgtcggattgcacccggaatcgttccagctaatcaaagtttatataaattagagaagcaatccgattaggaatcgttccgacccaccaatccggcacaaacgaacaatgccgcgttttcctcaagtaatgtcatcatctctctccggggtgacatggctgtttgctgcttagctgtttttttgtgcattgtatgactg

SEQ ID NO: 2000 - DNA, 2456 bp, Oryza sativa
ctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggccatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggcattgagccacttgtctcgttcaaggatgtccccaactcggagaagcagaatctgttcgtcagcaagctgaatctgtgctgtgctgtctttgacttctcggatccgaacaagagctcggcggagaaggatatcaagaggcagacgttgttggatctcatagattacgtggattccagcagttcccgtttctccgaggcggtgattgctgctagctctaggatgtttgctgtcaacttgttccgggtgtttcctccaaattacaggtccggttcatctggcggcggcgagggtgaagaggaggagccaatgtttgagcctgcatggtgccatctgcagcttgtttatgagctgctactgaaatttattggatcctcgtccctcgatgcaaaggtagggaaaaagtactttgatcactccttcattgtgaaactgctgaatcttcttgattcagaggatccaagggaaagggattgtttgaaaactattctgcacaggatttatgggaagttcatggttcaccgtccttttatccggaaagcagtaagcaatatattctaccactttgtgtttgagactgaccggcataacggaattgctgagctgctggaggtatttggcagtgttattagtggctttgcgttgcctctgaaggaagaacacaaaatctttctttggagagttttggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaacgcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactatttttcccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctgg

SEQ ID NO: 2001 - DNA, 2543 bp, Oryza sativa
ggctcctcctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggctatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggtattgagccacttgtctcgttcaaggatgtccccaactcggagaagcagaatctgttcgtcagcaagctgaatctgtgctgtgctgtctttgacttctcggatccgaacaagagctcggcggagaaggatatcaagaggcagacgttgttggatctcatagattacgtggattccagcagttcccgtttctccgaggcggtgattgctgctagctctaggatgtttgctgtcaacttgttccgggtgtttcctccaaattacaggtccagttcatctggcggcggcgagggtgaagaggaggagccaatgtttgagcctgcatggtgccatctgcagcttgtttatgagctgctactgaaatttattggatcctcgtccctcgatgcaaaggtagggaaaaagtactttgatcactccttcattgtgaaactgctgaatcttcttgattcagaggatccaagggaaagggattgtttgaaaactattctgcacaggatttatgggaagttcatggttcaccgtccttttatccggaaagcagtaagcaatatattctaccactttgtgtttgagactgaccggcataacggaattgctgagctgctggaggtatttggcagtgttattagtggctttgcgttgcctctgaaggaagaacacaaaatctttctttggagagttttggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctggtcatggttgctcaagcaacttctaatacgttgattcagtttggtagtatctcctaatgtggtattcttacaacctaaaa

SEQ ID NO: 2002 - DNA, 2136 bp, Brachypodium distachyon
acaagccgagcccttcccttcctgtctgctcctcctccccactctctctctctcttgctcttcccgagaagcggacgaagcgaagagcagcagatttcgatccggttcccgacgccctcacaggattcctgtcctgtagctaggtagagagcttcccccgtcctccccaccgctcggatccggcgagctcgcggccgggaaggcccagatccggggccgttccggtgtcctccttttgctgcgcgcgagtaagagcgagctttgctgttggccatgtcgtcgtcactggcgtgagaggacttggcgcaaaggaagatgtggaagcagttcctcagcaagctgccccggaagtcctcgggctccgggagggacgacttcgactcgggccagtgcagcaacgggaatgggagctcgatacagcgcacgagcagctgcggcagcatcccggccggccggtctacttccaccatcaagcgcatgtcgtccgccgtcttcccctcgagcgtcgtggcgggcatcgagcctctggtttccttcaaggacgtccccaactcggagaagcagaacctgtttgtcagcaagctgaacctgtgctgcgccgtctttgatttctcggacccgagcaagagttcggcggagaaggatatcaagaggcagacgttgttggatcttgtagatttcgtcgattcgagcagttcacgtttctccgaggccgtgattgctgcctgctcgaggatgtttgcagtcaacttgttccgggtgttccctccgaattacaggtccggttctggtggtggcgagggtgatgaggatgagccgatgtttgatcctgcatggtgtcatctgcagcttgtgtatgagctgctgctgaaatttattggatccaactccctggatgcaaagatagggaagaagtactttgaccactccttcattgtaaggctgctcaatctgcttgactctgaggatccaagagaaagagattgtttaaaaactattctgcacaggatttatgggaaatttatggttcaccgtccgtttatccgcaaagcagtaagcaatatattctaccactttgtgtttgagactcagcggcataatgggattgctgagctgctggaggtatttggcagcgttattagtggctttgcattgccgctgaaggaagaacacaaaatctttctttggagagttctgattcctttacacaagccaaaatcagttggcgtgtacctccagcagttgacatactgtgtgacacagtttttagaaaaggacccgaagcttgcgggctcaataattattggtttactaagatattggccaataacaaatagtcagaaggaagtgatgtttctgagtgagatcgaagagatccttgaagctaccagcatggtagagttccagaaatgcatggttcccttgtttcggcgaatcgctcattgtgtcaacagttctcacttccaggttgctgaaagagcactcttcatgtggaacaatgatcacattatcagcttggtggcacaaaaccgcctagtgatcatgcccatcattgtcccagcactagaacagaatagtcagaatcattggaaccaagcggtccttaatctgactgccaatgtaatgaagatgttttctgagatggacgaggaactattttcagcatgcctaacaaagtgcaaggaggaagatgataaccaagcgtcactggaagagaagcggaggttgacatgggagaagctggagtcagctgcagctctccaaccagtgaccggccatacagccgtcctggtaggtcgccaaccgtcagcaaatttaatcgcgacgcttatttagcatatgttcagtggaggtgcaaaggggtgctcttccccttttcggtgaagcgccccaagtgaacaaccttcagggttcaccgttttgcttttctttgtaagttgtaactatttccagtatgtctatgctccagaggcaactcatgcatgtaagagcaagtgctgagtgctgagactctttacctgtaagtttgcccttttatttatgaacgatgtcctagagcttaattcaagtgtcctcatgcaccatgctgctttcatgtttagttggtttagcacattctctcgtgcaaacatggga

SEQ ID NO: 2003 - DNA, 2301 bp, Hordeum vulgare
cgacgccttcccttcctgtctgctcccccccacctcactccctctcctctcctcttcccgagaagaagcagcggaccacgcgcaggctcacagatttcgatccgcttccccaagcatcgcccccccacgagctcccggccgagctcgccgccgcgtctcggcgcacggatccggagatccccggccgcggaggccccagatccggtgccgttctgttctggtggggggtggagcggccatctgcttttgctgccgcctgctgcgcgcttgtgaggctctgctccgctctcctgcggccgtaccatgccggcgccggcgtgaggggctcctgggcggacgggcgggcgcaaccaagatgtggaagcagttcctcagcaagctgccgcggaccaagtcctcgggcggcggcggcggcggcgactcgggccagtgcagcggcgggaatggcaacccgatacagcgcaccagcagcgtgccggcgggcgggggcggccgctccgcctccaccatcaagcgcatgtcctccgccgtcttcccctccagcgtcgtggccgggatcgagccgctcgtctccttcaaggacgtgcccagctccgagcgccacaacctcttcgtcagcaagctcggcctctgctgcgccgtcttcgacttctccgacccggccaagagctccgccgagaaggacatcaagcggcagacgctgctggatctcatcgacttcgtcgactccagcagcggccgctacccggaggccgtcattgctgcctgctctaggatgctcgccgtcaacctgttccgggtgttccctccgagctacaggtctggtggtggctcgtccggtggtggaggcggcggcgagggcgacgaggacgagcccatgttcgaccctgcctggtgccacctgcagcttgtgtatgagctgctgctcaagttcatcggatccagctccctggatgccaagatagggaagaagtacttcgaccactccttcattgtcaggctgctcaacctcctcgactcagaggaccccagagagcgagactctctgaaaaccatcctccacaggatctatggcaaattcatggttcaccggccgttcatccgcaaggcggtgagcaacatattctaccactttgtgtttgaaactcagcggcacaacggaatcgcagagctactcgaggtgtttggcagtgtcattagtggctttgcattgcctctcaaggaagaacacaagatctttctctggagagtattgattcctctgcacaagcctaagtcagttggggtgtatctccagcagttgacatactgtgtgacacagtttctagaaaaggaccccaagcttgccggatcgataatcatcggtttgctgagatattggcctgtaacaaatagtcagaaggaagtgatgttcctgagtgagatcgaggagatcctggaggctaccagcatggtggagttccagaaatgtatggttccgttgtttcgacggatagctcattgcatcaacagttcccacttccaggttgctgaaagagcactcttcatgtggaacaatgatcacatcatcagcctggtggcacaaaaccgacaagtgatcatgcccatcatcgttccagcgctagaacagaacgggcagaaccactggaaccacgcggtcctgaacctgaccgccaacgtgatgaagatgttctccgagatggacgaggaactattctcggtgtgcctaacaaagtgcaaggaggacgaagaaaaccaggtgtcgatggaggagaagcggaggctgaagtgggcgaaactagagtccgctgcagccctccagccagtgaccggccacacagccgtcctggtagggtaggtcagccagtcgtcggcgatagtttgatcgccgccaccctcgtttagcgtatgttcgttcggtggaggctcgtgcaaatggtgctcttcccctgttcggtgaagcgcgcctggctgatgatcagatcaactccagggctcgtcgttttgttttccttttgtacgttgtaactattcccactatgtctatgttgtagaggcaaatgtacctgtgagcgagcgccttgtgctgagactcctacctgtaactttgcctgcttattttatgaacattgtcctagagcttaattcaagtgtctagagctatttctctcgagcaaatatgggtcgcggctgtgattccagtgttttgaatttgattgccatgtgggtacctatttctctgtattatcctgacatcctatatgtgagggcattgtaattgaagtgtacaacagacattag

SEQ ID NO: 2004 - DNA, 2367 bp, Hordeum vulgare
gacgccttcccttcctgtctgctcccccccacctcactccctctcctctcctcttcccgagaagaagcagcggaccacgcgcaggctcacagatttcgatccgcttccccaagcatcgccccctcacgagctcccggccgagctcgccgccgcgtctcggcgcacggatccggagacccccggccgcggaggccccagatccggtgccgttctgttctggtggggggtggagcggccatctgcttttgctgccgcctgctgcgcgcttgtgaggctctgctccgctctcctgcggccgtaccatgccggcgccggcgtgaggggctcctgggcggacgggcgggcgcaaccaagatgtggaagcagttcctcagcaagctgccgcggaccaagtcctcgggcggcggcggcggcggcgactcgggccagtgcagcggcgggaatggcaacccgatacagcgcaccagcagcgtgccggcgggcgggggcggccgctccgcctccaccatcaagcgcatgtcctccgccgtcttcccctccagcgtcgtggccgggatcgagccgctcgtctccttcaaggacgtgcccagctccgagcgccacaacctcttcgtcagcaagctcggcctctgctgcgccgtcttcgacttctccgacccggccaagagctccgccgagaaggacatcaagcggcagacgctgctggatctcatcgacttcgtcgactccagcagcggccgctacccggaggccgtcattgccgcctgctctaggatgctcgccgtcaacctgttccgggtgttccctccgagctacaggtctggtggtggctcgtccggtggtggaggcggcggcgagggcgacgaggacgagcccatgttcgaccctgcctggtgccacctgcagcttgtgtatgagctgctgctcaagttcatcggatccaactccctggatgccaagatagggaagaagtacttcgaccactccttcattgtcaggctgctcaacctcctcgactcagaggaccccagagagcgagactctctgaaaaccatcctccacaggatctatggcaaattcatggttcaccggccgttcatccgcaaggcggtgagcaacatattctaccactttgtgtttgaaactcagcggcacaacggaatcgcggagctactcgaggtgtttggcagtgtcattagtggctttgcattgcctctcaaggaagaacacaagatctttctctggagagtattgattcctctgcacaagcctaagtcagttggggtgtatctccagcagttgacatactgtgtgacacagtttctagaaaaggaccccaagcttgccggatcgataatcatcggtttgctgagatattggcctgtaacaaatagtcagaaggaagtgatgttcctgagtgagatcgaggagatcctggaggctaccagcatggtggagttccagaaatgtatggttccgttgtttcgacggatagctcattgcatcaacagttcccacttccaggttgctgaaagagcactcttcatgtggaacaatgatcacatcatcagcctggtggcacaaaaccgacaagtgatcatgcccatcatcgttccagcgctagaacagaacgggcagaaccactggaaccacgcggtcctgaacctgaccgccaacgtgatgaagatgttctccgagatggacgaggaactattctcggtgtgcctaacaaagtgcaaggaggacgaagaaaaccaggtgtcgatggaggagaagcggaggctgaagtgggcgaaactagagtccgctgcagccctccagccagtgaccggccacacagccgtcctggtagggtaggtcagccagtcgtcggcgatagtttgatcgccgccaccctcgtttagcgtatgttcgttcggtggaggctcgtgcaaatggtgctcttcccctgttcggtgaagcgcgcctggctgatgatcagatcaactccagggctcgtcgttttgttttccttttgtacgttgtaactattcccactatgtctatgttgtagaggcaaatgtacctgtgagcgagcgccttgtgctgagactcctacctgtaactttgcctgcttattttatgaacattgtcctagagcttaattcaagtgtctagagctatttctctcgagcaaatatgggtcgcggctgtgattccagtgttttgaatttgattgccatgtgggtacctatttctctgtattatcctgacatcctatatgtgagggcattgtaattgaagtgtacaacagacattagctttggaggcaggaaagttagcattttaagcattccgtatttgaaatgaaaagagtaagtagatggc

SEQ ID NO: 2005 - DNA, 2158 bp, Secale cereale
gactgtctgctactgtaccttcccccacctcactccccctcttccctcctcttcccgagaagaagcacacagatttcgatccgcttccccaagaaaacccacccccacgagctcccgaccgacccagctcgccgccgcgtctcggcgcacggatccggagggcaccggccgcggaggccccagatccggtgctgttctggtggggggtggggtggagcggccatctgcttccgctgccttttgctgcgcgctgtcaggctctgctccgctccgctctgctgcggccgtaccatgccggcgccggcgtgagggcctccacggcggacgggcggacgggaccaagatgtggaagcagttcctcagcaagctgccgcggaccaagtcggcgcgggacggcggcggcggcgactcgggccagggcagcggcggcaatggccacccgatacagcgcaccagcagcgtgccggccgcgggcggggcggggcggccgctccgcctccaccatcaagcgcatgtcgtccgccgtcttcccctccagcgtcgtcgccgggatcgagccgctcgtcgccttcaaggacgtgcccggctccgagcgccacaacctgttcgtcagcaaggtgaacctctgctgcgccgtcttcgacttctccgacccggccaagagctccgccgagaaggacatcaagcggcagacgctgctggatctcatcgacttcgtcgactccaccaccggccgcttcccggaggccgtcattgccgcctgctccaggatgctcgccgtcaacctgttccgggtgttccccccgagctacaggtctgttggtggctcgtcgtccggcggcggcgagggcgacgaggacgagccgatgttcgaccccgcctggtgccatctgcagctcgtgtacgagctgctgctcaagttcatcgggtccaactccctggatgccaagatagggaagaagtacttcgaccactccttcatcgtcaggctgctcaacctcctcgactccgaggaccccagagagcgggactccctgaagaccatcctccacaggatctacggcaaattcatggtgcaccggccgttcatccgcaaggcggtgagcaacatattctaccactttgtgttcgagacccagcgccacaacgggatcgccgagctgctcgaggtcttcggcagcgtcatcagtggctttgcattgcctctcaaggaagaacacaagatatttctctggagggttctcattcctctgcacaagccgaaatcagttggggtgtatctccagcagttgacatactgtgtgacacagtttctagaaaaggaccccaagcttgccggatcgataatcatcggtctgctgagatattggccggtgacaaatagtcagaaggaggtgatgttcctgagtgagattgaggagatcctggaggctaccagcatggtggagttccagaaatgcatggttccgttgtttcggcggatagctcagtgcatcaacagttcacacttccaggttgctgaaagagcactcttcatgtggaacaatgatcacatcatcagcctggtggcacaaaaccgccaagtgatcatgcccatcatcgttccagcgctagaacagaacggccagaaccactggaaccacgcggtcctgaacctgaccgccaacgtgatgaagatgttctctgagatggacgaggaactattctccgcgtgcctaaccaagtgcaaggaggacgagaaaaccaggcgtcgatggaggagaagcggaggctgaagtgggcgaaactagagtccgctgcagccctccagccagtgaccggccacaccgccgtcctggtagggtaggtcgccaaccgtcggcgataatctggtcgccgccaccctcgtttagcatgtgtttggtcggtgttggtgcgtgccaatggtgttcttcccctgttcggtgaagcgtgcccaagtgacgatcaactccagggctcgttgttttgcttttcttctgtaccttgtaactattcccactatgtctgtgctctagaggcaaaatgtagctgtgagagcgagcgccttgtgctgagactcattacctgtaacttttgcctgtttattttatgaacattatcctagagcttaattcaagtgtccagagccatttctctc

SEQ ID NO: 2006 - DNA, 1557 bp, Avena sativa
aagatgtggaagcagttcctcggcaagctgccccgcaccaagtcctcgggcgccggccgggacggcttcgacgcgggccagtgcagcagcaacagcaccaactgggagtacagcgcgccaccacgcctcccgtccggcggcggcagcgccggcggccggtccgcgtccgccatcaagcgcatgtcctcggcggtcttcccttccagcgtcgtcgccggcatcgagccgctcgtcgccttcaaggacgtgcccggctccgagcggcacaacctcttcgtcagcaagctcggcctctgctgcgccgtcttcgacttctccgacccggccaagtccgcagccgagaaggacatcaagaggcaggcgctgctggatctcgtagacttcgtcgacaccaacaccagccgcttctccgagcccgtcatcgccgcatgctccaggatgttcgccgtcaacctcttccgggtattccctcccaactacaggtccggttcttcctcttctggcagcggcgagggtgacgaggatgagcctatgttcgatcctgcctggtaccacctgcagctcgtatacgagctgctgctcaagttcatcggatccacctcgctggatgccaaggtcgggaagaagtacttcgaccactccttcatcgtcaggctgctcaacctgctcgactccgaggatcccagagaaagagactccctgaaaactatcctgcacaggatctacgggaaattcatggtccaccgaccgttcatccggaaagccgtgagcaacatattctaccacttcgtgttcgagacgcagcggcataacgggatcgctgagttgctggaggtctttggcagcgtcattagtggctttgctctgccactcaaggaagaacacaagatcttcctttggagagttctgatccctctgcacaagcctaaatcagtcggtgtgtatctccagcagctgacctactgcgtgacacagtttctagacaaggatcccaagcttgcgggctcgataattatcggtttgctaagatattggcctataacaaatagtcagaaggaagtgatgtttctgagcgagatcgaagagatcctcgaagctaccagcgcggtggagttccagaaatgcatggttcctttgttccggcggatcgctcattgcataaacagttctcacttccaggttgctgaaagagcactcttcatgtggaacaatgatcacatcatcagcctgatagcacagaaccgccaagtgatcatgcccatcattgtcccagcgttagagcagaacagtcagacccactggaaccaagcggtcctgaacctgaccgccaacgtgatgaagatgttctccgaggtggacgaggagctgttctcggcgtgcctgaccaagtgcaaggaggacgaagagaaccaggcgtcgttagaagagaagcggaggttgacgtgggcgagactagagtcggctgcggccctccagccagtgaccggccacacagccgtcctggtcggtcgccaaccgtcggcgaatctgatcgccacacttatttagcatgtacgt

SEQ ID NO: 2007 - DNA, 1764 bp, Zea mays
gctgcctgctcacacttcgccactactgctgctgcgcgttggcgagcgcgcgtggttcacgagcgagctccaccacaagcccagtcgcgcacggcagccgttttgcttgttttgtttgctttccgcctcttccgtgcttcctcttttgggcggcctggctgggctagctagctgttctgttcattccgagttcccggcatagaacacgaggttggagttagaggcttaccgagggagcagacagcagaggtcactagcgatttcacagtcacgcacctgcatttcttcttttttttcttcttcttttctttagcaagctctctttcttttcttgctcttgttttgtttgtcctccctgtaataactcttgcctgccttcccctaccctggtctctttccttcttcctgcactgcaggacactataagagtagctagccctacccaatatcttcagccgtgcttgccaacttggagagagagagagagagagagagagagagagagagagagagagagagagagagagagagagagagagagagagagagagagagagagagagagagaagagaagagaagagaagagaagggagtgagtgatcgcaggaaggaggatcggagtgatgggagacgcagcagagaccaacaagactcttcacaactggatgggcgagccgaggccgaggtcgagcgaccagcgcgacgaggaggagacgcttcagctcagcctcggcctccccggaggaggagcaagtgcgggtggtggggtagcacccgccgcctggagaatgctgccggccagagacgaggagatgcgctctgctgctgctgtcgtcgacacctccctgctctctctcggctactccgccccagctttctcgccccgctcaccaggcaaggcaaaggggtccccagcagcagctacagagaatgcccttgcatccaccaacaacgcctcccagagaagatctccaaataccccggttattgggtggcctccagttcgtgccttcagaagaaatctggccacctctagcagagcatcccttgaacatcagaatgggaagaaggcagccaaacctgaacagaccacaaaaagagctccatttgtaaagatcaacatggacggcatccctattggtagaaaaatcgatctgagtgccctcggtagttacgatgagctgtctctgtctgtcgacaagctattccgggggcttcttgcagcacaacaagaccctctggctgccggcgcaaaggagtgttcacaggaagaggtggcgatatcgggtttactagatggaactggggagtacactctggtttatgaggattatgaaggcgatagggtgctggttggcgatgtcccctgggggatgtttgtttcttcggtgaagaggctgcgcgttctgaagacatctgacctctcttcatctctaacagcacctcctggccagaagaggacggtaactgagtgtccagtgtttacctcttagacacttccttgcagtgatgttggtgtgctgtgaagaagaaaacgtcttctgagcttgtatcatctttcttcgtggtttcttcctcttcttttccctactttctcttggaagggatcatcaaagaaccgaaccgaccttttgggttttcctgctcttgtttattttgtttctctttccgggaagcgatgtgaccttttgggttgtatgtaaatgttcagacgaaccagctctatgtttatgcagcctatcctgtctgttgccttttacaca

SEQ ID NO: 2008 - DNA, 2155 bp, Triticum aestivum
ggtggaggggaggttcgtggtggagaagaacagcctgcgggtgacgtcgccggcggcgctgcggggcgtgtacgagtgcgccatcggcaacttcgggatgccgcagtacgggggcaccatgcacggcgtcgtcgtctaccccaaggccaacaccaaggcctgcaagcccttcgccgacttcggcctctccttcaaccccaaggccggcggcctccccgtcttcctcctcgtcgaccgcggagactgctacttcacaaccaaggggtggaacgcgcagacggcgggagcggcggcggtgctcgtcgccgacgacagggcagagcccctcatcacaatggacaccccagagtccagcggcaaggagcacctggagaacatcaccgtgccctcagccctggtctccaagcgcttcggcgacgacctgaagaccgccctcgagaacggcgacatggtgaacgtgctcctggactggcgggaatccctcccgcacccggacgagcgcgtggagtacgagttctggaccaacagcaacgacgagtgcggcgcgaaatgcgacatgcagatgagcttcgtccgggacttccggggcgtggcgcaggtgctggagcagcgcggctacacccagttcgcgccgcactacatcacctggtactgcccggaggccttcgtcctgagcgcgcagtgcaggtcgcagtgcatcaaccacggccgctactgcgcccccgacccggagcaggacttcaccaccgggtatgatgggaaggacgtcgtggtgcagaacttgatccagatctgcctcttcaaggtcgccaacgagagccgcaagccgtggctgtggtgggactatgtgcacgacttcgccatccggtgccccatgaaggagaagaagtacaccaccgattgcgctcatggtgtcatcaagtcccttggaatggacattgacaagattacccagtgcgtcggagaccccgacgccgatgaggacaacccggtgctcaaggcggagcaagatgctcaaattggtcatggtgctcgaggggatgttaccatactgccgactttcgtcgtcaacaacagacagtacagagggaaactggataaaagggctgtgctccgagcgatatgttcgggattcgaggagacgaccgaacccgatatctgtttgactcaagatatacaaacaaaccagtgcttggaaaacaatggaggttgctggctggacaaaaatactaatttcactgcatgcaaggataccttccgtgggcgggtttgcgagtgcccggttgtcaatggcgtcaagttcgttggcgacgggtacacccactgtgaagcttctggtgttggtcgatgccaaatcaacaacggaggctgctggaaggagaccaggaacggcaagtctgtctccgcgtgctcgaatgagcaagctaagggctgcaaatgtccgcaaggcttcaagggtgatggcatacacggttgcgaagatgttgatgagtgcaaagagaggctcttctgccagtgcaaggactgcagctgcgagaacacatggggaagctacgagtgtggctgcggtggtagcaacatgctgtacatgagagagcatgacacttgcatcagcaaggtcgcgacttcgtcggtgggctgggggttcatgtgggtcatcttcttcggcctcggcttcgccggagtgggagcatacgccgtctacaaatatcggctacggagctacatggattcagagatccgcgcgatcatggcgcagtacatgccgctggagaaccaggagacgtcgagccaccaacggcacgtggaccacgccgacatctgaagcaccaaggagttctaagtacatacggatcatcaagcataagagctagtctcaccgcgtccgtggcgcatcggagtggccgggtttggagctgcaattttgaattcagaaaagattggccggttagctagcttatgattctgaaagacaaacgtactctctcttttctctctttctgaaacttcaaggacaggtttaggatcgatctcaccggagttttagccctcatttagtcataattgtgatgctcgaggtctcgttcagcgtgatgacattgtgtaaataccgttgttcgttcggactgaatcgtgttgggtgcgtttaataaag

SEQ ID NO: 2009 - DNA, 2578 bp, Brachypodium distachyon
cggggagaccgccacgtacttctcctccgcctctctacaatctctctctctcactcgcacacaacaccattaagcacctcgtctcccaaatccacccataatccttgctacacaagtgatcgatcgccttttccgcgcaattcccccccaaatcaatcccacgccgatccatcagcactcgggccacccggctggggttctcttctcgctgttcttcattgttgggagtgcagggatcgatcgggcggcgggctgagatcagatgggaggcggtcggaggttttcgccgccgccgccggcggtgggatggcggcagcggaacagggcgccagcggtggttctgatcgtggcgttggtgatgatggcggagccggcggcggcgaggttcgtggtggagaagaacagcctgcgggtgacctcgcccgcggcgctgcggggcgtatacgagtgcgccatcggcaacttcgggatgccgcagtacgggggcaccatgcacggggtggtcgtctacccaaaggccaacgccaaggcctgcgccgacttccgcgactccgccggcctcaacttcagccccaagcccggcggcctccccgtcttcctcctcgtcgatcgcggagagtgctacttcacaactaaaggatggaacgcgcaaactgctggagctgctgcggttcttgtagccgatgacagagtggaacccttgatcacaatggacactccagagtctagtggcaaagagcacctagagaacatcagtgtcccttcagcactagtatccaagagactaggggacgatcttaagaacgcactgcaaaacggggatatggtaaatgtgcttctggactggagggagtctctcccgcacccggacgagcgtgtcgagtacgaattctggacgaacagcaatgacgaatgtggtgccaaatgtgacatgcagatgaatttcgtaaggagtttcagagggatagcgcaggttcttgagcaaaggggttacacccagtttgcacctcattatattacgtggtactgtccggaagctttcatcctcagcaagcagtgcaggtcgcagtgcataaatcatgggaggtactgcgccccagatccagagcaggacttcagcattggatatgatggaagagatgtggtggttcagaacctgattcagatttgcttgttcaaggtcgctaacgaaacccgcaaaccgtggttgtggtgggattatgtgcatgactttgcgatcaggtgcccgatgaaggataagaaatacacgcgtgattgcgctaatggtgttattaagtcacttggattagacattgacaagattaataaatgtgtgggagaccctgaagccgatgaagagaatccagtgctcaaagcagaacaagatgctcaaattggtcatggttctcgaggggatgttactatactaccgacttttgtcgtcaataacagacaatatagaggaaagctggataaaagagccgtgctaagagcaatatgctcgggatttgaggagacaaccgaacctgatatttgtttggctcaagatatacaaacaaatcaatgtttggaacacaacggaggttgctggctggatagttccaataattttactgcatgcaaggataccttccgtgggagagtttgtgaatgccctgttgtcaatggtgtaaagtttgttggtgacgggtacacccactgtgaagcttctggtgttggcagatgccaaatcaacaacggaggctgctggaaggaaaccaggaacgggaagtctgtctctgcctgctcaaatgaagagactaaaggttgcaaatgcccaccgggtttcaagggtgatggaatacacagttgtgaagatgttgatgaatgcaaagagaaacttttctgccagtgcaagggctgcaactgtgagaacacatggggaagctacgagtgtggctgtggtggtaacaatatgttatacatgagagagcatgacacctgtatcagcaaagttgccagttcgtcggtgggccagggcttcctctgggttatcttcttcggcctcgctttcgcaggagttggcgcatatgctgtttacaagtatcggctacggagttacatggattcagagatccgcgccatcatggcccagtacatgccactggagaaccacgagatgtcgtcgattccgcaacggcccgtggagcacgccgatatctgaaacatcaagggtttatccagatcaagattcaagcaaagaacttcactagcccttcgtgagcagaaggagatggattgattccccatttagcttagtatgattctgaaagataaaatagctgcacaccctctcttttttctcttctcttctgaaacttgcagaagaacaggttaggatctcaccgaagttataactagccctcctccttggcccttagagtagtagtcataaattttgagctcgtggtctccgttcagtatcctataacccgccatgtgttagtaacaatttgtaaataccgttgttgtttcagactgaaccatgtttactgtcgttgatagcaataaaagagagaccagaagagcgtttttagcc

SEQ ID NO: 2010 - DNA, 2307 bp, Secale cereale
gagatcatcgatccgcccgcccatcgatcctcctccgcgcgcggctcgtgttccatcgtcgtcgtgcggcatctgggccagggaagggatcgggtcaccgagcgaggtgatcgagatgggagggagatcgtcgccgtcggcggggtggcggccgcggctgcttctacttcttctcgtgtcggcggtggcgatggtggtggaggggaggttcgtggtggagaagaacagcctgcgggtgacgtcgccggcggcgctgcggggcgtgtacgagtgcgccatcggcaacttcgggatgccgcatacggggcaccactgcacggcgtcgtcgtctaccccaaggccaacgccaaggcctgcaaccccttcgccgacttcggcctctccttcaaccccaaggccggcggcctccccgtcttcctcctcgtcgaccgcggagactgctacttcacaaccaagggatggaacgcgcagacggcgggagcggcggcggtgctcgtcgccgacgaccgagcagagccgctgatcacaatggacaccccagagtcgagcggcaaggagcacctggagaacatcacggtgccctccgccctggtctccaagcgcttcggcgacgacctcaaggccgccctcgagaacggcgacatggtgaacgtgctcctggactggcgggagtccctccctcacccggacgagcgggtggagtacgagttctggaccaacagcaacgacgagtgcggcgccaagtgcgacatgcagatggacttcgtccgggacttccggggcgtggcgcaggtgctggagcagcgcggctacacccagttcgcgccccactacatcacctggtactgcccggaggccttcgtcctgagcgcgcagtgccggtcgcagtgcatcaaccacggccgctactgcgcccccgacccggagcaggacttcaccaccgggtacgacggcaaggacgtcgtggtgcagaacctgatccagatctgcctcttcaaggtggccaacgagagccgcaagccctggctgtggtgggactatgtgcacgacttcgccatccggtgccccatgaaggagaagaagtacaccaccgattgcgctcatggtgtcatcaagtcgcttgggatggacattgacaagattaccaagtgcgtcggagaccccgacgccgatgaggacaacccggtgctcaaagcagagcaagatgctcaaattggtcatggtgctcgaggggatgttaccatactgccgactttcgtcgtcaataacagacagtacagagggaaactggataaaagggaggtgctacgagcgatatgttcgggatttgaggagacgacagaacccgatatctgtttgactcaagatatacaaacaaaccagtgcttggaaaacaatggaggttgctggctggacaaaaataccaattttactgcgtgcaaggataccttccgcgggcgggtttgcgagtgcccggttgtcaacggcgtcaagttcgttggcgatgggtacacccactgcgaagcttctggtgttggtcgatgccaaatcaacaacggaggctgctggaaggagaccaggaacggcaagtcggtctcggcctgctcgaatgaacaagctaagggctgcaaatgtccacaaggattcaagggtgacggcatacacggttgcgaagatgttgatgaatgcaaagagaggctcttctgccagtgcaaggactgcagctgcgagaacacatggggaagctacgagtgtggctgcggtggtagcaacatgctgtacatgagagagcatgacacttgcatcagcaaggtcgcgacatcgtcggtgggctgggggttcatgtgggtcatcttcttcggcctcggtttcgcgggcgttggagcatacgccgtctacaagtatcggctacggagctacatggattcggagatccgcgcgatcatggcgcagtacatgccgctggagaaccaggagacgtcgagccaccaacggcatgtggagcacgccgacatctgaagcagcaaggagtcttacatacggatcatcaagcataagagctgccgtagtttctctggtcgcgtccgtggttggtagtatcgtcagagcagtcgggctcggaggagctgcagtttttgggttcagaagattggttcttggatagcttatgattctgaaagacaacatactcttttttttctctctttgtgatgaaactttgaggactaggtttaggatgggatctcaccgcagtttagccctcaacttagtctaaattcgatgctcgtggtctcgttcagcttgata

SEQ ID NO: 2011 - DNA, 2908 bp, Oryza sativa
attttttaaaaagtcaatggcgtcaaatattttggatggagggagtacatctctatctccggatctcatctcactccgctagctttagcaatcctagcaaattagcaatagcgataccgatagctcccggtcaaatccttcgtagggcaggcttcctttattgcactcctgctcccgcgaaagcctcgcctcgccttttctccctaccaagccaccacgccacccaaaccgcgatttctgatcgatcgatcgttagctcgatccaagaacccatcttttctttgatccccaatcctcttttgccgaggattaattgggagaagatgacgatgatggggtgtgccgtgctgctcgtggtggtggcgtccatggcgggggaggcggcggggaggttcgtggtggagaagaacagcctgcgggtgacgtcgccggcggggctccggggcgtctacgagtgcgccatcggcaacttcgggatgccgcagtacgggggcaccatgcacggggtcgtcgtctaccccaaggccaacaagaaggcctgcaggtccttcgacgacttcgacctctccttcaagcccaagcccggcggcctccccatcttcctcctcgtcgatcgcggagactgctacttcacaacaaagggatggaatgctcaaaccgctggagctgcagctgttcttgttgccgatgatagattggagcctttgataacaatggactctccagagtctagtggcacagattacatagagaaaattactgttccttcagcacttgtaacgaagaagtttggggacgaccttaagaaagcactggaaaacggtgatatggtcaatgtccttctggattggagggaatctctccctcatcctgatgagcgtgtagagtatgaattctggacaaacagcaacgatgaatgtggtgccaaatgtgacatgcaaatgaattttgtgaggaacttcagaggaacagcacaggttcttgagaaaaggggttacactcagttcacccctcactacattacatggtattgtccggaagcttttgtcctgagcaagcagtgcagatctcagtgtatcaatcatgggagatactgcgctccagatccagagcaggatttcaacattggatatgatggaaaagatgttgtgcttcagaacctgattcagatttgcttgttcaaggttggcaatgaaactcacaaaccatgggtgtggtgggattatgtacacgatttttcaattaggtgcccaatgaaggagaagaaatacacgcgtgaatgcgctaatggtgttatcaagtcacttggattggaccttgagaggatcaacaagtgtgtgggagaccctgaagctgatgaagaaaatcccgtgcttaaagcggaacaagatgctcaaattggtcaaggctctcgaggagatgtcactatattgccgacccttgtcgttaacaacaagcagtacagaggtaagctggagaaaagtgctgtgttaaaagcagtatgctcaggatttgaggagacaactgaacctgatgtttgtttgagtcaagagatccaaacaaatgaatgtttggagagcaatggagggtgctggcaggacaagactaataattttactgcgtgcaaggacaccttccgtgggcgagtttgtgaatgccctattgcccgtggtgtgaagttcgttggtgacgggtacactcactgtgaagcttctggtgtcggtaggtgccaaatcaacaacggaggctgctggaaggaaactaaaaatgggaagacggtttctgcctgctcaaatgaagaatctaaaggctgcaaatgcccaccaggtttcaagggtgatggtataaaaagttgtgaagatattgatgaatgcaaagacaagcttttctgccagtgcaaggactgctcttgtgagaatacatggggaagctatgagtgcagctgtggtggaagtaatatgttatacatgagagagcatgacacttgcatcagcaaagttgcttcttcgtcagtgggctggggcttcctttgggttattttctttggcctcgctttggctggaattggagcatatgccgtatacaaatatcggctacggagttacatggattcagagattcgtgcgatcatggctcagtacatgcccctggagaatcaagaaacaccgaatcaacatcgtcctgtggagcatgctgatatctgaaattgcagcaagcttaactgggagctggcagcagtatcggtggtcgccatcttgacagagtggtaggcttggagctaccctttgtgcccagaagataaaaaaaaattcagtatagcttatgtttctgaaacgacaagatttttgcatatcctctttttctctttgctgaaacttgcaggacagattaggatctccccagaattaacacctcattggcctctagtcataattatgagcttctggtcttgttcttactctactcctacatgtttttttgtttttcagcgagatactcctatatgttaaaagcttgtaaatactgttgttcagacaatagtccttaataaagagaccggaagagcattctacacctaaacaagatttgagttgaggattccacgagcatagcaatgttcacttctgttgatgaggctttgtaagcatatgtatgttccttcttgctggggattgtactccatccgtttcacattttcaaataaccgactattttgcctttaacattgcactacaaaattgttagactaaattgagttaaagtttcatgtttatattaggacataatatgtttaaataatgtggaatccttttgtctttgtaaatattttgtaaaaaagacgagcgaacaaagtttaaaagtgaatagtatccacgacaggctttctgagttcatcgatcaggccacc

SEQ ID NO: 2012 - DNA, 2451 bp, Setaria italica
ggaaagggtgctggtgctccgatcctcatcgtctccatcgcagctccctcccagaacccattattccatcgtacatctctcttgttcatctcgacttcttgctctcgatccggaaggattattgatcgatcggccggccggaaagcaatgtccgtgtcgatggggacgaggctgcggccgccggcgtggtggtgccgcgcgctgctggcgctggcgatcgcggcgggcctgatggcggtggacccggcggcggcgcgcttcgtcgtggagaagaacagcctgcgggtcacctcccccgccgcgctccggggcgtctacgagtgcgccatcggcaacttcggcatgccgcagtacgggggcaccatgcacggcgtcgtcgtctaccccaaggccaacggcaaggcctgcaagcccttcgcagacttcggcctctccttcaagcccaagcccggcggcctacccgtcttcctgctcgtcgatcgcggagactgctactttacaaccaagggatggaatgcacaaaattctggagctgcagcagttcttgttgcagatgacaaagtagagcctttgatcacaatggactctccagaatctagtggtacagagcacatggagaacatcactattccttcagcacttgtgacaaagagatttggtgatgacctcaggaaagctctgcaaaatggagatatggttaatgtccttctggactggagggaatccctgccccatcctgatgagcgtgtggagtatgaactctggacaaacagcaatgatgaatgcggtgctaaatgtgacatgcaaatgaacttcgtgaggagcttcagaggaatagcacaagcccttgagaaaaggggctacacccagttcactcctcactatattacatggtattgtccagaagcttttgtcctgagcaaacagtgcaaatcgcaatgtatcaatcatgggagatactgcgcaccagatccagagcaggatttcagcattggatatgacggcaaagatgttgtgcttcagaacctgattcaaatttgtgtgttcaaagttgccaatgaaagtcgcaagccctggatgtggtgggattatgtgcacgactttgctgttaggtgcccaatgaaggagaagaaatacacacgtgaatgtgctaacggtgttatcaaatcacttggattggaaattgagaaaatcaacaagtgcattggagatcctgaagccgataaagaaaattcagtccttaaagcagaacaggatgctcaaattggtcatggttctcgtggcgatgtcactatactgcctactcttgtcgtcaatagcagacaatacagaggtaaactggaaaaaagttctgtgctaaaagcagtatgctcgggatttgaggagacaactgaacctgatatctgcttgcgcgaagatattgagacaaatgaatgtttggagcacaatggaggttgctggttagacaaggctaccaatgtttctgcgtgcaaggatacgttccgcggtcgtgtttgtgaatgccctagtgtcaatggcgtaaagtttgttggtgatgggtacacacactgtgaagcttctggcctcggtaggtgccaaatcaacaatgggggctgctggaaggagactaggaatgggaagactgtctcagcctgctcaaatgaagaagctaaaggctgcaaatgcccaacaggtttcaagggtgatggagtgaacagttgcgaagatgtcgacgaatgcaaagagaacctttactgcaagtgcaaaaattgcgcctgtgagaatatatggggaagctacgagtgcagctgtggcggcagcaatatgctgtacatcagagaacatgatacgtgtatcagcaaacattctacctcgacaattggctggggcttcctatgggttattttctttggcctggccttggctggagcaggagcatatgccgtgtacaaatataggctacggagctacatggattcagagattcgcgcgatcatggctcagtacatgcccctggagagccatgaaatgccgagtcaacagcgcccggtcgagcacgcagacatctgaaacagcaaaccttaaaatgaagcaagcgtaagagctaggaaatcgcgtcggtggcagtcgcagagaagtcggctcggagctgccctttgtgtgcagaatattgatcctccatacagcctacgattggttctgaaggacagagtatcgatggatagactgttttactccccctttatttatttttttcttttcagaagattacagggcagattaggttgtgtcactgcagtttagaattcattggtagtcatctctcgattttatggtcgtgttctgcattccacagtaaatgttgccattctgtaaatactgtcgttcagacttgggacataatatagtagtgttttgattgcctgaataaaaaggcccggatctgtttcc

SEQ ID NO: 2013 - DNA, 2942 bp, Panicum virgatum
caggtggctgcgtgttgcctgcgttgctggttaccggcgagcggcggcatccaaagcatcaagtgtacagtacagtcgagctcggggcaactcgatgctgacggtcgtgatgtcgattggcggttgaccccgaggagcgctccaagcgggggaacgtaaaggcgcccggtccccgaaaccccacgcaagtggcgtcctatctatcctcgccttcgccgcggtcaccgtcttgcttccccggatcaacaccaggcaggcaggaggcctctgcactctgcagctgggctgccttcctgcattggaagcgttccaacccctacggcttttggcgccacgtctcccccctcgacgcgacctctagatccgtcgatctcactgcaccattcccgatcgccactgctccggccggtcaaaaatcaaactccctcctccttggtgcacggggcaggttccttcgttcgtcgttgcattgcgccccggggcccgggctccctcccgcaaaagcctcgcatcgccttttcttgtcctcaagccacccaaatcgcacggaaagggtgcgcccgcccctcatcggatccatcgcgctcttcatctcgctcgcgcagaacccatttgatcttctccctccttcagatcatctcaacttcttggcccatcgatcggcaatggggacgtggctgcggccgccggcctggtgctgcgcgctgctggcgctggcgctcctgctgggggaccccgcggcggcgcggttcgtcgtcgagaagaacagcctgcgggtcacctcccccgccgcgctccggggcgtctacgagtgcgccatcggcaacttcggcatgccgcagtacgggggcaccatgcacggcgtcgtcgtctacccaaaggccaacgccaaggcctgcaagcccttcgccgacttcgacctctccttcaaccccaagtccggcggcctgcccgtcttcctgctcgtcgatcgcggagattgctacttcacaaccaagggatggaatgcacaaaatgctggagctgcaacagttcttgttgctgacgataaagtggagcctttgatcacaatggactctccggaatctagtggtacagagcacatggagaacatcactattccttcagcacttgtgacaaagagatttggcgatgacctcaggaaagcgctgcaaaatggagatatggttaatgtccttctggactggagagaatccttgccccatcccgatgaacgtgtggagtatgaattgtggacaaacagcaatgatgaatgtggtgctaaatgtgacatgcaaatgaacttcgtaaggagtttcagaggaatagctcaagcccttgagaagagaggctacacccagttcacccctcattatattacatggtattgtccagaagcttttgtcctgagcaaacagtgcaaatcgcagtgtatcaaccatgggagatactgtgcaccagatccagagcaggatttcagcattggatatgacggcaaagatgttgtgcttcagaacctgattcaaatttgtgtgttcaaagttgccaatgaaagtcgcaagccgtggatgtggtgggattatgtgcacgactttgctgttaggtgcccaatgaaggataagaaatacacacgtgaatgtgctaatgatgttatcaagtcacttggattggaatttgagaaaatcaacaagtgtattggagatcctgaagccgacaaagaaaatccagtccttaaagcagaacaggatgctcaaattggtcatggttctcgcggcgatgtcactatactgcctacccttgtcgttaataatagacaatacagaggtaagctggaaaaaagttctgtgctaaaagcagtatgctcggggtttgaggagacaactgaacctgatatctgtttgcgcgaagatattgagacaaatgaatgtttggagcacaatggaggttgctggttagacaaggctaccaatgtttctgcatgcaaggataccttccgtggtcgtgtttgcgaatgccctgttgtcaatggcgtaaagtttgttggtgatgggtacacccactgtgaagcttccggccttggtaggtgccaaatcaataatgggggctgctggaaggagactaggaacggaaagactgtctcagcctgctcaaatgaagaagctaaaggctgcaaatgtccaacaggtttcaagggtgatggagtgaacagttgcgaagatgtcgatgaatgcaaggagaaccttttctgcaagtgcaagaattgcgcttgtgagaatacatggggaagctacgagtgcagctgtggcggcagcaatatgctgtacatcagagaacatgatacttgtatcagcaaacattctacctcgtcaataggctggggcttcctatgggttattttctttggtcttgccttggctggagcaggagcgtatgccgtgtacaaatataggctacggagctacatggattcggagatccgcgcgatcatggctcagtacatgcccctggagagccaagaaatgccgaaccaacaccgcccagtggagcacgcagacatctgaaacagcagagcttatatgaaggaagcataagggctaacaacatcgcatgggtggtggtcgtccacctctacagagaagtcggctcggagctgccctttctgtgcaggatattgattgattctccatatagcctgtgattctggaaggcagaacgctttgtttttttttcccctcctgaagattacagttaaggagcagattaggttctctcactgcagtttagaattaattcattgctagtcgcctctcttttgcattccacagtaaatgttgccattctgtaaatactatcattcagacttgggacatataaacagtagtgtgtttgtttgatcgcctgaataaaagtaaaagacccagaaatagcacatgatccttcta

SEQ ID NO: 2014 - DNA, 2554 bp, Sorghum bicolor
gccttttcttgtcctgaagccacccaagccgcacggaaagggtgcctgcctgcccctcgctcggctcccagaacccatcccatctccggccgcccacttcttggcagctcgatccgatcatcggatcggccgtccggcgggaacgaaccaacaaagctaggttcggatcgtgtcgatcgtgtgtccatggagacgacgacggcggccaggcggcggcggcggctgctgctgctcctggtcctgctggcgctcgcggcgcaccgtgcggcggcgcggttcgtggtggagaagaacagcctgcgggtcacgtccccggccgcgctccggggcgtctacgagtgcgccatcggcaacttcggcatgccgcagtacggcggcaccatgcacggcgtcgtcgtctaccccaaggtcgatgccaaggcctgcaggcccttcgacgcctccggcctctccttcaagcccaagtccggcggtctgcccgtctttctactcgtcgatcgcggagactgctacttcacaaccaagggatggaatgcacaaaatgctggagctgcagcagttcttgttgccgacgacaaagtcgagcctttgatcacaatggattctccagaatccagtggcacagagcacattgagaacatcacaattccttcggcacttgtgaccaagagatttggagacgacctcaggaaagcactgcaaaatggagaaatggtgaatgttcttctggactggagggaatctctgccccatcctgatgagcgtgtggagtatgagttctggacaaacagcaatgatgaatgcggtgctaaatgtgacatgcaaatgaacttcgtgaggagcttcagaggaatagctcaggcccttgagaaaaggggttacacccagttcacccctcactatatcacatggtattgtccagaagcttttatcctgagcaaacagtgcaagtcacaatgtatcaatcatggcagatattgcgcaccagatccagagcaggatttcagcattggatatgacggcaaagatgttgtggttcagaacctgattcaaatttgcgtgttcagagttgccaatgaaactcgcaggccgtggatgtggtgggattatgtgcacgactttgctgttaggtgcccaatgaaggagaagaaatacacacgtgaatgtgcacatggtgttatcaattcacttggattggacattgagaaaatcaacaagtgtgttggagatcctgacgccgataaagaaaatccagtcctcaaagcagaacaggatgctcaaattgggcatggttctcgcggcgatgtaactatactgccaactcttgtcgtcaataacagacaatacagaggcaaactggaaaaaagatctgtgctgaaagcagtatgctcgggatttgaggagacaaccgaacctgatgtctgtttgcgcgaagatattgagacaaatgaatgtttggagaacaatggaggttgctggttagacaaggctaccaatgtttctgcgtgcaaggataccttccgtggtcgtgtttgtgaatgccctactgtcaatggtgtaaagtttataggtgatgggtacagccactgtgaagcttctggtctcggtaggtgccagatcaacaatgggggctgctggaacgagactaggaacgggaagactgtctctgcctgctcaaatcaagaagctaaaggctgcaaatgcccatcaggtttcaggggtgacggaatgaacagttgcgaagatgtcgatgaatgcaaagagaagcttttctgccagtgcaaggattgcgcttgtgagaacacatggggaagctacgagtgcagctgcggtggcagcaattcgctatacatcagagagcatgatacctgtatcagcaaacagtctagttcgtccctgggctggggcttcctatgggtgattttcatcggccttgccttggctggagcaggagcatacgccgtgtacaaatacaggctacggagctacatggattcagagatccgtgcgatcatggcccagtacatgcccctggagagccaagagatgccgaaccaacatcgctctgtcgtccccgtcgaccacgcagacatctgaaacggcatggcttacatggatcgagcataaagagtcagtatcattgcatatttgcattgcatcggtggcagtcctctacgtcgacagagaagtcggctgcctcgagagaattggatgctgatacgattctgaaggacaggagtattggacggtagactgtttcatcacagcacaccctgtttcttgttttgttttgtttttttttatctttttcctccctgaaagtcagagcagattagggtctctcaccgcagtttagagccggttgagttctctctttctctagtcacttttagagcctgcagtcgtgccgtgcgtcgctgcgtagtaacacagtaattaatcgttgagcgttctgtaaatattgttgttgagactgaacactgaagtgcgttggtgttgctgccctgaataaaaggagcgcagaaagagcatgagcctgctaatatttttttgc

SEQ ID NO: 2015 - DNA, 1490 bp, Secale cereale
gacttgatctcccttgcctcttcgctcactcccgtgcatcacgacatcctagccatgaagccaagcgccgccatcctcctcgccgccgtcgtggcgctgctcttggtcgccgccgtgcggggcgatgacgactgtggttcgccggagtcggcggcgcaggaccgcgcgcgggcgaaccctctcaaaatcgcggccttcttctccatcctggtctgcggggcgctgggctgctccctgcccgtgctggggcggcgggtgcccgcgctccggcccgagggcgacgtcttcttcctggtcaaggcgttcgcggcgggggtcatcctggcgacggggttcatccacatccttcccgacgcgttcgagaacctcacgtcggactgcctgccctccgacgggccgtggaaggacttcccgttcgccgggttaggagccatggtcggcgccatcggcacgctcgtcgtcgacaccgtcgccacgggctacttcacgcgcgcccacctgaacaaggacggaggccacggggcgataagcagcagcgccgccgtcgtggacgaggagaaacaggccgctgccgccgccagcgaggaagcgcgccgtcgcgacggcggggagcaggacgtacacgtacacacgcacgcgacccacggccacgcccacgggtcggcggcccttgttgcggccgttggcggcgccgaggacgaaaaggacacgatccggcatcgcgtaatctctcaggtactcgagttgggcattgtggtgcactcggtgatcatcggcatctcccttggcgcctctcaggacccagatacaatcaaacctctcgtggtcgccttgagcttccaccagatgttcgagggaatgggccttggtggctgcatagttcaggcaaagttcaaggctaggtccatcgtcaccatgatcctcttcttctgcctgacaacgccggtgggcatcgccatcggctatggcatatcgcgagtgtacaacgagaacagcccgacggcgctggtggtggagggcagcctcaactccgtggcagcggggatcctcatctacatggccctcgtcgacctcctcgccgaggacttcatgaaccccaaggtgcagagcagggggaagctgcagctcggcatcaacgtctccatgctggttggtgcgggcctcatgtccatgctcgccaaatgggcctagccggaagcctataacatgaaacagttttgttccatgacataaagagtcgaggatgtacgtagctatatttgatcgtcgaggttgaaacgacataatcttcgtgcatatgctttatctcccaaactaggtaatggcaaccgtagcgtaggcatctaaagaaaagcaatagtgtaggttttgcaccgagagtttggaaggtgtggaaagcgtgagtgctgctcacaaggaatgtcgacattatctcgtcaactttgacagggctttcaaattaaagtattgaaaagaaattcttcatataa

SEQ ID NO: 2016 - DNA, 1461 bp, Secale cereale
ccaacccaactacgacgtagacaatacaacgacagtactagccatgaagccgagcgccgctgtcctcctggccgccatcgtggcgctgctcttggtctccgccgtgcggggcggcgatgaccactgcgggtcgccggagtcggcggcgcaggaccgcgcgcgggcgaaccctctcaaaatcacggccttcttctccatcctggtctgcggggcgctgggctgctctctgcccgtgctggggcggcgggtgcccgcgctccggcccgagggcgacgtcttcttcctggtcaaggctttcgcggcgggggtcatcctcgcgacggggttcatccacatcctccctgacgcgtttgagaacctcaagtcaccctgcctgaagccttccgacgggccgtggcaggacttcccgttcgccgggttaggagccatggttggcgccatcggcacgctcgtcgtcgacaccgtcgccacggggtacttcacgcgcgcccacttgaacaaggacgaggccaacggggcgataagtagcaactccgccgtcgtggacgaggagaaacgggctgctgccgaggaagcgcgccatcacgacggcgaggagctcgaggtacacgtgcacacgcacgcgacccacggacacgcccacgggtcggcggcgctcgtggcggccgttggcggggcagaggacgaaaaggacacgatccggcatcgcgtaatctctcaggtacttgagttgggtattgtggtgcactcggtgatcatcggcatctcgctcggcgcatctcagaacccggaagcaatcaaacctcttgtggtcgccttgagcttccaccagatgttcgagggaatgggacttggtggctgcatagttcaggcaaagttcaaggctaggtccatcgtgatcatgatcctcttcttctgcctgacaacgccggtgggaatcctcatcggctttggcatatcacgggtgtacaacgagaacagcccgacggcgctggtggtggagggcagcctcaactctgtggcagcggggatcctcatctacatggccctcgtcgacctcctcgccgaggacttcatgaaccccaaggtgcagagcagggggaagctgcagcttggcatcaacatctccatgctggttggtgcaggcctgatgtccatgctcgccaaatgggcctaggcgatcgcaagcctacaacatgaaatagttttgctccatgacatatgtatagacgtacctatattggatagtcgagtttgaaacgatataatctcccaaactaggtaatgccaacccagtagtgtaggcatctaaagaaaataagtagaccttgtttgggctacggatttttgaaaatcagcttcggcttggattctcagaatcagctgcagctgaagattctggaaatctgaagcagcctctttgtttgccctgcaaatctgaagcagctacaaccctgaatg

SEQ ID NO: 2017 - DNA, 1354 bp, Avena sativa
gcacgacatactagtgcagcagtcatgaagccgagcgccgacgtgctcctcgctgtccttgtggcgctgctcttggtctctgccgtgcgcggcggcgacgacgacgaccactgcgggtcgccggagtcggcggcgcacgaccgcgcgcgggcgaggcctctcaagatcgcggctttcttctcgatcctactctgcggcgctctgggttgctccctgcccgtgctggggcggcgcgtgcctgtgctccggcccgacggcgacatcttcttcctggtcaaggcgttcgctgccggggtcatcctcgccacaggtttcatccacatattacccgacgcgttcgataacctcacgtcgccctgcctgcctgccgacggcccctggcaggacttcccgttcgccggcctaggcgccatggtcggcgccatcggcacgctcgtcgtcgacaccatcgccactgggtacttcactcgcgcacacctgaaaaaggacgctgcgacagggagcagcagtgccgccgtcgtggatgaggagaaacaggccgctgctgccgccgccgccgccaccgaggaaggtggggagcacttgcacgtcgtgcacacgcacgcgacgcacggccacgcgcacggctcggcggcgctcgtcgcggctgttggcggcgccgaggacgagaaggacacggtccggcatcgcgtaatatctcaggtacttgaattgggtatcgtggtgcactcggtgatcatcggcatctccctcggcgcgtctcatgatccggacacgatcaagcctctggtggttgccttgagcttccaccagatgttcgagggcatggggcttggcggctgcatagttcaggcaaagttcaatgcgaggtccattgtgaccatgatcctcttcttctgcctgaccacaccggtgggcatcctcgtcggcatgggcatatcgcacgtatacaacgagaacagcccaaccgccttggtggtggaaggcagtctcaactcggtggctgctggaatcctcgtgtacatggccctcgtcgacctactggccgaggacttcatgaaccccaaggtgcagagcaggggcaagctgcagctcggcatcaacttctccatgctgctcggggcaggcctcatgtccatgctcgccaaatgggcgtagccaagtaccaaacagttttgctccatggcatctgagttcgaggatggcaggagacatatggtcgtcgaagttgaaacgttattaatattagcatagagcctgttcattgctacgggcgttacattaaatcaaataaacaatatttcatatgtctaaatctatatgccatcgaaattgaatggtggggagtccttga

SEQ ID NO: 2018 - DNA, 1283 bp, Avena sativa
accatgtcactctccctcccccggccttcgccgtccaccagcgggccgggtagcacgacatactagtgcagtcatgaagccgagcgccgccgtgctcctcgctgtccttgtggcgctgctcttggtctctgccgtgagcggccacgacgactgcgggtcgccggagtcggcggcgcacgaccgcgcgcgggcgaggcctctcaagatcgcggctttcttctcgatcctactctgcggcgctctgggttgctccctgcccgtgctggggcggcgcgtgccggtgctccggcccgacggcgacatcttcttcctggtcaaggcgttcgctgctggggtcatcctcgccacaggtttcatccacatattacccgacgcgttcgataacctcacgtcgccccgcctgcctgccgacggcccctggaaggacttcccgttcgccggcctaggcgccatggtcggcgccatcggcacgctcgtcgtcgacaccctcgccactgggtacttcactcgcgcacacctgaaaaaggacgacgctgcgacagggagcggcactgcagccgtcgtggatgaggagaaacaggccgctgctgccgccgccgccgccaccgaggaaggtggggagcacttgcacgtcgtgcacacgcacgcgacgcacggccacgcgcacggctcggcggcgctcgtcgcggctgttggcggcggcgaggacgaaaaggacacggtccggcatcgcgtaatatctcaggtacttgaattggggatcgtggtgcactcggtgatcatcggcatctccctcggcgcgtctcaagatccggacatgatcaagcctctggtggttgccttgagcttccaccagatgttcgagggcatggggcttggcggctgcatagttcaggcaaagttcaatgcgaggtccatcgtgaccatgatcctcttcttctgcctgaccacgccggtgggcatcctcgtcggcatgggcatatcgcacgtatacaacgagaacagcccaaccgccttggtggtggaaggcagtcttaactcggtggctgctggaatcctcgtgtacatggccctcgtcgacctcctggccgaggacttcatgaaccccaaggtgcagagcaggggcaagctgcagctcggcatcaacttctccatgctgctcggggcaggcctcatgtccatgctcgccaaatgggcgtagccaagtaccaaacagttttgctccatggcatctgagttcgaggatggcaggagacatatggtcgtcgaggttgaaacgttac

SEQ ID NO: 2019 - DNA, 1356 bp, Triticum aestivum
aacaagctctctcaaggcactatctggctgactagctagaatagaccgctcgatagagtagcatcataagcaaacacccatagaccgatcatggcggcgcgcgccattgttgccctctcgctcatcctcgcgctggtcgccatagccagcggaggagcgtcggcgcagctgtcgtcgggattctactcccgctcctgcccgggcatgctcaaagccgtgcgctcggcgctgcacccggccatcgctagggagcgccgcgtgggcgcctccatcgtccgcctcttcttccacgactgcttcgtccagggctgcgacgcctcgctgctgctggacgacgcgccgggcctgcgcggcgagaagaacgccacacccaacaagaactccgccagggggttcgaggtcatcgacgccgtcaaggcggccgtcgaggagtgttgtcccggggtcgtctcctgcgccgacatcctcgccatcgccgccgaggagagcgtcgtcttcctgggtggcccgagctgggaggtgaagatggggcggagagactcgaccacggcgagcttcaacggcgccgagaacaacatccccccgccgacgtcggggctcgcaaaccttacgtccctcttcgccgcgcaggggctctcccagaaagacatggtcgcactgtcaggagcccacacaatcggcctagcacgctgcacaaacttccgggaccacatctacaacgacacaaacatcgacgccggcttcgccaggagccgccagtcaggctgccctcgcgccactggctccggtgacaacaacctggcgcccctcgacctgcaaactccggccgtcttcgagaatgactactacaaaaaccttgtccagaagaggggccttctgcactcggaccaggagctcttcaatggcggtgctgccgatgcgctggtccgggagtacgtcggtagccagagcgccttcttcaaggactttgtggagggaatgatcaagatgggggacatcacgccgctgatgggatccaacggacagatcagaatgaactgcaggaggatcaactaagattcttctccgctttccgtgccaacaattccgatgttgttcccatgcttgaatccatgatgattttcccttttttacttaaactcatttgttcccttttcttttaaggataaaaggttaaaagatattataatactcccctttgtaccatgttcacggaagaactgaacatggatgcactggcaaaagaacaaagtgcaaagtgagatgtggcaaatcaaatatatagtttcaatagatcaagtggatcctaaaattgtcaagtaaagaggggctaaagattgaatcccacattcttta

SEQ ID NO: 2020 - DNA, 1444 bp, Triticum aestivum
tcaaggcactatctagctggttgtagaatagaccgatcgagtagcatcgtaagaaacacctataaaccgatcatggcagcgcgcgccattgttgtcctctggctcatcctcgcgctggtcgccatcgccagcggaggagcgtcggcgcagctatcgtcgggcttctactcccgctcgtgcccgggcatgctcaaagccgtgcgctcggcgctgcacccggccatcgccagggagcgccgcgtgggcgcctccatcgtccgcctcttcttccacgactgcttcgtccagggctgcgacgcctcgctgctgctggacgacgcgccgggcctgcgcggcgagaagaacgccacgcccaacaagaactccgccagggggttcgaggtcatcgacgccgtcaaggcggccgtcgaggggtgttgtcccggcgtcgtctcttgcgccgacatcctggccatcgccgccgaggagagcgttgtcttcctgggtggcccgagctgggaggtgaagatggggaggagggactcgacgacggcgagcttcaacggcgccgagaacaacatcccaccaccgacatcggggctcgcgaaccttacgtccctcttcgccgcgcaggggctatcccagaaagacatggtcgcactctcaggagcccacacaatcggcctagcacgctgcacaaactttcgggaccacatctacaacgacacaaacatcgacgccggcttcgccaggagccgccagtcaggctgccctcgcgccaccggctccggtgacaacaacctggcgccactggacctggaaaccccgaccgtcttcgagaacgactactacaagaacctcgtccagaagaggggccttcttcactcggaccaggagctcttcaatggtggtgctgcagacgcgctggtccgggagtatgtcggtagccagagcgccttcttcaaggactttgtggagggaatgatcaagatgggggatatcacgccgctgacaggatccaatggacagatcagaatgaactgcaggaggatcaactaagattcttctcccctttctgcgccaacaattccgatgttgttcctatgcttgaattcatgataattttcccttaaacttatttgtttccttttcttttaaggataaaaggttaaaagatattataaatctgcccctttgtgccacgttcacggaagaactggacatggatgcaccggcaaaagatcaaagtgcaaagtgagatgtggcaaaccaatatatattttcaacgtatgcagtggcaaatcctgaaattttcaagtaaagaggggctaaagatcaaatgccacagtctttacctccccgacgagttgataaatgaaggaaatatgccctataggcaataataaagttgttattttatatttttttatatcatgataaatgtttattattcatgtcagaatta

SEQ ID NO: 2021 - DNA, 1247 bp, Triticum aestivum
atagaccgatcatggcagcgcgcgccattgctgtcctctcgctcatcctcgcgctggtcgccatcgccagcggaggagcctcggcgcagctgtcgtcgggcttctactcccgctcctgcccgggcatgctcaaagccgtgcgctcggcgctgcacccggccatcgccagggagcgccgcgtgggcgcctccatcgtccgcctcttcttccacgactgcttcgtccagggctgcgacgcctcgctgctgctggacgacgcgccgggcctgcgcggcgagaagaacgccacgcccaacaagaactccgccagggggttcgaggtaatcgacgccgtcaaggcggccgtcgaggggtgttgtcccggcgtcgtctcgtgcgccgacatcctcgccatcgccgccgaggagagcgttgtcttcctgggtggcccgagctgggaggtgaagatggggcggagagactcgaccacggcgagcttcaacggcgccgagaacaacatcccgccgccgacgtcggggctcgccaaccttacgtccctcttcgccgcgcaggggctctcccagaaagacatggtcgcactctcaggagcccacacaatcggcctagcacgctgcacaaacttccgggaccacatctacaacgacacaaacatcgacgccggcttcgccaggagccgccagtcaggctgccctcgtgctaccggctcaggcgacaacaacctggcaccgctagacctgcaaacccccacggtcttcgagaacgaatactacaaaaacctcgtccagaagaggggcctcctgcactcagaccaggagctcttcaatggtggcgctgccgacacgctggtccgggagtatgtcggtagccagagtgccttcttcaaggactttgtggagggaatgatcaagatgggggacatcacgccgctgacggggtcgaacggacagatcaggatgaactgtaggagggtcaactaagattgttctcccctttccgcagcaacaatccgatgttgttaccatgcttgatttgccccttttcacttaaactcgtttgtttccttttcttttaaggttaaaatgttaaaatatattacaatactgcccttttgtggcatgttcatggaagaactgaacatggatgcactggcaaaagaacaaagagcaaagtgagatatgacaaatcaacaattttaatgtatggagtggcaaatactcaaattattaagtaaagaggggctaaagatc

SEQ ID NO: 2022 - DNA, 1130 bp, Secale cereale
aggtctctccaggcactatatggctgaccagaatagaccgatcatggcggcgcgcgccattgtttccctctcgctcatcctcgcgctggtcgccattaccagcggaggagcgtcggcgcagctgtcgtcgggcttctactccagctcgtgcccgggcatgctcaaagcagtgcgctcggcgctgcacccggccatcgccagggagcgccgcgtgggcgcctccatcgtccgcctcttcttccacgactgcttcgtccagggctgcgacgcctcgctgctgctggacgacgcgccgggcctgcgcggcgagaagaacgccacgcccaacaagaactcggccagggggttcgaggtcatcgacgccgtcaaggcggccgtcgaggaatgttgtccgggcgtcgtctcctgcgccgacatcctcgccgtcgccgccgaggagagcgttgtcttcctgggtggcccgagctgggaggtgaagctgggccggagggactcgacgacggcgagcttcaacggcgccgagaataacatccctccacccacatcggggctcgcgaaccttacgtccctcttcgccgcgcaggggctctcccagaaagacatggtcgcgctctcaggagctcacacaatcggcctagcacgctgtacaaacttccgggaccacatctacaatgacaccgacatcgacaccggcttcgccaggagccgccagtcaggctgccctcgcgccaccggctccggcgacaacaacctggcgccgttggacctacaaaccccgaccgtctttgagaacgcctactacaagaacctcgtccagaagaggggcctcctgcactcggaccaggagctcttcaatggtggcgctgctgacgcgctggtccgggagtacgtcggtagccagagcgccttcttcaacgactttgtggagggaatgatcaagatgggggacatcacaccgctgacggggtccaacggacagattaggatgaactgtaggagggtcaactaagattgttgtccgcttcccgtggcaacaattccgatgttgtttccatgctgaattcatatcgatttccactttacactaaactcgtttgttccggtttcttttaaggataaaagtttaaatc

SEQ ID NO: 2023 - DNA, 1076 bp, Secale cereale
ccgatcatggcggcgcgcgccattgttgccctctcgctcatcctcgcgctggtcgccatcgccagtggaggagcgtcggcgcagctgtcgtcaggcttctactccagctcgtgcccgggcatgctcaaagccgtgcgctcggcgctgcacccggccatcgccagggagcgccgcgtgggcgcctccatcgtccgcctcttcttccacgactgcttcgtccagggctgcgacgcctcgctgctgctggacgacgcgccgggcctgcgcggcgagaagaacgccacgcccaacaagaactccgccagggggttcgaggtcatcgacgccgtcaaggcagccgtcgaggaatgttgtcccggcgtcgtctcctgtgccgacatcctcgccatcgccgccaaggagagcgttgtcttcctgggtggcccgagctgggaggtgaagatggggcggagagactcgacgacggcgagcttcaacggcgccgagaataacatccctccaccgacatcggggctcgcgaaccttacgtccctcttcgccgcgcaggggctctcccagaaagacatggtcgcactctcaggagcccacacaatcggcctagcacgctgcacaaacttccgggatcatatctacaacgacacaaacatcgacgccggcttcgccaagagccgccagtctggctgccctcgccccaccggctccggcgacaacaacctggcgccgctagacctgcagaccccgaccgtcttcgagaacgactactacaagaacctcgtccagaagaggggcctcctgcactcagaccaggagctcttcaatggtggcgctgccgacgcactggtccaggagtatgtcggtagccagagcgcattctttaaggactttgtcgagggaatgataaagatgggggacatcacgccgctgatgggatccaacggacagatcaggatgaactgcgggaggatcaactaatattgttaccatgctcgaattcatgatgatttaccctttttcacataaactcctttgtttcgatgtcgtgtaaggatgaaaggttaaaacatattaaaatacta

SEQ ID NO: 2024 - DNA, 1091 bp, Leymus cinereus x Leymus triticoides
gaccgatcatggccgcgcgcgccattgtcgtcctgctctcgctcatcctcgcgctggtcgccggcggcgcgtcggcgcagctgtcgtcgggcttctactcccgctcgtgcccgggcatgctcaaagccgtgcgctcggcgctgcacccggccatcgccagggagcgccgcctgggcgcctccatcgtccgcctcttcttccacgactgcttcgtccagggctgcgacgcctcgctgctgctggacgacgcgccgggtctgcgcggcgagaagaacgccccgcccaacaagaactccgccaggggcttcgaggtcctcgacgccgtcaaggcggccgtcgaggagcgttgtcccggcgtcgtctcctgcgccgacatcctcgccatcgccgcccaggagagcgtcgtcttcctgggtggcccgagctgggaggtgaagatggggcggagagactcgacgacagcgagcttcaccggggccgagaacaacatcccaccgccgacgtcggggctcgcaaaccttacgtccctcttcgccgcgcaggggctctcccagaaagacatggtcgcactctcaggagcccacacaatcggcctagcacgctgcacaaacttccgggaccacgtctacaacgacaccaacatcgacgccggctttgccaggagccgccagtcaggctgccctcgcgccaccggctccggcgacaacaacctggcgccgctggacctgcagaccccgaccgtcttcgagaacaactactacaagaacctcgtccagaagaggggcctcctgcactcggaacaggagctcttcaatggcggcgctgccgacgcgctggtccgggagtacgtcggtagccagagcgccttcttcaaggactttgtggagggaatgatcaagatgggggacatcacgccgctgacaggatccaacggacagatcaggatgaactgcaggaggatcaactaagattgttctcccctttccacggcaacaattccgatattgttcccatgcttgaattcatgatgatttgccctttttcacttaaactcatttgtttccttttcttttaaggataaaaggttaaaa

SEQ ID NO: 2025 - DNA, 1122 bp, Pseudoroegneria spicata
ggcactatctagctgactagaatagaccgatcgagtagcatcctaagcaacacccatagaccgatcatggcggcccgcaccattgttgtcctctcgctcatcgtcgcgctggtcgccatcgccagcggaggagcgtcggcgcagctgtcgtcgggcttctactcccgctcgtgcccgggcatgctcaaagccgtgcgctcggcgctgcacccggccatcgccagggagcgccgcgtgggcgcctccatcgtccgcctcttcttccacgactgcttcgtccagggctgcgacgcctccctgctgctggacgacgcgccgggcctgagcggcgagaagaacgccacgcccaacaagaactccgccaggggtttcgaggtcatcgacgccgtcaaggcggcagtcgaggagtgttgtcccggcgtcgtctcctgcgcggacatcctcgccatcgctgccgaggagagcgtcgtcttcctgggtggcccgacctgggaggtgaagatggggcggagagattcgacgacggcgagcttcaacggggccgagaacaacatcccaccgcccacgtcggggctcgcaaacctcacatccctcttcgccgcgcaggggctctcccagaaagacatggtcgcactctcaggagcccacacaatcggcctagcacgctgcacaaacttccgggaccacatctacaacgacacaaacatcgacgccggcttcgccaggagccgcgagtcaggctgccctcgcacctccggctccggcgacaacaacctggcgccgctggacctgcagaccccgaccgtcttcgagaacgactactacaagaacctcgtccagaagaggggcctcctgcactcggaccaggagctcttcaatggcggcgctgccgacgcgctggtccgggagtacgtcggtagccagagcgccttcttcaaggactttgtggagggaatgatcaagatgggggacatcaccccgctgacggggtccaacggacagctcaggatgaactgcaggaggatcaactaaaaatattgttctcccctttccgccacaacaattccaatgttgttcccatgtttgaattcatgatgatttgccctttttcacttaaactca

SEQ ID NO: 2026 - DNA, 1250 bp, Hordeum vulgare
atccagcaaaacaagctctcaaggcactatctatctagctagctagatagctaacacagttgattccatcgataatggcggcgcgtgccattgtcgtcctggtctcgctcgtcctagcggtggtcgccggcggcgcgtcggcgcagctgtcgtcgggcttctactcgcgctcgtgcccgggcatgctcaaagccgtgcgctcggcgctgcacccggcgatcaccagggagcgccgcgtgggcgcctccatcgtccgcctcttcttccacgactgcttcgtccagggctgcgacgcctcgctgctgctggacgacgcgccggggctgcgcggcgagaagaacgccgcgcccaacaagaactccgtcagggggttcgaggtcatcgacgccatcaaggcggccgtcgagaaggagtgtcccggcgtcgtctcctgcgccgacgtcctcgccgtcgccgccgaggagagcgtcgttttcctgggtggcccgagctgggaggtgaagatggggcggagagactcgacgacggcgagcttcaccggcgccgagaacaacatcccaccgcccacgtcggggctcgcaaacctcacgtccctcttcgccgcgcaggggttgtgccagaaggacatggtcgcgctctcaggagcgcacacgatcggcctggcacgctgcacaaacttccgggaccacatctacaacgacaccaacatcgacgacggcttcgccaggagccgccagtcaggctgccctcgcaccgccggcttcggcgacaacaacctggcgccgctggacctgcagaccccgaccgtcttcgagaacaactactacaagaacctcgtccagaagagggccctcctacactcggaccaggagctcttaaacggcggcgccgccgacgcgctggtccggcagtacgtcggcagccagagctcattcttcaaggacttcgtggtggggatggtcaagatgggggacatcgggccgctgacggggtccagcggacagatcaggaagaactgcaggaggatcaactaagaaaagatcctccactttgagcgcagacaattgcgaaatccctagaaatgcagcacaatccgtagcaattcgggatgtgtttgatcgcgcccaagcttgcaagcagcttgtagtttcctgtcgttcgactctgtttctgcaattgtcaaaccaatgtacgttgtgtctgttgggttaataaaaggcctaccagtctatagccaggaattataaggt

SEQ ID NO: 2027 - DNA, 1057 bp, Hordeum vulgare
agcaaaacaagctctcaaggcactatctatctagctagctagatagctaacacagttgattccatcgataatggcggcgcgtgccattgtcgtcctggtctcgctcgtcctagcggtggtcgccggcggcgcgtcggcgcagctgtcgtcgggcttctactcgcgctcgtgcccgggcatgctcaaagccgtgcgctcggcgctgcacccggcgatcaccagggagcgccgcgtgggcgcctccatcgtccgcctcttcttccacgactgcttcgtccagggctgcgacgcctcgctgctgctggacgacgcgccggggctgcgcggcgagaagaacgccgcgcccaacaagaactccgtcagggggttcgaggtcatcgacgccatcaaggcggccgtcgagaaggagtgtcccggcgtcgtctcctgcgccgacgtcctcgccgtcgccgccgaggagagcgtcgttttcctgggtggcccgagctgggaggtgaagatggggcggagagactcgacgacggcgagcttcaccggcgccgagaacaacatcccaccgcccacgtcggggctcgcaaacctcacgtccctcttcgccgcgcaggggttgtgccagaaggacatggtcgcgctctcaggagcgcacacgatcggcctggcacgctgcacaaacttccgggagcacatctacaacgacaccaacatcgacgacggcttcgccaggagccgccagtcaggctgccctcgcaccgccggcttcggcgacaacaacctggcgccgctggacctgcagaccccgaccgtcttcgagaacaactactacaagaacctcgtccagaagagggccctcctacactcggaccaggagctcttaaacggcggcgccgccgacgcgctggtccggcagtacgtcggcagccagagctcattcttcaaggacttcgtggtggggatggtcaagatgggggacatcgggccgctgacggggtccagcggacagatcaggaagaactgcaggaggatcaactaagaaaagatcctccactttgagcgcaga

SEQ ID NO: 2028 - DNA, 949 bp, Triticum aestivum
cataagcaacacccatagaccgatcatggcggcgcgcgccattaattgttgccctctcgctcatcctcgcgctggtcgccatagccagcggaggagcgtcggcgcagctgtcgtcgggattctactcccgctcctgcccgggcatgctcaaagccgtgcgctcggcgctgcacccggccatcgctagggagcgccgcgtgggcgcctccatcgtccgcctcttcttccacgactgcttcgtccagggctgcgacgcctcgctgctgctggacgacgcgccgggcctgcgcggcgagaagaacgccacgcccaacaagaactccgccagggggttcgaggtcatcgacgccgtcaaggcggccgtcgaggggtgttgtcccggcgttgtctcttgcgccgacatcctggccatcgccgccgaggagagcgttgtcttcctgggtggcccgagctgggaggtgaagatggggaggagggactcgacgacggcgagcttcaacggcgccgagaacaacatcccgccgccgacgtcggggcttgccaaccttacgtcgctcttcgccgcgcaggggctctcccagaaagacatggtcgcactctcaggagcccacacagtcggcctagcacgctgcacaaacttccgggatcacatctacaacgacacaaacatcgacgccggcttcgccaggagccgccagacaggctgccctcacgccaccagctcaggggacaacaacctggcgccgctggacctacaaaccctgaccgtcttcgagaaccactactacaagaatctcgtccagaagaggggcctcctgcactcagaccaggagctcttcaatggtggtgctgccgacgcgctggtccgggagtatgtcggtagccagagcgccttcttcaaggactttgtggagggaatgatcaagatgggggacatcacgccgctgac

SEQ ID NO: 2029 - DNA, 1235 bp, Secale cereale
atctagatagataacacacttgacttgatcgatcatcagcaacgtaaacccacagacatcggccatggcggcgcgtgccattgtcgtcctggtctcgctcatcctcgcggtggtcgcgggcggcgcgtcggcgcagctgtcatcgggcttctactcccgctcgtgcccgggcatgatcaaagccgtgcgctcggcactgcggccggcaatcgccagggagcggcgcgtgggcgcctccatcgtccgcctcttcttccacgactgcttcgtccagggctgcgacgcctcgctgctgctggacgacgccccgggcctgcgcggcgagaagaacgccatgcccaacaagaactccgtcagggggtttgaggtcatcgacgccatcaaggcggctgtcgagaaggagtgtcccggcgtcgtctcctgcgccgacatcctcgccatcgccgccgaggagagcatcgccattctgggtggcccgagctgggaggtgaagatggggcggagagactcgacgacggcgagcttcaacggcgccgagaacaacatcccgccgccaacgtcggggctcacaaaccttacatccctcttcgccgcgcaggggctctcccaaaaagacatggtcgcgctctcaggagcccacacgatcggcctagcacgctgcacattcttccgggaccacgtctacaacgacacaaacatcgactccggcttcgcgaggagccgccagtcaggctgccctcgtaccgccggctccggcgacaacaacctggcgccgctggacctgcagaccccgaccgtcttcgagaacgactactacaagaacctcgtgcagaagaggggcctcctgcactcggaccaggagctcttcaacggcggcggcgccgacgcgctggtccggcagtacatcggcagccagagcgccttcttcaaggacttcgtggtggggatgatcaagatgggggacatcacgccgctgacggggtccagcggacaggtcaggaagaactgcaggaggatcaactaagaaaagatcctccactttctgcacagacagttgtgaaatccctagcaatgcagcacaatccgtagcaatccaggatgtgttcggtcgcgcccatgcttgcaagcagcttgtagtttcctctcgttcgactctgtttatgcaattgtgaaatcaatgtacattgtgcctggtggattaataaaggtctaccccgtctctgtagtcaaaaaaa

SEQ ID NO: 2030 - DNA, 1222 bp, Triticum aestivum
ctagatagcacacttgattcgatcgatcgtcagcaacgtaaacccatagatgtcgaccatggcggcgcgcgccatcgtcgtcctggtctcgctcatcctcgcggtggtcgccggcggcgcgtcggcgcagctgtcgtcgggcttctactcccgctcgtgcccgggcatgctcaaagccgtgcgctcggcgctgcggccggcgatcgtcagggagcggcgcgtgggcgcctccatcgtccgcctcttcttccacgactgcttcgtccagggctgcgacgcctcgctgctgctggacgacgcgtcgggcctgcgcggcgagaagaacgccaagcccaacaagaactcagtcagggggtttgaggtcatcgacgccatcaaggcggccgtcgagaaggagtgtcccggcgtcgtctcctgcgccgacatcctcgccatcgccgccgaggagagcgtcgtcttgctgggtggcccgagctgggaggtgaagatggggcggagggactcaacgacggcgagcttcagcggcgccgagaacaacatcccgccgcctacgtcggggctcgcaaaccttacgtcgctcttcgccgctcaggggctctcccagaaagacatggtcgcgctctcaggagcccacacggtcggccaagcacgctgcacattctttcgggaccacatctacaacgacacaaacatcgactccggcttcgccaggagccgccagtcaggctgccctcgtaccgccggctccggcgacaacaacctggcgccactggacctgcagaccccgagcaccttcgagaacgactactacaagaacctcgtccaaaagaggggcatcctgcactcggaccaggagctcttcaacggcggcgccgccgacgcgctggtccagcagtacatcggcagccagagcaccttcttcaaggacttcgtggtggggatgatcaagatgggggacatcacgccgctgactgggtccagcggacagatcaggaagaactgcaggaggatcaactaagaaaagatcctccactttctgcgcagacagttgtgaaatccctagaaatgcagcacaatccgtagcaatccaggatgtgtttggtcgcgcccatgcttgcaagcagcttgtggtttcctctcgttcgactctgtttatgcaattgtgaaatcaatgtacgttgtgcctggtggattaataaaaaggtctaccccgtctctatgg

SEQ ID NO: 2031 - DNA, 2138 bp, Lolium multiflorum
agcagcgtcgcctttgccattgctcaccagatcgaacacaagaagataacagcactgcctctcgatcgtactccaataaatagtagctaggcagcccatcccaaggaccaaggtacgcaagggaaggagaggactctctccgcgcgcgttcgttccccacatccatctcccacgcagtccccggcctcgagtgagcttcagctagcgagtccagaatcaatggcgataggcgccttcgtggacggcccggcgggcggcgcgggctacaacggccgcgtcacctccttcgtcgtgctctcctgcatcgtcgccggcagcggcggcatcctcttcggctacgaccttggcatctcaggcggagtgacgtcgatggagtccttcctcaagaaattcttcccggacgtctaccaccaaatgaagggggacagccacgtttccaactactgccgttttgacagcgagctgctcaccgtcttcacctcctccctctacatcgccggtctcgtcgccaccctcttcgcctcctccgtcaccaccaagtacggccgccgcgcatccattctcataggaggctccgtcttcatcgccgggtccgttttcgggggcgctgccgtcaacgtctacatgctgctcatcaaccggatcctcctcggcataggcctcggattcaccaaccagtcaattccactgtacctttcagaaatggcaccaccgcagtaccgtggtgccatcaacaacggcttcgagctgtgtatcagcatcggcatcctcattgcgaacctcatcaactacggagtggcaaaaattgaaggaggatgggggtggaggatatcactgtccatggccgctgtccctgccgcattcctaaccattggcgcaatcttccttcctgagacccccagcttcctgatccagcgtgatggcaatgtcgaccaggcgaagatgatgctccagaggctgcgtggcacgaccggagtccagaaagagctcgatgatctggtcaccgctagcaacatctcgcggacaatcaagaacccgtaccggaacatcctgaagaagaagtacaggccacagcttgtgatagcactcctcattcctttcttcaaccaggtcactgggatcaacgtgatcaacttctacgcgcctgtcatgttccgcacaatcgggctcaaggagagtgcatccctcatgtcagccgtcgtgacgcgcctctgcgcgacggccgccaacatcgtggcaatgatcgtcgtggaccggttcgggcgcagaaagctgctgctggtcggcggcgtgcagatgatcctgtcgcagttcacggtgggcgccgtcctggcagtgaagttcaaggaccacggggtcatggagaaggagtacgcatacctggtgctggtcatcatgtgcgtgttcgtggcggggttcgcgtggtcttgggggccgctgacgtaccttgtcccgacggagatctgcccgctggagatcaggtcggccggccagagcgtggtgatcgcagtcatcttcctggtcacgtttctgatcgggcagacgttcctggccatgctgtgccacctcaagttcggcaccttcttcctcttcggagggtgggtgtgcgtgatgaccatgttcgtcttctttttcctgccggagacgaagcagctccccatggagcagatggagcaggtctggaggaggcactggttctggaagaggattgttggggaggaggaggaggaacaagaggcgggtcagacgcaaactgcaccaggaaccattgccttgtccaccacaccacataataactagtgacatgcatcttcttggggttaaaacaacctgtaacacaaaatgatcaactagtctgctgatcactatatctgcatgtacaaggtgggaaggtgctcatatagatatatgctgtatgtatcctaactggctcagtagtcgaatcaaatgcaactgtcagtatgtaacctatgattaaattgacatttctaatggctaaaggcagttttgcgtatccgcggcacaccataactatttgtaaggtctgcatatgtatgtcagaagataagatgtcatctctgtatgaaatcaccttatacttgatttccttttcgaagtttaagagctatcactgcggc

SEQ ID NO: 2032 - DNA, 1905 bp, Avena sativa
gtctccttccccacatagctaccccagccacaacaggcaggcaaccatcatccccacccatatatagattgagcgagctcgcgcgcttcaggtgaaggagaaaaataaatcaatggcgataggggcgttcgtggaaggcccgtcgggcggcgcggggtacaacggccgagtcacctccttcgtggtgctctcatgcatcgtcgccggcagcggcggcatcctctttggctacgaccttggaatctcaggcggggtgacgtccatggagtccttcctcaagaggttcttcccggacgtgtaccgccagatgaagggcgacgacagccacgtctccaactactgccgcttcgactccgagctactcaccgtcttcacctcctccctctacgtcgccggactcgtctccacgctcttcgcctcctccgtcaccacaaagtacggccgccgcacatccattctcatcggaggctccgtcttcatcgccgggtccgtctttggaggcgcggcagtcaacgtctacatgctcctcatcaaccgggtactcctcggcataggcctaggattcacaaaccagtcgattccactgtacctttcggaaatggcaccaccacagtaccgtggtgccatcaacaatggctttgagctctgcatcagcattggcatcctcatcgcgaacctcatcaactacggagtggcgaagattgaaggaggatggggatggaggatatctctgtccatggctgctgtccctgccgcgtttctgacaatcggcgcgatcttcctgcccgagacccccagcttcctgatccaacgtgacggcaacatcgaccaggcaaagatgatgctccagaggctgcgcggcacgacaggcgtccagaaagagctcgacgatctggtcaccgcaagcaacatctcgcggacgatcaagaacccataccggaacatcctgaagaagaagtacaggccgcagctggtgatcgcgctgctcatccctttcttcaatcaggtcaccgggatcaacgtgatcaacttctatgcgccggtcatgttccggaccatcgggctcaaggagagcgcatccctcatgtcagcagtcgtcacacgcgtctgcgccttatttgcaaacgttgtagcaatggtcgtcgttgacaagttcgggcgcaggaagctcttgctagcaggcggtgttcagatgatcctgtctcagttcacggtcggtgcaatcctggccgtgaagttcaaggaccatggagccatggagaaggagtacgcatacctagtgttgatcatcatgtgtgtcttcgtcgcaggatttgcctggtcttggggacctctcacttacttggtccctacagagatctgcccgctggagatccggtccgcagggcagagcgttgtgatcgcagtcatcttcttggtgacatttgtgatcgggcagacctttcttgctatgttgtgccatctcaagttcggcaccttctttctgttcggggggtgggtgtgcgtgatgacgctgttcgtcttcttcttcctgccagagacgaagcagctgcccatggagcagatggagcaggtctggaggcggcactggttctggaagaggatcgtcggggaggaggaggaggaagaggagatgcagactgcggcaggagccgtagccttgtccaccacagcacataataactagtcaaagattcttgggggtgaaacaacctgcaccccaaaaatgatatgaactagtctgatctgtatatctggatgtacaaggggaggtactcatataaccatatatatactgtgtctgtatgtatcctaaccggctcgctagtcgaattaatgcaactgtcagtatgtaacttatgattaagttggcattctcggatggcaacggataataaggaattt

SEQ ID NO: 2033 - DNA, 2232 bp, Hordeum vulgare
gctcagggaaataaataggcacaccccctgcccacaaccccctctcactcccccactgctagcgctagctgttctagccaagctccccatccttccttcccctgcccaatccatctccaaccagctacaagaacccatcaatggcgataggggcgttcgtggagggcccggcgggcggcggcgggtacaacggccgcgtcacctccttcgtcgtgctctcctgcatcgtcgccggcagcggcggcatcctcttcggctacgacctcggaatctcaggcggcgtaacctccatggagtcgttcctgaagaagttcttcccggacgtgtaccaccagatgaacggggacaaagcggccgtctccaactactgccgcttcgacagcgagctgctcaccgtcttcacctcctccctctacgtcgccggcctcgtcgccaccctcttcgcctccaccgtcaccacccgctacggccgccgcgcatccatcctcatcggcggctccgtcttcatcgccggatccgcattcgggggcgccgccgtcaacgtctacatgctcctcgtcaaccgcatcctcctcggcatcggcctcggcttcaccaaccagtcgattccactatacctttcagaaatggcgccgccgcaataccgtggcgccatcaacaacggctttgagctctgtatcagcatcggcatcctcatcgcgaacctcatcaactatggagtgcagaaaatcgaaggaggatgggggtggaggatatcactgtccatggctgctgtgcctgctgcatttctgactatcggtgcgatcttcctgcctgagacccccagcttcctgatccagcgtgatggcaatgtcgacgaggcgaagataatgctccagaagctgcgtggcacgacgggggttcagaaagagctcgacgatctggtcaccgctagcaacatatccagagcaatcaagaacccgtaccggaacatcctgaagaagaagtacaggccgcagctcgtgatagccctcctcattcctttcttcaaccaggtcacgggaatcaacgtgatcaacttctacgccccggtcatgttccggaccatcgggctaggggagagtgcggcactcatgtcagcggtcgtgacacgcctctgcgccacagttgccaacattgtggccatgatcgtcgtcgacaagttcgggcgcagaaagctgttgctggtaggcggtgttcagatgatcctgtcacagttcacggtaggcgcgatcctggccgtgaagttcaaggaccaaggagtcatggggaaggagtacgggtacctggtcctgatcatcatgtgcgtcttcgtggcggggttcgcctggtcctggggacctctcacctacttggtcccgacagagatctgcccgctggagatcaggtcggcagggcagagcgttgtgatcgcggtcatcttcctgatgacctttgtgatcgggcagacgttcctcaacatgctgtgccatctcaagttcggcaccttcttcctgttcggagggtgggtgtgcgtgatgacgctgttcgtcttcttcttcctgccggagacgaagcagctgcccatggagcagatggagcaggtctggaggaggcactggttctggaagaggatagttggggaggaggaagaggaggtggatcaggcgcaaactggagcaggaaccatatccatgtccaccacatcacatagcagttagtgacattcttttgcgggggtgcaaaaacctgcactccaaaaatgatgaactagtccgatgatcagtatatatctgcatgtacaaggggaggcactcaatatagccacattatactgtatgtatcctaactcaagtcaatagtttagtgcacctgtgagtatgaattgatgatgtaacctatagaagttgatagtatttggaatggcagaaggtaataaggtaggagtatattgcagcttgactaaataagatcaaggttttgtaagctctgcttattataattacgcgtgtcagtcagaagacaagccctcacctctactgtatatggaagaaaccaccttatatatgattgtgattgggttttcatcagagtgcaaggatctatctgtctatcttgggattcagataatgtatctcctgtgagggcacacatttacatttattcacatcatatttgtttgactgccttgagctgttggttgaactgtcctgtgtttctcaccttggtaataca

SEQ ID NO: 2034 - DNA, 1748 bp, Panicum virgatum
tctctctctgatagtcgaataggtgattttcgtttccatttttatttatttattgctcaagtcagtgtcaaactgccaggtggggttacctccatggagtccttcctcagcaagttcttcccggacgtgtatcaccagatgaaaggggacaagaacgtcagcaactactgccgtttcgacagcgagctcctcaccgtcttcacctcctccctctacgtcgccggcctcgtcgccacgctcttcgcctcctccgtcacaaggaggttcggccgccgcgcctccattctcatcggcggcactgtcttcatcgtcggctccgtcttcggcggggcagccgtcaacgtctacatgctcctcctcaacaggatcctgctcggcataggactaggcttcaccaaccagtctattccactgtacctatcagaaatggcgccaccccagtaccgtggggccatcaacaatggctttgagctctgcataagcattggcatcctcatcgcaaacctcatcaacgtcggagttgagaaaattgcagatggatggggctggagaatctctctctccctggcagctgtgccagctgcattcctaaccatgggcgcaatattcctgcctgagacacccagcttcataatccaacgtgatggcaacattgatgaggcaaagatcctgctccagaggctacgtggcacaactagaatccagaaagagcttgatgatttggtctctgctagcaatgtctcgaggacaatacaacatccactccggaagatattcaagaggaagtacaggccacagcttgtcatagcactctcggttccattctttaaccaggtcacaggaatcaacgtcatcaacttctatgcgccagtcatgttccgaaccatcgggctcaaggagagcgcatccctcatgtcagcggttgtcacacgaatctgtgcaacagttgctaacattgtagcaatggttgtcgttgacaggtttggtcgtaggaagctcttcctagtaggtggcattcagatgatcttgtcacagatcatggtaggggcagtcctagctgcaaagttcaaggaccacggaggaatggaaaaggagtatgcatacctagtcttgatcatcatgtgtgtgttcgttgcaggctttgcatggtcttggggacctctaacctacttggtcccgacagagatttgcccactggagatcaggtcagccgggcagagtattgtcattgctgtgatcttcttggtgacatttgtgattggccagaccttcctcgcaatgttatgccatctcaagtttggaacattcttcctctttggtggatgggtgtgtgtgatgacactcttcgtatacttcttcttgccagagacaaagcaactgccaatggagcaaatggagcaggtatggaggaggcactggttttggaaaaggattgtaggggaggaagaggaagagagagaggcaagaagcatagctttgtccaacacatagtgattttcttttagggtcaagtttatttggtgaaacctacagaaatggtacaccattctgattagtaaatatgcatgcatcaaggtatattattgtatagctgcacaaattgtaactagtaactgcattagtctcctaatttgacacttctggcattgtgtaacctttaagaggggcttccagaattatagcaagtaataagaactttcagtgcttcgcaaatagcaggtagctctgagaatggcaccatctaatca

SEQ ID NO: 2035 - DNA, 1968 bp, Triticum aestivum
cacctccttcgtcgtcctctcctgcatcgtcgccggcagcggcggcatcctcttcggctacgacctcggaatctcaggcggcgtcacgtccatggagtcgttcctcaagaagttcttcccggacgtgtaccaccagatgaacggcgacaaggccgccgccgtctccaactactgccgcttcgacagcgagctgctcaccgtcttcacctcctccctctacgtcgccggcctcgtcgccaccctcttcgcctcctccgtcaccacccgctacggccgccgcgcctccatcctcatcggcggctccgtcttcatcgccggctccgccttcgggggcgccgccgtcaacgtctacatgctcctcgtcaaccgcatcctcctcggcatcggcctcggattcaccaaccagtcgattccactgtacctctcggaaatggcgccgccgcagtaccgtggcgccatcaacaacggctttgagctctgtatcagcatcggcatcctcatcgcgaacgtcatcaactatggagtgcagaaaatcgaaggaggatgggggtggaggatatcactgtccatggctgctgtgcctgctgcatttctgactatcggtgcgatcttcctgcctgagacccccagcttcctgatccagcgtgatggcaatgtcgacgaggcgaagatgatgctccagaggctgcgtggcacgacgggggttcagaaagagctcgacgatctggtcaccgccagcaacatatccagggcaatcaagaacccgtaccggaacatcctgaagaagaagtacaggccgcagctcgtgatagcgctcctcattcctttcttcaaccaggtcacgggaatcaacgtgatcaacttctacgcgccggtcatgttccggaccatcgggctaggggagagcgcggcactcatgtcagcggtcgtgacacgcctctgcgccacagtcgccaacatcgtggccatgatcgtcgtcgacaagttcgggcgcagaaagctcttgctggtaggcggtgttcagatgatcctgtcacagttcactgtcggtgcgatcctggccgtgaagttcaaggaccatggagtcatggataaggagtacggatacctggtcctggtcatcatgtgcgtgttcgtggcagggttcgcctggtcctggggacctctcacctacctggtgccaacagagatctgcccgctggagatcaggtcggcagggcagagcgtcgtgattgcggtcatcttcctgatgacgtttgtgatcgggcagacgttcctcaacatgctgtgccatctcaagttcggcaccttcttcctgtttggcgggtgggtgtgcgtgatgacgctgttcgtcttcttcttcctgccggagacgaagcagctgcccatggagcagatggagcaggtgtggaggaagcactggttctggaagaggatagttggggagggggaagaagaggtggatcaggcgcacactggagcaggagccatagccatgtccaccgcaccacatagcagttagtgacatttcttttggggggtgtaaaacctgcacccaaaaatgatgaactagtctgatggtcagtcagtatatctgcatgtacaaggagaggtggtactcatatagccatactatatatatactgtatgtatcctaactcaagccaatagagtatgactgaattaatgtaacctatatataagttgatgtttggaatggcagaaagtgataaggtaggagtatattgcagagcagcttgactgaataagataaggttttgtaagctgtgcttgtaattagagatgcatgtcagaagacaagccctcacctgtgctcttgtatatggaagaaaccacattatatatgatttggttttcatcaaagtacaaggatctatcttgggactcagatgatgtatcttctgtgagggcactcatttacacgcatcatattcgaccgccttgagc

SEQ ID NO: 2036 - DNA, 2021 bp, Brachypodium distachyon
gcaaagcagagcattgccgttgccattgcccaccagaacacactggagtggctcacacaataaatagcctaggccccaagaagaagaagaagaagaagaggaggaggaggaagtaaagagagcgggctccccctccatctcggcttccctcagccgcagaggcagagcagagcagtgcggctagcttgagctccagcttgttgattaatggcgataggggcgttcgtggaagggccgacgggcggcgccgccgcagcggctgggtacaacgggcgcgtgacttccttcgtggtgctctcctgcatcgtcgccggcagcggcggcatcctcttcggctacgatctcggaatctcaggtggagtgacgtcgatggagtcgtttctgaagaagttcttcccggaggtgtaccgccagatgaaaggggacaaggtggacgtgagcaactactgccgcttcgacagcgagctgctcaccgtcttcacctcctccctctacgtcgccggtctcgtcgccacgctcttcgcatcctccgtcaccacccgctacggccgccgcgcctccatcctcatcggcggctccgtcttcatcgccggctccgtctttggtggcgccgccgtcaacgtttacatgctactcctcaacaggatcctcctcggcatcggccttggcttcacaaatcagtcgattccgctgtacctttcagaaatggcgccgccgcagtaccgcggcgccatcaacaacggcttcgagctctgcatcagcatcggcatcctcatcgccaacctcatcaactacggcgtcgccaagatcgaaggcggctggggctggcggatctcgctctccatggccgccgtccccgccgccttcctgaccgtcggcgccatcttcctcccagagacccccagcttccttatccagcgcggcggcggcaacaccgacgcggcgaaagccatgctccagcggctgcgcggcacggccggcgtccagaaggagctcgatgaccttgtcgccgcagccggagccggacaacaaggccgcccgttgaggacgctcctggggaagaagaagtacaggccgcagctggcgatggcgatcctgatccccttcttcaaccaggtgaccggcatcaacgtgatcaacttctacgcgccggtcatgttccggaccatcgggctcaaggagagcgcctcgctcatgtcggccgtggtcacccggctctgcgccacggccgctaacgtcgtggccatggtcgtcgtcgacaggtccggccgccgcaagctcctcctcgccggcggcgtccagatgatcctgtcccagttcgccgtgggcgccatcctcgccgccaagttcaaggaccacggcgccatggacaaggagtacgcgtacctggtgctcgtcataatgtgcgtcttcgtggccgggttcgcctggtcatgggggccgctcacttacttggttccgacagagatctgcccgctggagatcaggtcggccgggcagagcgttgtgatcgcagtgatcttcttggtgaccttcgtgatcgggcagacatttctcgccatgctttgccatctgaggtccgggacgttttttctgtttgggggctgggtgtgcttgatgacgctgttcgtcttcttcttcctgccggagacgaagcagctgcccatggagcagatggagcaggtctggaggaggcattggttctggagaagggtcgttgggacggaggaggaagaagacgatgtcatgagtgcagagactgctgctgcaggaagtgccatagctttgtcctccagcagaggacgtaattagttagtgaccttcttctaccacataatgatcaagagattcccataatcaaattcttgtttgtatgtatgtatgtatgtatgtatcctaactcgttacatatatagttcgatcagcgctcatgtgtgtcagtacgtatgtaacatggataaaccacattgtatcaatctgaataaatgccgctgctggagagtttatttcagcggcaagga

SEQ ID NO: 2037 - DNA, 2948 bp, Oryza sativa
ctatttcactagtccggtcagagaatgaaatgaagagatgatagtatactgatctagttgggatcctggattaaagcagctgatgaacaatcaggtggtgttcttttcttcttaagatgaagattaagtttttacgtaaaacaagatagtattaacattaacgtatgattacaaacttgaaaaatagattaatataatattaaagagcaactttcatatagaaagttttcgcacgaaatgtaccgtttagccgtttgaaaaatgtgccacgaaaatcttattcttcatacaactcttattggtgaaaagaaaggtacctcactgtcagtaagctgggcttgtgttgtgatagcgctcaggccacacatctctgcagcttgccgccgcctcctccttcgtagggactgattagtatatgtgcagtgcaaggtagcttccggtttcagtcttgagctagcacagcattaattaaaccaccaacccaaatattgttcgatcgatctgcatctgctagctgctgctgctgctgctttttcttcttcttctactggatcgagagagagagagagagaaagaaagaaagaagattatatatattaacaatggccatcggagcgttcgtcgaaggaggcggcagtgggtacagcgggcgcgtgactccgttcgtggtgctgtcgtgcatcgtcgccggcagcggtggcatcctcttcggctacgacctcggcatctcaggtggggtaacgtcgatggagccgttcctgaagaagttcttcccggacgtgtaccatcagatgaagggggacaagaagaaggtgagcaactactgccgctttgacagcgagctcctcaccgtcttcacctcctccctctacatcgccggcctcgtcgccactctcgtcgcctcctccgtcaccaggcgcttcggccgccgtgcctccatactcatcggcggctccgtcttcgtcgccggctccgtcttcggcggcgccgctgtcaacatctacatgctcatcctcaacagggtcctgctcggcattggactcggcttcaccaaccagtcgatcccgctgtatctgtcggagatggcgcctccgcagcaccgtggcgccatcaacaacgggttcgagctgtgcatcagcatcggcatcctcatcgctaacctcatcaactacggcgtggacaagatcgagggcgggtgggggtggaggatctccctgtccatggccgccgtccccgcggcgttcctcaccgtgggcgcgctgttcctgccggagacgcccagcttcgtgatccagcgcagcggcgacgtggactcggctcgggcgttgctgcagcggctgcgcggcacggcggcggtgcacaaggagctggaggacctggtgatggcgagcgaggtgtccaagacgatcaggcacccgctgcggaacatgctccggcgtcggtacaggccgcagctggtgatcgcggtgctggtgcccctgttcaaccaggtgaccgggatcaacgtgataaacttctacgcgccggtgatgttccggacgatcgggctgcgggagagcgcgtcgctgatgtcggcggtggtgacgcgggtgtgcgcgacggcggcgaacgtggtggcgatggcggtggtggacaggctggggaggaggaggctgctgctggtgggaggggtgcagatgctggtgtcgcaggtgatggtgggggcgatcctggcgggcaagttcagggagcacggggaggagatggagaaggagtacgcgtacctggtgctgagcgtcatgtgcgtcttcgtcgcgggcttcgcctggtcgtgggggcccctcacctacctggtccccgccgagatctgccctctggaggtgcggtcggcggggcagagcatcgtcatcgccgtcatcttcctcctcaccttcctcatcggccagaccttcctcgccatgctctgccacctcaagttcgccaccttcttcctcttcgccgcctgcctctgcgtcatgacgctcttcgtcttcttcttcctccctgagaccaagcagctgcccatggagcagatggatcagctctggaggacgcattggttctggaagaggatcgtcggcgactccccccaacaacaagtagtcgagctacaccaccaccaccaaagatcatcatcagaataaacaaactaaatcactaaacacgccttccacctaagtatatacgcatcataccctatataatataatatgcatgtattaattaactgatgatcgactgtatgcataatgcatgtacactactactacatatatacaacagcaacagtcagccagccgcccacaataagatcagcccagctcaattgcaccttaattagttaattaagaggctgatcacaaaataattactccatatgtgcaaccatttgtggcctcacgccttgttaactctctgtaacagtattactatgcatatatataatttgcataatggaagatgtttcctctataaagttgtccgtatttaaattggttggacatcacccatatccaatcaacatgagtctaagttaactattatacaccccctctcagcctagccaacccaacccaattggctcaccccatcacacacactgtcccgcgcgcatttgtatccatctgctttttattccttttccttttttttctttgcttattagtcaacgctattttgatatataatcaacgtcactaattattaatttgtagaccgacactatcgagggagtagatctcgaccatggtatttgtagagtatgagaatcgttggtgccaaggtatacacgagattaaggtaagagagactggagacaaggacttttatataagttcagtccccttaacttacaattaatagttctacttctattggctgaagctggtgttgccttcatgtatcaatatcttactaatacaatatttggg

SEQ ID NO: 2038 - DNA, 1876 bp, Oryza sativa
gctctctccactccactctcgcgttcttgtggagtcgtgctccactccgggaaggaaggagtgggtgggtaggtgagtggagttggtcgatggcgattggggcgttcgtggagagcggcggcggcggcggcgggggagggggaggagggtacggcgggcgggtgacggcgtacgtggtgctgacctgcgtcgtcgccggcagcggcgggatcctcttcggctacgacctcggcatctccggtggtgtgacctcaatggactcgtttctgaagagattcttcccggatgtgtaccagaagaagcaggacaccagagtgagccactactgcgcgttcgacagcgagctcctcaccgtgttcacctcgtcactctacatcgccggcctcgtcgcgaccctcttcgcgtcgtccgtcacaaggaggtatggccgccggacgtccatgctgatcggcggcaccgtcttcatcgccggctcggtgttcggcggcgccgccgtcaatgtgttcatgctgctcatcaaccggatcctactgggaataggtctcgggttcactaatcagtcaatcccactgtacctgtcagaaatggcgcctccacgataccgtggggcgatcaataacggcttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacaggccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcgatgatcgttgtcgacaggtttgggcgtagaaagctcttccttgtaggtggtattcagatgatcctttcccagcttgctgtgggtgcaatcctggctgcagagttcaaggactatggatccatggacagagagtatgcttaccttgtgttgatcaccatgtgtgtgtttgttgctggctttgcatggtcatgggggccattgacattcttggtcccaactgagatatgtccacttgagatcagatcagcagggcagagtattgttgttgcagtggtcttcctgatgacatttgtgattggacagacattccttgcagttctatgccgcatcaagtcagggacattcttcttctttgcaggatggatctgcttgatgacagtgtttgtttatttcttcctgccggagacaaagaagctgcccatggagcagatggagcaggtctggaggaagcattggttctggaagaagattgtaggggaggaggaggaaaaacaagcagagaaaacagctctccctagcatgtaaagccctatgaattggaatgtatttgaccatacaaaaaccatacaaagtgtagggttctaattagcaaatgtaagtttgtaattcttctgtctaaatgtagtgtgttgaggtggtcagttgccgtgactggctctttcagatggtaattacaaagaaatgtaacattaatgttgtaacaagggtgccattttgtttctgattccagatgaaaaggaaaaactattccatat

SEQ ID NO: 2039 - DNA, 2673 bp, Oryza sativa
cttcatacaactcttattggtgaaaagaaaggtacctcactgtcagtaagctgggcttgtgttgtgatagcgctcaggccacacatctctgcagcttgccgccgcctcctccttcgtagggactgattagtatatgtgcagtgcaaggtagcttccggtttcagtcttgagctagcacagcattaattaaaccaccaacccaaatattgttcgatcgatctgcatctgctagctgctgctgctgctgctttttcttcttcttctactggatcgagagagagagagagagaaagaaagaaagaagattatatatattaacaatggccatcggagcgttcgtcgaaggaggcggcagtgggtacagcgggcgcgtgactccgttcgtggtgctgtcgtgcatcgtcgccggcagcggtggcatcctcttcggctacgacctcggcatctcaggtggggtaacgtcgatggagccgttcctgaagaagttcttcccggacgtgtaccatcagatgaagggggacaagaagaaggtgagcaactactgccgctttgacagcgagctcctcaccgtcttcacctcctccctctacatcgccggcctcgtcgccactctcgtcgcctcctccgtcaccaggcgcttcggccgccgtgcctccatactcatcggcggctccgtcttcgtcgccggctccgtcttcggcggcgccgctgtcaacatctacatgctcatcctcaacagggtcctgctcggcattggactcggcttcaccaaccagtcgatcccgctgtatctgtcggagatggcgcctccgcagcaccgtggcgccatcaacaacgggttcgagctgtgcatcagcatcggcatcctcatcgctaacctcatcaactacggcgtggacaagatcgagggcgggtgggggtggaggatctccctgtccatggccgccgtccccgcggcgttcctcaccgtgggcgcgctgttcctgccggagacgcccagcttcgtgatccagcgcagcggcgacgtggactcggctcgggcgttgctgcagcggctgcgcggcacggcggcggtgcacaaggagctggaggacctggtgatggcgagcgaggtgtccaagacgatcaggcacccgctgcggaacatgctccggcgtcggtacaggccgcagctggtgatcgcggtgctggtgcccctgttcaaccaggtgaccgggatcaacgtgataaacttctacgcgccggtgatgttccggacgatcgggctgcgggagagcgcgtcgctgatgtcggcggtggtgacgcgggtgtgcgcgacggcggcgaacgtggtggcgatggcggtggtggacaggctggggaggaggaggctgctgctggtgggaggggtgcagatgctggtgtcgcaggtgatggtgggggcgatcctggcgggcaagttcagggagcacggggaggagatggagaaggagtacgcgtacctggtgctgagcgtcatgtgcgtcttcgtcgcgggcttcgcctggtcgtgggggcccctcacctacctggtccccgccgagatctgccctctggaggtgcggtcggcggggcagagcatcgtcatcgccgtcatcttcctcctcaccttcctcatcggccagaccttcctcgccatgctctgccacctcaagttcgccaccttcttcctcttcgccgcctgcctctgcgtcatgacgctcttcgtcttcttcttcctccctgagaccaagcagctgcccatggagcagatggatcagctctggaggacgcattggttctggaagaggatcgtcggcgactccccccaacaacaagtagtcgagctacaccaccaccaccaaagatcatcatcagaataaacaaactaaatcactaaacacgccttccacctaagtatatacgcatcataccctatataatataatatgcatgtattaattaactgatgatcgactgtatgcataatgcatgtacactactactacatatatacaacagcaacagtcagccagccgcccacaataagatcagcccagctcaattgcaccttaattagttaattaagaggctgatcacaaaataattactccatatgtgcaaccatttgtggcctcacgccttgttaactctctgtaacagtattactatgcatatatataatttgcataatggaagatgtttcctctataaagttgtccgtatttaaattggttggacatcacccatatccaatcaacatgagtctaagttaactattatacaccccctctcagcctagccaacccaacccaattggctcaccccatcacacacactgtcccgcgcgcatttgtatccatctgctttttattccttttccttttttttctttgcttattagtcaacgctattttgatatataatcaacgtcactaattattaatttgtagaccgacactatcgagggagtagatctcgaccatggtatttgtagagtatgagaatcgttggtgccaaggtatacacgagattaaggtaagagagactggagacaaggacttttatataagttcagtccccttaacttacaattaatagttctacttctattggctgaagctggtgttgccttcatgtatcaatatcttactaatacaatatttgggatgacct

SEQ ID NO: 2040 - DNA, 1968 bp, Oryza sativa
atgtcggcatccgccaacccctcctcgccttcttcttctccagtaataaatccacgcaaaagcctcgccgcgcaccaccacccagctctctccactccactctcgcgttcttgtggagtcgtgctccactccgggaaggaaggagtgggtgggtaggtgagtggagttggtcgatggcgattggggcgttcgtggagagcggcggcggcggcggcgggggagggggaggagggtacggcgggcgggtgacggcgtacgtggtgctgacctgcgtcgtcgccggcagcggcgggatcctcttcggctacgacctcggcatctccggtggtgtgacctcaatggactcgtttctgaagagattcttcccggatgtgtaccagaagaagcaggacaccagagtgagccactactgcgcgttcgacagcgagctcctcaccgtgttcacctcgtcactctacatcgccggcctcgtcgcgaccctcttcgcgtcgtccgtcacaaggaggtatggccgccggacgtccatgctgatcggcggcaccgtcttcatcgccggctcggtgttcggcggcgccgccgtcaatgtgttcatgctgctcatcaaccggatcctactgggaataggtctcgggttcactaatcagtcaatcccactgtacctgtcagaaatggcgcctccacgataccgtggggcgatcaataacggcttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacagaccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcgatgatcgttgtcgacaggtttgggcgtagaaagctcttccttgtaggtggtattcagatgatcctttcccagcttgctgtgggtgcaatcctggctgcagagttcaaggactatggatccatggacagagagtatgcttaccttgtgttgatcaccatgtgtgtgtttgttgctggctttgcatggtcatgggggccattgacattcttggtcccaactgagatatgtccacttgagatcagatcagcagggcagagtattgttgttgcagtggtcttcctgatgacatttgtgattggacagacattccttgcagttctatgccgcatcaagtcagggacattcttcttctttgcaggatggatctgcttgatgacagtgtttgtttatttcttcctgccggagacaaagaagctgcccatggagcagatggagcaggtctggaggaagcattggttctggaagaagattgtaggggaggaggaggaaaaacaagcagagaaaacagctctccctagcatgtaaagccctatgaattggaatgtatttgaccatacaaaaaccatacaaagtgtagggttctaattagcaaatgtaagtttgtaattcttctgtctaaatgtagtgtgttgaggtggtcagttgccgtgactggctctttcagatggtaattacaaagaaatgtaacattaatgttgtaacaagggtgccattttgtttctgattccagatgaaaaggaaaaactattccatattctgcagg

SEQ ID NO: 2041 - DNA, 1347 bp, Panicum virgatum
atcaaagcttccaggcaagcaactcaagtagttgccatcctcctctcccttccggcagtgaagagggatcaagtagtgctcattagcaagctgggcatagaaatctatcctttaccaatctagactcctgacctctacaaaatcctaatcatcaccgtaaactccatataaccgaagctaagatatccaatggcaggcctgtctcttcagcatcccttggctttcgcctttggcctcctcggcaacgtcatctccttcatgacctacctggccccactgccgacgttctaccggatctacaagaacaagtcgactgaaagtttccagtcggtaccgtacgttgtggcgcttttcagcgcgatgctgtggatctactacgcgctgctcaagtccgacgagtgcctgctcatcaccatcaactccgccggctgcgtcatcgagacgctctacatcgccttgtacctcacctacgcgcccaagaaggcaaagctgttcacggccaagctcctgctgctcctgaacgtcggcgtgttcgggctcatcctcctcctcacgctgctcctctccgccggccagaaccgcgtcgtcatcctcggctgggtctgtgtcggcttctccgtcagcgtcttcgtcgcgccgctcagcatcatccaccaggtggtgcgcacgaggagcgtggagttcatgcccttctcgctctccctctccctcaccgtcagcgccgtcgtctggttcctctacggcctgctcatcaaggacaaatacgtcgccctgcccaacgtgctggggttcaccttcggcgtcatccagatgggcctctacgcgatctaccgcaacgcaacaccgagggtgccagcaaaggaggtggccgacgacaaggaggacatcgtcgtcgtcgaggtgcccgagcacgtcgtgaccattgccaagctgggtgcgccggccgtggagctcaagacccacgaggtgcgtcctgccatggccacgcccacggaggaggcctggccggagaacgacaaggcggtggccaagcaggagaacggcacggtggcgggcaagggagacaacgacggtgaccaagtttagattcatgatgattatcgatctcctctggtcataaggctgcacgctgcgcatgtaccacgcgaagtggccgacctgtccgtgaatgcaagcatgtgtagatgtatgtgagctatgaaaaaggttggtgacgaagatagaaccagaagaggggaagatatcggggtcgtagttcgcatcggctgccgcagttgtttggtttgatttcattctcgtgcatttactaatatttagcatctgttcttgtaatagtcctgtggttgt

SEQ ID NO: 2042 - DNA, 1158 bp, Panicum virgatum
atcaagccttcaggcaagcaactcgagtacttgtcatctcctcctctcccttcctgctgtgaagagggatcaagtgctcattagcaagctagagataggaatcctttattaatctaggctcctgacctacaacctccgatcctcatccccgtcgtaatctctcatatataccgaagctaagatcaccaatggcgggcctgtctcttcagcatcccttggctttctcctttggcatcctaggcaacatcatctccttcatgacctacctggccccactgccgacgttctaccggatctacaagagcaagtcgactgaaggtttccagtcggtgccgtacgtggtgtcgctgttcagcgcgatgctgtggatctactacgcgctgctcaagtccgacgagtgcctgctcatcaccatcaactccgccggctgcgtcatcgagaccctctacatcgtcatctacctcgcctacgcgcccaagaaggccaagctgttcacggccaagatcctgctgctcctgaacgttggcgtgttcgggctcatcctcctcctcacgctgctcctctccgccggccagcaccgcgtcgtcatcctcggctgggtctgcgtcggcttctccgtcagcgtcttcgttgcgccgctcagcatcatccgtcaggtagtgcgcacgaggagcgtggagttcatgcccttctcgctctccctctccctcaccgtcagcgccgtcgtctggttcctctacggcctgctcatcaaggacaaatacgtcgccctaccgaacgtgctggggttcatcttcggcgtcatccagatgggcctctacgcgatctaccgcaacgcgacgccgagggtgccagccaaggaggtggccgacgacgacaaggaggacatggtcgtcaaggtacccgagcacgttgtgaccattgccaagctgggcgagccggccgtggagctcaagacccacgaggtgcgtcctgccatggccacgcccacggcggatgccgggccggagaacgacaaggctgtggccaacaagcaggagaacggcacggtgccgggcaagggaagcaacactgaccaagtttagattcatcatgagtatctcctggtcataagtaaggctgcacgctgcgcatgtaccacgcgaagtggctgagctg

SEQ ID NO: 2043 - DNA, 1241 bp, Setaria italica
cctatctcttacaattaagaagaggggtcatcaagtagtgtccatcttcaatcttcatacgtagcaagcctgctaaaacacaaacaaattaaaccagcctccttgttaactttcgtatcaaagctaacattttccaatggctggcctatctcttgatcatccattggccttcacctttggcctcctcggcaacatcatctccttcatgacctacctggccccactgccgacgttctaccggatctacaagaccaagtcgacggagggattccagtcggtgccttacgtggtggctctgttcagcgcgatgctgtggatctactacgcacttctcaagtccgatgagttcctgctcatcaccgtcaacgccgccggctgcgtcatcgagactctatacatcaccatgtacctcgcctacgcgcccaagaaggccaagctgttcacggccatgatcctgctgctcctgaacgtgggcgtgttcgggctcatcctcctcctcacgatgctacttgccgccggcgagaagcgcgtcgtcctcctcggctgggtctgcgtcggcttcgccgtcagcgtcttcgtcgccccgctcagcatcattcgccaggtggtgcgcacgaggagcgtggagttcatgcccttcttcctctccctctccctcaccgtcagcgccgtcgtctggttcctctacggcctgctcatcaaggacaaatacgtcgcactaccgaatgtcatcggcttcacctttggggtcatccagatgggcctgtacgctctctaccgcaacgcgacgcccagggtgccagcaaaggaggttgccgacgtcaaggcgacggtggtggacgataccttcaaggtgcctgagcacgtcgtgaccatcgccaagctcggggcgccggccgtggagatcttgaccagcgaggtgcacccggtggagtccccgccaacagaggaggccaagaaggaggacgacgagccgttggaagaagagctgggtgacgcgtcgaaaaagggaagcaacaccactgagcaagtctagaagaaacatgcgtagtctgagtcacaattacggcaacgccacgcgtggtcaagcccatgtactgatgcacacacatagatgtatgcaaaacgtatgtgagctatgcaacaagggagcaagacgagggaaaaagaaggggactaagtctggactggagggccactgctggtgttattttattataatccatagactgttcttgtag

SEQ ID NO: 2044 - DNA, 1446 bp, Sorghum bicolor
atcaagctttcaggcaagcaagcaactcctccagtagtagttgtcacctagctcctctcttcgttctcactgagaagaaggatcaagtgcttataagcaagctacctgcagcttggcatacaaatccttggccaaggtagctagcctactgatctatatacaaactcctcataaacgctcgtaccaaagcaaagatctccaaatggctggcctgtctctacagcatcccatggccttcgccttcggcctcctcggcaacatcatctccttcatgacctacctggcaccactgccgacgttctaccggatctacaagagcaagtcgacgcagggtttccagtcggtgccgtacgtggtggccctcttcagcgccatgctgtggatctactacgcgctgcttaagtccaacgagttcctgctcatcactatcaactccgccggctgcgtcatcgagaccctctacatcgtcatgtacctcctctacgcccccaagaaggcaaagctgttcacggccaagatcttgctcctcctgaacgtgggcgtgttcggcctcatcctcctcctcaccctgctcctctccgccggacagcaccgcgtcgtcgtcctcggctgggtctgcgtcgccttctccgtcagcgtcttcgtcgcgccactcagcatcatccgtcaggtggtgcgcacacggagcgtagagtttatgcccttctcgctctcgctctccctcaccgtcagcgccgtcgtctggttcctctacggcctgctcatcaaggacaaatacgttgccctgccaaacgtgctcggcttcagcttcggtgtcgtccagatgggcctgtacgcgctctaccgcaacgcgacgcccagggtgccgccggccaaggaggtgaccgacgacgacgcggcggcggacggcaccttcaagctgcccggcgagcacgtggtgaccattgccaagctgaccgcagtacctgccgtgtctccgcagctccaggaggaggccaagccggccgacaacggcacgacgccggcgccggcgccggcaaacgatgtccaactcaacgccgagcaagtctagatttccctctcgctctcaaaacatgcgtatagatgtgtatccgggtaggtcataaattaagccgccgcacgtgaagtgggcaaaagccgtgcgtgcctctctgcatgcgcagtatggcactacacgcacacatgatcgatcgagctgctgtgaaagggatgaaaacgagactgagagaaccaccaggaaggggggtagggtctcgccccgggtcgtcgtagtagtttgcgtctgtctgctgctggtgcttcatttcgttctcgcccccattgcatgatgtattgattttattaccttgttattatagttcttggctattaattagctagtgtgtccgtcaccttccatgtaataacaacaatctatatataaat

SEQ ID NO: 2045 - DNA, 1293 bp, Panicum virgatum
gttttggtttcctctctgcattgtgaagaggggacaagtagtgtattgtcaatctgcaatcttggtgcataaatctctgatcaagcaagctaaggctcctaaaacacacgaacaagccagcctgcacgttaaagttccatatcaaagcagaagttttcaatggctggcctatctcttcaccatccattggcctttgcctttggtctccttggcaacatcatctccttcatgacttacctggccccactgccgactttctaccgaatctacaagagcaagtcgactgaaggtttccagtcggtgccgtacgtggtggcgctgttcagcgcgatgctgtggatctactacgcgctgctcaagtccgacgagatcctgctcatcaccatcaacactgccggctgcgtcatcgagaccctgtacatcgtcatctacctcgcctacgcgcccaagaaggccaagctgttcacggccatgatcctgctgctcctgaacgtcggcgtgttcgggctcatcctcctcctgacgatgctgctctccgccggccacagccgcgtcgtcctcgtcggctgggtctgcgtcggcttcgccgtcagcgtcttcgtcgccccgctcagcatcatccgtaaggtggtgcgcacgaggagcgtggagttcatgcctttcttcctctccctctccctcaccgtcagcgccgtcgtctggttcctctacggcctattcatcaaggacaaatacgtcgccctccctaatgtcatcggcttcaccttcggtgtcatccagatgggcctgtacgctctctattgcaacgcgacgcccaggttaccagccaagggtgtagatgctgacaaggataatgaggcggtggacgataccgtcatggtgcccgagcacgtcgtgaccatcgctaagcttggagcgccggccgtggagatgaagacctgcgaggtgcaccccgtggagtcgccgccgacagaggaggcggcgaagcaggaggacgacgagccgtcggtggaggagctggagatggcggggaacaagggaagcaacaacaccgaatcaagtctagatgccacatgcgtagtctgagtcatataattgaaggctacgccaacgccaagtggccaaccccatgtacggatgcacacacctagacgtctatggaagtgagccaccagacgagagggaagaaaaggggaccaaatcctgctgcttttgttattttattattagtccttattctgttcttgaaatagttccatttctttcttattagtatatgtctaacaccttctt

SEQ ID NO: 2046 - DNA, 1465 bp, Saccharum officinarum
aggcccccaacccagctcaggtcctcagactcctcacgccgcgcacgagccggagccgccgagggcgcgcccatccggacccagacagagctcgcctgcgcctgcgcctgcgcctccaccgatcggcaagcggggggaagatgaggggttcgtcgcggagaccggtggccgtggtgatggcctgggtgcggcgccagccgcccaaggtcaaggccttcctcgccgtcgtcgcggggatggccgcgctcgtcttcatccgcttcatcgtccacgaccacgacaacctcttcgtcgccgccgaggccgcacacgcgctcgggatcgccgtgctcatctacaagctcaccaaggagaagacctgcgccggattgtcactcaagtctcaggatttgaccgcattgtttctagctgttaggttgtattgtagttttgttatggagtatgacatccatacaattctggatacagctacacttgcagctactctttttgttatttacatgattcggttcaaactgagatcaacatatatgctggacaaagacaactttgccttgtactatgtggtattgccttgtgctgtgctagcgctacttgttcatccttcaacatcgcacaacatagtgaacagaatctgctgggccttctgtgtttatttggaagcagtttcagtgttgccccagttgcgcttgatgcaaaataccaagattgttgagccattcacagctcattatgtgtttgcactgggtgttgcaaggtttcttagctgtgcacactgggtccttcaggttttggatacccatggccgtttgttgactgctctgggctatggtttgtggccctcaatggtgcttctctctgaaattgttcagacattcatccttgcagatttctgctactactatgtgaagagtgttttcggtgggcaactggtgctgcggcttccgtccggggtggtgtgaaaactgcagcgagatagaaaagcataccgttcgtttcttctctcttcatcagcatacaaagcaacagccactgtgctcctagtgcccaaacttttcaatcctaaagtgaattagcggagcccagttcgctctaacttttttgtttcagttgtaaactgtttacgtgaaacctgtaccaataccgtgaaacgtagggtgtccatctgacttttttcgtccaggctagagttgaagcacgtagcttccacacccgacttgtctcatttccagagtagaggccagattctcccatttcaatgactgtttatctttcgttctcgttcttctgggtgttgtacaaatagacggaatgcgaggatgcattgcagttaagcattggctccagcctccagacgtctggatggatatgctttgcttcagcatcatagttggtgcttagatctggactctgctggaagaaatgtgaagctgcaagtccagcgatgcttacgatttggggcctg

SEQ ID NO: 2047 - DNA, 1264 bp, Sorghum bicolor
cctccgcctcgcctcgcctcgcccgtcccaggccccccaccccagctcaggtcctcagactcctcacgccgtgcacgagccacgagcccgagacccggacagagctcgcctgcgcggctgcgcctccaccgatcggcaagcggggggagatgaggggttcgtcgcggaggccggtggccgtggtgatggcctggatgcggcgccagccgcccaaggtcaaggccttcctcgccgtcgtcgcggggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggattgtcactcaagtctcaggatttgaccgcattatttctggctgttaggttgtattgtagttttgttatggaatatgacatccatacaattctggatacagctacacttgcagctaccctttttgttatttacatgattcggttcaaactgaggtcaacatatatgctggacaaagacaactttgcattgtactatgtggtattgccttgtgctgtgctagcgctacttattcatccttcaacatcgcacaacatagtgaacagaatctgctgggccttctgtgtttatttggaagcagtttcagtgctgccccagttgcgcttgatgcaaaataccaagatcgttgagccgttcacagctcattatgtgtttgccctgggtgttgcaaggtttcttagctgtgcacactgggtccttcaggttttggatacccgcggccgtttgttgactgctctgggctatggtttgtggccctcaatggttcttctctccgaaattgttcagacattcatccttgcagatttctgctactactatgtgaagagtgttttcggtgggcaactggtgctgcggcttccgtccggggtggtttgaaaactgcagcgagatagaaaagcataccgttcgtttcttctctcttcatcatacgaagcagcagtcactatgctcctagtgcccaaacttttgaatccttaagtgaattagcggagccctgttcgctctaactttttttcttaagttgtaaactgtttacatgaaaaactgtaccaataccgtgaaacgtaggctgttcatctaactttttcgtccaggctagagttgaagcacgtagcttccacacccgacttgtcgcatttccagaatagaggccatttcaatgactgttt

SEQ ID NO: 2048 - DNA, 1233 bp, Zea mays
ctcaggagtcaggtcctcacgccgcgcacgggccagagacgacgagagcgcgcccatccggacccggacagagctcgcctgcgcctgcgcctccaccgatcggcaagcgggaggggagatgaggggttcgtcgcggaggccggtcgccgtggtgatggcctgggtgcggcgccagccgcccaaggtcaaggccttcctcgccgtcgtcgcggggatggctgcgctcgtcttcatccgcttcatcgtccacgaccacgacaacctcttcgtcgccgccgaggccgcgcacgcgctcgggatcgccgtgctcatctacaagctcaccaaggagaagacctgcgccggattgtcactcaagtctcaggatttgactgcattatttctggccgttaggttgtattgtagttttgttatggagtatgacatccatacaattctggatacagctgcacttgcagctactctttttgttatttacatgattcggttcaaactgaggtcaacatatatgctggacaaagacaactttgccttgtactatgtgatattgccttgtgctctgctagcgctacttgttcatccttcaacatcgcacaacatagtgaacagaatctgctgggccttctgtgtttatttggaagcagtttcagtgctgccccagttgcgcctgatgcaaaataccaagattgttgagccgttcacagctcattatgtgtttgcactgggtgttgcaaggtttcttagctgtgcacattgggtccttcaggttttggatacccgaggccgtttgttgactgctctgggctatggtttgtggccttcaatggtgcttctctccgaaattgttcagacattcatccttgcagatttctgctactactatgtgaagagtgtttttggtggccaactggtgctgcggcttccgtccggggtggtgtgaacactgcagcgcgatagaagaagcataccgtccatttcttctgtgttaaatcacacaaagcaacagtcatgctcctagtgcccaaactttttcactctctcaaagtggattagcagagccccgttaatcttttttacttgtaaactgtttacgtgaatactgtaccaacaccgtggaacgtaggccgtccatctgactttttcatccaggctagagttgaagcttgtcgcatttccagaatagagaccagattctcccatttcattgactggtagtctattgtagaaacagac

SEQ ID NO: 2049 - DNA, 1112 bp, Oryza sativa
gcgcactgcacgccgcaacacaacgcgctcgcctcgcctcgccccgatcggtggtggtgctcgccgtcgccgggcggcgctagggtggccggagaggctccggagagtaggaggaggaggaggagccggagatgagggggtcgaggaggccggtggccgtggtgctgagctgggtgcggaggcagccgcccaaggtcaaggcgttcctcgccgtggtcgccgggatggccgcgctcgtcttcatccgcttcatcgtccacgaccacgacaacctcttcgtcgccgccgaggccgcccacgcgctcggcctcggagtcctcatctacaagctcaccaaggagaagacctgcgccggactctcactcaagtctcaggatttaacagcactatttctggctgttaggctgtactgcagttttgttatggagtatgacatccataccatacttgatacagctacactagcagctactctctttgtcatctacatgattcggttcaaactgaggtcaacttatatgctggacaaggacaattttgcattgtactacgtggtgttaccttgtgctggcctagctctcctggttcatccttcaacatcgcataacatcatcaacaggatctcctgggctttctgtgtttatttggaagctgtttcagtgctgccacagttgcgtttgatgcaaaacacaaagattgtggaaccatttacagctcattatgtgtttgcattgggtgttgcaaggtttcttagctgcgcacactgggtccttcaggttttggatacccgtggtcgcttgttgactgctctgggctatggtctctggccttcgatggtgcttctctctgaaatcgttcagacgttcatccttgctgatttctgctactactatgtgaagagtgtttttggtgggcaacttgtccttcgacttccgtctggagtggtgtaaaaatgcagcaggatgcaacatgttatgggctttgtgcacgtttagtacatcgtcggataccagagccttgtttgcttgataatttttttcagttacaaattgctcatgtgaaaaatgtacctaccagagaccgtgatgaaatctagagactagtttttaact

SEQ ID NO: 2050 - DNA, 1324 bp, Oryza sativa
caaccagaacccccacgcactcacgcgcactgcacgccgcaacacaacgcgctcgcctcgcctcgccccgatcggtggtggtgctcgccgtcgccgggcggcgctagggtggccggagaggctccggagagtaggaggaggaggaggagccggagatgagggggtcgaggaggccggtggccgtggtgctgagctgggtgcggaggcagccgcccaaggtcaaggcgttcctcgccgtggtcgccgggatggccgcgctcgtcttcatccgcttcatcgtccacgaccacgacaacctcttcgtcgccgccgaggccgcccacgcgctcggcctcggagtcctcatctacaagctcaccaaggagaagacctgcgccggactctcactcaagtctcaggatttaacagcactatttctggctgttaggctgtactgcagttttgttatggagtatgacatccataccatacttgatacagctacactagcagctactctctttgtcatctacatgattcggttcaaactgaggtcaacttatatgctggacaaggacaattttgcattgtactacgtggtgttaccttgtgctggcctagctctcctggttcatccttcaacatcgcataacatcatcaacaggatctcctgggctttctgtgtttatttggaagctgtttcagtgctgccacagttgcgtttgatgcaaaacacaaagattgtggaaccatttacagctcattatgtgtttgcattgggtgttgcaaggtttcttagctgcgcacactgggtccttcaggttttggatacccgtggtcgcttgttgactgctctgggctatggtctctggccttcgatggtgcttctctctgaaatcgttcagacgttcatccttgctgatttctgctactactatgtgaagagtgtttttggtgggcaacttgtccttcgacttccgtctggagtggtgtaaaaatgcagcaggatgcaacatgttatgggctttgtgcacgtttagtacatcgtcggataccagagccttgtttgcttgataatttttttcagttacaaattgctcatgtgaaaaatgtacctaccagagaccgtgatgaaatctagagactagtttttaactacctagcttttatcatacgatcagttgtcgcaggccccaatagatagaccaagatagttcccctaatttggatctcgttattgatcacctcctgctgttggtgtgcaaagtttgtttatctagcagaactctctagtcagcatctatgatgggccagaagcaaacccacgtgacatcagagaccatac

SEQ ID NO: 2051 - DNA, 1268 bp, Panicum virgatum
cccgtccccattaaccccgccatccctcttccccgcccgtcccagccccctcgcgccgcgccgcacacgagccggaatccggagccggagctcgcctgcctgcgcctccaccgatcggcgggatgaggggttcctcgcggaggccgctggccgcggtcatggcctgggtgcggcgccagccgcccaaggtcaaggccttcctcgccgtcgtcgccgggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggactgtcactcaagtctcaggatttgacagcattatttctggctgttaggttgtactgcagctttgttatggagtatgacatccatacgattctggatacagctacactagcagccactctttttgttatctatatgattcggttcaaactgaggtcaacatatatgctggacaaagacaacttcaaattgtactatgtggtagtgccttgtgctgtgctaacgtttattgcccatcctacaacatcgcacaacatagtgaacagactttgctgggccttttgtgtttatttggaagctgtttcagtgctgcctcagttgcgcttgatgcaaaataccaagattgttgagccattcactgctcattatgtgtttgcactgggtgttgcaaggtttctgagctgtgcacactgggtccttcaggttttggatacccgtggccggttgttgactgctctgggctatggtctgtggccatcgatggtgcttctctccgaaatcgttcagactttcatcctcgcagatttctgctactactatgtgaagagtgtttttggtgggcaactggtgctgcggctcccctccggggtggtctagaaactgcagcaggatacaaagcatactgttggtttcttctctgctcatcaatcatcatacaatgcaacagtcattatgctccttgtgcctaaactctagcattatcgagtggttagcagagcctcgttcgctctaattttttttctcttttcatctgtaaactgtttacgtgaaacctgtaccaaataccgtgaaacgtaggttgtccatcagacttttccgtccaggctagagttgttgcagttccagaatagagacagacgggatttccccattgcaatgactgcgttcctccttcgttgtcgctgatctcgtcctatcgct

SEQ ID NO: 2052 - DNA, 1442 bp, Panicum virgatum
tttaaaaactttaaaagatttgcttgctcgagggggcccgggcccacaggcgctgtcaatgaatgccacgaatcgaaacagctgcaacaaccaacccgaccggacccgtccccattaactccgccacccccgcccccgcccccgcccgtcccagtcccctcgcgccgcacacgagccggaatccggagccggagctcgcctgcctgcctgcgcctccaccgatcggcgccgggatgaggggttcctcgcggaggccgctggccgcggtcatggcctgggtgcggcgccagccgcccaaggtcaaggccttcctcgccgtcgtcgccgggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggactgtcactcaagtctcaggatttgacagcattatttctggctgttaggttgtactgcagctttgttatggagtatgacatccatacaattctggatacagctacactagcagcaactctttttgttatttatatgattcggttcaaactgagatcaacatatatgctggacaaagacaacttcaaattgtactatgtggtagtgccttgtgcggtgctaacgtttgttgcccatcctacaacatcgcacaacatagtgaacagactttgctgggccttttgtgtttatttggaagctgtttcagtgctgcctcagttgcgcttgatgcaaaataccaagattgttgagccattcacagctcattatgtgtttgcactgggtgttgcaaggtttctgagctgtgcacactgggtccttcaggttttggatacccgtggccggttgttgactgctctgggctatggtctgtggccatcaatggtacttctttccgaaatcgttcaaactttcatcctcgcagatttctgctactactatgtgaagagtgtttttggtgggcaactggtgctgcggctcccctccggggtggtctagaaactgcagcaggatacaaagcatactgttggtttcttctgtgctcatcaatcgtcatacaatgcaacagtcattatgcttcttgtgcccaaactttagcattatcgagtggatagcagagactcgttcgctctactttttttcttttcatctgtaaactgtttacgtgaaaccttgtaccaaaatactgtgaaacgtaggttgtccatctgacttttttcgtccaggctagagctgttgcagtttcagaatagagacagaaacgggatttccccattttcaatgactctgttcctctttgttgtcgctgatctcgtcttatcgctgtgttaatgttaagaatgtggaggatgctttgcttggcatatctctggactgacggcatac

SEQ ID NO: 2053 - DNA, 1060 bp, Echinochloa colona
ctgcaacaacccgacccatccttaactccgccatccctccctcctgcgctcccgtcccagtcctcacgccgcacacgagccggaaggagctcgcctgctcgcgcctccaccaccgatcggccagccagcgcgggaggggaaggggggagatcagatgaggggttcgtcgcggaggcccgtggccgcggtcatggcctgggtgcggcgccagccgcccaaggtcaaggccttcctcgccgtcgtcgccgggatggccgcgctcgtcttcatccgcttcatcgtccacgaccacgacaacctcttcgtcgccgccgaggccgcgcacgcgctcggcatcggtgtccttatctacaagctcaccaaggagaggacatgcgccggattatccctcaagtctcaggatttaactgcgttgtttctagctgttagactgtactgcagctttgtcatggagtatgacatccatacaattctggatactgccacacttgtagccacactgtttgttatttacatgatacggttcaaactgaggtcaacttatatggtggacaaggacaattttgcattgtactatgtggcggtaccttgtgctgtactggcactacttattcatccttcgacatctcacaacatcgttaaccggatctcctgggcgttctgtgtttacttggaagctgtttcagtgctgccacagttacgcttgatgcaaaataccaagattgttgaaccatttacagcccactatgtatttgcactgggggtcgcaaggtttcttagctgtgcccactgggttctacaggttttggacacgcgaggccgtctgttgacagctctcgggtatggtttgtggccatccatggtgcttctgtcagaaattgtgcaaacattcatccttgcggatttctgctactactatgtgaagagtctggttggtgggcaactggtactacggcttccctcaggggtggtgtaagaagtgcagcaggatacaaaaactttgtggttcacctattcttatgtaccctgaataacagttatgctctagcccccaacctgt

SEQ ID NO: 2054 - DNA, 1269 bp, Setaria italica
cgccgcacacgtgccggaacccgtaacccaggggcgcgcccatccgggagccgcagcccgccggagctcgccttgccttcgccttcgccttcaccttcaccgatcgacgagcgcgacgggagggagggagtgggggagatgaggggttcgtcgcggaggccgctggccgcggtcatggcctgggtgcggcgccagccgcccaaggtcaaggctttcctcgccgtcgtcgcggggatggccgcgctcgtcttcatccgcttcatcgtccacgaccacgacaacctcttcgtcgcctccgaggccgcgcacgccatcgggatcggcgtgctcatctacaagctcaccaaggagaagacctgcgccggactgtcactcaagtctcaggatttgacagctttatttctggctgttaggttgtactgcagctttgttatggagtatgacatccatacgattctggatacagctacactggcagctactctttttgttatttatatgattcggttcagactgaggtcaacatatatgctggacaaagataacttcaaattatactatgtggtagtgccttgtgctgtactaacaacttttgctcatcctacaacatcgcacaacatagtgaacagactttgctgggccttttgtgtttatttggaagctgtttcagtgctaccccagctgcgcttgatgcaaaatacgaagattgttgagccattcacagctcattatgtgtttgcactgggtgtcgcaaggtttcttagctgtgcacactgggtccttcaggttctggatactcgtggccgtttgttgacagctctgggctatggtctgtggccatcaatggtgcttctctccgaaatcgttcagacattcatcctcgcggatttctgctactactatgtgaagagtgtttttggtgggcagcttgtgctgcgactcccgtccggggtggtgtaaaactgcagcaggatacggagcacactgttggtttcttctctctctgcccatcatacaatgcaacagtcattatgctcgtgctcctggtgcccccaaactttagcattgtcgagtggatagcagagcctcgttcgcgctatttcttttttttttcgtttgtaaactgtttacatgaaacctgtaccaaacaccgtgaaacgtaggttgtccatctgactttttaacgtccaggctagagttgttgcagttccacaatagagacagagacgggattttcccgatttcagtgaatgtgttcctctttcgttg

SEQ ID NO: 2055 - DNA, 2238 bp, Oryza sativa
gaaaaaacggaagacgtgtagagaaaatgctactaataaaattatagataaggtttctttaagttgcaccacaaaacgatggaacatgtgactgctagaagtagagtgccaagatttgtgcagaattctgccaagaatttccccccgttggcacgggcctcccattaattgcaacccccgcactccaaaacggcaaacagccgggcagccagccagccatccggatctatcccaaaaacaaaacaacgcacacgcgcccgcacactatccgggccaccgcatcgagggggaaaaaaacgagagaggaaaaaaaaaagaaaaaaaacaaggggagaaaaaaaccctccccgtgttctccgatcggcggcgaggcgaggcgagggcggcggagatgaggggggcgaagcggccgctcggcgcggtgatggcgtgggtgcggcggcagccgcccaaggtgaaggccttcctggccgtcgtcaccggcatggccgcgctcgtcttcatccggttcatcgtccacgaccacgacaacctcttcgtcgccgcggaggccgcgcacgcgctcggcatcgccgtgctcatctacaagctcaccaaggagaagacctgcgccggactatccctcaagtctcaggatttaactgcgttgtttctagctgttagactatactgcagcttcgttatggagtatgacatccatactgtgctagatactgctacacttgcagctacactttttgtaatctacatgatccggttcaaattgagaccaacttatatggtggacaaggacaattttgcattgtactatgtggtggtaccttgtgctgtgctagcactgcttattcatccttcaacatctcataacattgtgaaccgtatcagctgggcattttgtgtttacttggaagctgtctcagttctaccacagctgcgtttgatgcaaaacacaaagattgttgagccgttcacagcacactatgtgtttgcattgggagttgcaaggtttcttagctgtgcacactgggttcttcaggtattggatactcgtggtcgattgttgactgctctgggctatggcttgtggccatctatggtgcttctgtcggaaatcgtgcagacattcatccttgctgatttctgctactactatgtgaagagtttggtcggtgggcagctggtgctacggcttccatctggggtggttcaaaatggagagagaaagagttatgacgtgctccagcgattcgggtttcataccatctgtatggtggcgttcgggcacgacctgccctgcctcgccgacggcggggtcatggaggatgccaggtcggatttcatgcactccttcggcgaggcgcagaaccttgtcgtcggacgcttctttgatctcatcgaggtctcctggaagatcaagaagtggctcaacgtcggcaccatacgccgtctgaggaaggccatcgccgacgtccacaccttcgccatggacatcgtccgcgcccggcgccagagcgcgtccgtgcaagacagagacgacgtcctgtcgaggtttgtggcgagtgacgagcacagtgacgaggtcctccgcgacatcgtcctcagcttcctcatcgtcggccgtgacacgacggcgtcggggctgagctggttcttctgtctcttgtcgtcccggccggacgtcgtggcgcgcatcgccgacgaggtccgcgcggtgaggaagccgaccgacacacgcctcggcgagccgtttcggttcgatgcgctctgggagatgcactacctccatgccgcactcacggagtcgatgcggttgtacccgccggcgtcagtcgtgcgcggcggacgacacactccccgacggcacgctcgtccgcgccggttggtccgtgacgtacagcgcatacgccatcgagcgaggactgcttggagtacaggccggagcggtggctcggcgaggacggcgtgttccagccggcgagccagagaaagagagatgccggcgagccagagaaagagagattgacaagtgagcccgtgggcataattttttcagtagaagatcttgccatactcctccttcatgacataacctaaataaccgttttcttagcaaacacttgctctgtaattctagattctgaatgtcaaggccgccgcactcctttagcttgcatggaacactccattggtgtttaccccttgccccgtacccacaggtcccacatccatgcgtaccac

SEQ ID NO: 2056 - DNA, 1812 bp, Oryza sativa
gccagccatccggatctatcccaaaaacaaaacaacgcacacgcgcccgcacactatccgggccaccgcatcgagggggaaaaaaacgagagaggaaaaaaaaaagaaaaaaaacaaggggagaaaaaaaccctccccgtgttctccgatcggcggcgaggcgaggcgagggcggcggagatgaggggggcgaagcggccgctcggcgcggtgatggcgtgggtgcggcggcagccgcccaaggtgaaggccttcctggccgtcgtcaccggcatggccgcgctcgtcttcatccggttcatcgtccacgaccacgacaacctcttcgtcgccgcggaggccgcgcacgcgctcggcatcgccgtgctcatctacaagctcaccaaggagaagacctgcgccggactatccctcaagtctcaggatttaactgcgttgtttctagctgttagactatactgcagcttcgttatggagtatgacatccatactgtgctagatactgctacacttgcagctacactttttgtaatctacatgatccggttcaaattgagaccaacttatatggtggacaaggacaattttgcattgtactatgtggtggtaccttgtgctgtgctagcactgcttattcatccttcaacatctcataacattgtgaaccgtatcagctgggcattttgtgtttacttggaagctgtctcagttctaccacagctgcgtttgatgcaaaacacaaagattgttgagccgttcacagcacactatgtgtttgcattgggagttgcaaggtttcttagctgtgcacactgggttcttcaggtattggatactcgtggtcgattgttgactgctctgggctatggcttgtggccatctatggtgcttctgtcggaaatcgtgcagacattcatccttgctgatttctgctactactatgtgaagagtttggtcggtgggcagctggtgctacggcttccatctggggtggttcaaaatggagagagaaagagttatgacgtgctccagcgattcgggtttcataccatctgtatggtggcgttcgggcacgacctgccctgcctcgccgacggcggggtcatggaggatgccaggtcggatttcatgcactccttcggcgaggcgcagaaccttgtcgtcggacgcttctttgatctcatcgaggtctcctggaagatcaagaagtggctcaacgtcggcaccatacgccgtctgaggaaggccatcgccgacgtccacaccttcgccatggacatcgtccgcgcccggcgccagagcgcgtccgtgcaagacagagacgacgtcctgtcgaggtttgtggcgagtgacgagcacagtgacgaggtcctccgcgacatcgtcctcagcttcctcatcgtcggccgtgacacgacggcgtcggggctgagctggttcttctgtctcttgtcgtcccggccggacgtcgtggcgcgcatcgccgacgaggtccgcgcggtgaggaagccgaccgacacacgcctcggcgagccgtttcggttcgatgcgctctgggagatgcactacctccatgccgcactcacggagtcgatgcggttgtacccgccggcgtcagtcgtgcgcggcggacgacacactccccgacggcacgctcgtccgcgccggttggtccgtgacgtacagcgcatacgccatcgagcgaggactgcttggagtacaggccggagcggtggctcggcgaggacggcgtgttccagccggcgagccagagaaagagagatgccggcgagccagagaaagagagattga

SEQ ID NO: 2057 - DNA, 1001 bp, Echinochloa colona
cttcgaccggaggtggtggtgcgaacgcgaggcgaccgaggggagacgccatgagggggacgaagcggccgctcggcgcggtgacgtcatgggtgcggcggcagccgcccaaggtgaaggccttcctggccgtggtcaccggcatggccgcgctcgtcttcatccgcttcatcgtccacgaccacgacaacctcttcgtcgccgccgaggccgcgcacgcgctcggcatcggtgtccttatctacaagctcaccaaggagaggacatgcgccggattatccctcaagtctcaggatttaactgcgttgtttctagctgttagactgtactgcagctttgtcatggagtatgacatccatacaattctggacactgccacacttgtagccacactgtttgttatttacatgatacggttcaaactgaggtcaacttatatggtggacaaggacaattttgcattgtactatgtggcggtaccttgtgctgtactggcactacttattcatccctcgacatctcacaacatagtgaacagaatctgctgggccttttgtgtttatttggaagctgtttcagtgctgccccagttacgcttgatgcaaaataccaagattgttgaaccattcacagctcattatgtgtttgcactgggtgttgcaaggtttcttagctgtgcacactgggtccttcaggtcttggatactcgtggccgtttgttgactgctctgggctatggtctgtggccatcaatggtgcttctctccgaaatcgttcagacattcatcctcgcggatttctgctactactatgtgaagagtgtttttggtgggcaattggtgctgcgactcccgtccggggtggtgtaaaaactgcagcaggatacaaagcatgttggtttcttctctgcccatcatacaaagcaacagtcatcatgctactagtgcccaaactttagcattgtcaagtggatagcagagcctcgttcgctctaattttcc

SEQ ID NO: 2058 - DNA, 1226 bp, Pennisetum glaucum
aaaaatactacggcagaaaaaaataataagaagaaaacactcccgtgttcttcgaccggaggtggtggtggtgcgaacgcgaggcgaccgaggggagacgagagagagacaccatgagggggacgaggcggccgctcggcgcggtgacgtcgtgggtgcggcggcagccgcccaaggtgaaggccttcctggccgtggtcgccggcatggccacgctcgtcttcatccgcttcatcgtccacgaccacgacaacctcttcgtcgccgccgaggccgcgcacgcgctcggcatcggcgtcctcatctacaagctcaccaaggagaggacctgcgcaggactatccctcaagtctcaggatttaactgcattgtttctagctgttagactgtactgcagctttgtcatggagtatgacatccataccattctggacactgccacacttgtagccacactgtttgttatatacatgataaggttcaaactgaggtcaacttatatggtcgacaaggataattttgcattgtactatgtggtgttaccttgtgctgtactggcactacttgttcatccttcaacatctcacaacattgtgaaccggatctcctgggcattttgtgtttacttggaagctgtttcagtgctgccgcagttacgcttaatgcaaaacactaagattgttgaaccgtttactgctcactatgtatttgcattgggtgtcgcgaggtttcttagctgtgcgcactgggttctacaggttttggacacgcgtggccgcctgttgacagctctcggctatggtttctggccatctatggtgcttctgtcagaaattgtgcagacattcatccttgcagatttctgctactactatgtgaagagtctggtcggtgggcaactagtgctacggcttccctcaggagtggtgtaagaagtgcagcaggatacaaaacttggcggttcacccattcttatgtagcctgaataactgttctagccccccgacctgcatctcgtctaatgtgagaccagagcctcctttagttgatgttacaagttgtgactgtttatgacagaattgctccgagggtcctcttaagagataggttgtcattgagactgtttgtagtgtgtgggccctgatacatagtacttagtttctgtatcactgtcgtggtcgtagaaccaggtggttaatggtctgttttggattataatcttagca

SEQ ID NO: 2059 - DNA, 1334 bp, Sorghum bicolor
gccaacgcagccagccataactccgccccgatctatccgtcgcccccccaaaacacgagagcgcagcaagagagagaaacaaaaaaataaataataaggaagaaaataataagaaaaaaaacacactcccgtgctcttcgaccggcggtggtggtggtgcgaacgcgaggcgaccaaggggagacgagatgaggggggcgaagcggccgctcggcgtggtgacgtcatgggtgcggcggcagccgcccaaggtgaaggccttcctagccgtcgtcaccggcatggccgcgctcgtctttatccgcttcatcgtccacgaccacgacaacctcttcgtcgccgccgaggctgcgcacgcgctcggcataggcgtcctcatctacaagctcaccaaggagaagacctgcgccggactatccctcaagtctcaggatttaactgcgttatttctagctgttagactgtactgcagctttgtcatggagtatgacatccatacgattctggacactgctacccttgtagccacactgtttgttatttatatgatacggttcaaactgaggtctacttatatggtggacaaggataactttgcattgtactatgtggtgctaccatgtgctggactggcactacttattcatccttcaacatcacataacattgtgaaccggatctcttgggcattctgtgtttatttggaagctgtttcagtgctgccacaattacggttgatgcaaaatactaagattgttgaaccgtttactgctcactatgtatttgcattgggggttgcaaggtttcttagctgcgcccactgggttctacaggttttggacacgcgtggccgtctgttgacagctctcggctatggtttgtggccatctatggtgcttttatcagaaatcgtgcagacattcatccttgcagatttctgctactactatgtgaagagtctggttggtgggcaactggtgctacggcttccctcaggggtggtgtaagaagtgcagcaggatacaaaacttagtgcttcaccgattgatatgtactctgaataacagtttatgctctagtgcccaacctgggagccttttttagttgatgatgttacgagttatgactatgtatgacaaaattgctgcaagggtgtcctcttaaaagttaggttctcactgagactgcttagcggcgcgtttcttgatacccaatctctgagtacttagcttctgctgtatgactgtcgtggtcttagaatcgggtggttaatggtctctttggattataacgctttcatatgtttttgcgacaagcaaattgatcttgatctt

SEQ ID NO: 2060 - DNA, 1210 bp, Brachypodium distachyon
acacaccggaagacccacaagagtccccaggccggacctctcgcgcacgggtcgggacccccgccggagcaaggaacgtccctgctctctctttctcgcgcgccgcggcggcccgccggagcagcagcagtagcaggaggcggaggagatgagggcgtcgcggaggccgatgggggtggtgctggggtgggtgcggaggcagccgccaaaggtcaaggctttcctcgccgtcgtcgccggcatggccgcgctcgtcttcatccgcttcatcgtccacgaccacgacaacctcttcgtcgccgcagaggccgcgcacgccatcggcatcgccctactcgtctacaaactcaccaaggagaagacctgcgcaggactgtcactcaagtctcaggacttaacagcattattcctggctgttaggttgtactgcagctttgttatggagtatgacatccatactatactggattcagctacactagtagctactcttttcgtcatttacatgatccggttcaaattgaggtcaacttatatgctggacaaggacaattttgcattgtactatgtggtggtaccttgtgctgtgctggccgtacttgttcatccttcaacatcacatatcatgatcaacaggatctgttgggccttctgtgtttacttggaagctgtttcagtgctgccccagttgcggttgatgcaaaacacaaagattgttgaaccgttcacagctcattatgtgtttgcgttgggtgttgcaaggtttcttagctgtgcacactgggtccttcaggtcttggatactcgtggccgtttgttgactgctctgggctacggcctgtggccttcaatggtgcttctctctgaaatcgtccaaacgttcatccttgcagatttctgctactactatgtgaagagtgttgttggtggacagctggtgctgcgacttccttccggggtggtgtaaaatcttcagcaggataacttatttgctccgtcttagtgtcgaacagtcgttctgcttctagcgcccaaccatgtgggaacgggattcaagagccttgtttgctgcttcttttttccagttataaactgttactgtgaaaattgtaccagagatcgttgtggagcttaggttactgagaagactatctatctatatatagctgactgtttatcacccagaatagtagtttccattcaagtactc

SEQ ID NO: 2061 - DNA, 1181 bp, Avena sativa
taaacggaaataaatcccgtgttctccgatcggaggtggtggtggtgaggcgacgcgaccgaggctcaggcgacgatgagggggacgaagcggccgctcggcgtggtgacggcatgggtgcggcggcagccgcccaaggtgaaggccttcctggccgtggtcacgggcatggccgcgctcgtcttcatccgattcatcgtccacgaccacgacaacctcttcgtcgccgccgaggccgcgcacgccctcggcatcgccgtcctcatctacaagctcaccaaggagaagacctgcgcaggactatcccttaagtctcaggatttaactgcattgtttctagctgttagactatactgcagctttgtcatggagtatgacatccatactgtgttggatactgctacacttgtggcgacactttttgttatttacatgattcggttcaagttgaggtcaacttatatggtggacaaggacaactttgcattgtactatgtggtggtaccttgtgctgcgttggcgctacttgttcatccttcaacatctcacaacattttaaaccggttcagctgggcattctgtgtttacttggaagctgtttcagtgcttccacaattgcgtttgatgcagaatactaagattgtggaaccattcacagctcactatgtgttcgcactgggagttgcaaggtttcttagctgtgcccactgggttcttcaggttctggatactcgtggccgcctgctgactgctctgggctatggtttgtggccatcgatggtgctcctgtcagaaatcgtgcagacgttcatcctcgcggatttctgctactactatgtgaagagcctcgtcggcggacagctggtgctacggcttccctccggggtggtgtaggagccacagcaggacctcccagcttactgtactctgaacaacaggcatcgaatgctctagcgccctgaccctctgcgtgcttgtcgtcagacataggaaagaacaccggacatgttttcagttacagactattagcagtcagtgagagaatcgcagcagacagacattaggttttgtcgacgtgacttgtaacagcgtatgcctggatatacattacctgacctgagtattttagcttccttatatgtgtttgtcgttcgctattctagaaattggaaggcattagc

SEQ ID NO: 2062 - DNA, 1166 bp, Secale cereale
aaaaataactcacgcgtacgaacgctgccgcagcgaaggcagggcggaaaaataaacgaaaaaaaaggaaataaatcccgtgttctccgatcggaggaggcgacgggcgacgatgagggcgtcgaagcggccgctcggcgtggtgatggcgtgggtgcgccggcagccgcccaaggtcaaggccttcctcgccgtggtcaccggcatggccgcgctcgtcttcatccgcttcatcgtccacgaccacgacaacctcttcgtcgccgccgaggccgtgcacgcgctcggcatcgccgtgctcatctacaagctcaccaaggagaggacttgcgccggactatcccttaagactcaggatttaactgcattgtttctagctgttagactatattgcagctttgtcatggaatatgacatccatactgtgttagatactgctacacttgtggctacactgtttgttatctacatgattcggttcaaacttaggtcaacttatatggtggacaaggacaactttgcattgtactatgtggtgataccctgtgctgtgttggcgctacttgttcatccttcaacgtctcacaacattgtaaaccgatttggctgggcgttctgtgtttacctggaagccgtgtcagtgctgccacaactgcgtttgatgcaaaataccaagattgtggaaccgttcacagctcactatgtgtttgcgctgggggttgcgaggtttcttagctgtgcccactgggttctccaggttttggacacccgtgggcgcctgttgactgcgctgggctacgggttgtggccgtcgatggttctcctgtcagaaatcgtgcagaccttcatcctcgcggatttctgctactactatgtcaagagcctggtcggcgggcagctggtgctgcggctaccctccggggtggtgtaggcgggaggatctctgcagcgggagaaacgactcggtggttcacccgtcgggcgtgcctgagttggttatttccagttacagcttaagtgttagtgagaaaatggcagcagcagcagacataggcttgtcggtgtgtgtgtgtgtgactggtaacagcagcgtatgtatgacctaacttgagagttaattttagcttccggtatgttgtttggggcctgtatggctctttcttggg

SEQ ID NO: 2063 - DNA, 1248 bp, Setaria italica
aaataataataataagaaaacactcccgtgttctacgaccgcaggtggtggtggtgcgaacgcgaggcgaccgaggggggagacgccatgagggggacgaagcggccgctcggcgcggtgacgtcgtgggtgcggcggcagccgcccaaggtgaaggccttcctggccgtggtcgccggcatggccgcgctcgtcttcatccgcttcatcgtccacgaccacgacaacctcttcgtcgccgccgaggccgcgcacgcgctcggcatcggcgtcctcatctacaagctcaccaaggagaggacctgcgccggactatccctcaagtctcaggatttaactgcgttgtttctagctgttagactgtactgcagctttgtcatggagtatgacatccataccgttctggacactgccacacttgtggccacactgtttgttatttacatgatacggttcaaactgaggtcaacttatatggtcgacaaggataattttgcattgtactatgtggtgttaccttgtgctggactggcactacttattcatccttcgacatctcacaacattgtgaaccggatctcctgggcgttttgtgtttacttggaagccgtttcagtgctgccgcagttacgcttaatgcaaaacactaagattgttgaaccatttactgctcactatgtatttgcactgggtgttgcaaggtttcttagctgtgcgcactgggttctacaggttttggacacgcgtggccgcctgttgacagctctcggctatggtttatggccgtctatggtgcttctgtcagaaatcgtgcagacattcatccttgcagatttctgctactactatgtgaagagtctggttggtgggcaactggtgctacggcttccctcaggggtggtgtaagaagttcagcaggttacaaattccgcggttcacccattcttatgtacccagaataacagttatgctctagcccccgacctgcatcttgtgtctaatgtgagaccggagcctcctttagttgatgttgcaagttgtgactatttatgacagaattgctccgagggtcctcttaaaagataggttgtcattgagactgtttatagtgcgcgggccctgatacctagttcttagtttctgtatcactgtcgtggtcgtagaaccaggtggttaatggtctattttggattataatcttagcatgctttcttatcttttagcccgcaaataaattgggttgagcca

SEQ ID NO: 2064 - DNA, 1191 bp, Zea mays
aaaaataataataataaggggaaataataagaaaaaaattctcgtgttcttcgaccggtggtggtggtgcgaacgcaaggcgaccaaggggaggcgagatgaggggggcgaagcggccgctcagcgtggtgacgtcgtgggtgcggcggcagccgcccaaggtgaaggctttcttggccgttgtcaccggcatggccgcgctcgtcgtcatccgcttcatcgtccacgaccatgacaacctcttcgtcgctgccgaggctgcgcacgcgctcggcataggcgtcctcatctacaagctcaccaaggagaagacatgtgccggactatccctcaagtctcaggatttaactgcgttatttctagctgttagactgtactgcagctttgtcatggagtatgacatccatacaattctggacagtgctacacttgtagccacactgtttgttatttatatgatacggttcaaactgaggtcaacttatatggtggacaaggataactttgcattgtactatgtggtgctaccatgtgctggactggcactacttgttcatccttcaacatctcataacattgtgaaccggatctcctgggcgttctgtgtttatttggaagctgtttcagtgcttccacaattacggttgatgcaaaatactaagatagttgaaccgtttacagctcactatgtatttgcgttgggggttgcaaggtttcttagctgcgcccactgggttctacaggttttggatacgcgtggccgtctgctgacagctctcggctatggtctgtggccgtctatggtgctgttttcagaaatcgtgcagacattcatccttgcagatttctgctactactatgtgaagagcctggttggtgggcagctggtgctacggcttccctcaggggtggtgtaagagaagtgcaagctgcagcagaatacaaaactttagtgcttcaccggttcatatgtacttttagtagtgcccaacctgggagccttttttagttgatgttacgagttatgactatatgtatggcaaaattgctgcaagggtcctcttaaaagataggttgatattgagactgtttatagctgcgcttttctggatacccaatctttgggtacttggcttctgccgtatgactgtcgtggtcttaggatcaggtggttaatggtctctttggatt

SEQ ID NO: 2065 - DNA, 1155 bp, Zea mays
aagaaaaatactcccgtgttcttcgaccggcggcggtggtgcgaagcgaggcggtaagggagacgagatgagggggacgaagcggccgctcggcgtggtgacgtcgtgggtgcggcggcagccgcccaaggtgaaggccttccttgccgttgtcaccggcatggccgcgctcgtcttcatccgcttcatcgtccacgaccacgacaacctcttcgtcgctgccgaggctgcgcacgcgctcggcataggcgtcctcatctacaagctaaccaaggagaagacctgcgccggactatccctcaagtctcaggatttaactgcattatttctagctgttagactgtactgcagctttgtcatggagtatgacatccatacaattctggacactgctacacttgtagccacactgtttgttatttatatgatacggttcaaactgaggtcaacttatatggtggataaggataactttgcgttgtattatgtggtgttaccgtgtgctggactggcactacttattcatccgtcaacatctcataacattgtgaaccggatctcctgggggttctgtgtttacttggaagctgtttcagtgcttccgcagttacacttgatgcaaaatactaagattgttgaaccctttacagctcactatgtatttgcattgggagttgcaaggtttcttagctgcgcccactgggttctacaggttttggacacgcgtggtcgtctgttgacagctcttggctatggtttgtggccgtctatggtgcttttatcagaaatcgtgcagacattcatccttgcagatttctgctactactatgtgaagagtcttgttggtgggcaactggtgctacggcttccctcaggggtggtgtaagaagtgcagaagagatactctgaataacagttatgctctagtgcccaacctgggagccttcttttagctgatgatgttgcaagtaatgactatgtatgacaaaattgctgcaagggttctcttaaaacatagtttgtcattgagacttcatagctgcgccgtttcttgatgcccaatctccgagtactagcttcctgtgactgtcgtggtggtcttagaatcaggtggttagtgatctcattggattatataattctataatgctttca

SEQ ID NO: 2066 - DNA, 1225 bp, Avena sativa
cggaaataaatcccgtgttctccgatcggaggtggtggtggtgaggcgacgcgaccgaggctcaggcgacgatgagggggacgaagcggccgctcggcgtggtgacggcatgggtgcggcggcagccgcccaaggtgaaggccttcctggccgtggtcacgggcatggccgcgctcgtcttcatccgattcatcgtccacgaccacgacaacctctttgtcgccgccgaggccgcgcacgccctcggcatcggcgtcctcatctacaagctcaccaaggagaagacctgcgccggactatcccttaagtctcaggatttaactgcattgtttctagctgttagactatactgcagctttgtcatggagtatgacatccatactgtgttggatactgctacacttgtggcgacactttttgttatttacatgattcggttcaagttgaggtcaacttatatggtggacaaggacaactttgcattgtactatgtggtggtaccttgtgctgcgttggcgctacttgttcatccttcaacatctcacaacattttaaaccggttcagctgggcattctgtgtttacttggaagctgtgtcagtgcttccacaactgcgtttgatgcagaataccaagatcgtggaaccattcacagctcactatgtgttcgcactaggggttgcaaggtttcttagctgcgcccactgggttcttcaggttctggatactcgtggccgcctgctgactgctctgggctatggtttgtggccatcgatggtgctcctgtcagaaatcgtgcagacgttcatcctcgcggatttctgctactactatgtgaagagcctcgtcggcggacaactggtgctacggcttccctccggggtggtgtaggagctgcaggaggaccacccagcttactgtactctgaacgacagccagcgaatgctctagcgtcccgaccctctgcgtgcttgtcgtcagacataggaaacaactccggatatgttttcagttacagactattagcagtcagtgagaagatcgcagcagacagacataggttttgtcgacgtgacttgtaacagcgtatgcctggatatactttacctgacctgagtatgagtattttagcttccttatgtgtttgtcgtcgctattctagaaattggaaggcattagctatatgatttgaccagtgtctgagtacatgaaaaaatttatgctgg

SEQ ID NO: 2067 - DNA, 1209 bp, Triticum aestivum
aaaataactcacgcgtacgaacgccgccgcagcgaaggcagggtggaaaaataaacgaaaaaaaggaaataaatcccgtgttctccgatcggaggaggcgacgggcgacgggcgacgatgagggcgtcgaagcggccgctcggcgtggtgatggcgtgggtgcggcggcagccgcccaaggtcaaggccttcctcgccgtggtcaccggcatggccgcgcttgtcttcatccgcttcatcgtccacgaccacgacaacctcttcgtcgccgccgaggccgtgcacgcgctcggcatcgccgtgctcatctacaagctcaccaaggagaggacctgcgccggactatcccttaagacccaggatttaactgcattgtttctagctgttagactatactgcagctttgtcatggaatatgacatccatacagtgttagatactgctacacttgtggctacactttttgttatctacatgattcggttcaaacttaggtcaacttatatgctggacaaggacaactttgcattgtattatgtggtgataccttgtgctgtgttggcgctgcttgttcatccttcaacgtctcataacatcgcaaaccgatttagctgggcgttctgtgtttacctggaagccgtctcagtgctgccacaactgcgtttgatgcaaaataccaagattgtggaaccgttcacatctcactatgtgtttgcgctgggggttgcgaggtttcttagctgcgcccactgggttctccaggtattggacactcgtgggcgcctgttgactgcgctgggctacgggttgtggccgtcgatggttctcctgtcagaaatcgtgcagaccttcatcctcgcagacttctgctactactatgtcaagagtctggtcggcgggcagctggtgctacggctaccctctggggtggtgtaggaggaggatctgcagcgggaggaacgacgactggttggttcgcccatgaggcgtgcccgagaccggagccgtcttagcccagatatattattcagttacagcttacaattggcactagtgagaaaatcgcagcagcagacatatagggttatcggtgtgtgtgactggtaacagcagcgtatgtatgacctaacctgagagtaactttagcttccagtatgtttgtttgtttgtcgcctctattttagaagaaaaaaaagtgggaagccgatg

SEQ ID NO: 2068 - DNA, 1262 bp, Brachypodium distachyon
cggccccccaaaataactcacgaggacgaacactatcgcagcaaaggcgggggagaaaaaaaaagagagagaaaaaaaggagaaaatcccgttttctccgatcggagctggtggtgaggcgacgcgaccgagacgaggcgagatgagggggacgaagcggccgctcggcgtggtgacgtcgtgggtgcggcggcagccgcccaaggtgaaggccttcctcgccgtagtcacgggcatggcggcgctcgtcttcatccggttcatcgtccacgaccacgacaacctcttcgtcgccgccgaggccgcgcacgcgctcggcatcgccgtactcatctacaagctcaccaaggagaagacctgcgccggactatccctcaagtctcaggatttaactgcattatttttagccgttagactatactgcagctttgtcatggagtatgacattcataccgtgttggatactgctacacttgtggctacactttttgttatttacatgattcggttcaaattgaggtcaacttatatggtggacaaggacaattttgcattgtactatgtggtggtaccttgtgccgcgttggcgctacttattcatccttcaacatctcacaacattgcaaaccggttcagctgggcgttctgtgtttacttggaagctgtttcagttctgccacaactgcgtttgatgcaaaatactaagattgtggaaccgttcacagctcactatgtgtttgcactgggggttgcgaggtttcttagctgtgcgcactgggttcttcaggttctggatactcgtggccgtctgttaactgctctgggctatggtttgtggccgtctatggtgctcctatcagaaatcgtgcagacattcatccttgcagatttctgctactactatgtgaagagtctggttggtgggcaactggtgctacggctcccctccggggtggtgtgagaacttcagcggaacacacaacttgttggctaggttcaccttctgcgtctctcgccaagcccgagcccagagctgtttttactcgatgtttcagttacaactgttagtcagaaaattaaaccagacataggttgttgatgctgactgtttataactccgtatgccctgacctaatttgagtacttagctttccatatggttatcgcaatttttagaacagcatgtcagttatgaacttacgacagtgccctcatgacatcaacctgtgtgaaaaacttgtgatatgaaatgtatgctcgga

SEQ ID NO: 2069 - DNA, 1578 bp, Panicum virgatum
cgggatatatttttgaaattttccaaaaccgacatatatttttgaaattttaattttttttaaatataaaaaagaaaaaattccccccgcgtgcctctcactccaaacggcaaaaaggccaaactaccaacgcagcctaactccgtccgcccccgatctctccgacgcccccaccaaatatactctactctcgcaggaagagagaaagaaaaataaataacgaggaaaaataataataagaaaacactccccgtgttcttcgaccggaggtggtggtggtgcgaacgcgaggcgaccgaggagggaagacgcgatgagggggacgaagcggccgctcggcgcggtgacgtcgtgggtgcggcggcagccgcccaaggtgaaggccttcctggccgtggtcaccggcatggctgcgctcgtcttcatccgcttcatcgtccacgaccacgacaacctcttcgtcgccgccgaggccgcgcacgcgctcggcatcggcgtccttatctacaagctcaccaaggagaagacctgcgccggactatccctcaagtctcaggatttaactgctttgttcctagctgttagactgtactgcagctttgtcatggagtatgacatccatacaattctggacactgccacacttgtagccacactgtttgttatttacatgatacggtttaaactgagatcaacttatatggtggacaaggataattttgcattgtactatgtggtggtaccttgtgctgcactggcactacttattcatccttcgacatcacacaacattgtgaaccgggtctcctgggcattctgtgtttacttggaagctgtttccgtgctgccacaattacgcttgatgcaaaatactaagattgttgaaccgtttacagctcattatgtatttgcgttgggggtcgcaaggtttcttagctgtgcccactgggttctacaggttttggacacgcgtggccgtctgttgacagctctcggctatggtttgtggccatctatggtgcttctgtcagaaatcgtgcagacattcatccttgcggatttctgctactactatgtgaagagtctggttggtgggcaactggtgctacggcttccctcgggggtggtgtaaggagttgagcaggctacaaaacttcgtggttcacccattcttatgtaccctgaaaaacagttatgctctagcccccgacctgtgtctcgtatctaatgtgagaccggagcctcttttagttgatgttacaggttgtgactatttatgacaaaaattgctgcgagggtcctcttaaaagataggctgcaattgagactgtttatagtcgtacctaatctcagagtacttagcttctgtatcactgtcgtggtcttacaatcaggtggttaatggtctctcttggattataatctcagcatgctttcttatgcttcagcccacaaataaattggcttgagattgcagaactcgccatgtgaaaatcgtggaacgaagggcatcatgtcgtattcgcttggcattgagattatcaggagcagggaggggttccttcctcgcccgtcact

SEQ ID NO: 2070 - DNA, 1347 bp, Triticum aestivum
ccccctctcctcctcctttcctccgtagcctccaaaaataactcacgcgtacgaacgccgccgcagcgaaggcagggtggaaaaataaacgaaaaaaaagaggaaataaatcccgtgttctccgatcggaggcggcgacgggcgacgatgagggcgtcgaagcggccgctcggcgtggtgatggcgtgggtgcgccggcagccgcccaaggtcaaggccttcctcgccgtggtcaccggcatggccgcgctcgtcttcatccgcttcatcgtccacgaccacgacaacctcttcgtcgccgccgaggccgtgcacgcgctcggcatcgccgtgctcatctacaagctcaccaaggagaggacctgcgccggactatcccttaagactcaggatttaactgcattgtttctagctgttagactatactgcagctttgtcatggaatatgacatccatactgtgttggatactgctacacttgtggctacactttttgttatctacatgattcggttcaaacttaggtcaacttatatggtggacaaggacaactttgcattgtactatgtggtgataccttgtgctgtgttggcactagttgttcatccttcaacgtctcacaacatcgcaaaccggtttagctgggcgttctgtgtttacctggaagctgtctcagtgctgccgcaactgcgtttgatgcaaaataccaagattgtggaaccgttcacagctcactatgtgtttgcgctgggggttgcgaggtttcttagctgtgcccactgggttctccaggttctggacacccgtgggcgtctgttgactgcgctgggctacgggctgtggccatccatggttctcctgtcagaaatcgtgcagaccttcatcctcgcagatttctgctactactatgtgaagagcctggtcggcgggcagctggtgctacggctaccctccggggtggtgtaggaggatatctgcagcgggagaaacgactcgtcgggtcacacccatcagaggaggatattttcagttacagcttacaagtgtcattagtgagaaaattgcagcagcagacataggcttgtcggtgtgtgtgttactggtaacagcagcgtatgtatgacctaacttgagggttaattttagcttccgtatgtttgtttgtcgcctctattctggaaaatccctcgtttcttggaacctgtggaaattatgatgagaggaagaaagaccatatagtaagtatcatagcctggtcaagtgatgcgcgggccgttgcatcacgccttgtggcctgcgtctcacaccggccccgtgtgtgtgcaagcaaaatcctcgggcctctgt

SEQ ID NO: 2071 - DNA, 1246 bp, Secale cereale
gactccacagtaccagtaccgcacccatccatcctcctctcccgcaaaaccgaaggccagacccagaccgctcacgccgcaccgcacgcgctgcacgggcacccaacaggacacaagcccttctccgatcgtgctcgctcgccgccgcgccgctggtagcagagcagcggggaggagctccgagatgagggcgccgcggaggccgatggcggtcgtgctcagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggccgcgcacgcgctcggcatcgccgtgctcatctacaagctcaccaaggagaagacctgcgctggactttcactcaagtctcaggatttgacagcattgttcctggccgttaggttgtactgcagctttgttatggagtatgacatccatacaatactggattcagctacactagtagctaccctttttgtcatttacatgattcggttcagactgagatcaacttatatgctggacaaggacaattttgcattgtactacgtggttgtaccatgttgtgtgctggcatttattgctcatccttcaacatcacatatcatgatcaataggatctgctgggccttctgtgtttacttggaagctgtttcagtgctgccccagttgcgcttgatgcaaaatacaaagattgttgaaccattcacagctcattatgtgtttgcattgggtgtggcaaggttccttagctgtgcacactgggtccttcaggtcttggatactcgtggcagattattgactgctctgggctatggcttttggccatcgatggtgctcctctctgaaatcgtccagacgttcatccttgcagatttctgctactactatgtgaagagtcttgccggcggacaactagtgctgcggcttccttctggggtggtgtaaaatctgcaacatgatgcacaactcatttgttcggtgctgtgtcttactgttgaacagtggctctgcttctggggcccaaccttctcttatcccatgtgggatggattcaaaagtcttgtttgccttttctttttctagttataaactgtttggtgaaaattgtaccggagactgttggtcgtgaagcttaggctgttgagaatactatctatagctgactatttatccagactagttttcaag

SEQ ID NO: 2072 - DNA, 1553 bp, Triticum aestivum
acagtatcagtaccgcacccatccatcctcctctcctgcaaaaccaaaggccagacccagaccagaccgctcacgccgcaccgcacgcgctgcacgggcacccaacacaagcccttctccgatcgtgctcgctcgccgccggtactagtctagtagagcagcggggaggagctccgagatgagggcgccgcggaggccgatggcggtggtgctcagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggccgcgcacgcgctcggcatcgccgtgctcatctacaagctcaccaaggagaagacctgcgctggactttcactcaagtctcaggatttgacagcactgttcctggccgttaggttgtactgcagctttgttatggagtatgacatccatacaatactggattcagctacactagtagctactctttttgtcatttacatgattcggttcagactgaggtcaacttatatgctggacaaggacaattttgcattgtactacgtggttgtaccatgttgtgtgctggcatttattgctcatccttcaacatcacatatcatgatcaataggatctgctgggccttctgtgtttacttggaagctgtttcagtgctgccccagttgcgcttgatgcagaatacaaagattgttgaaccattcacagctcattatgtgtttgcattgggtgtggcaaggttccttagctgtgcacactgggtccttcaggtcttggatactcgtggcagattattgactgctctgggctatggcttttggccatcgatggtgctcctctctgaaatcgtccagacgttcatccttgcagatttctgctactactatgtgaagagtcttgctggcggacaactagtgctgcgacttccttctggggtggtgtaaaatctgcaatatgatgcacaactcatttgttcggtgctgtgtcttactgttgaacagtggctctgcttctggcgcccaaccttctctcttcccatgtgggatggattcaagagtcttgtttgccttttctttttccagttataaactgtttggtgaaaattgtaccggagactgttggtcgtgaagcttaggctgttgagaatactatctatagctgactatttatccagactagttttcaagtacttgcctccttacatgctcagtcatcccagttccggattggggaggccatgagatcctccattttcgatggtcatgttctcttttcatttgtgttgatctggtgttgtagctctgagcattggcctggccaggtttccagcttgagccaacatctccagtttttgtatgggccttggattctgctgaattcgcagtgccgtcaacgaaactgaagagttgttgttcaggctatataggttggtcatccgtgggattcggctatgcaatttttccagttcaatcttttgtcaaaactcctcagtttcatcac

SEQ ID NO: 2073 - DNA, 1361 bp, Triticum aestivum
tcctcctctcctgcaaaaccaaaggccagacccagacccagaccgctcacgccgcaccgcacgcgctgcactggcacccaacacaagcccttctccgatcgtgctctctcgccgccggtagcagtctagcagagcagcggggaggagctccgagatgagggcgccgcggaggccgatggcggtcgtgctcagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggccgcgcacgcgctcggcatcgccgtgctcatctacaagctcaccaaggagaagacctgcgctggactttcactcaagtctcaggatttgacagcactgttcctggccgttaggttgtactgcagctttgttatggagtatgacatccatacaatactggattcagctacactagtagctactctttttgtcatttacatgattcggttcagactgaggtcaacttatatgctggacaaggacaattttgcattgtactacgtggttgtaccatgttgtgtgctggcatttattgctcatccttcgacatcacatatcatgatcaataggatctgctgggccttctgtgtttacttggaagctgtttcagtgctgccccagttgcgcttgatgcagaatacaaagattgttgaaccattcacagctcattatgtgtttgcattgggagtggcaaggttccttagctgtgcacactgggtccttcaggtcttggatactcgtggcagattattgactgctctgggctatggcttttggccatcgatggttctcctctctgaaatcgtccagacgttcatccttgcagatttctgctactactatgtgaagagtcttgctggtggacaactagtgctgcgacttccttctggggtggtgtaaaatctgcatcatgatggacaactcatttgtttggtgctgtgtcttactgttgaacagtggctctgcttctggcgcccaaccttcgctcttcccatgtgggatggattcaagagtcttgtttgccttttctttttcagttataaactgtttggtgaaaattgtaccagagactcttggtcgtgaaatgtaggctgttgagaatactatctatagctgactatttatccagactagttttcaagtacttgcctccttacatgctcagtcatcccagtttcggattgcggaggccatgagatactcgctttttgatggtcatgttctctttcatttgtgttgatcttggtgttgcagctctgagcattggttccagctgagccaacatctc

SEQ ID NO: 2074 - DNA, 871 bp, Hordeum vulgare
atgagggcgtcgcggaagccgatggcggtggtgctgagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggcagcgcacgcgctcggcatcgccgtgctcatctacaagctcaccaaggagaagacctgcgctggactttcactcaagtctcaggatttgacagcattgttcctggccgttaggttgtactgcagctttgttatggagtatgacatccatacaatactggattcagctacactagtagctactctttttgtcatttacatgattcggttcagactgaggtcaacttatatgctggacaaggacaatttttcattgctctacgtggttataccatgttgtgtgctggcgtttcttgcgcatccttcaacatcacatatcatgatcaataggatctgctgggctttctgtgtttacttggaagctgtttcagtgctgccccagttgcgcttgatgcaaaacacaaagattgttgaaccattcacagctcattatgtgtttgcattgggtgtggcaaggttccttagctgtgcacactgggtccttcaggtcttggatactcgtggcagattattgactgctctgggctatggtttttggccatcgatggtgctcctctctgaaatcgtccagacgttcatccttgcagatttctgctactactatgtgaagagtcttgctggtggacaactagtgctgcgacttccttctggggtggtgtaaaatctggaacatgatgcacaactcatttgttcggtgctgtgtcttactgtcg

SEQ ID NO: 2075 - DNA, 1587 bp, Hordeum vulgare
acacgaaacggttgcagctgcaccaaacccagcccgacccgtccggacctttactcgaccaccaccacagtacccgtaccacgccacacccgtccatccccctctcctgcaaaaccgaaggccggaccggaccagaccagaccgcacgcgctgcaaacaagcccttctccgactccgatcgtgctcgctcgccgccggtactagtctagagcagcggggaggaggagatgagggcgtcgcggaagccgatggcggtggtgctgagctgggtgcggaggcagccgcccaaggtcaaggccttcctcgccgtcgtcgcgggcatgaccgcgctcgtcttcatccgcttcatcgtccacgaccacgacaacctcttcgtcgccgccgaggcagcgcacgcgctcggcatcgccgtgctcatctacaagctcaccaaggagaagacctgcgctggactttcactcaagtctcaggatttgacagcattgttcctggccgttaggttgtactgcagctttgttatggagtatgacatccatacaatactggattcagctacactagtagctactctttttgtcatttacatgattcggttcagactgaggtcaacttatatgctggacaaggacaatttttcattgctctacgtggttataccatgttgtgtgctggcgtttcttgcgcatccttcaacatcacatatcatgatcaataggatctgctgggctttctgtgtttacttggaagctgtttcagtgctgccccagttgcgcttgatgcaaaacacaaagattgttgaaccattcacagctcattatgtgtttgcattgggtgtggcaaggttccttagctgtgcacactgggtccttcaggtcttggatactcgtggcagattattgactgctctgggctatggtttttggccatcgatggtgctcctctctgaaatcgtccagacgttcatccttgcagatttctgctactactatgtgaagagtcttgctggtggacaactagtgctgcgacttccttctggggtggtgtaaaatctggaacatgatgcacaactcatttgttcggtgctgtgtcttactgtcgaacagtggccctgcttctggagcccaaccttctctcttcccatgtgggatggattcaagagtcctgttgcttttctttttccagttataaactgtttggtaaaaattgtaccggagactgttggtcgtgaagcgtaggctgttgagaacactatctatagctgactatttatccagactagttttcaagtacttgcctacttacatgctcaatcatcccaattccggattggggaggccatgagatcctccattttcgatggtcatggtctctttgatttgtgttgatctggtgttgtagctctaagcattggactggccagggttccagctggagccaacatctccagtttttgtatgggccttggattcagagagtttgctcaggctagatataggatggtggttggcgggattggccttttgtcacgttatttgttcggtttgtttcactaagaaaagggtttgattttgtttagtttttcagttc

SEQ ID NO: 2076 - DNA, 1262 bp, Avena sativa
aacctgacatcccgagggggacgaaacggaacagctgcagctgcgccaacccaacccgtcccgtgccattacgacgcacccatcctctcctgcgaaaccaaagaccagaccactcacgccgcgccgcacgcactgcacgcgcaagcccttctccgatcgtgctcgctcgccgcggcggtggtggtagtagggtgaccggagcagcggggaggaggagatgaggccgccgcggaggccgttgggggtggtggtggcgtgggtgcggcggcagccgcccaaggtcaaggctttcctcgccgtcgtcgcgggcatggccgcgctcgtcttcatccgcttcatcgtccacgaccacgacaacctcttcgtcgccgcagaggccgcgcacgcgctcggcctcgccgtcctcatctacaagctcaccaaggagaagacctgcgctggactgtcactcaagtctcaggatttgacagcactgttcctgtctgttaggttgtactgcagctttgttatggagtatgacatccatacaatactagattcagctacactagtagctactctttttgtcatttacatgattcggttcagactgagggcaacttatatggtggagaaggacaactttgcattgtactatgtggtggtaccttgttttgtgcttgcatttttctctcatccttcaacgtcacatttcgcggttaaccggatctgctgggccttctgtgtttacttggaagctgtttcagttctgccacagttgcgcttgatgcagaatacaaagattgttgaaccgtttacagctcattatgtgtttgcattgggtgttgcaaggtttcttagctgtgcacactgggtccttcaggtcttggatacgcgtggcagattgttgactgctctgggctatggtctgtggccttcgatggtgcttctctctgaaatcgtccagacattcatccttgcagatttctgctactactatgtgaagagtgttgttggcggacagcttgtgctgcggcttccttcgggggtggtgtaaaatctgcaacaagaatacacagctcagttggtcggtgctctgtcgtactgttgaacagtggttctgcttctagcgcccaaccttctctcttcccatgtgggatagatttaagagcgagccttgtttgcttttcgttttcctttccagatataaactgaaaattgtaccagagaacgtcgtgaagattaggttgatgagaatgttgtctgtctatgaatagctgact

SEQ ID NO: 2077 - DNA, 1641 bp, Lolium multiflorum
atcccccgggggacgctcagcgtcgtccaactaaaaaacgcaaaaattacgaaccgagccataagtgcggcagatctatctatccgccacctccccaccttggcctccaaaaataactcacggggtacgaacgctatcgcaccaaaggtgggggaataataaagagaagaaaaaataaacggaaataaatcccgagttttccgatcggaggcgacgcgaccgaggctccggcgacgacgatgagggggaccaagcggccgctcggcgtggtgacggcatgggtgcggcggcagccgcccaaggtgaaggctttcctcgccgtggtcacgggcatggccgcgctcgtcttcatccgcttcatcgtccacgaccacgacaacctcttcgtcgccgccgaggccgcgcacgcgctcggcatcgccgtcctcatctacaagctcaccaaggagaggacctgcgctggactatcactcaagtctcaggaattgacagcactattcctggctgttaggttgtactgcagctttgttatggagtatgacatccatactatactggattcagctacactagtagctactctttttgtcatttacatgattcggttcagactgagggcgacttatatgctggagaaggacaactttccattgtactatgtggtggttccttgttttgtgcttgcgtttttctcccacccttcaacgtcacatttcatggtcaatcggatctgctgggccttctgtgtttacttggaagctgtttcagtgctgccacaactgcgtttgatgcaaaataccaagattgtggaaccgttcacagctcactatgtgttcgctctgggggttgcgaggtttcttagctgtgcccactgggttcttcaggttttggatactcgtggccgcctattgactgctctgggctatggtttgtggccatctatggtgctcctgtcagaaatcgtgcagacgttcatcctggcagatttctgctactactatgtgaagagtctggtcggtgggcaactggtgctacggctcccatccggggtggtgtgagaactgcagccatgttctagcgccggatcttctgcgtctctcgccaagcacgagaccggagcagccctcgtcagttgatattttcagttacaactattagtcagtgaggaaatcgcagcagacataggttttgtcgatgtaactgttaacagcgtatgccatgatattcctaacttgagtgtctagcttccgtatgtttgtcgccgttattttagaaatgggaagccattagttatgatgacagtatctgtgcgtaaatggatctatgaaagttatgcttggaagaccatcttagctagtcgctgtcctatcgcgttggtgttgccgagctgatgcggaggaccggtaaaacaatgtgcgccttggtttgctgggaacgagggcagttgcatcatgctttgttgctcgctccgcacaccggttccgtgctcaaattctcggggcgactgtttacctgttaccctgacgggcggtttgagacgttggtgtctgatggaaatgtttgatcgtaacgagtctataggaataggattcatccggttcactttacctggaaagcttgccatctttgcaccgacagcaa

SEQ ID NO: 2078 - DNA, 1411 bp, Ananas comosus
ctacgagccgatcacctgctcgcaccaaaaacaaaaccccgtgtcctcgtcacattccgagtccaaaataattaggaatccaaaacccactatgtacgccccagttcccaaaagagctttctcgctccgctgcgaccccaaaaggccaaaagagaaaaagtagagatctttgtgctctctccctcgtcctcgtcctcgtcctcttcctcgtcccagggtatatagcgatcgcgggcgcgcaaatcgccgcggggagaagcgatgcgggggccgcggcggccgctgagcgtggtggcggggtgggtgcggcggcagccgccgaaggtgaaggcgttcctcgcggtggtggcgggcatggcggcgctcgtgctcatacgcgccgtcgtgcgcgaccacgacaacctcttcgtcgccgccgaggccgtccacgccctcggcatctccgtcctcatctacaagctcaccaaggagaagacctgcgccggattgtccctcaaatctcaggatttaacagctttatttcttgctgttagattgtattgtagttttgtcatggagtatgacatccacacactgctggacaccgctacacttgtgactactctttgggttatatatatgattcgatttaagctaaagtcatcttatatggaggacaaggacaactttgcaatccattatgtggtcttgccttgtgctttactagcagtacttattcatccttccacatcacataatattgtgaacaggatttgttgggctttctgtgtttacctagaagctgtttcagtgttacctcaattgcgactgatgcaaaacacgaagattgttgagcccttcacagctcattatgttttcgccttgggagtagctaggtttttgagttgtgcgcactgggtccttcaggttttggatactcgcgggcgcttattgacagctttgggctatggttggtggccttctatggttcttctctcggagattgttcagactttcatcctcgcagacttctgctactattacgtgaagagtcttgtaggtgggcaactggtgctacgccttccttccggagtggtgtaaaataaagcgcggcatggaaacttctcggatttactcggttaactaatttaactcaaatgcttgaccttttgatcgccttctcaccatgatcaggcctgatatgtttttctgatctgttttctcgtatcagattgtagtggaaataatcgtaaaatgtagttttcacagaagaatcttttacccgacggtcgccctaggactgcaaaacttccatggaatgcggtatcgctctctgcgtgccgttgctctcttaatgaaaatctcctggttgtttggttggttaattaaccactgtttgtcatgttcatatcatgagtttctgagatttcaa

SEQ ID NO: 2079 - DNA, 1298 bp, Musa acuminata
tgggaaccaaaacgaagtttaaggtcttctttttctctacgctcttcgcttcttggattcggagaagggaaggatcgccgtgagcgaagcgtcgggatgagagggggcagacggccgatctacgcggtggcggcatgggtgaggcggcagccgtcaaaggtgaaggcgttcctgggcgtggtggcgggcatggcagccctcgtattcctccgattcatcgtccacgaccacgacaacctcttcgttgcggctgaggctgttcacgccattggaatctccgtcctcatctacaagcttaccaaggagaggacctgtgccggcctttcgttgaagtcccaggacttaacagctttgtttttagctgtcagaatgtattgcagctttgttatggaatatgatatacacactgtgctagatactgccacacttgctactaccctttgggtcatttacatgattagatttaaactgaagtcaagttacatggaggataaggacaactttgctatatattatgtggtggtgccttgtgctttgttagcccttgcagttcatccttcaacctcacataatatcttcaataggatttgttgggccttttgtgtttatttggaagctgtttcagtgttgccacagctacgtttgatgcaaaacacaaagattgtagaaccattcacagctcactatgtttttgctcttggggttgcaagatttctgagttgtgctcactgggtccttcaggtcctagatactcaaggacgcttgttgacagctttgggctatggtttgtggccatcaatggttctccttgctgaaattgtgcaaactttcatcctagctgatttttgttactattatgtgaagagtcttgttggtggtcaacttgtgctacggcttccttctggcgtagtgtgaccctctgcacatatcagtttgaattaacacacgacgaatctatcgtcttctcaatacttcaatgcctcttctctcatgagaggcctgctttgtggcatcctaagttatgaagtagtcattttcatgcgtagcaagattttctttctttaaagtggttagagatggattgttaatgtgagcgcctatgggatacataatggtggatcttgggttggactttcctttttgaaacatccgattgttagattgttagttagctttttcctgttgtactatgccgttggtctgaaaagaaacattgcgaagcattgcgcacattactgtttcttgataggacttgatgttttgaatataattatcaaaccaatgtgcctctacagccc

SEQ ID NO: 2080 - DNA, 1207 bp, Musa acuminata
cttgtgttactgtagtcggaggggatcgccgtaagaggggcgtcgcgatgaggggggcgaagcggccgatccacgctctggcggcatgggtgaggcggcagccgccgaaggtgaaggctttcctcggcgtggtggcgggcatggcggcgctcgtcttcctccgcttcatcgtccacgaccacgacaacctcttcgtcgccgccgaggccgtccacgccatcggcatctccgtactcatctacaagctctccaaggagcggacctgcgccggactttcattgaagtctcaggacttaacagctttgtttttagctgtcagactgtattgcagctttgttatggaatatgatatgcacacagtgttagatactgccacacttgctactactctttgggttatttacatgatacggtttaaactgaagtcgagttacatggaggacaaggacaactttgctatatattacgtggtagtgccttgtgctttgttagcccttgcagttcatccttcaacctcacataatatcttcaatagaatttgttgggccttttgtgtttatttggaagctgtgtcagtgttgccccagttacgtttaatgcagaacaccaagattgtagaaccattcacggctcactatgtttttgccttgggggttgcaagatttctcagttgtgctcattgggtccttcaggtcctggacactcggggacgcttgttgacagctttgggttatggtttgtggccgtcaatggttcttcttgccgaagttgttcaaactttcatccttgctgatttctgttattattatgtgaagagtgtttttggtggacaactggtgctacggcttccgtccggtgtagtgtgatcttccacaggacgcctggtgcatatgaattctttgtgcatagtgtgtaattcctcttctcgcaaaactagtgaccactatggattctcacttgtgatttattagaccttaaatagtgggtagagtttgcttgttacctgtctgtcggtgctgagtagagcatcatgtgagctattacaggatactatatgcttgcaaaagacttcctgggtagcttcatccttgtaaacttatcacgtcaagcttgtgccctttgtgctatgtcttcaacatggcttagcaccatttttctttcgtgtttaaagctgattgtgaattgaatttatcatgtatctacgaag

SEQ ID NO: 2081 - DNA, 1199 bp, Musa acuminata
ctcagctcgctactttcgggagtgaaggtagcggaaaaaagaggctcctcgattcgccctcttttctgcttggattcgagcatcggatcgcagcgagggaaggcgtcgcgatgaggggagcaaagcagccgatctacgccgggacggcatgggtgaggcggcagccgcccaaagtgaaggcgttcctctgcgtggtcacgggcatggcggccctcgtcttcctccgcttcatcgttcacgaccacgacaacctcttcgtcgctgcagaggccgtccacgcccttggaatctccgtcctcatctataagctcaccaaggagaggacctgcgccggactttcattgaagtctcaagatttaacagctttgtttttagctgtcagactttattgcagcttcgttatggaatacgatatacacacattgctagattctgccactcttgctactactctttgggttatttacatgattcgatttaaactgaagtctagttacatggaggataaggacaactttgccatatattatgtggttgtgccttgtgctctgttagcctttgcagttcatccttctacatcacataacattttcaataggatatgttgggcattttgtgtttatttggaagctgtttcagttctgccccagttacggttgatgcagaacacaaagattgtagaaccattcacagctcattacgtttttgctctgggggttgcaagatttctgagttgtgctcactgggtccttcaggtcctggacactcgtgggcgattgttgacagctttggggtatggcttgtggccatcaatggttcttcttgctgaaatagttcaaactttcattctcgctgatttctgttattattatgtgaaaagtctcgtcggtggacagctggtgctccggcttccttctggcgtagtgtgatcctatgtgatctgtgccacacttcagtttgagttcatttgaattctttgttggtgtaactgtaatgcctcgtctctcatgcaagcctatgctggttgtggattcacacttgtgacatcttaagttatgaagaagtcatttccatggttacgaagatcaattctcgcatataagaccaccttaaagtgggtggggattgcttgttatctgtgtgctaagcaaagcataatgctagtagttatttcaggataattaaattgttctttttaa

SEQ ID NO: 2082 - DNA, 1293 bp, Festuca arundinacea
tgaggcgacgcgaccgaggctcggcgacgacgacgataagggggaccaaacggccactcggcgtggtgacggcatgggggcgacggcagccgcccaaggtgaaggctttcctcgccgtggtcacgggcatggccgcgctcgtcttcatccgcttcatcgtccacgaccacgacaacctcttcggcgccgccgaggccgcgcacgcgctcggcatcgccgtcctcatctacaagctcaccaaggagaagacctgcgccggactatccctcaagtctcaggatttaactgcattgtttctagctgttagactgtactgcagctttgtcatggagtatgacatccatactgtgttggatagtgctacgcttgtggctacactttttgtgatttacatgattcgcttcaaattgaggtcaacttatatggtggacaaggacaattttgcattgtactatgtggtggtaccatgtgctgcgctggcgctacttattcatccatcaacgtctcacaacattgcaaaccggttcagctgggctttctgtgtttacttggaagctgtttcagtgctgccacaactgcgtttgatgcaaaataccaagattgtggaaccgttcacagctcactatgtgttcgctctgggggttgcgaggtttcttagctgtgcccactgggttcttcaggttttggatactcgtggccgcctattgactgctctgggctatggtttgtggccatctatggtgctcctgtcagaaatcgtgcagacgttcatcctggcagacttctgctactactatgtgaagagtctggtcggtgggcaactggtgctacggctcccatccggggtggtgtgagaactgcagccatgttctagcgccggatcttctgcgtctcttgccaagcgcgagaccggagccgccctcttcagttgatattttcagttacaactattagccagtgaggaaatcgcagcagacataggttttgtcgatgtaactgttaacagcgtatgccatgatattcctaacttgagtgttttagcttccttatgtttgtcaccgttattttagaaattggaagccatagttatgatgacagaatctgtgcgaaaatggacctatgaaaggtatgtttggaagaccatcttagctagtcgctgtcctattgtgttggtgttgccgagctgatgaggcaggcctggtaaaacaatgtgcgccttggtttattgggcaggaacgagggcagttgcatcatgctttgttgctggcttctcaaaaaaaaaaaaaaaaaaaa

SEQ ID NO: 2083 - DNA, 1413 bp, Elaeis guineensis
gatcaattttattgtaccgcagaattggaccactctctttctccctctgtctctctcgttctcctttggacgaaccaaaaaaaaaaaggaattttttcgtctcgccgttccccatcgctcacgctttgttctctgcttctcggatcgagagaggaggcacctatagcgagcgatcggatcgaacgagcgacgatgaggggatcgaggcggacgatgaacgtggtggtgggatgggtgaagcggcagccgcccaaggtgaaggcgttcctgagcgtggtggcaggcatggtggccttggtcttcctcagattcgtcgtgcacgaccacgacaacctcttcgtcgccgccgaggccgtccacgccctcggcatctcagttctaatctataagctcaccaaggagaggacctgcgcaggactttcactcaagtctcaggatctaacagctttatttttagctgttagattgtactgcagtgttgttatggagtatgacatacacacactactggattctgctacacttctgactaccctgtgggttatttatatgattcgatttaaactaaagtcaagttacatggaggataaggacaactttgcaatatactacgtggtggtgccttgtgctgtactagcccttttaattcatccttcgaccgcacataatattgtgaacaggattttctgggccttttgtgtttatttggaagctgtctctgtgttaccccaattacgcttgatgcaaaacacaaagattgttgaacctttcacagctcactatgtatttgcattgggagttgccagatttttgagttgtgcacactgggtccttcaggttctggatacgggtggacgcctgttgacagctttggggtatgggttgtggccctccatggttctcctctcggaaatcgttcagaccttcatccttgcagacttctgctactattacatcaaaagtcttgttggtggacaattggtgctacgtcttccttctggggtggtataagtttaaaaattctgtacaacatctcagttattgtaccctgaagtaacataatatgaaatctggatatgtgcgtcttctattgcctgatccttctgaacctatagcgtttgtgagtgttcaccagtgagatcaagttgtcaacacgtgcaaagtggatggaagttgaatctaatgtagatatcctgggtgggaatgcattggtttttagctgactgcctgtaccttagataaagctccaaccttttatggatcctttatcctttttagctctttaaaactccctggcattcctgcaagcataaacctcatggatatattcctaatatcagcttgtggatactttgccattacattatttattgtttttaaagcatgacaatgcattgagatcgttggatgtca

SEQ ID NO: 2084 - DNA, 1277 bp, Musa acuminata
gaaaggagacgaagaagcgactcgatttctgtgccctctttaattcctggattcgagcagggaggagcggatcgctgcgagggaaggcgtgcgatgaggggggcgaggcggccgatctacgcggtggcgacatgggtgaagcggcagccgcccaaagtgaaggcgttcctgtgcgtggtggcgggcatcgcggccctcgtcttcctccgcttcatcgttcacgaccacgacaacctcttcatcgccgccgaggccgtccacgccctcggcatctccgtcctcatctataagcttaccaaggagaggacatgcgctgggctttcgttgaagtctcaggatttgacagctttgtttttagctgccagactttattgcagtttcgttatggaatacgatatacacacagtgctagatactgctacacttgctactactctttgggttatttacatgattcgttttaagctgaggccaagttacatggaggataaggacaattttgctatatattttgtggttgtgccttgtgtgctgttagcgcttgctgttcatccttctacatctcacaatattttcaataggatctgttgggccttttgtgtttatctggaagctgtttcggtgttgccccagttacgattgatgcagaacacgaagattgtagaaccgttcactgctcactatgtttttgctcttgggattgcaagatttctgagttgcgctcactgggtccttcaggtcctggacactcgtggacgactgttgacagctttagggtatggtttgtggccaccaatggttcttcttgccgagatcgttcaaactttcattctcgctgatttctgctattattatgtgaagagtgttgtcggtggacagctggtgctacggcttccgtcaggtgtagtgtgatcttccacgcacagtcagactgaatcatcaacttaaactgaatcatttgtctgagcataccgaaatgcctcctctcttatgcgaggcttgcaccagttagggattctcacctgtgacatgttgagttatgaagaagtcttacatatagacactaatgtgggtagaaattgcacgttagctgactgtatgcagcaagtaaatagtttcttgaggaagttttacggttgaccttgggttgacttcttttctataacaagactttcaacctcctagcttcatattttgtagacttatccggctttttccctttgtactatgcttttggtttgagatgaaagaggaggccaaaggaacggttggtgggg

SEQ ID NO: 2085 - DNA, 2175 bp, Cocos nucifera
tgagaactattacttgtcctcatttttcttcgggatggtagagaagccagatcctcttttcctctattcacctaatataccatggaggctaagcagctaatccactttattttcatcttggaaggagatgagtgtctgaactgatctggagtagggagtgtaaggagcatggctatgtcccctattgttgctccattaaagagaggagcgcctatcctctcttcctctttgaaaaagaagaggccaaccaccactgcaacctccaccaaataaagatagatggggagggagagagaggagcaggccatatgacttttcaccatttttatctcttatcttttggtcactctatcttctcttatttatatctaaataaatagataaataaactattacttatcacaacaccgaagaactggagcttaagctggtcaccttccgcatcctggccccgatcggtgtcatcgttatcaaaacccaccgtctataagtaccacccaccccctggaattccacgaaagcccacgtatttctgtaccttggatctcccttttgagagagagtgggagagagaaggctctttcgtttctcccctcgtcctctgcaactcggattgggagagaaagcaccgaaagcgagggagtcatcgatcggatcggaggagcgaagatgagggcaccgagggggcggataaatgccgttgcgggatgggtgaagcggcagccgcccaaggtgaaggctttcctgagcgtcgtggcgggcatggcggcactcgtcttcctcagattcgtcgtccacgaccacgacaaccttttcgtcgccgccgaggccgtccacgccctcggcatctcagttctaatctataagctcaccaaggagaggacctgcgcgggactttcactcaagtctcaggatctaacagctttatttttagctgttagattgtactgcagttttgttatggagtatgacatacacacactactggattctgctacacttctgactaccctgtgggttatttatatgattcgatttaaactgaagtcaagttacatggaggataaggacaactttgcaatatactatgtggtggtgccttgtgctgtactagcccttttaattcatccttctaccgcacataatattgtgaacaggattttctgggccttttgtgtttatttggaagctgtctctgtgttaccccaattacgtttgatgcaaaacacaaagattgttgaacctttcacagctcactatgtatttgcattaggagttgccagatttttgagttgtgcacactgggtccttcaggttctggatacgggtggacgcctgttgacagctttgggctatgggttgtggccctccatggttctcctctccgaaattgttcaaaccttcatccttgcagacttctgctactattacatcaaaagtgtcgttggtggacaattggtgctacgtcttccttctggggtggtataattttaaaaattctgtacaacgtctcagttattgtaccctgaacttaatatgaaatccgggtatgtgcatcttctattgccttatcctttcgaaacctatagcctttgtgagttttcaccagtgatatcaagttgtcaacacgtgcaaagtggatggaatttgactctaatgtagatatcctgggtgggaatgcattggttcttagctgactgcctgtactttagattaagctcaaccttttatggatcctcaactctttaaaactccctggcattccttcaagcataaacctcatggatattttccttacacaccatatcagcttgtggatactttgccattgcattatttattgttttcaaagcacgacaatgcattgagatgattggatgtcatgggctaatatatcggttgggaaattgttgacgttgatccgagttctttcctcttcctcgttggagtaaaggatctttttcgaggaggattttgtttatagacaaacaaatgaaatttgtccatgagagtgccaaattgtgtaacttgttgagggtgttaagaaattcagcctcttaatgtatggttggttgattaatttaatgcagacatggatctaaagtaactatgatccttggcaccattagattttgtgcttgcgctggtgttggttgacggaatatctgtgctatc

SEQ ID NO: 2086 - DNA, 1151 bp, Ricinus communis
attttccgtcaccctctagggaaaattaataaagaaagtatccaattctccgatgagggcaccaaagaggccgatccacgcagtttcgacatgggtccggcgacagccgcccaaagtcaaagcctttttggcggtggtggcgggtatggcggcgcttgtatttctccgattcatagtacatgatcatgataacctttttgtggctgctgaggctgtccactctattggtatcattgttcttatttataagctcatgaaggagaaaacttgtgcgggactatcacttaagtctcaggaattgacagctatgtttttagctgttaggctgtattgcagctttgttatggaatatgatatacataccctgcttgatttagctacattgggaacgactttgtgggttatttatatgatccgtttcaatttgaagtctagttacatggaggacaaagacaattttgcaatatattatgtggtggtaccctgtgccattctagctttgttaattcatccatcaacatctcataatattgtgaataggattttctgggcattctgtgtatacctggaagctgtttctgtgttacctcagttgcgtgtaatgcaaaatacaaagatagttgagccatttacagctcattatgtatttgcattgggtgttgcgaggttcttgagttgtgcccactgggttcttcaggttttggacactcgtggacacttgctggtagccttgggttatggattgtggccttctatggttcttatatcagaaattgttcagactttcatcttagctgacttctgttactattatgtcaaaagtgtttttggaggacagcttgttctccgtcttccctcaggagtggtgtaattgaagatcctgttctgccgttgagcaatattgctgtctgaaatcaatgttttcaagcaatgctgttccaagaatttttgggttcgagacagggttcttcacgttatgatctgaagtaaagtgggtcatctgtacatttgggggtgcagaaactctgatggatattttatttaagaaagataattttttatagttgggttaacttcttttgttagtgctgacttctgatctgcctttttttttttttttttcccatactaatgaatattactgatcagcg

SEQ ID NO: 2087 - DNA, 1092 bp, Allium cepa
gaccccttctgtcaaaatctcccaaatttctaacgccattcacacaaaatcaagaagcgatttttacagatcgaagatgagaggatcatcaaagagacaaataaacatggtgatttcatgggtaaagcgtcagccaccaaaagtaaaagcttttctgagcgtcgtgtccgctatggctgctcttgtttttctgagattcattgtccatgatcacgacaatctttttgtcgctgctgaggctgctcacgcgattggaatttccgttcttgtatacaagctcaccaaggagaaaacttgtgctggactctctctcaaatctcaggagctaacagctttatttttagcagttcggttgtactgcagttttgttatggagtatgatattcacactgtgttggactctgcaacccttgcatccacattgtgggttatttatatgatgcggtttaagttaaaatccagctatatggaggacaaagacaattttgcaatgtactatgtggttgtgccttgtgcagcattagcttttctaattcatccttcaacatctcacaacatcctcaaccgaatctgctgggcgttctgtgtttatttagaagctgtttcagtcttaccccagctacgtctgatgcaaaacacaaagattgttgaaccgtttacatctcactatgtctttgcattgggagtcgcgagatttctcagctgtgcgcattgggttctacaggtattggatactcgaggaagactgttgactgcattgggatatgggctctggccatcaatggttcttctctctgaaattgttcaaactttcatccttgcagatttttgctactactatgtgaaaagtactttgggtgggcaactcgtgatgcgtttaccttccggcgtagtgtgagtgtaacccataaatttatgtagaatttgaaatatgggtatatttaatttgacctttttcctctcttttctttttttcttcttccatattgtgcttagtttagagattttgagcaaggatatgtagctatgattacctaaatgattgtcctgtctatgtgaattaatgtggagttaagaactaaaaacacacac

SEQ ID NO: 2088 - DNA, 1258 bp, Phalaenopsis aphrodite
cggccattagcgaagctccgagctccaactctgttggcggaactttgtactgatccgatccctgcaccagaggttctcaacgtaggaagatcccctctcttcgttcttctagataggtttttgttcttgtggtgagctgattagggatcgagcaatcggcgttgaggatgagggtttcgaagcgatcgatcggcgtggtgtgggcatgggtccggcagcagccgccgaagatcaaagcgttcctctccgtggtcaccgggatggcagcactcgccttccttagattcgtggttcacgaccacgataatcttttcgtcgcctctgaggccgttcacgccgtcggaatctcggtgctcatctacaagctcaccaaagagaaaacatgtgccggactatccctcaagtctcaggaattaacggctttgttcttatctgttagactttactgcagttttgttatggagtatgatatacacacgttgctggattctgccactcttgtaacaacactgtgggttatttatatgattcgttttaaactaaaatcaagctacatggaagataaggacaatttcgcaatatactatgtggttgtgccctgtgcagtgttagctttgttggttcacccaactacatcacacaatcttgttaacaggattttctgggccttctgtgtttatcttgaagctgtttctgtgttgccacagctccgtttgatgcagaacaccaagattgttgagccatttactgcacactacgtatttgcattaggaattgccaggtttttgagctgtgcccattgggttcttcaggtattggacacacggggaagattgctgactgctcttggatacggcttgtggccatcaatggttctcctctctgaaatagtccaaacattcatccttgctgatttctgttattattatgtgaagagtgtattcggtgggcagcttgttctgcgtcttccttcaggtgttgtgtgagatatattatattattattattatttattattattattattagaatgttttattttggtaaattgatgcatatttggacaattttttaatgtagaaactagaaatagaggctaattcaattgttgttgatcagaatgagatttacgataaaagaaattctactgcttttttatgagagctttggatttcttagcgtctgtttggggccattttgttatatattttattctattttatgcatctttatatccaacgcctaaattttaaatgcc

SEQ ID NO: 2089 - DNA, 1246 bp, Amaranthus tuberculatus
gtttataaaaaccctaaacagtagaaaaaatttgaagatgaggccacagagaaggccgattcaagcagtaatggcgtggctaagaagacaaccgccgaaagtgaaggcttttcttgcagtagtcgcaggaatggcagcgttggtgttgttaagagctgttgttcatgatcacgataatctttttgttgcttctgaagctgttcatgttattggaatcgctgttcttatctataaacttacaaaggagaaaacttgtgcgggactgtcattgaaatcacaggagctgacagctatcttcttggcagttcggctgtactgcagttttgtcatggaatatgatattcacacactactagattctgccaccttagtttttacaatttgggtcatctatatgattcgatttaagctaaggtcaacttatatggaggacaaagacaattttgctctttattatgtgttattaccttgtgctgttttggcatttttggttcatccctcaacttcacacaactttttcaacagaatattgtgggcattctgtgtatatttagaagcagtctcagttctgccacagctacgggttatgcaaaatacaaagattgttgaaccatttacagcgcattatgtatttgcgcttggagtagcaagattcttgagctgtgcccactgggttcttcaggtattggacagccgtgggcaccttctaacggctctgggctatggattatggccatcctttgttcttatttcggaaattgtgcaaactttcattcttgcagacttctgttactactatgtcaaaagcatctttggagggcaacttgtcctacgtcttcctacgggagttgtgtaaactcagttaaagggaggctgcacaaacaaaaatagtttagagagctcgtgggtgtttttctttcacgttcagccttctttgcactccatacaggcgatctgtgctttctagtgtgattataacctgattcggtaggggatgtgtaaacgttaggggtgatagaagaacattggattaacgttgatttaaactgcttcgtttatctgaacgattacattaatttttcagcaccaaaactccgatttatctcataggcaagtagcaattgaagtggacgaaatcatgtgtttcttcactttcgatatgcttcatgtgctttttgtctgtatgtcatgaatctgcggttgatgaagaagcccaactattaaggacttgaaaacagtcgtggga

SEQ ID NO: 2090 - DNA, 1324 bp, Amaranthus tuberculatus
cttctattcagcctaaatggaccattttattttataatctccctaactttgtaagactcaatttcttgtctcttctcaattttttctcttttcttaccaaattcaaaaccaacccaataatctctgcaaaatcttctccaatttcccatacttttctcaattacccacaaatcattaacaataatgaagggaggaaaacgaaccccagtacaagctgtaactctatgggtacgaagacaacccccaaaggtgaaagcttttcttgctgtgattgcaggaatggctgctttagttttcctaagaatggttgttcatgatcatgataatctttttgttgctgctgaagctgttcatgctattgggattgctgttcttatctataaacttaccaaggagaaaacttgtgctggactctcactgaagacccaagaacttacggctatctttttggctgttagattgtactgtagttttgtgatggaatatgacattcacacgctgttagatacagctacattggcgacaaccctctgggttatttatatgattcgctttaagttgaagtccacttatatggaggagaaagacaactttgctatttactatgtggtgggaccttgtgctttattgtctctactcgttcatccttccaccgtccacaacatcgtcaacaggatcagctgggccttttgtgtttatctagaggctgtttcagttctacctcagctaagagttatgcagaacacaaagattgtcgaaccattcacagcccattatgtttttgccctaggggtggcaagatttttaagttgtgcacattgggttcttcaggtcttagacacccacggccgcttgcttacagctttaggctacggtttgtggccttcaatggtgttgctttccgaagtcgttcaaacttttatcctggcagatttctgctattactacgtgaagagtcttgttggtgggcagctcgtcgtgcgtctcccctctggtgtggtgtaaatttagcgcttaggtacgtagcaaaaacgatcagagtaatgcatccttgtttaacttaaaaccccaaaggagtaaatcgggtgctttttgttagttagtcttttcggcaatgtgaattttctgtacaaacttgttgtttctcgcaacgacttaagctggtttcgaccagggatgtatctaaaccgggatattcatatcccattaattttcgtattttgaactagactttcagcctctggtgcaatttgcaatcaggacgatttttagtcttttaaccttcaaataagtttacctgtggtgtgccatgtttgaccaaccc

SEQ ID NO: 2091 - DNA, 1101 bp, Theobroma cacao
aaaaaaaaaaaaagaagaagaagaagacatgagggcgcagaggaggccgatccacgcggtgtcgatgtgggtgagacgacagccgccgaaggtgaaggcttttttggcggtggtatcggggatggcggcgcttgttcttctacgattcatcgtacacgaccatgacaaccttttcgttgccgccgaggctgtccactccatcggaatctctgtcctcatctataagctcacaaaggagaagacttgtgctggactatcactcaaatcccaagaactaacggctatctttttagctgttaggctgtactgtagctttgtcatggagtatgatatacacaccctacttgatttagccacattggctacaaccttgtgggttatttatatgatccgtttcaaactaaagtccagctacatggaggacaaggacaactttgctatatattatgttgttgcaccttgtgcagtactagctcttcttattcacccatcaacttctcataatttattgaaccggattttctgggcgttctgtgtatatctggaagctgtttcagttttacctcagttgcgagtgatgcagaataccaagattgttgagcctttcacagctcattatgtttttgcattgggtgttgcaaggttccttagctgcgctcactgggttctccaggttttggacagtcgaggtcatttgctggtagccctgggttatggattgtggccttctatggttcttatatctgaaattgttcaaactttcattttagcagacttctgttactattatatcaagagtgtctttggagggcagcttgttctccgtcttccctctggagtggtataagtgaggatgctgttttgctttggtcgatgagcttgctgcctcaaaaactataacttggttacaaatgtgactgggtgtccttgtttaagttctggttttttgctctcgacatgttcctcgtgactgggaattagtggatgttttgtaaatttcgggatgcagcaactttgggtggttatttatattaaaaacatttcatagatggattaatttttggtgtcaaatgccaatcttctgcttatattaagttaatt

SEQ ID NO: 2092 - DNA, 1544 bp, Citrus clementina
tccaacccaaaaaaatagtctacaagaccatttggtcaaataatttttcagatccggacccgataatccatacccgaccgagagcgcaaattatattcggagcagagctaaaaccgatgtatcatcactagagagcaaagccccaatcggaaactcaattgtctcgctctctctaaattacatctcactctctcgcactttctcttaatttccggtaaaatatttttagaccgctcatgagggcgccgaagaggccgatccacgcggtttcgacatgggtccggcgacagccgccgaaagtgaaggcatttttggcggtggtctccggcatggcagcgctggttttgctccgattcattgtacacgaccacgataacctcttcgttgctgccgaggccgtgcactccattggaatctccgtgttaatatacaagctcatgaaagagaaaacttgtgctggactgtcactcaaatcccaggaactaacagctattttcttagctgtgaggctatactgtagttttgtgatggaatatgatatacacaccctactggatttagctactttggctacgaccctttgggttatttatatgatccgtttcaatctaaggtctagttacatggaggacaaggacaactttgcaatatattatgtggtggtaccctgtgcagtattggctctgttaattcatccatcgacttcgcataatatattgaataggattttctgggctttctgtgtttatctggaagctgtttcagtactgccccagttgcgggtgatgcagaacacaaagattgttgaaccattcacagcccattatgtatttgcgcttggtgttgcgaggtttttgagctgtgcccactgggttctccaggttctggatagtcgtggacacttgctggtagccctgggctatggattatggccttcgatggtgcttatctcagagattgtccaaactttcatcttagcggacttctgttactactatgtcaaaagtgtctttggcggacagctagtcctccgacttccctccggggtggtgtaattgcaaaaaattgtcgtgcatggtctatgagcacattgacatatacaattaactttaatcagagcgtgtggctggtggttctggttcaaattcccattttgctttcgattttggactccctaggtcttgcaatcatgattggaagttaaatgggttgtttaggaaagttggggatgcaggaaatttgggtggatatttatatttgaaaatgattttatagtcactcaactctgccaaggctgatcttttgcatacgataaatgttggaagcttatgttagattttgtgggcctccatcttgtcatgcaattaaagtcagaccttatattttgaatggctactggtgttgaattaatgtgggcactgggcggctttcatattattacgtgtcatcttattaaaaacttaatttgtttagcatcgatatacaagaaatagaaaatatatatattttgatgcaatccgcagtaaggtttcatcattgtttta

SEQ ID NO: 2093 - DNA, 1226 bp, Elaeis guineensis
cccattgggtctcccctttcaaagaagaaagtaggaagaaaaagggctcttttatttctcctctcgtcctccgctattcggattgggagagaaggcaccgaaagggagggagttgtcgatcgatcggaccggaggagcgaagatgaaggcatcgagggggcggataaacgccgttgtgggatgggtgaagcggcagccgcccaaggtgaaggctttcctgagcgtcgtggcgggcatggcggcactcgtcttcctcagattcgtcgtccacgaccacgacaacctcttcgtcgccgccgaggccgtccatgccatcggcatctcagttctaatctataagctcaccaaggagaagacctgcgccggactgtcactcaagtctcaggatctaacagctttatttttagctgttagactgtactgcagttttgttatggagtatgacatacacacactgctggattctgctacacttgtgactaccctgtgggttatttatatgattcgatttaagctgaagtcaagttacatggaggataaggacaactttgcaatatactatgtggtggtgccttgtgctgcactagcccttttaattcatccttcaacatcacataatattgtgaacagatttttctgggccttttgcgtctatttggaagctgtctcagtgttaccccagttacgtttaatgcaaaacacaaagattgttgaaccattcacagctcactatgtatttgcattaggagttgctagattcttgagttgcgcgcactgggtccttcaggtcctggatactcgtggggccctgttgacagctttgggatatgggatgtggccatccatggttctcttctcagaaattgttcaaaccttcatccttgcagacttctgctattattacgtcaaaagtcttgttggtgggcaattggtgctacgtcttccttctggggtagtataaatttgaagattctgtgcaacctctcagttatcataccccgaagtaacttgatgtgaaatcctattttgtgcattttctattgccttatcccttagaaacctatagcctttgcaatttgtcaatggtgatgtcaagttgtgaacacatgcgaagtctaagaaatttaaaagcatttgtagatatcttgaatgataatgctttggttttttgctgactgcctgtactttagataaagctaatctagatcttttgtggatcttttatc

SEQ ID NO: 2094 - DNA, 1257 bp, Allium cepa
acttattaataataatgagtccggtatataaataacaattcgtactgcgtgctatggacatacagatacttccgggcctgataattccattaaattaaaaacagaaactaccccctctatcaaaatctcccaaatttttattgccaatcccacaaaatcaagagccgatttttacagatcgaaaatgagaggaacatcaaagagacaaataaacatggtgatttcatgggtaaagcgtcagccaccaaaagtaaaagcttttctgagcgtcgtgtccgctatggctgctcttgtttttctgagattcattgtccatgatcacgacaacctttttgttgctgctgaggctgctcacgcgattggaatttccgttcttgtttacaagctcaccaaggagaaaacttgtgctggactatctctcaagtctcaggagctaacggctttatttttagcagttcggttatactgcagttttgttatggaatatgatattcacactgtgttggactctgcaacccttgcatccacgttgtgggttatttatatgatgcggtttaagttaaaatctagctatatggaggacaaagacaattttgcaatgtactacgtggtagtaccttgtgcggcattagcttttctaattcatccttctacatcacacaacatcctcaatcgaatttgctgggcgttttgtgtttatttagaagctgtttcagtcttaccccagctacgtctgatgcaaaacacaaagattgttgaaccgtttacatctcactatgtctttgcattgggagtcgcgagatttctcagctgtgcgcattgggttctacaggtattggatactcgaggaagactgttgactgcattgggatatgggctctggccatcaatggttcttctctctgaaattgttcaaactttcatccttgcagatttttgctactactatgtgaaaagtactttgggcgggcaactcgtgatgcgtttaccttcaggcgtagtgtgagtgtaacccataaatttatgtagaatttgaaatatgggtatattttatttgacctttttcctctctttcctttttttcttcttccatattgtgcttagtttagagattttgagcaaggatatgtagctatgattacctaaatgattgtcctgtctatgtgaattaatgtggaattatgaactatgactgctctattcttgtttttggcattcttgatcaaattaatggttttgagtgaccagctttgttcc

SEQ ID NO: 2095 - DNA, 2275 bp, Citrus sinensis
tccaacccaaaaaaagagtctacaagaccatttggtcaaataatttttcagatccggacccgataatccatacccgactgggagcgcaaattatattcagagcagagctaaaaccgatgtatcatcactagagagcaagccccaatcggaaactcaattgtctcgctctctctaaattacatctcactttctcgcactttctcgcactttccgggaaaatatttttagaccgctcatgagggcgccgaagaggccgatccacgcggtttcgacatgggtccggcgacagccgccgaaagtgaaggcatttttggcggtggtctccggcatggcagcgctggttttgctccgattcattgtacacgaccacgataacctcttcgttgctgccgaggccgtgcactccattggaatctccgtgttaatatacaagctcatgaaagagaaaacttgtgctggactgtcactcaaatcccaggaactaacagctattttcttagctgtgaggctatactgtagttttgtgatggaatacgatatacacaccctactggatttagctactttggctacgaccctttgggttatttatatgatccgtttcaatctaaggtctagttacatggaggacaaggacaactttgcaatatattatgtggtggtaccctgtgcagtattggctctgttaattcatccatcgacttcgcataatatattgaatagaattttctgggcattctgtgtttatctggaagctgtttcagtactgccccagttgcgggtgatgcagaacacaaagattgttgaaccattcacagcccattatgtatttgcgcttggtgttgcgaggtttttgagctgtgcccactgggttctccaggttctggatagtcgtggacacttgctggtagccctgggctatggattatggccttcgatggtgcttatctcagagattgtccaaactttcatcttagcggacttctgttactactatgtcaaaagtgtctttggcggacagctagtcctccgacttccctccggggtggtgtaattgcaaaaaattgtcgtgcatggtctatgagcacattgacatatacaattaactttaatcagagcgtgtggctggtggttctggttcaaattcccattttgctttcgattttggactccctaggtcttgcaatcatgattggaagttaaatgggttgtttagtaaagttggggatgcaggaaatttgggtggaatatttatatttgaaaatgattttatagtcactcaactctgccaaggctgatcttttgcatacgataaatgttggaagcttatgttagattttgtgggcctccatcttgtcatgcaattaaagtcagaccttatattttgaatggctactggtgttgaattaatgtgggcactgggcagctttcatattattacgtgtcatcttattaaaaacttaatttgtttagcatcgatatacaataaatagaatatatatatattttgatgcaatccgcagtaaggtttcatcattgttttagatgccggagctaccgattaaggctggaacttacgcgtggaatctgttgtaacacaaaatgtaggacgaagcttcaaataaaagttttaaggtgttgggagtagcagaagttattacacaaaacaacaaacataggacactgggattaacacaaactgaggctttgttttctgtcttaacgattgtaaaaccaagagtatgaaactactcgagccacactcttattttcagacggtgagattcctagcaagaatgccctcaaaggtaattccagggccaaaagctagtatcaatccccaatcggtgtcttcatgatcctgtgacttcattttcaaactctcttccaacatatactccagcacatacacaatggtgttgctgctagcattcccataatccatcagagctcttctgctggcattcagtttatctggcaacaaattcagtctcttttccaacttattcaatatcgcaggccctccgggatgaactgcccaaaacatcttgttgtaatcattgttggtaaatccaatattgcccattagcttgccacagaatccttcaatgttatcctcgattatctgaggcagctctcttgccagcttaaagctaatcccctcttccgtaagcctcccgtctattgttttttcggtatttggcaagaagttctggattgctgtgtgcagctcaaagagaggcctttcactgggaaccgggtctgagccaacgat

SEQ ID NO: 2096 - DNA, 1302 bp, Populus trichocarpa
gataacaggaaagaaaataattccgtaaaagcccaataaaaaaatcccctccctttttcaatctatcgtcctaatttcccctcaatttccatcactttctcaggaaaatcatatcgaattccacgatgaggccaccgaggagaccgatccatgtggttacgacgtgggtgcgacggcagcctccgaaggtcaaggcgtttttggcggtggtggctggaatgtcagcgctggtgctcctcagattcatcgtacacgatcacgataacctctttgtggctgctgaggctgttcactccattggaatctctgtgcttatttataagttaatgaaagagaaaacttgtgctggattatctctgaaaactcaggagctgacagctatgttcttagctgtaaggttgtactgcagcttcgtaatggaatatgatatacataccatactggatttagctacgttggcaacaaccctgtgggttatttatatgatccgttttaatctgaagtcgagttacatggaggacaaagacaactttgcattatattatgtggcggcaccctgtgctgttttggctttgcttattcatccgtcaacagctcataacctactgaaccggatcctctgggcattctgtgtatacctggaagctgtttctgtgcttcctcagttgcgggtcatgcaaaacaccaagattgttgagccattcactgctcattatgtatttgcattgggtgttgcaaggttcttgagctgtgcccattgggttctccaggttttagatactcggggacacttgttggtggccttggggtatggattatggccttctatggttcttatctcagaaatcgtccagactttcatcttagcagatttctgttattattatgtcaaaagtgtatttggagggcagcttgttctccgcctcccctctggagtggtgtaactaaagttcttttatggtgtggtcgatgagcaacgttgccacctaaaatttctctatcaaatcatgactggagaaaagtgggttcacttctaaagctggggatgcagaaactttggttggatatttgcacttaaaatataatttaatggatggttaattaatttttcggcgctaatattctcttctgttcatgctgtgagagttgatgcaaatctagttacctttatgaggtgctaacttttgatacccatcaaaactgatataagagcatgtcttgagtaggcttaggggagattttgataaatagttaaaaacgaattgatggggctgtcaagttgtagtaaaggaggtttttggc

SEQ ID NO: 2097 - DNA, 1375 bp, Papaver somniferum
gatgaaattaatatttaaattcctgtcttgagttttgactctgcgacttctaaaaacgtcttaaaaagtagtagtagtataatttttgatatctaagttatcaattcttcttcatcttgattcagatcagagagactgagagaggatgagaggatcaaagacaccaatccacgcggtagcaacatgggtacgaagacaaccaccaaaagtgaaagcttttctagctgtaatttctggtatggcagctttggttttcctccgatttatagttcacgatcatgataacttgttcgttgctgctgaagctgttcattctcttggtatctgtgttcttatctataagctcatgaaggaaaagacatgcgctggactttcactcaagtctcaggaactaacagcaatgtttttagctgtcagactttactgcagttttgttatggaatatgatatacatacgctgctggattcagctacattagtagcaaccttgtgggttatttatatgattcgttttaagttgagatcgagttacatggaggataaagacaacttcccaatatattatgttgcggccccatgcgcggtgtttgctgtttttgtacatccatccacatcgcaccatatggtaaaccgaatatgctgggcattctgtgtgtacctggaagctgtttcggtgttgccccagttgcgtgtgatgcagaacacaaagattgttgaaccatttacggctcattatgtatttgcgctgggtgttgcgaggttcttgagctgtgcccattgggtcctccaggttttagacacacatggacggttactaacagcattgggttatggattgtggccatccatggtacttctctcagagatagtccaaactttcatccttgcagacttctgttactattacgtgaaaagcgttgttggtggccagcttgttttgcgtcttccatctggagtggtatagaacacctgagagggaatccataactttgtgcaaattgtatgtgctgcggtggcaaccaagttataacttccaagtgatctgtcagattgtggttatctctaattgcgctccaggtggtcagtgaacccacattttcttgcattgttgacttaatagactctgggtttacagttgtaaagttggagaatttttggtaatatttttagtttaaaggatgaattctaggttctcttttccttgctttggtacatgaaaccgttctttcacacacgattacctatctagcagttccatggatgttcatggtgtgaatttttgttttgctttaaatcatcaataagcaacatgcacaatcagggagtatatctttatttccatctgtaatatctgtaagaaacacattctttttgc

SEQ ID NO: 2098 - DNA, 1303 bp, Ananas comosus
aattagggcttttgctcctcctcctcgtctcttctcccaccccttcgatcgatcgagcgaggcgaagaaggcgacgacaatggcgagggttttgtcgaagggcgcgatggcggcggcggcgaggtgggtgcggcggcagccgccgaaggtgaaggcgttcctcgcggtggtggcgggcatggcggcgctcgtgctcatacgcgccgtcgtgcgcgaccacgacaacctcttcgtcgccgccgaggccgtccacgccctcggcatctccgtcctcatctacaagctcaccaaggagaagacctgcgccggactgtcacttaagtctcaggacttaacagctcttttttagctgttagactgtactgcagctttgttatggaatatgatatccacactcttctggataccgctgcactcgcaactaccttgtgggtcatttatatgatgcggtttagactaaagtcgagttacatggaggataaggataactttgcaatatattatgtggtgctgccgtgtgccgtgttggcccttcttatccatccgtcaacatcgcataatatccttaacaggatttgttgggcattctgtgtttatctagaagcggtctcagtgttaccccaattacgtttgatgcaaaatacaaagattgttgaaccattcacatctcactatgtattcgctctgggtgtggctagatttttaagttgcgcacactgggtccttcaggtcctggacactcgcggccgtctgctgacgcagttgggctacggattgtggccgtccatggttctcctcgccgaaatcgtccaaacattcatcctcgccgatttctgttattattacattaagagtctcgtcggaggccaactggtgctgcgccttccttctggtgtggtgtaaagatttgaaactttacgcgtgcgagttctcagcttcctgtactatgaagtatattcatattcctgcatgatgaactctttggcttgattgttctgatgctaaattgtagaagtgtacatatttaagtgaaaatttattttggttttatgaagcttttgcgaatttgcgtttgaatctgtttatttcgctttgatgttttgctttgtttttggcctctcattcctttttagtgtgtcaagaaattgttgtctcatcaaacagatggggtaggcggttttggtcatccttgatttacatattttttaattattgcatgatgtatgatgatgcttgtgggtggtagaaatttcattttggattgtagagattcctctgatcatcacgcaaagttggtcaatcc

SEQ ID NO: 2099 - DNA, 1268 bp, Euonymus alatus
acggcaagaagtcacgaacgcagagcaacttcaaatacgtccgttctggtccagattgaatcaacctcaaacatcttcagtctttcccggattaagaagagaagcaaatagaccgccatgagagcgccgaggaggccgatccacgcggtgtcgacatgggttcggcgccagcccccgaaagtcaaagcctttttggcagtggtttcgggaatggcggcactggtgctgctccggttcatcgttcacgaccacgacaatctcttcgtagctgccgaggctgtacactccatcggaatctctgtccttatctacaagctcatgaaggagaaaacttgtgccggattgtcactaaaaacccaggaactgacagctatgttcttagctgttagactgtactgcagttttgttatggagtatgatattcatactctacttgatttggctaccttggcaacaaccatctgggttatttatatgatccgtttcaaactaaggtctagttacatggaggataaagataactttgcgatatattatgtggtggtaccctgtgctgttttagccttgttaattcatccaacaacttctcataatatattgaacagaatattctgggcattttgtgtatatctagaagctgtttcagtgctacctcaactgcgggtcatgcagaacaccaagattgttgaaccattcacagcacattatgtatttgcacttggtgttgcaaggttcctgagctgtgcccattgggttcttcaggttttagatagtcgcggacacttgttggtggctttgggctatggattatggccctctatggttcttatttctgaaattgtccagactttcatcttggctgacttctgttattattatgtcaaaagtgtttttggaggacagcttgtccttcgacttccctctggagtggtgtaactgtaaaatcctcttgggatgtaaactcaatgcgtattatgaaacattaacttgtgtgatccttgaagttcatttctgccttgctgtacgatatttgcttacatcatgactggaagtcgaattggtggtttgtaaattaggggatccacaaaacttggccggatatttatatttgaaacatgatggtatgtcgatcttcgtttctttttcttactccaacatcctagtagccaaatcttgtgatttctactggactagtttgttcgaagttgagatgactctttggcttcagcattgacctgattaaccacttctctaaagatatattgtta

SEQ ID NO: 2100 - DNA, 874 bp, Platanus occidentalis
ttttgcgagggagtcgagatgaggggacagaggagacccgtccacgctgtggcgacatgggtgaagcgtcaaccgccgaaggtgaaggctttcctggccgtcgtttcgggcatggccgcgcttgtactcctccgctttatagttcacgatcacgacaacctctttgtagcggccgaggccgttcacgctctcggaatctctgttctcatctacaagctcatgaaggagaagacctgcgcgggactttcactcaaatctcaggaactaacggctatatttctagctgttagactgtactgcagttttgttatggaatatgatatacacacactacttgattcagctacactggggacaaccctgtgggttatttatatgattcgttttagactgaagtctagttacatggaggataaagacaactttgcaatatattatgtggtggtgccatgtgtacttttagctctagctattcatccatcaacatcacataatattttgaacaggatttgctgggctttctgtgtatatcttgaagctgtgtcagtattgcctcagttgcgagtaatgcagaatacaaagattgttgaaccatttacagctcattatgtttttgcgttgggtgttgcaaggttcttgagctgtgctcattgggtcctccaggtcttagacaccaggggacgtttattgacagctttggggtatggactgtggccttctgcggttctcctttcagaagttgtccagactttcatacttgcagacttctgttactattacgtcaaaagtctggttgggggacagcttgtgcttcgtcttccctcgggagtggtgtaaggctgaagctttcatgtgcagtagtgtttgggttttc

SEQ ID NO: 2101 - DNA, 1369 bp, Populus trichocarpa
cccccccaaaataaaaataaaaataaaaataaaaatcccctccctctttaaaatctccatcaagcagtcaagccctaatttcccctcaatttctctcaatttccatcactttctcaggagaatcaaatcgaattctacgatgagaccaccgaagagaccgatccaagtggtaacaacatgggtgcgacgacagcctccgaaggtcaaggcgtttttggcggtggtggcggggatgacagcgctggtgcttctccgattcatcgtacacgatcacgataacctctttgttgctgctgaggctgttcactccattggaatctctgtgcttatttataagttaatgaaagagaagacttgtgctgggctatcactgaaaactcaggagctgacagccatgttcttagctgtgaggctgtactgcagctttgtaatggaatatgatattcataccgtactggacttggcaacgttggctacaaccctgtgggttatttatacgatccgttttaaactgaagtcgagttacatggaggataaagacaactttgcattatattatgtggcggcaccttgtgctgttttagctttgcttattcatccatcaacatctcacaatctactgaaccggatcctctgggcattctgtgtatacctggaagctgtttctgtacttcctcagttgcgtgtcatgcagaacaccaagattgtcgagccattcactgctcattatgtatttgcattgggtgttgcaaggttcttgagctgtgcccattgggtcctccaggttttagatactcgtggacacttattggtagccttggggtacggattatggccttctatggttcttatctcagaaattgtccagactttcatcttagcagatttctgttattattatgtgaaaagtgtatttggagggcagcttgtgcttcgtcttccctctggagtggtgtaattgaagccgtcttctggtgtagtctatgagcaaaattgctgcctgaaattgacttgggcaatgctgttgagatctgttttgttctccagttaagtttctctttcaaattatgaccggagaaaagtgggtttacttgtaaagttggggatgcagaaacttggttggaattttgtacttaacacataattaattgatggttaacttaattaatttgtcggctgtaatcttcctttttgtttatattgtgagagttgatgcaaatctagtaccttttgtgacgtgcaaacttatatttcatgagtgatccctgtcaaagctgatacaagagcctgtcttcttgagtaggctatgagatttggataaacagttagaattgatagagctatcaagttatacaaggacagttttggg

SEQ ID NO: 2102 - DNA, 1404 bp, Papaver somniferum
cttcttcagaacttccacattacttcaccattaataagataagatgaaattaatatttaaattcctgtcttgagttttgactctgcaacttctaaaaacgtcttaaaaagtagtagtataatttttgatatctaagttatcaaaacttcttcatcttgattcagatcagagagactgagagaggatgagaggatcaaagacaccaatccacgcggtagcaacatgggtacgaagacaaccaccaaaagtgaaagcttttctagctgtaatttctggtatggcagctttggttttcctccgatttatagttcacgatcatgataacttgttcgttgctgctgaagctgttcattctcttggtatctgtgttcttatctataagctcatgaaggaaaagacatgcgctggactttcactcaagtctcaggaactaacagcaatgtttttagctgtcagactttactgcagttttgttatggaatatgatatacatacgctgctggattcagctacattagtagcaaccttgtgggttatttatatgattcgttttaagttgagaccgagttacatggaggataaagacaacttcccaatatattatgttgcggccccatgcgcggtgtttgctgtttttgtacatccatccacatcgcaccatatggtaaaccgaatatgctgggcattctgtgtgtacctggaagctgtttcggtgttgccccagttgcgtgtgatgcagaacacaaagattgttgaaccatttacggctcattatgtatttgcgctgggtgttgcgaggttcttgagctgtgcccattgggtcctccaggttttagacacacatggacggttactaacagcattgggttatggattgtggccatccatggtacttctctcagagatagtccaaactttcatccttgcggacttctgttactattacgtgaaaagcgttgttggtggccagcttgttttgcgtcttccatctggagtagtatagaacacctgagagggaagcttactttgtggaaattgtatgtgctgcggtggcaaccaagttataacttccaagcgatctgtcagattgtggttatctctaattgcgctctaggtggtcagtgaacccacattttctggcattgttgacttaatagaatctgggtctacagttgtaaagttggagaaattttggtaaatattttagtttaaaggatgaattctaattctaggttctcttttccttgctttgttacatgaaacccttctttcacagataattacctatctagcagttccatggatgttcgtggtgtaagaatttttgctttgcgttaaatcatcaataaggtagtcagatgaattgcaacatgcataatcatggagtatatctttatttcccaa

SEQ ID NO: 2103 - DNA, 1151 bp, Gossypium hirsutum
attacgaataggcggatacccactttctctaaatcccacaaaatttccatactttctcgggaacaagaaagaaaaagaaaagacatcatgagggcagagaagaggctgatccacgcggcaacgatgtgggtgagacgacagccgcccaaggtgaaggcttttttggcggtggtgtcggggatggcggctcttgttttgctccgattcatcgtacacgaccacgacaacctcttcgtcgccgccgaatctgtccattctctcggaatttctgtactcatctataaactcacaaaagagaagacttgtgccggactatctctgaaatcccaagaactaacagctatatttttagctgttaggctgtattgtagctttgtcatggaatatgatatacacaccatacttgatttagccacattggctacaaccttatgggttatttacatgatccgttttaaactcaagtcgagctacatggaagacaaggacaactttgctatttattatgttgttatcccttgtgcagtactagctctgtttattcatccatcaacttcacataatcttatgaaccgaattttctgggcgttctgtgtatatctggaagctgtttcagttttacctcagttgcaagtgatgcaaaataccaagattgtcgagcctttcacggctcattacgtatttgcattgggtgttgcaaggttcctcagctgtgcccattgggttctccaggttttagatagtcgaggacacttgctggttgccctaggttacggattatggccttctatggttcttatttcggaaatcgttcaaactttcattttagctgacttctgttactactacatcaagagtgtattcggagggcagcttgttctccgtcttccctctggagtggtataagtgaagatgctgtcgtgtagtcgttgatgagcttgctgactgaaaaaagaagtatgactcgtttccgtaatgtggcaagttatccttgtttaagttcttgtttttcgctctcgacgcctttcttttgactcgatatcagtggatagtttgtatacttcggaagaggatatttatatcgaaaacatttcatagatggattaactcttttttttgtgtcaaatccttaaattattagaataagcttt

SEQ ID NO: 2104 - DNA, 1193 bp, Gossypium hirsutum
acaaaatttccatcactttctcgggaacaagaaagaaaaagaaaagacatcatgagggcagagaagaggctgatccacgcggcaacgatgtgggtgagacgacagccgcccaaggtgaaggcttttttggcggtggtgtcggggatggcggctcttgttttgctccgattcatcgtacacgaccacgacaacctcttcgtcgccgccgagtctgtccattctctcggaatttctgtactcatctataaactcacaaaagagaagacttgtgccggactatctctgaaatcccaagaactaacagctatatttttagctgttaggctgtattgtagctttgtcatggaatatgatatacacaccatactcgatttagccacattggctacaaccttatgggttatttacatgatccgttttaaactcaagtcgagctacatggaagacaaggacaactttgctatttattacgttgttatcccttgtgcggtactagctctgtgtattcatccatcaacttcacataatcttatgaaccgaattttctgggcattctgtgtatatctggaagctgtttcagttttacctcagttgcaagtgatgcaaaataccaagattgtcgagcctttcacggctcattacgtatttgcattgggtgttgcaaggttcctcagctgtgcccattgggttcttcaggttttagatagtcgaggacacttgctggttgccctaggttacggattatggccttctatggttcttatttcagaaatcgtccaaactttcattttagctgacttttgttactattacatcaagagtgtattcggagggcagctcgttctccgtcttccctctggagtggtataagtgaagatgccgtcgtgtagtcgttgatgagcttgctgactgaaaaaagaagtatgactcgtttccgtaatgtggcaagttatccttatttaagttcttgtttttcgctctcgacgcctttcttttgactcgatatcagtggatagtttgtatacttcggaagaggatatttatatcgaaaacatttcatagatggattaactctctttttttgtgtgtcaaatccttaaattattagaataagctttaaacattgatttcaattagtgaaaaatgccattactattatgttatataataaaatggataagggattcattgag

SEQ ID NO: 2105 - DNA, 1303 bp, Eucalyptus grandis
gaagaacatcgggacacgagcgcgcgcagagagagacagaaagagacagagagacatcatcggagaatcgaacgagaccggagttccggcgaagggcggaggggcaaagatgaaggcgtcgaagaggccgatccaggcggtggcgtcgtggctccgccgccagccgccgaaggtgaaggctttcctcgccgtcgtgtccgggatggtggcgctcgtgttcctccggatggtggtccacgaccacgacaacctcttcgtcgccgccgaggccgtccacgccgtcgggatcgccgtcctcatctacaagctcagcaaggagaagacctgtgcagggctgtcgctcaaatcacaggaactaacagctgtgtttttagctgtaagactttattgtagtgttgtaatggagtatgatatccatacattacttgattcggctacactagccaccactctttgggtcatctacatgattcgctttaagctgagatcgagttacatggaggaaaaagacaattttgctatttactatgtggtgattccatgtgctgtgctatctctagtgattcacccctcaacacaccatcatatcattaacaggatttgctgggccttttgtgtttatcttgaagctgtttcagtactaccccaactccgtgtcatgcagaacacaaagattgttgagccatttacggcgcattatgtttttgcactgggagttgcaaggtttttgagttgtgcccattgggtactccaggtactggacacaagaggaggcttactgacggcattgggatatggaatgtggccttccatggtcctcctgtccgaaatagtccagactttcattttggccgatttttgctactactacgtcaaaagcgtctttggtggacaactcgtgctacgtctcccctctggagtggtgtgaacgatgttaaattatacaggaagaatcggggaccatcttagacttctaccatctggagatggtagctactcttgtctagttccattttcacctcctcctgtcagaccattatagagttttccttttttctctctggtggatgttgagttgaggatgcattaccatctcgtacataaaattttccgtagaaaacttgtgcagattggcttcctgatgttggcatttaatatttattttgctgttgccgactgtggagatctcctgatagcttaatgtacagcttagaggctgttcttagtcctatgttctggagcttatctgatgtcatggctaaaattatcagaaatttcaactttcttgctgtccgtatttata

SEQ ID NO: 2106 - DNA, 1227 bp, Mimulus guttatus
tccccttttcagctcaaagattttcccccaaaaattgtccatattttccggcggaaaacctagcgaaattaaattgaatatccctgtatctatatatctatatatatatatatactgataagtttgcattgcggatatagaatatgagggcaccaaaaaggccgatccaggcggtgtcgacatgggtccgccggcaaccgccgaaggtgaaggcgtttctggccgtgattagcggcatggcggcgcttgttctccttagggcaattgttcacgatcacgataatctcttcgtggcagcggaggctgttcactctatcggaatcgccgttctgatttacaagttgatgaaggagaagacttgtgctgggctttcactcaaatcccaggagctaacagctatctttttagctgttagattgtattgtagtttcgtcatggagtatgacatacacactttgctcgacatggcaacactggctacgaccttgtgggttatttatatgattcgtattaaactccaatcgagttatatggaggataaagataacattgcactgtattatgtggtgggcccatgtgctgtattagctttactaatccatccttctacatcacatcacatcatcaacagaatcgcctgggctttctgtgtttaccttgaagctgtttctgtgctccctcaactgcgtgtcatgcaaaatacaaagattgtcgaacccttcacagctcattacgtattcgcattgggtgttgcgaggttcttgagctgcgctcattgggttctccaggttttggacacacgtggtcatcttctagtggcactcggttatggactatggccttcaatggttcttatatcggaaattgttcagaccttcatcctagccgacttttgctattactatgtaaaaagtgttttcggtggacagctcgtgttgcgccttccttctggagtggtgtaaatcagcagtcgtatacgcttttcttatttaattgttcgttttagtgcacttacacgccactcttgttatccgctggttcttacaaaatactaattcggttttagattagtcgataatcttcgttgtaagcgctttcaactatgaatttcattatcaccacaatactaaacttttatttctcatggtgtacttgtcatgtttttttggcttcaatagttttttacaccattgatggaagttaacaatggcaacacggttttttcgg

SEQ ID NO: 2107 - DNA, 1255 bp, Carica papaya
aacaaaagagatctcctgatcgcactcggttcccaaccaaatcaaatcgcacccgtatatacaaattctcacactcacttttcaatttttattcgattcgagtctccgtcgtcttcccgggaaagaggattatcagggggcgcacatgaggccacagaagagatcgatccacgccgtatcgacatgggtgaggaagcagccgccgaaagtgaaggcgtttttagcggtggtggccgggatggcggcgctcgtgctgcttcgattcatcgtacacgatcacgacaatctctttgttgctgctgaggctgttcactcgattggaatttccgtgctaatttacaaactcatgaaggagaagacttgcgctggactatcactcaaatcccaggaactaacagctatgtttctagctgttaggctgtactgcagctttgttatggaatatgatatacacactgttcttgacctggctactttggctacaactttatgggttatttatatgatccgtttcaagttgaggtctagttacatggaagataaagacaattttgctatttattatgtggtcataccatgtgctgtattagctttatttattcatccatcaacatcgcatcatttattaaacaggattttctgggcattctgcgtatatttggaagctgtttcagttctacctcagttgcgggtcatgcagaacacaaagattgttgaaccattcacagctcattatgtatttgcactaggagttgcaaggttcctaagctgtgcccactgggtcctacaggttctagatactcgtgggcacttgctcgttgcactaggttatggattatggccttctatggtccttatttcagaaatcgtccaaactttcatcttagcagatttctgttactactacgtcaaaagtgtttttggaggacagctagtacttcgtcttccatctggagtggtctaattgaacaatctcttgggctgtgtttgatgtagcctcaaagcaatcaaaattaacttatttgaagatgtggctggttgccccttaaagctcccttttttgcattccacgccattctggttgtctgtaaattggggattcatagaactttaggtgggatatatatgattttcatagctgggataaactttttagcatcattggtaatcttttgctatcttacctaaattatgtagacttacaatgtgctctgcaagtaaattagagatcacgaatggttaacgatgcttaaat

SEQ ID NO: 2108 - DNA, 1317 bp, Papaver somniferum
caaaaaaactgatgaaaagaaagtgaacctctgtctattgcatcaaccacttctaaatctgtcctccattaataaatccaatcctgcaaattcctcttctcaaagctatctggttcaaaccctcagctctaagcgcataatttgcaacactcatcatcttcatttccatatataaggagagcagtgatgagggctcagaagaagccaatccaagctgtagcaacgtgggtaaggagacaaccaccaaaggtgaaggcgtttttagccgtggtatcaggaatgactgctcttgttttcttgagatttatcgtaaacgatcacgataatctctttgttgcagctgaggctgttcatgctattggtgtctcggttcttatttataaactcatgaaggagaaaacatgtgctggactttcactcaaatctcaggaactcacagcaatatttctagctgttagactatattgcagttttgttatggagtacgatatacacacgcttctagatacagccacattggggacaaccctgtgggttatttatatgatccgatttaaactaagatctagttatatggaggataaagacaactttgcgatctattatgtgttggtgccatgtgccgtattagctctagccattcacccatcaacgtcacataatattttgaacaggatcttctgggctctatgtgtatacctagaagcagtttcagtgcttccccagttaagggtgatgcagaacacaaagattgttgaaccatttacagctcattacgtatttgccttgggcgttgcaaggttcttgagctgtgcccattgggtcctccaggtcctagatactcgtggacgcttactaacagctttgggttatgggctgtggccttctatggttcttttgtcagagatagtccaaaccttcatcctggcagacttctgttattattatgtgaagagcatttttggcggacaacttgttctacgtctcccctccggagtagtatgagagtcttaagcgagctcttctcttacacggtgtggcgctaactgttcacatcaataacttaagcttagagaatgtgtttttggtcatttttgttagttcgtcgttctctctcctttctgtagtagtcaatgatgactctaaattgttgtagcccggggtaactgtaaagatagaaatgcaagcgttctcttggtgttaaaatttatttcaaggaaatcatgattgttccatggctagactatattataacagtgtaagcatctccaatattaatgccatatctgttctggggttaaaaaaaaaaaaaaaaac

SEQ ID NO: 2109 - DNA, 1123 bp, Tripterygium wilfordii
acaaatagaccgccatgagagcgccgaggaggccgatccacgcggtgtcgacatgggtacggcgccagcccccgaaagtcaaagcattcttggcagtcgtttcggggatggcggcactggtgctgctccggttcatcgtacacgaccacgacaatctcttcgtagctgccgaggctgtacactccattggaatctccgtccttatatacaagctcatgaaggagaaaacttgtgccggattgtcactcaaaacgcaggaactgacagctatgttcttagcagttagactgtactgcagttttgttatggaatatgatattcatactctactcgatttggctaccttggcaacaaccatctgggttatttatatgatccgtttcaaactaaggtctagttacatggaggataaagataactttgcgatatattatgtggtggtaccctgtgctgttttagcattgttaattcatccaactacttctcataatatattgaacagaatattctgggcattttgtgtatatctggaagctgtttcagtgctacctcaactgcgggtcatgcagaacaccaagattgttgaaccattcacagcacattatgtatttgcacttggtgttgcaaggttcctgagctgtgcccattgggttcttcaggtcttagatagtcgtggacacttgctggtggctttgggctatggtttatggccctctatggttcttatttctgaagttgtccagactttcatcttggctgacttctgttattattatgtcaaaagtgtttttggaggacagctcgttcttagacttccctctggggtggtgtaactgtgaaatcctcttgggatgtaaactcggggcgtattatcaaacgttaacttatgtgatccttgaagctcctttctgccttgctgtaagatatttgcttacatcatgactggaagtcgaataggtgctttgtaaagtaggggatccacaaaacttggctggatatttatatttgaaacatgattttatgtcgatctttgtctctttttcttaaccaacatcctagtagccaaatcttgtgatgttctactggactagtttgttcaaagtcaagacgactctttggtttt

SEQ ID NO: 2110 - DNA, 1052 bp, Allium cepa
cgaaaatgagagggtcgtctaagaggcaaatcaacatggtgatttcatgggtgaagcgtcagccacctaaagtcaaagcttttcttagcgtggtatccgccatggcagctcttgttttttgagatttattgtgcatgatcatgataatctcttcgttgctgctgaagcttgtcacgcaatcggaatttctgttcttgtttataagcttactaaggaaaaaacttgtgctggactctctctcaagtctcaagagctaacagctttatttttagcatttagattgtactgcagttttgtcatggaatatgatattcacactttgttggattccgcaacccttttatctactttgtgggttatttatatgatgcggtttaaattgaaatctagctacatggaggaccaagacaattttgcaatatattatgtggtggtaccttgtgctgttttagcgttgctaattcatccttcaacatcacataatattatcaacagaattttttggggattttgtgtctacttagaagctgtctcagtgttaccccagctacggctaatgcaaaacacaaagattgttgaaccttttacatctcactacgtctttgctttgggggttgccagattcctgagctgtgcacattgggttctacaggtgttggatacgcatggtcggctgctgactgcattgggatatgggctgtggccgtcaatggtacttctctctgaaatcgttcaaactttcatccttgccgatttttgctattactatgttaaaagtattgtgggcgggcaactcgtgctgcgtttaccttcaggagtagtatgaatgtgcctgcaactttaattctaatataccctcacaaattagtgtaaaatctgaaacatggcttatttaatttgaacattttcctcggttcttattttgtgaatggcttatattgaatttagcttagagattgaggaaggacgtgtatttattatcttattatttacctgtgtttctgtccaactcattgcgatttctgcttgttcgttttcatcaaattaatggt

SEQ ID NO: 2111 - DNA, 1250 bp, Beta vulgaris
cccacgcgtccgaaattccatcttttattcttttgtcactccattttcaacgcccaacaaaacttttttcccacacattcatacacacagaaaaacagagagagaaaatgaagggaggtaaaagaagccctgtacaagcggtaaatctatgggtgcggcgacaaccaccgaagatgaaggcgtttcttgcggttgttgcagccatggctgcacttgttttccttcgtatggtggttcatgatcacgataatctctttgttgccgctgaagctgttcacgccattggtattgctgtcctcatcttcaagctcaccaaagagaaaacttgcgctggactttcactcaaatctcaagaacttacagctatatttttagctgttagactgtactgtagttttgtgatggaatatgatattcacacattactagatacagcaacattggcgacaaccctttgggttatttatatgattcgttttagactgaagtccacttatatggaggagaaagacaactttgctatttactttgtggtggtaccttgtgctgtattgtctctacttatccatccttccactgtccataacattgtcaataggattagctgggcattttgtgtctatctggaggctgtttcagtgctaccgcagctacgagtcatgcaaaacacaaagattgttgaaccattcacagctcattatgtttttgccctgggagtggcgagattttttagttgcgcgcattgggttcttcaggtcctagatacccatggtcgtttgctcacagctttaggatatggtttgtggccttcaatggtgctgctttctgaagttgttcaaacttttatcctagcagatttctgttattactacgttaaaagccttgttggtggacagcttgtgctgcgtcttccctcaggagtggtgtaagttaaaggtttagttatgcaggatcagagtgatacatccttgtttaacttgaaaaaacacagaggcgtaagtcaggtgctttttgttaaatttttatttttggcactgaatttcctgtacaaacaacttgtcagtttccgctactactagtgatataccgaggagattccaaccagggatgtatctgttcttaatatacatgtcatattaactgtttcactgtgaattagatgtttatcctgtgtaacattagtattagttagaacttttttcgttagctttccttcgctcaattgtttcatcaactattcagcaggttct

SEQ ID NO: 2112 - DNA, 1230 bp, Manihot esculenta
gagattctcttcctcgcttcttctacatataaattcaaccctcttttccctcaacttttatcttttccggtgaaaccaatcagcttctccgatgaggccgcataaaaggccgatccacgctgtcacgacatgggtgcgacgacagccgcccaaggtcaaggcttttttggcggttgtgtctgggatggctgctctcgtcttgctcagattcattgtacatgatcatgacaatctcttcgtcgctgccgaagctgtgcactctctcgggatcagtgtccttatatacaagctcatgaaggagaagacttgcgctggactatcactgaagtcccaggaattgacagctatgtttttagctgtcaggttgtattgcagctttgtgatggaatatgatatacataccttacttgatttggctacattggcaacgactctgtgggttatttatatgatccgtttcaaattgagggctagttatatggaggacaaagataactttgcaatatattatgtggcgttaccctgtgctattctagcattgtttattcatccatcaacatctcataatctattgaacaggattttatgggcattctgtgtatacctggaagctgtctcagtactaccacagctgcgggtcatgcagaatacaaagatagttgaaccattcactgcacattatgtatttgcattgggtgttgcaaggttcttgagttgtgcccattgggttctccaggttttagatagtcgtgggcacttgctggtggccttggggtatggattatggccttctatggttcttatctcagaaattgtccagactttcatcttagcagacttttgttattattacatcaaaagtgtgtttggaggacagcttgttctccgcctgccctcaggagttgtgtgagtgaagatcctggtgtgctccttgaacaacattgcttttgaagattaatgtttttaggcaatgttgttgcaaaattttttttccccatacaggtttctcccctcgctgttacaactggaagtaaagtaggccgtttgtaaatttggggatgcaaaaactctgctccgatgaatatgattgatatttggaaaacataattttgatagttggattacttattttgtcaatggcaatgctgatccttttactgaagtgtagaccagtcccttggcttgtgatacactctttttctgcttatgaaatgctgaatctagttggat

SEQ ID NO: 2113 - DNA, 844 bp, Manihot esculenta
aaaatcaatccttttcgccgatgaggccgcagcaaaggccgattcacgccgtcacttcatgggtacggcgacagccgtccaaggtcaaggcttttttgggcgtggtgttggggatggccgctctcgttttcctcagatttattgtacatgatcatgacagtctctttatcgctgctgaggctgttcactcaatcggtatcattgtacttatatacaagcttacgaaggagaggacttgcgctggactatcactcaagtcccaggaattgacagctatgtttttagctgtccggctgtattgcagctttgtgatggagtatgatatacataccttacttgatttggccacgttggctacgactttgtgggtcatttatatgatccgtttcaaattgaagtctagttatatggaggacaaagacaactttgctatatattatgtggtgctaccctgtgctattctagcacttcttattcatccatcaacatctcataatttattgaataggatttcatgggcattctgtgtgtacctggaagctgtctcagtattacctcagttgcgggtcatgcagaacacaaagatagttgaaccattcacagcacattatgtatttgcgttgggtgttgcgaggttcttgagttgtgcccattgggttctccaggttttagatactcgtggacgcttgctggtagccttggggtatggattatggccttctatggttcttatctcagaaattgtccagactttcatcttagcagacttttgttactattatgtcaagagtgtgtttggaggacagcttgttctccgccttccctcaggagtggtgtgatttaa

SEQ ID NO: 2114 - DNA, 1226 bp, Gossypium raimondii
ggcggatacccactttctctaaatcccacaaaatttccatcactttctcgggaacaagaaagaaaaagaaaagacatcatgagggcagagaagaggctgatccacgcggcaacgatgtgggtgagacgacagccgcccaaggtgaaggcttttttggcggtggtgtcggggatggcgactcttgttttgctccgattcatcgtacacgaccacgacaacctcttcgtcgccgccgagtctgtccattctctcggaatttctgtactcatctataaactcacaaaagagaagacttgtgccggactatctctgaaatcccaagaactaacagctatatttttagctgttaggctgtattgtagctttgtcatggaatatgatatacacaccatacttgatttagccacattggctacaaccttatgggttatttacatgatccgttttaaactcaagtcgagctacatggaagacaaggacaactttgctatttattatgttgttatcccttgtgcagtactagctctgtttattcatccatcaacttcacataatcttatgaaccgaattttctgggctttctgtgtatatctggaagctgtttcagttttacctcagttgcaagtgatgcaaaataccaagattgtcgagcctttcacggctcattacgtatttgcattgggtgttgcaaggttcctcagctgtgcccattgggttctccaggttttagatagtcgaggacacttgctggttgccctaggttacggattatggccttctatggttcttatttcggaaatcgttcaaactttcattttagctgacttctgttactactacatcaagagtgtattcggagggcagctcgttctccgtcttccctctggagtggtataagtgaagatgctgtcgtgtagtcgttgatgagcttgctgactgaaaaaagaagtatgactcgtttccgtaatgtggcaagttatccttgtttaagttcttgtttttcgctctcgacgcctttcttttgactcgatatcagtggatagtttgtatacttcggaagaggatatttatatcgaaaacatttcatagatggattaactcttttttttgtgtcaaatccttaaattattagaataagctttaaacattgatttcaattagtgaaaaatgctattactattatgttatataataaaatggataagggattcattgagaagcaagaa

SEQ ID NO: 2115 - DNA, 948 bp, Actinidia deliciosa
gagagagagagacgatgagggcaccgaagaggccgatccacgcagtgtctatgtgggtccgtcgacagcctccgaaggtgaaggccttcctcgccgtcgtggcggggatggcggcgctggtgttgctgcgagtcatcgtccacgatcacgacaacctcttcgtcgccgccgaagccgttcactccatcggaatctgcgtcctcatctacaagctcacgaaagaaaaaacttgcgccggactctcacttaaaacgcaggaactaacagccttatttttagctgttaggctgtactgcagctttgtcatggaatatgatatacacacattgcttgatttctccacattggctacaacactgtgggttatttatatgatccgttttagtctaaagtcaagctacatggaggacaaagacaacttagcaatgtattatgtggtggtgccatgcgccgtgttggctttgttaattcatccatcgacttcacataatattgtcaacaggattttttgggcgttctgtgtatatctggaagcagtatctgtattaccccagctgcgagtcatgcaaaacacaaagattgttgaaccattcacggctcattatgtatttgcattgggcattgcaaggttcctgagctgtgctcactgggttctacaggttttagacagtcgtggccatctgctggtagctctgggttttggattatggccttcgatggttcttatctcagaaattgttcaaacttttatactagcagacttctgttactactacgttaaaagtgtttttggaggacagcttgtgctacgtcttccttccggagttgtgtaaccgaaggttgtacaagcgcgagggcattggaaggggtacttaaatataatgtgagctcttcatttcgttccttttgctccgctcacgattgatatgttgctaggtgatccttcca

SEQ ID NO: 2116 - DNA, 1398 bp, Mimulus guttatus
cgtttcaagagaaaatcccccacggaaaataattcgtaaattcagcccacacacacacacgagatacaccgatacgtacacccctctctgcgtgcgtacacagaagaagatgaggtcaccgaggaggccgatccaggccgtgtcgacatgggtgcggcggcagccgcccaaggtaaaggcgtttctggccgtaatcagcgggatggcggcgcttgttatcctccgcgcaatcgttcacgatcacgataatctctttgttgcggctgaggctgtccactcgatcggaatctgcgttcttatttataagttgatgaaggagaagacttgcgctggcatttcgctcaaatcccaggatctaacggctatctttctggctgtaagattatattgtagtttcgtgatggaatatgacatacacaccgtgcttgacatggctacactggcaactactttatgggttatatatatgatccgacttaaactgaagtcgagttatatggcggataaagataattttgcgttatactatgtgctggccccttgtgctattttagctttactaatccacccatctacatcgcatcacatcattaaccggattgcatgggctttctgtgtctatttagaagctgtttcagtgctaccacaactgcgcgtcatgcaaaacaccaagattgtcgaaccattcaccgctcattatgtatttgcattgggtgttgcgaggttcttgagctgtgctcactgggttctccaggttcttgatagccgtgggcatcttcttgtggcattgggttatggactttggccttcgatggttcttatttcagaaattgttcaaaccttcattctggccgacttttgctattactatgtaaaaagtgttttcggaggtcagcttgtgctgcgtcttccttctggagtggtgtaatcggcttcgtaatcttatgttagttcttctctcttcatcagcagaattctgatgtgtggcaaaagcttggtagttgaggcaaattagatatatttatatcaacttaccaaaatactatattagttcgattgtatcactactaattttggtttcgtagaatggatttctttttttttttttttttggcaagacttcaaatatttcttactgattggcgatcgcaatactttgcttgacaatatatagagatcaagttgaggtattcgataatcggtttgaattagatggtcaaaagcacggttcgataacataacgaattaaattttcacttttaattttgttctatgagatgtgaagttcgattttgacttgagcttgattatatgtataaaaatcaagctacacgagctcgagctcaatcatatacagtttttatagctcgataaagattcaaacgagattgaacaatc

SEQ ID NO: 2117 - DNA, 886 bp, Allium cepa
catcaaagagacaaataaacatggtgatttcatgggtaaagcgtcagccaccaaaagtaaaagcttttctgagcgtcgtgtccgctatggctgctcttgtttttctgagattcattgtccatgatcacgacaatctttttgtcgctgctgaggctgctcacgcgattggaatttccgttcttgtatacaagctcaccaaggagaaaacttgtgctggactctctctcaagtctcaggagctaacggctttatttttagcagttcggttgtactgcagttttgttatggagtatgatattcacactgtgttggactctgcaacccttgcatccacgttgtgggttatttatatgatgcggtttaagttaaaatctagctatatggaggacaaagacaattttgcaatgtactatgtggttgtgccttgtgcagcattagcttttctaattcatccttcaacatctcacaacatcctcaaccgaatctgctgggcgttctgtgtttatttagaagctgtctcagtgttaccccagctacgtctgatgcaaaacacaaagattgttgaaccgtttacatctcactatgtctttgcgttgggagttgcaagatttctcagctgtgcacattgggttctgcaggtattggatactcgaggaagattgttgactgcgttgggatatgggctgtggccatcaatggttcttctctccgaaattgttcaaactttcatccttgcagatttttgctactactatgtgaaaagtactttgggtgggcaactcgtgatgcgtttaccttccggcgtagtgtgagtgtaacccataaatttatgtagaatttgaaatatgggtaatatttatttcgaccattttctttctttcttttt

SEQ ID NO: 2118 - DNA, 1396 bp, Cajanus cajan
gtagggtagaaagtagaaagtggtgagacataaatatgtagactcaagggaagttgggggcattggcagattgggtgggaattgcatctgcaaactgcaacgactcaagttgacgttgacgctggagttgtgccctaattcatcagtttgggggaaagaaaggaaaatcaaccatcgctctcatctcatctcctccattgcaatttgcaattaagaacgcataatcatatacaaaagaattaattggcggaaggaaacaatgaggggtgggagaaagtcgatccacgcgatcacgacatgggtgcggcgacaacccccaaaggtgaaggcttttctcgccgtcgtttccggcatggcggctctcgtctttctccgtttcatcgttcacgatcacgacaaccttttcgtcgccgccgaggctgtccactcccttggaatttctgttctcatctacaagctcatcaaagagaaaacttgtgccggattatcgctcaaatcccaggaattgacggctatatttttagctgtcaggctgtactgcagttttgttatggaatatgacatacacaccctgcttgatttggctactttggcaacgacactctgggttatatacatgattcgttttaaattgaagtctagttacatggaggagaaagacaattttgctatatactatgtggtgataccctgtgctgtgttagccttgtttattcatccatcaacttctcatcatttattgaacaggattttctgggcattctgtgtatatcttgaagctgtgtcagtactaccccaattgcgagtcatgcagaacaccaaaattgttgagccattcacagcacattatgtatttgctctgggtgtcgccagattcttgagctgtgctcattgggttcttcaggtgttagatagtcgtggacatttgttggttgccttggggtatggattatggccgtcaatggtgcttatttcagaaattgtccagacttttatcttagctgatttctgttactattatgtcaaaagtgtctttgggggacagcttgttctccgcctaccttctggagtggtgtgattgaagattcacttcactgcatacttgcatttaaattaactatatggtcggctatcattgttggagtccatagtgcattgaaaaagtttggctcctttgaaaaagctggttctttgtaaagttagagatgaaggaaaaacttaaatatttatgtttaaggtatacagtatttccagttggaaatgcgttacacataatgtgtctatttgcttaggctcatgaaattcagttcttgattgaaatattccacgttatcctaagttaactgcatgacttgagccaatgaggcagtcactataaaggttgctttgaagggac

SEQ ID NO: 2119 - DNA, 1283 bp, Tripterygium wilfordii
aaatagaacttcgccatgagagcgtcaaagaggccgatccacgcggtgtcgacatgggtgcggcgccagcccccaaaagtcaaagcattcttggcagtggtttcggggatggcgacactggtgctgcttcgcttcatcgtacacgaccacgacaatctgttcgtagccgccgaggctgtacactccatcggaatctccgtccttatctacaagctcatgaaggagaaaacttgtgctggattgtcactcaaaacacaggaactgacagctatattcttagctgttagactgtactgcagttttgttatggaatatgatattcatactctactcgatttggctaccttggcaacaaccatctgggttatttatatgatccgtttcaaactaaggtctagttacatggaggataaagataactttgcaatatattatgtggtggtaccctgtgctgttttagccttgttaattcatccaacgacttctcataatttgttgaacaggatattctgggcattttgtgtatatctggaagctgtttcagtgctacctcaattgcgggtcatgcagaacaccaagattgttgaaccattcacagcacattatgtatttgcacttggtgttgcaaggttcctgagctgtgcccattgggttcttcaggttttggatagtcgcggacacttgctggttgctttgggctatggattatggccctctatggttcttatttctgaaattgtccagactttcatcttggctgacttttgttattattatgtcaaaagtgtttttggaggacagcttgtccttcgacttccctctggagtggtctaactggaaaatcctcttggaacgtaaacccagggcagattatcaaacgggaacttatgtgatcttggagctcctttctgccttgctgtaacgatattttcttacatcatgaccggaagttgaattagcggtttgtaaagtaggggatgcacaaaacttggctggatatttatatttgaaacatgattgaacgtccatttttgtctcttttccttgaaccaacatcctagtagccaaatcttgtgatgttctactggactagtttgttcgaagtcaagatgactctcaggcatttacattgacctggttaccttacatctttcagcagctttgatcagttatgatagtaagagtgttggaagttggaaccactttgctaacctatcctgttattttgagcactgaaaaaaccacatcagtatgtgttgaaattgattgaatgatattgtaat

SEQ ID NO: 2120 - DNA, 1356 bp, Sarracenia psittacina
ggacagaacgatgagatttcttctgcacttctttccataataatcaagaagcttgttcagattagacacctatcagaggtaaaacatattctctcagctcccaatcaaggaaggcacccttattttccatcactagctcatcgtattaccgctgtatagcaacgcccgctcacccactcaaacccccggaagaggaaagacagagatcatgaggccaccgagaaggccgatccacgccgtctcgttatgggttcggagacagccgccgaaggtgaaggctttcctggcagtcgtcgccgggatggccacactggttttgtacgatttatcgtgcacgatcacgacaacctcttcgttgcggccgaagctgttcactccgctggaatctccgtcctcatctacaagctcatgaaggaaaaacttgtgctggaatctcgcttaaatctcaggaactgacagccctgtttttagctgttaggctgtactgcagctttgtcatggaatatgatatacacaccttgcttgatttatccacattggctacaactctgtgggttatttatatgattcgtttaatttaaagtctagctacatggaggacaaagacaactttgcaatatattttgtggttgcaccctgtgcagtgttggctttgctaattcatccatcaacatcacatcatattatcaacaggattttctgggcattttgtgtatatttggaagctgtttctgtattaccccagttgcgtgtcatgcaaaatacaaagatcgttgaaccattcacagctcattatgtgtttgcattgggcgttgcaaggttcttgagctgtgctcactgggttctacaggtgctggacagtcgtgggcatctgctgacagctctgggttatggactatggccttcgatggttcttatctccgaaattgtccaaactttcatactagcagacttttgttactactatgtgaaaagtgtttttggaggccagctcgtgctgcgtcttccttcaggagtcgtgtaactgagaatttcacgagcacgctagcattggaagttaaaacatataccaggtgctcttcattatttagttgtttttgctctgcagcgtttcatattactctggtggtccatccatgactggaaatgaagtgccaactgtttgtatattttggaggatgcaggcaacttaaatggagattgcattaactttgttgtgtcagcagtaatgtcaggccttatagttttatacacccaagataacttatttccgccttcacaatggttttattgagcttttatgacaaatgaattagcagaaggaacatggtgaatgatttgaattgtcttggatta

SEQ ID NO: 2121 - DNA, 1097 bp, Antirrhinum majus
cttccactttccactaattaattaaattactcccacaattcacacacacagtagagaagatgagaccagcgaagaggccgatccaagccgtgtcctcatgggtacgccggcaaccgcccaaggtgaaggccttcctcgccgtgatttccggcatggcggcgctcgttctcctccgcgcaatcgtgcacgatcacgacaatctgttcgtagccgccgaggctgtccattcgatcgggatttctgttcttatctacaaattgatgaaggagaagacctgtgctgggctttcgctcaaatctcaggagctaacagctatctttctggctgttagactgtattgcagttttgtcatggaatttgacatacacactttgcttgacatggctacgctggcgacaaccttgtgggttgttttcatgatccgctttaaattgagatcgagttatatggaggataaagacaattttgcattgtattatgtgttggccccttgtgctgtcttagctttactaatccatccatctacatcgcataacatcgtcaacaggattgcctgggctttctgtgtttacctggaagctgtatctgtgctacctcagttgcgtgtcatgcaaaacacaaagattgttgaaccattcacggctcattacgtatttgcattgggtgttgcgaggttcttaagctgtgctcattgggttcttcaggttttggacactcgtggtcatctcctagtggcattgggttatgggctgtggccgtcaatggttcttatatcagaaattgtccaaaccttcattctggcagacttctgctattactatgtcaaaagtgtatttggaggagaacttgtgatgcgcctaccttctggagtggtgtaataacacgagtggttgaaaaagcctattaggtgtttttcgtgcagaacaactgctcggcttgattacgggtactcacccataaaatctggtgggttgcaaaattagaagtttgggaatattggatatttatgacaaactcaactttcccaggaacagtatgcaaatttcattgtaaagattttacatctgaattaatgatcatgatatttaatttgggaa

SEQ ID NO: 2122 - DNA, 1420 bp, Phaseolus vulgaris
tgtgttttttaaaatatgatatccttagggtttagggcacattttggtggttgtttctcatgaaattttgttgagtggaaacttttggagagagaaaagaaaacaaagagaaaaaaattatcgatccattttgttttgtctgagtctcggttttggcattgggctattgtttagtttgttcgttccaatccaacgttggttgttgtttgggcgtgcgtgtgggtgtgtgttgggtgtccaaaaagttgaatcagcgaccccatgagacctcagagaacgtcgatccacgccgtcacgtcatgggtgaggcggcaacccccaaaggtgaaggcttttctcgccgtcgtttccggcatggcggctctcgtcctcctccgcttcatcgtccacgatcacgacaatctctttgttgctgccgaggccgtccactccctcggaatttccgtcctcatctataagctcacgaaggagaagacttgtgctgggttgtcgctcaaatcccaggaattgacagctatctttttagctgttaggctttactgcagttttgtcatggaatatgatatccacaccatacttgatttcgctactttcattacaacactgtgggttatatatatgattcgttttaagctgaaggctagttacatggaggagaaggataactttgcaatatactatgtggtggtaccgtgtgctgtcttagccttgcttattcatccatcaacttctcatcatttattaaacaggatttcttgggcattctgtgtatatctggaagctgtctcagtcctgccccaactgcgggtcatgcagaacaccaagattgttgagccattcacagctcattacgtatttgcactgggtgtcgcaagattcttgagctgtgcacattgggttcttcaggtgttagatagccgtgggcatttgttggtagccttggggtatggtttatggccatcaatggttcttatctctgaaattgtccagaccttcatcttggcagatttctgttactattatgtcaaaagtgttttcgggggacagcttgttctacgtcttccctctggagtggtgtgattgaagatatgctttggtgtgcattgtcacacttattttaacttaatcaggcattatggtcggttacccttgttagagtacattttgtgttggctcacttgtttggttctttggtggagtgtaaagttggggatgaaagaaaaccaagtatatttatgtttaacgtactacggttatttatagttggaagtcatttacacaaagtctatgctatgtgtggttccgcaaaggcaatggtcataacggttataatctgttaacagctgaagacaataccagttattaaaatggtttaaacagaattttattagttggatgataataacagaagagagcccga

SEQ ID NO: 2123 - DNA, 1210 bp, Fagus grandifolia
aaccactaaactttctctctctttccatttcaattttccacacccacttccattaataaattctttttttttccttccatttttcctcactttctcgcctacactttcccggaaaatcaaaagagaaaacaagaacacaaatctcgatgaggacacagagaaggccgatccacgctgtttcgacatgggtgcggcgacaaccaccgaaagtcaaggctttcttggccgtggtctcgggcatggcggctcttgttctgctccgattcatcgtccacgaccacgacaatcttttcgtcgctgctgaggctgtacactccatcggaatctccgtgctcatctacaagctcatgaaggagaagacatgcgctggactatcacttaaatcccaggaattaacagctatgtttttagctgttaggctctattgcagttttgttatggaatatgatatacacaccctacttgatttagctacattcgcgacaaccttgtgggttatttatatgatccgttttaacttaaaggctagttacatggacgacaaggacaactttgcaatatattatgtggtggtaccctgtgccgtgttagcgttgtttattcatccatcaacttctcaccatttattgaacaggatcttctgggctttctgtgtatatctggaagctgtttcagtactaccccagttgcgggtaatgcagaatacgaagattgttgaaccattcactgctcattatgtatttgcgttgggcgtggcaaggttcctgagctgtgctcattgggttctccaggttttagatactcgtggacacttgctggttgccctgggttatggattgtggccttctatggttcttatctcagaaattgtccagactttcatcttagcagacttctgttactattatgtcaaaagtgtttttggcggccagctcgtcctccgtcttccctctggagtggtgtgatagagatcctcttggtccatgttcagcaggtgcagcgccatccaaaaaattaacttaacccggcaatgtggctccatccttgtttaagtttcccctttttgctctccacacggatctggttctccctgtgtcatgactaatggtcaagtgggttgtttgtaaagatggggtgttgaaaagttggatatttatatattaaacatgattttcatagttcatttatgttgtgtcaattgtattttctt

SEQ ID NO: 2124 - DNA, 1031 bp, Daucus carota
cataatctacatcctactgctcaaaggggtttggtagtgcaattgaaagacttgaatctgaaacatacaagagggagcaagaaacaaagttaacccttttgtctatcttgacaactgaagaacaagaagaagactttgagttgtttaaggttagaaccatgagaggggcaccaaagagaccgatccaaatgataacatcatggctgaggagacagccgccaaaggttaaagcttttctgggtgtagtggctggcatggccgctcttgttttgctcagagctattgttcatgatcatgataccctttttgttgctgctgaagctgttcattctcttggcatctccgtccttatctataagctaatgaaagaaaaaacttgtgctggactctcacttaaatcccaggaattgacagctttgtttttggctgtcagactgtactgtagttttgtcatggaatatgacatccataccttgcttgatttagccacactcggtacaaccttatgggtcatatatatgattcgcttcaaactgcggtcaagctatatggaggacaaagacaattttgcaatatattatgtggtgattccttgcgcagtattagcaatgttagtccatccatctacatcacacaacttcattaacagattcttctggggtttctgtgtatatttggaatctgtctctgtgctcccccaactgcgtgttatgcaaaataccaagattgttgaaccatttacagctcattatgtgttcgctttgggtgttgcaaggttcttgagctgtgcccactgggttctccaggtgctggacactcgtggccatctacttgttgctctgggatatggactatggccttctatggttctgatttcagaaatagttcaaacctttatcctagcagacttctgttactactatgttaaaagtgttttcgggggacaacttgtcttgcgccttccatctggagtagtttaaaggaggatataacgaaagttaacttaaatatggtgattagttttttgtttt

SEQ ID NO: 2125 - DNA, 1338 bp, Trifolium pratense
aacctaacacagtttcatattatgttttatgttttattattattatcatccctatctatctctccctctcttctctcaacaaatctatagatccttccaatataccttgtctcacgcggttgcagtttttggaagtgtctttgtctttctgctgtgtcgttgtgtttcttcaaaatctccatagaaacaaaagaaaaccctttttcgcaccatgagacctcaaagaacatcgatccacgccatctccacatgggtcaggcgacaaccaccaaaggtcaaggcttttctcgccgtcgtttccggtatggctgctctcgttctcctccgattcatcgttcacgatcacgataatctttttgtcgctgctgaagctgttcattctctcggaatcaccgttcttatctataaactcatgaaagaaaaaacctgtgctggattatcactcaaatcccaggaattgacagctatatttttagctgttaggctgtattgtagttttgtcatggaatatgacatacataccatacttgatttggctactttcgttactacgttgtgggttatatacatgattcgttttaaattgaaggctagttacatggaggagaaggataactttgcaatatactatgtggtgataccatgtgccgtgttagccctgctcattcatccatcaacatctcatcatatattgaacaggattttctgggcgttctgtgtatatctggaagctgtttctgtactgccccaacttcgggtcatgcagaacactaagattgttgagccattcaccgcacattatgtatttgcactcggtgtagcaagattcttgagctgtgctcattgggttcttcaggtgttagatacccgtggacatttattggttgccttgggctatggtttatggccgtcaatggttcttatctcagaaattgttcagacattcatcttagcagatttctgttactattatgtgaaaagtgttttcggcggacagcttgttctacgccttccctctggagtggtgtgattgaagatctacgccctcagattttcttttaacttaatcaggcaccatgtttggttactcatgttagacttagagtacattttgtgttgacatgcttattctgtaaagttggggatgaaagatagctaaatatattttatgttctgaggtaccattatttatcatgtctggaaatgctttatactacataaaagtctctatttgcttagagtttttgttacaactattccacatgctcaagttctaccaagtcttaggtcgtggtctacatcttttgttttttggttgttgctgtgggatctaatgaa

SEQ ID NO: 2126 - DNA, 1301 bp, Lotus japonicus
cctttatagggggctctctctctctctcaaatctcgtgttccaatcttaaccgagagagagtgtgtctctttgtgtgtttgagcattgggaactcgaaacctcgctcacaatctgcagcaacctcgctcaccatgaggcctcagagaatgtcgatccacaccgtcgccacatgggtcaggcgccaacccccaaaggtcaaggccttcctcgccgtcgtctccggcatggccgctctcgtccttcttcgcttcatcgttcacgatcacgataacctcttcgttgctgctgaagctgtccactccctcggaatctccgttctcatctataagctcatgaaggagaagacttgtgccgggttatcactcaaatcccaggaattaacagctatgtttttagctgttaggctgtactgtagttttgtcatggaatatgacatacacaccctgctggattttgctactttcgcaactacagtgtgggttatttacatgattcgttttaaactgaaggctagttacatggaggagaaggataactttgcaatatactatgtggtgataccatgtgctgtgttagccttgcttattcatccgtcaacttctcatcatatattgaacaggattttctgggcattctgtgtatatctagaagctgtttcagtactaccccaactgagggtcatgcagaacacaaagattgttgagccattcacagctcactatgtatttgcactgggcgttgcaagattcttgagctgtgctcactgggttcttcaggttttagatactcgtggacatttgttggttgccttggggtatggtttatggccatcaatggtgcttatctcagaaattgtccaaaccttcatcttagcagatttctgttactattatgtcaaaagtgttttcgggggacagcttgttcttcgtcttccctctggagtggtgtgattgaagatctgctttggtgcggtcccacagttactattaacttaatgaggcatcatggttggttcccattgttagagtacattcacagttgtttccttggtggaaatgtaaagttagggatgaaggaaactaaatatatttatgtttgagatacggctatttatagttggaaatgcagagtctctatttgcttaggcttttggattcatttttgttatgacttcttcacgttcttaagttctaatgaaacctaccttcacaatatggactctgcgatctctgtctattccgtgtaagatgcgtttcacaacccaactttaactatccgtttggatacgaacaaaaaaaag

SEQ ID NO: 2127 - DNA, 1118 bp, Orobanche aegyptiaca
catacatctatatatatacacgaagaggactttaaatcgaaggagaagctcaattaatttattgaaattcataaatattttggacaaagggcttcactcgtacagaattatgaaggtaccaaggaggccgatccaagcggtggcgacgtgggtgcggcggcaaccgccgaaggtgaaggcgtttctggcggtggtcagcggcatggcggcacttgttctcctccgcgcgatcgttcacgatcacgataatctattcgtagcgtcggaggctgttcactcgatcggaatcggagttttgatttacaagttgatgaaggagaggacttgtgctgggctttcactcaaatcccaggagctaacagctatctttttggctgttagattgtattgcagttttgttatggaatacgacatacacactatacttgatatggctacactggctacaactttgtgggttatttatatgatccgtttcaaactgaagtcaagttatatggaggataaagacaatattgccctctattatgtggtggtcccttgtgctattgtagctttactaattcacccatctacatcacatcacatcatcaacaggattgcatgggctttttgtgtttaccttgaagctgtttctgtgctacctcagttgcgtgttatgcagaacacaaagattgttgaaccttttacagctcattatgtatttgcattgggtgttgcaaggttcttgagctgtgctcactgggttctccaggttctggactcccgtggtcatctcctggtggcattgggttatggactgtggccttcgatggttcttttatccgaaattgttcagaccttcatcttagccgatttctgctattactatgtaaaaagtgttttcggggggcagctcgttttacgccttccctctggagttgtataactattgatggttgtgtaagttctcacagaaagaaatctggagtttcctcgaatgggatgtccacattaatcttaatttaccagaaaccgtatcgggataaactgtatgactattctttttttttcttttagatagtcgatttaaatgtaaggatttcgactttaaatcagtgacgacaatgcttatttta

SEQ ID NO: 2128 - DNA, 1514 bp, Petroselinum crispum
gcgaaaagaagaatatagagaacattaaaaaagggaataataatcaagaagtcataatctacatcctactgttccaagggcggattggtagtttaattgaaagacttgaatctcgaaaacacaaatacatacatagcatacaactagaagcaaagaaagaaagtggaaagacttgcagttgttgtttgtgtgaaaggcaggtatgagggcaccaaagaggccgatccaaatggttacaagctgggtgaggcggcagccgccaaaggttaaagcttttcttggtgtagtcgccggcatggctgctcttgttttactccgagctattgttcatgatcatgataccctttttgttgctgctgaagctgtccattctcttggaatctctgtccttatctataaactcatgaaggaaaaaacttgtgctggactttcactcaaatcccaagaattgacagctttgtttttggctgtcagactgtactgtagttttgtcatggaatatgacatccataccttgcttgacttggctacactcggtacaaccttatgggtcatatacatgattcgctttaaactgcgatcaagctatatggaggacaaagacaatttcgctatctattatgtggtgattccttgtgcagtattagcagcagtagtccatccatctacgtcacacaacttcataaatagattcttctggggattttgtgtgtatttggagtctgtttctgtgctccctcaactgcgtgttatgcaaaatacaaagattgttgaaccatttacagctcattacgtatttgctttgggtgttgcaaggttcttgagctgtgcccactgggttctccaggtgttggacactcgtggccatctacttgttgctctgggatatggactatggccttccatggttcttatttcagaaatagttcaaaccttcatattagcagacttttgttactactatgttaaaagtgttttcggaggacagcttgtcttgcgccttccatctggcgtagtttagtggagaatgtaagctgtgaaaattaacttgtattggtggttagttctttgtttttgccccacagaatccatgttggttgagaattgttcatgtcgtgatgactgaaaatcagtgaagtggatggtttgtaaagatgggaatatggaatttgagggacttataaattacagtctacatttcccagatttcatagtaatatttactgtcctaattatggaatcttttctgtcactataatttatactaaatctggttatcttctaatctcagtaggggtgagatataatgttaaacttgttgacttcttggattttcttgacttgctgtcaactaagaatatgtggtaatgtggaatttttattgattcctgaaaaagtttatagtttggaaagaatttcacctggagtgtttaagttgaacagatgtattatactatttattttgatatccttatataggtggcagagaaaatcctatcgttgccctttctatt

SEQ ID NO: 2129 - DNA, 1192 bp, Arachis hypogaea
cgggggggtttgaagaaggtgactaggtgggtgagggaagagttaaaccgttgaagtgcataaatctcaaattacgccctaattcagattttagaaggaaaaaagttgaaacctctttgcatctctctgagactcagaagaggaatgaggcctccgaaaaagtcgatccacgccgtcaccacatgggtgcggcggcagcctccgaaagtaaaggcttttctcgccgtcgtttcgggcatggcggcgctcgtgtttctccgcttcatcgttcacgatcatgacaacctttttgtcgccgctgaagctgtccactcccttggaatctccgttctcatctacaagctcatgaaagagaagacttgtgccggattatcgctcaaatctcaggaattgacggctatgtttttagctgttaggctgtattgcagttttgtcatggaatatgacattcacaccatacttgatttggctactttgggtacaacactctgggttatatacatgatccgttttaacttgaggtctagttacatggaggagaaggacaattttgcaatatattatgtggtgataccttgtgctgtgttagccttgtttattcatccatcaacttctcatcatttattgaacaggattttctgggcattctgtgtgtatcttgaagctgtatcagtactaccccaattgagggtcatgcagaacaccaaaattgttgaaccattcacagctcattatgtgtttgcacttggtgtcgcaagattcctcagctgtgcacattgggttcttcaggtgttagatagccgtggacatttgttggttgccttggggtatggtttatggccatcaatggttcttatctcagaaattgtccagacttttatccttgcagatttctgctattattatgtcaaaagtgttttcgggggacagcttgttcttcgccttccatctggagtggtataaaagaaagttggattgggcgcatggttgcattttaaattaactttgatcaaagcaatgtgtttgactatgatggttggaggtccattttgtgttgacaaaggttggctatgggggagaagcttctttgtaaagttggaggggttcaatggaaaactcgttatttatgtctaacatacagtagagtattcttcgtagtttggaacgtgcctattcgcctatttcacttgct

SEQ ID NO: 2130 - DNA, 1333 bp, Papaver somniferum
tgtggaggaattcgagggtagaaaatagcttttgctaagggagtgttcaacaagatcttggtgaagttaatccatcacgtttgtccatttctcttccattcaagcttgaagatctccaaagtttgttcaaatccaagaagtatctggctcaaaccctcagctctaagagcatagtttgcaacacccatcatcttcatttccatataagttatataaggaggcagtgatgagggctcagaagaagacaatccaagctgtagcaacatgggtaaggagacaaccaccaaaggtgaaggcgtttctagccgtggtatcaggaatgactgctcttgttttcttgagatttatcgtaaacgatcacgataatctctttgttgcagctgaggctgttcatgctattggtgtctcagttcttatttataaactcatgaaggagaaaacttgtgctggactttcactcaaatctcaggaactcacagcaatatttctagctgttagactgtattgcagttttgttatggagtacgatatacacacgcttctagatacaaccacattggggacaaccctgtgggttatttatatgatccgatttaaactaagatctagttatatggaggataaagacaactttgcaatctattatgtgttggtgccgtgtgccgtattagctctagccattcacccgtcgacatcacataatattttgaacaggatcttctgggctctatgtgtatacctagaagcagtttcggtgcttccccagttaagggtgatgcagaacacaaagattgttgaaccatttacagctcattacgtgtttgccttgggcgttgcaaggttcttgagctgtgcccattgggtcctccaggtcctagatactcgtggacgcttactaacagctttgggttatgggctgtggccttctatggttcttttgtcagagatagtccaaaccttcatcctggcagacttctgttattattatgtgaagagcatttttggcggacaacttgttctacgtctcccctccggggtagtatgagagtcttaagcgagctcttctcttacacggtgtggcgctaactgttcacatcaataacttaagcttagagaacgtgtttttttttgtgttagttcgccgttccactctctcttttctgtagtagtcaatgatgactctgaattgttgtagcccgggtaactgtaaagatagaactgcaaatgttctcttggtgctaaaatatattttaaggaaaccatgattgttccatggctacactttgtaacagtgtatgcatctccgatattaatgccatatttgttctggggt

SEQ ID NO: 2131 - DNA, 1213 bp, Prunus persica
tcctaatctctctctctctctctctctctcaacagaggctgttccgcaccacaacgactaagttacctcactttctctccccctcatcacactttccgggaaaatcaagagcccgagaaaatcagagaaggaaaaaaagtgaaagaaaaacaacggaaaacctcatgagggctccgaagaggccgatccacaccgtatcgacatgggttcgacgccagccgccgaaagtgaaggcctttctggccgtcgtaacgggcatggcggctctggtcgtgctccgatttatcgttcacgatcacgataacctctttgttgcagctgaggctgtgcactcaattggaatcatggtcctaatctacaagctcacgaaggagaagacttgtgctgggttatcactcaaatcccaggagttaacagctatgtttttagctgtgagattgtattgcagttttgtgatggaatatgatatacacaccctgcttgatttagctacgctggtgacgaccctctgggttatttatatgatccgcttcaacttaaagtctagttacatggaggacaaagacaattttgcaatatactatgtcgtggtaccatgtgctcttttagctttgttcattcatccatcgacgtctcatcatttattgaacaggatttcctgggcattttgtgtgtatctggaagctgtttctgtactgccccagttgcgtgtcatgcagaacacaaagattgttgagccattcacagctcattatgtgtttgcactgggtgtcgcaaggttcctcagttgtgcccattgggttctccaggtattagatactcgcggacacttgcttgtagccttgggctacgggttatggccttctatggttcttatttcagaaattgttcagactttcatattagcagacttctgttactactatgtcaaaagtgtttttggagggcagctagtcctccgtctcccttctggagttgtatgagttcactccagttctgctgtgatttgcaagcgcactgccatcaagacttaacttagctaggcatgtggctggtcattgttgtttaagtttccctttttgctctccacaaggttctagttcgcttttttaatgaaaaaaaaatcatgactggggatgaagtgggttgtttgtaaagttggagatggagtgaatttaatttatatttataatttagacatgacttttctgaa

SEQ ID NO: 2132 - DNA, 1403 bp, Chenopodium quinoa
cattctctctcatcacctccattactacaccaccttcccaattctcaaatcaaaatcaaatcttgattaatttataacagcaaagagggcaaaaaaccctaatttctagaaaaagtttccaactttgaagaaattgagagaagatgaggcctcagagaaagacgatccatacgattatggcgtggttaagaaggcaaccgccgaaagtgaaggcgtttcttgcggtggtcgccggaatggcggcgttggtgttgctgagagcggtggttcgtgaccacgataatctctttgttgcggctgaagctgttcatgttattggaattgctgttcttatctataaactcacaaaggagaaaacttgcgctggactctcacttaagtcacaggagcttacggctatatttttagcagttaggctgtattgcagttttgtcatggaatatgatatccacacgctgcttgattcagctaccttggttttcacattgtgggtcatctatatgattcgatttaacttgaggtcaacatatatggaggacaaggacaactttgctctatattatgtgctagtaccatgtgctgttttagcagttttggttcatccatcaacttcgcacaacatcttaaacagaatttcgtgggcattctgtgtatatttagaagcttcctcagtgcttcctcaactccgggttatgcaaaatactaagatcgttgaaccgtttacggcgcattatgtatttgcacttggagtagcaaggttcttgagctgtgcccattgggttcttcaggttttggacagtcgtgggcaccttctaactgctttgggatatggactatggccatcatttgttcttatctcagagatagtgcaaactttcattttggcagacttctgttattactatgttcaaagcatctttggcgggcaacttgtcctacgccttccctcgggagttgtgtaaacattttataggaggctgcaccaaagaaaatggttttgcaagctcagtggtggtttaattatgcttatttaaccgtctttgcactccagatgggctatcatgagcccaatccagttagggctgtgtaaaagttagagatgaaaggagaacattggattaatgttgaatcatacgttatttatctggaagattacattaattttacagcatcagaaactcggaaacatagataactgagtatctggagcaattaaaacactgtttctcgtcacttgtattttatgtgcttgtgcctgtatttcatgtatggaaatatggaatcatatagctcaaattttacctttgggatttcttgtctttgtcctcgcagattatttaaagtagactttttaccctttgattggtgagttatgaatggttgaagtatcagttccaccatct

SEQ ID NO: 2133 - DNA, 1203 bp, Valeriana officinalis
caacatctatctctatccccatctccgatctccgaccaaatcacggcgtttataaaatcatagagggaagaagatagataataaattcgcatttacatatagatatagagagcatgagggcgcccaggaggccgattcatattgtctcgacatgggtcaggagacaaccgcccaaggtcaaagcttttctcgctgttgtggccggcatggctgccctagttttgctcagatttatcgtccatgatcatgacaacctctttgttgctgcagaagctgttcattccatcggaatctctgttctcatctataagcttatgaaggaacgaacttgtgctggactttcactgaaatcccaggaattaacagccatgtttttggcggtgcgactgtactgcagttttgttatggagtatgatatacacaccttgctagatttagctacacttggtacaacactctgggttatttacatgattcgctttaatctcaagtcaagttatatggaagacaaagacaattttgctatctattatgtggtggttccttgcgcagtgttagccttggctgttcatccaactacttcacatcatttactcaacaggattttctgggctttttgtgtatatcttgaagctgtttcagttttacctcaattgcgagtcatgcaaaacacaaagattgttgaaccttttactgctcattatgtattcgcgttgggcgttgcaaggtttttgagctgtgctcattgggttcttcaggtgttggacagtcgagggcagttacttacggctctaggttacggattatggccttccatggttctcatctcagaaattgttcaaactttcatactagccgacttctgctactactatattaaaagcgtatttggaggtcaacttgtgttacgccttccttcaggtgtagtctaaccgatgatcaaacgatgtgcccttagaaaaaggttgctcttttcgggcacgcggttggtgtagtgaaagaaaagaatgaagatgagttgtaaagttgggaatattgtcgagggcaatttaatagtactacgtactaaaaattagaacaccatgttaccttaccttgtattcaagttaaatgaattactagtaaattatatacaatactatatactacagtactactacttgtttcattgtttggggtggatgaatgattgatcaaatttta

SEQ ID NO: 2134 - DNA, 1082 bp, Vaccinium corymbosum
aatcaagacccttcattttatcgccaccgcataaccgccgcagaccaccgcatagagaaagaaaaagacacgatgaggccaggaaagaggccgatccaagccgtatcagtatgggtcaggagacagcctccaaaggtgaaggcttttctcgccgtcgtcaccggtatggcggcgctggttttgcttcgagtcatcgtacacgatcacgacaatcttttcgtcgctgctgaagctgttcactccatcggaatatctgtcctcatctacaaactcatgaaggaaaaaacttgtgctggactctcacttaaatctcaggaactgacagccctattcttagctgttaggctgtactgcagctttgtcatggaatatgacatacacaccttgcttgatatgtgcacgttggctacaaccctgtgggttatttatatgattcgttttaatttgaagtcaagctacatggaagacaaagacaactttccgatatattatgtggcggcgccctgtgctgcgttggctttgctcattcatccatcaacatcgcatcatattatcaacaggattttctgggcgttctgtgtttatttggaagccgtgtccgtactaccccagctgcgtgtcatgcaaaatacaaagattgttgaaccattcacagctcattatgtgtttgcgttgggcgttgcaaggttcttgagctgtgcccattgggttctgcaggttttggatagtcgtgggcatctgctgacagctctgggttatggattatggccttcgatggttcttatctctgaaattgttcaaactttcatactagcagatttctgttactactacgttaaaagtgtttttggaggtcagcttgtgctacgtcttccttctggagttgtgtaactgagaatttcaatcatggtggcatcaaaagacaatcacataattggtgctcgtcattttcttacttttgttatgcactcagttcatatttctgggtggtcgaaccttgactggaaatgaagttgagtgtatgtaaatttggtggttggaagccatttcaatgggtgctttagatttgttggggggaaaaa

SEQ ID NO: 2135 - DNA, 1033 bp, Trifolium pratense
cacgcggttgcagtttcggaactgtttttgtctctcgtgctgtgttttttgattcatcatcacaaactccattgaaagaaagaaaagaaaacccttcctttcttcttcgcagagccatgagacctcagagaacatcgatccacgcaatctccacatgggtcaggcgacaaccaccaaaggtcaaggcttttcttgccgtcgtttctggcatggctgctctcgttctcctccgattcatcgttcacgatcatgataatctttttgtcgctgccgaagctgttcactctctcggtatctccgttcttatctataaactcatgaaagaaaaaacctgtgctggattatcactcaaatcccaggaattgacagctatatttttagctgttaggctgtattgtagttttgtcatggaatatgacatacacaccatacttgatttggctactttcgttactacggtgtgggttatatacatgattcgttttaaattgaaggctagttacatggaggagaaggataactttgcaatatactatgtggtgataccatgtgccgtgttagccttgctcattcatccatcaacttctcatcatatattgaacaggattttctgggcgttctgtgtatatctggaagctgtttctgtactgccccaacttcgggtcatgcagaacactaagattgttgagccattcaccgcacattatgtatttgcactcggtgtagcaagattcttgagctgtgctcattgggttcttcaggtgttagatacccgtggacatttattggttgccttggggtatggcttatggccgtcaatggttcttatctcagaaattgtccagacattcatcttagctgatttctgttactattatgtgaaaagtgttttcggcggacagcttgttctacgccttccctctggagtggtgtgattgaagatctatgccctcggattttcttttcttttaacttaatcaggcatcatgtttggttactcatgttagacttagagtacattttgtgttgacat

SEQ ID NO: 2136 - DNA, 1428 bp, Gossypium hirsutum
cttgcttattttataatattcccagtggttgtgaagtgaggctacttaatttttaattcagattcagatttctcgcccgtcaaataaaaatccacccgaatcacttatcgttttctcaaatcccaatcaaaacgatagaggtcggagattcgaggaaagacaatccaaataaaaatatttttcccctattaaacaaaaagcttaaatcaaaccccaaaatccagaatcccacatcctctaaatccccaaaacgggaaaaaaagaataaagaagacatgaggacacagaagaggccgatgcatgcggtgtcgatgtgggtaagacgacagccgccgaaggtgaaggcttttttggcggtggtatcggggatggcggcattggttcttctccgagtcattgtacatgaccacgataacctcttcgttgccgccgaggctgtccattctatcggaatctctgtcctcatctataagctcaccaaggagaagacttgtgctggactatcactcaaatcccaagaactaacagctatctttttagctgttaggctgtactgtagctttgttatggaatatgacatacacaccttacttgatttagccacattggctacaacattgtgggttatttatatgatccgtttcaaactaaagtccagctacatggaagacaaggacaactttgtgatatattatgttgttgtcccttgtgcagtactagctctgtgtattcatccaacaacttcccataatctattgaaccggatttcctgggcattctgtgtatatctggaagctgtttcagttttacctcagttgcgagtgatgcaaaacaccaagattgttgagccttttacagctcattatgtgtttgcgttgggtgttgcaaggttcctcagctgtgcccactgggttctccaggttttagacagccgaggacgcttgctggtagccctgggttatggattgtggccttctatggttcttatatcagaaattgttcaaacttttattttagcagacttctgttactattatatcaagagtgtctttggagggcagcttgttctccgtctaccctctggggtggtctaagtgaagatgctattttgctgtggtcgatgagcttgctgccgaaagaaaacataacttggttactaatgtgactaggtgttcttgtttaatttctggtttttgctctgcacgtttcttgtgattgcaattagtggattgtttgtaaatttcgggatgcagaaactttgggtggatatttatagggaagcatttcatagatggtttagtttatggtatcaaatgcctaacctgccgcttatatgaagttatttattatagactattcctacatgtggaggtgaagaaagttataccttgctttgtcaaaaatatcattcatggtcaagagtattat

SEQ ID NO: 2137 - DNA, 1159 bp, Gossypium hirsutum
aaaattaattcttacgtcaacccccaatagactcgcattagcaatccacaaatcccaaaattttcccacgctttctcgctttctcgagaacaaagaaaaaaaacatgagggtacagcagaggccgatccgcgcgctgtcgatgtgggtgagacgacagccgccgaaggtgaaggcttttttgggggtagtatcggggatggcagcgcttgttcttcttcgattcatcgtacacgaccatgacaatctcttcgtcgccgccgaggctgtccactccatcggaatctctgtccttatctataagcttattaaggagaagacttgtgctgggctatcgctcaaatcccaagagctaacagctatctttttagctgttaggctgtattgtagctttgtcatggaatatgatatacataccctacttgatttggccacattggcaacaactttatgggttatttatatgatccgtttcaaactaaagtccagctacatggaagacaaggacaactttgctttatattatgttcttgtcccatgtgctgcacttgccctatttattcacccctctacttctcataatctagtgaaccggattttctgggcattctgtgtatatttagaagctgtttcagttctaccccagctgcgagtgatgcaaaataccaagattgttgagcctttcacagctcattatgtatttgcactgggtgttgcaaggttcctcagctgtgctcactgggttctccaggttttagacagtcgaggacacttgctggtagccctgggttacggattgtggccctccatggttcttatttcggaaattgtccaaactttcattttagcagacttctgttactattatattaagagtgtctttggagggcagcttgttctccgtcttccctccggagtagtttaagtgaagattctgttttgctttgatcgatgagcttgtttgccgaaaaaagtattactcggttaaaaatgtgactaggcatcctagttcaagttctggtttttgctctcgacatgtttcttatgactggaaattagcggattgcttgtaaatttcggggtgcagaaactttgggtggatatatattgaaaacatttcgtagatggattgatttttttcgtcaaatgctaatcttttgc

SEQ ID NO: 2138 - DNA, 1223 bp, Gossypium hirsutum
aaaattaatcttacgtcaacccccaatagactcgcattagcaatccacaaatgccaaaattttcccacgctttctctctttcttgagaacaaagaaaaaaaaacatgagggtacagcagaggccgatccgcgcgatgtcgatgtgggtgagacgacagccgccgaaggtgaaggcttttttggcggtagtatcggggatggcagcgcttgttcttcttcgtttcatcgtaaacgaccatgacaatctcttcgtcgccgccgaggctgtccactccatcggaatctctgtccttatctataagcttattaaggagaagacttgtgctgggctatcgctcaaatcccaagaactaacagctatttttttagctgttaggctgtattgtagctttgtcatggaatatgatatacatacgctacttgatttagccacattggcaacaactttatgggttatttatatgatccgtttcaaactaaagtccagctacatggaagacaaggacaactttgctttatattatgttcttgtcccatgtgctgcactggccctatttattcacccctctacttctcataatctagtgaaccggattttctgggcattctgtgtatatctagaagctgtttcagttctaccccagctgcgagtgatgcaaaataccaagattgttgagcctttcacagctcattatgtatttgcactgggtgttgcaaggttcctcagctgtgctcactgggttctccaggttttagacagtcgaggacacttgctggtagccctgggttatggattgtggccctccatggttcttatttcggaaattgtccaaactttcattttagcagacttctgttactattatattaagagtgtctttggagggcagcttgttcttcgtcttccctccggagtagtataagtgaagattctgttttgctttggttgatgagcttgtttgccggaaaaagcattattcggttaaaaatgtgactaggcatcccagttcaaattctggtttttgctcttgacatgtttcttatgactggaaattagcggattgtttgtaaatttcggggtgcagaaactttgggtggatatatattgaaaacatttcgtagatggattaattttttatgtcaaatgctaatcttttgcttatatgaagttaattattgtagactgttcctagatgtgatgatatgcattggctcgcaaaaaa

SEQ ID NO: 2139 - DNA, 1112 bp, Vigna unguiculata
attgtttactctgtttgttccaatccaacgttggttgtagtttaggcgtgcgtgcgtgtgtgttgggtgtccaaaaagttgaatcagcgaccccatgagacctcagagaacgtcgatctacgccgtcacgtcatgggtgaggcgacaacccccaaaggtgaaggcttttctcgccgtcgtttccggcatggcggctcttgtcctcctccgctttatcgtccacgatcacgacaatctctttgttgctgctgaggctgtccactccctgggaatttccgtcctcatctataagctcatgaaggagaagacttgtgctgggttatcacttaaatcccaggaattaacagctatatttttagctgttaggctttactgcagttttgtcatggaatatgatatccacaccatacttgatttcgctactttcataaccacactgtgggttatatatatgattcgttttaagctgaaggctagttacatggaggagaaggataactttgcaatatactatgtggtggtcccttgtgctgtgttagcattgcttattcatccatcaacttctcatcatttattaaacaggatttcctgggcattctgcgtatatctggaagctgtctcagtcctgccccagctgcgggtcatgcagaacaccaagattgttgagccattcacagcccattacgtatttgcactgggtgttgcaagattcttgagctgtgcacattgggttcttcaggtattagatagccgagggcatttgttggtagccttagggtatggtttatggccatcaatggttcttatctcagaaattgtccagaccttcatcttggcagatttctgttactattatgtcaaaagtgttttcgggggacagcttgttctacgtctaccctctggagtggtgtgattgaagatatgctttggtgtgagctgtctgtcacacttattttaacataatcaggcattatggtcggttacccttgttagagtacattttgtgttggctcacttgtttggttctttggtggagtgtaaagttggggatgaaagaaaaccaagtatatttattttaagttactacggttatttatagttggaagtgcttt

SEQ ID NO: 2140 - DNA, 904 bp, Eschscholzia californica
ggaggaccaaagaagccgatccatgtagttgcaacatgggtaaggaggcaaccaccgaaggtgaaggcctttttagcagtcatatccggcatggctgctcttgttttccttagattcatcgttaatgatcacgataacctttttgtagcagcagaagccgttcactctattggtatctgtgttcttatttataagcttatgaaggagaaaacttgtgccggactttcactcaagtcacaggaattaacagccatgtttttagcggtcagattgtactgtagtttcgttatggaatatgatatacatactctgttggattcagctacactggggacaactctatgggttatctatatgatacgttttaaattgagatctagttatatggaggataaagacaacttcccaatttattatgtcgctgtaccgtgtgctttgctagctcttttcgttcatccatcaacatcacatcatatgataaacagagtatgctgggccttctgtgtatatcttgaagctgtttctgtcctacctcagttgcgtgtgatgcaaaacacgaagattgttgagccatttactgctcattatgtatttgcacttggcgttgcgaggttcttgagctgtgcccattgggtcctgcaggtattggacacacgaggacggttgctaacagcattaggttacgggctgtggccatctatggttcttctctcagagatagttcaaactttcattcttgccgatttttgttactattacgttaaaagcgttgttggtggacagcttgtacttcgtcttccctctggagtagtatgaagttggtgggaggtttcatgtgcaatatatgtgctaattctgttgagtaataacttatagttagcaggttatgttatgtttgggttcc

SEQ ID NO: 2141 - DNA, 1278 bp, Fagopyrum esculentum
cgggggcgatcacctgcccctcattagactcctccccgcaatctagggacgaagatccacagaaacgcacgatctctctaaatctctccctcttcctctagtttctcttcgatttcaaaagattgggcacagatcgattgatttggaggtgattctagggttctaaggggaaagggaaggatgaaaggaggacagaagaggccgattcaagcgttttcgtcttgggttaggcgtcagcctcccaaggtcaaggctttcatggcggttatttctggtataatagcgctcgtcttcctccggatgatcgtccatgaccacgacaagctcttcgtcgccgctgaggctgttcacgctattggaatctgcgttcttatttataagcttacaaaggagaagacttgtgctggattgtcactcaaatcacaggaattgacggcaatgtttttagctgttagactgtattgtagttttgtcatggaatatgacattcacacgttactggacacagctactctagcaacaacgctctgggttatctatatgatgcgtttcaaagtgcgatctacctatatggaggacaaagacaactttgcaatttactatgtggcgataccttgtgctgttctatctgttattgttcatccttcaacaacccacaatattctaaacaggattgcctgggccttctgtgtctatctggaagctgtctctgtactacctcagctaagagtcatgcagaatacaaagattgttgaaccatttacagctcattatgtgtttgctcttggagttgcaagattcctcagctgtgcacactgggtgcttcaggtactggacacaaggggtcgtttactgacagcgttaggatacggattgtggccttccatggtgctgctttcggaaattgtccagacattcatactggctgatttctgctactattatgttaagagcatcttcggaggacagcttgtgcttcggctcccttcgggagtggtgtaggctacgggaaacttgaatgtatgcatcctacgggaaacttggagagtgtcacggataggcgggaagggaaggagggtgttttctgttaattatgtactggcagtcgcaaagccatatatatgatatttagatgaagacccaaaattgttatttaacagcacagcactgtatgcagcatatggaaggggattttatggagttgaggggtttgttgcgaacagatgttaatccatcttagtttatgttccctgttgctatttgcatctttccactgct

SEQ ID NO: 2142 - DNA, 1187 bp, Fagopyrum esculentum
cctcttcctccagtttctcttcgatttcaaaagattgggcagagatcgattgatttggaggtgattctagggttctagggaaaagggaaggatgaaaggaggacagaagaggccgattcaagcgttttcgtcttgggttaggcgtcagcctcccaaggtcaaggctttcatggcggttatttctggtataatggcgctcgtcttcctccggatgatcgttcatgaccacgacaagctcttcgtcgccgctgaggctgttcacgctattgggatctgcgttcttatttataagcttacaaaggagaagacttgtgctggactgtcactcaaatcgcaggaattgacggcaatgtttttagctgttagactgtattgtagttttgtcatggaatatgacattcacacgctattggacacagctactctagcaacaaccctctgggttatctatatgatgcgtttcaaagtgcgaactacctatatggaggacaaagacaactttgcaatttactatgtggcgataccttgtgctgttctatctgttcttgttcatccttcaaccacccacaatattctaaacaggattgcctgggctttctgtgtctatctggaagctgtctctgtactacctcagctaagagtcatgcagaatacaaagattgttgaaccatttacagctcattatgtgtttgctcttggagttgcaagattcctcagctgtgcacactgggtgcttcaggtactggacacaaggggtcgattactgacagcattaggatacggattgtggccttccatggttctgctttcggaaattgtccagacattcatactggctgatttctgctactattacgttaagagcatctttggaggacagcttgtgcttcggctcccttcgggagtggtgtaggctactatgggaaacttgaatgtatgcatcctacaatgacttgagagtgtcacggataggcgaggaaggggaagaaagggttgtttttctgttaattatgtactggcactcgcaaagccatatatatgatatttagatcaagacccataattgttatttaacagcagagctttgtatgcagcatatggaaggggattttatggagttgagggttttgttgccaacagatgttaatccatcttagtttatcttcccagttgctattcgcatcttt

SEQ ID NO: 2143 - DNA, 1225 bp, Gossypium raimondii
aagatatggattagtaggagaaaaattaattcttacgtcaactcccaatagactcgcattagcaatccacaaatcccaaaattttcccacgctttctctctttctcgagaacaaagaaaaaaaacatgagggtacagcagaggccgatccgcgcgctgtcgatgtgggtgagacgacagccgccgaaggtgaaggcttttttgggggtagtatcggggatggcagcgcttgttcttcttcgattcatcgtacacgaccatgacaatctcttcgtcgccgccgaggctgtccactccatcggaatctctgtccttatctataagcttattaaggagaagacttgtgctgggctatcgctcaaatcccaagagctaacagctatctttttagctgttaggctgtattgtagctttgtcatggaatatgatatacataccctacttgatttggccacattggcaacaactttatgggttatttatatgatccgtttcaaactaaagtccagctacatggaagacaaggacaactttgctttatattatgttcttgccccatgtgctgcacttgccctatttattcacccctctacttctcataatctagtgaaccggattttctgggcattctgtgtatatttagaagctgtttcagttctaccccagctgcgagtgatgcaaaataccaagattgttgagcctttcacagctcattatgtatttgcactgggtgttgcaaggttcctcagctgtgctcactgggttctccaggttttagacagtcgaggacacttgctggtagccctgggttacggattgtggccctccatggttcttatttcggaaattgtccaaactttcattttagcagacttctgttactattatattaagagtgtctttggagggcagcttgttctccgtcttccctccggagtagtttaagtgaagattctgttttgctttggtcgatgagcttgtttgccgaaaaaagtattactcggttaaaaatgtgactaggcatcctagttcaagttctggtttttgctctcgacatgtttcttatgactggaaattagcggattgcttgtaaatttcggggtgcagaaactttgggtggatatatattgaaaacatttcgtagatggattaattttttatgtcaaatgctaatcttttgcttatatgaagttaattattgtagaccattcctacatgtgatgata

SEQ ID NO: 2144 - DNA, 1169 bp, Medicago truncatula
attttgttccatctctctatcccttctctcaaatctatagatccttccaatctttgtcccacgcataggccaacaaagagaaagagaagaaccatctttgtcttgttcttgtgctgtgttgtgtttttcctcaaagaaaacccttaacatcatcatcaacgatgaggcctcagagaacatcgatccacgctatctccacatgggtcaggcgacaaccaccaaaggtcaaggcttttctcgccgttgtttccggtatggccgctcttgttctcctccgatttatcgttcatgatcacgataatcttttcgtcgctgctgaagctgttcactcgcttggaatctctgttcttatctataaactcatgaaggagaagacttgtgctggattatcactcaaatcccaggaattgacagctatatttttagctgtgaggctgtactgtagttttgtcatggaatatgacattcacaccatacttgacttggcgactttcgtaactacggtgtgggttatatacatgattcgttttaaattgaaggcgagttacatggaggagaaggataactttgcaatatactatgtggtgataccatgtgccgtgttagccctgctcattcatccatcaacttctcatcatatattaaacaggattttctgggcattctgtgtatacctggaagctgtttcagttctaccccaactgcgggtcatgcagaataccaagattgttgagccattcactgctcattacgtttttgcacttggcgtagcaagattcttaagctgtgctcattgggttcttcaggtgttagatacccgtggacatttgttggttgccttggggtatggtttatggccgtcgatggttcttatctcagaaattgtccagacattcatcttagcagatttctgttactattatgtcaagagtgttttcggaggacagcttgttctacgccttccctctggagtggtgtgattgcagatcttcaccctcacattttcttgttaacttaatcaggcatcatgtttggttacccatgttagacttagagtacattttgtgttgacatgtttattctgttccttggtggaagtgtaaagttggggatgaacgataactaaatatattttatgttcgaggtaccgttatttattatggttggga

SEQ ID NO: 2145 - DNA, 1267 bp, Tropaeolum majus
gctttcacacacttcaattaatcatttttctcgtaatttctttcctcttccccgaaaaacaaaaaaaggaagaatcatacacactcaatgagggcacccaagcggccgatccaaacagtattgtcatgggtgaaaaaacaaccacccaaagtcaaggcctttctggccgtggtggcggggatgtcggcactggttttgctccgattcatcgttcatgatcacgacaacctcttcgttgcagccgaagctgttcattcaatcggaatctctgttctaatctacaagctcatgaaggagaaaacttgcgcaggattatccttgaaatcccaggaacttacggctttgtttctagctgttaggctgtactgcagttttgttatggaatatgatatacacacgttactagatttatctacctttgctacaactgtatgggttatctatatgattcgattcaatctgaggtcgagttacatggaagacaaagacaatttcgctatatattatgtggttctaccttgtgctttattagctctgtttatccatccatcgacttcacatcatatactaaacagaattttctgggccttctgcgtctatttggaagcagtttctgtactaccacagttacgagtcatgcagaacacgaagattgttgaaccattcaccgcacattatgtatttgcacttggagtggcaaggtttctaagctgtgctcactgggttctacaggttctggatacccgtggacacttgctggtggcattaggttatggattatggccttcgatggttcttatatccgaaattgtccaaactttcatcttagccgacttctgttactactacgtcaaaagtgttttcggagggcaacttgtccttcgacttccgtctggagtggtgtaacccatttcaaggtacctttttggggtgtttgatgaaacaagctttacctggggtatttggattgacataatttaggcaaatttaccactggttgatgtgttataagctttgtttgtgtttttcttcaagccatcgaattctggtttggtttaactccgtccacggctggaagttggtggatttgtagacttggaaatccagaaaagtttggattgatatatttttattagaaggaaacgttattttcttttttattgtacgtctaaattataaatgaagcaagtttaatttatagagctccttaaatgaaccatgaatgtgtgattattatatttacaaaactctgatgcaaacgtttgtc

SEQ ID NO: 2146 - DNA, 1043 bp, Lippia dulcis
gagagagagagagagtgatacttgttacattgggcataccaatatgaggccaccgaggaggccgatccaggcggtgacgacatgggtgcggcggcaaccgccgaaggtgaaggggtttttggctgtgattagcggcatggtggcgcttgttatccttcgagcaattgttcacgatcatgataatttgtttgtggccgcggaggctgttcactcgatcggaatttgtgttctgatttacaagttgatgaaggagaagacttgtgctggactttcactcaaatcccaggagctaacagctatatttttggctgttagattgtattgcagttttgtgatggaatatgacatacacactttgctcgacatggctacactggctacaacattgtgggttatttatatgattcgttttaatctgaggtcgagttacatggaggataaagacaattttgcactatattatgtggtggggccttgtgctattgtagccttattaattcacccatcaacatcgcatcatataatcaataggattgcttgggctttctgtgtttaccttgaagctgtctctgtgctgcctcaactgcgtgtcatgcaaaacacaaagattgtcgaaccatttacagctcattatgtatttgctttgggtgttgcgaggttcttgagctgtgctcactgggttctccaggttttggacactcgaggtcatctccttgttgcattgggttatggactctggccttcgatggttcttatttcagaagttgttcagaccttcatccttgcagacttttgctactactatgttaaaagtgtttttgggggacagcttgtgctacgtcttccttcaggagtggtataattgattgttgtataagctttattcaaaacatgcccagttcttgcaaaatggatgtgaaaaatcaatatcaagttatcagaaaacagatttggttagttgtatcagtgctaatttggttttgagtacttggagcattttatagctgaattaatgatcacggtgcttatttacaaaaaaaaag

SEQ ID NO: 2147 - DNA, 1760 bp, Prunus mume
aaaaccgacatgcaacgggtgtagtacgtcttcttttattaaacttgggtccggatatctaattcgggtgcccggataacccacccgaaatcacggaagaaaatgtttgccttcgcaaaatccgtttttttccttgcaaaacagtcctaatctctctctctctctctctctctctctctctctctctcttaacagtggctgttccgcaccacaactactcgcattaataacttacctcactttctctccacctcatcacactttccgggaaaatcaagagcccagaaaatcagagaaggaaaaaaagggaaagaaaaacaacggaaaacctcatgagggctccgaagaggccgatccacaccttatcgacatgggttcgacgccagccgcctaaagtcaaggcctttctggccgtcgtaacgggcatggcggctctggtcgtgctccgatttatcgttcacgatcacgataacctctttgttgcagctgaggctgtgcactcaattggaatcatggtgctaatctacaagctcacgaaggagaagacttgtgctgggttatcactcaaatcccaggagttaacagctatgtttttagctgtgagattgtattgcagttttgtgatggaatatgatatacacaccctgcttgatttagctacgctggtgacgaccctctgggttatttatatgatccgcttcaacttaaagtctagttacatggaggacaaagacaattttgcaatatactatgtcgtggtaccatgtgctctattagctttgttcattcatccatcaacgtctcatcatttattgaacaggatttcctgggcattttgtgtgtatctggaagctgtttccgtactgccccagttgcgcgtcatgcagaacacaaagattgttgagccattcacagctcattatgtgtttgcactgggtgtcgcaaggttcctcagctgtgcccattgggttctccaggtattagatactcgcggacacttgcttgtagccttgggctacgggttatggccttctatggttcttatttcagaaattgttcagactttcatattagcagacttctgttactactatgtcaaaagtgtttttggagggcagctagtcctccgtctcccttctggagttgtatgagttcactccagttctgctgtgatctgcaagcgcactgccatcaagacttaacttagctaggcatgtggctagtcattgttgttttaagttaccctttttgctctccacaaggttctagttctcttttttaatgaaaaaaaaatcatgactggggatgaagtgggttgtttgtaaagttggagatggagtgaatttaatttatatttataatttagacatgacttttctgagttgcttcatcttttcttactaggtgctaacatttgctaaagtttactactacagaattgtttctttctacatccagttaatttgctcaagtatatatttaacaatggatgcaggacaaagtgtaaagcacttgtctgccatctgcccaccaacttgagtggatgcacattgcttcttttctttggttcaatattcaatttcctacagcactatcaaaccacaaactgctttcctgtttctacgaagtgcctacttcaccagctccgccacaattttttggtctttgtttcatttttgcatgtccgatttttgggtcttttttcttggtcctaccttaaattaaggttactaatcccacttgtcctgtgacactttagc

SEQ ID NO: 2148 - DNA, 1190 bp, Chenopodium quinoa
ggaggaaagagaagcccagttcaggcagtgaatatatgggttcggcgacaaccaccgaagatgaaggcgtttcttgcggtggttgtcggaattgcagctttagtgtttcttcgaatggttgttcaagatcacgacaacctctttgttgccgccgaagctgttcatgccgttggtattgccgtccttatttataaactcaccaaggaaaaaacttgcgccggactttcactgaaatctcaagaacttacagctatctttttagccgttaggctgtactgtagttttgtgatggaatatgatattcacacattactagatacagctacgctggcaacaactctctgggttatttatatgattcgatttagactgaagtccacttatatggaagagaaagacaactttgcaatctattatgtggttgttccttgtgctgtattgtcactgcttattcatcctaccaccgtccataacattgtcaatagggtgagctgggcattttgtgtctacctggaggctgtttcagtgctacctcagctacgagtcatgcaaaacacaaagattgttgagcccttcacagctcactatgtttttgctctgggggtggcgagatttttaagctgcgcacattgggttcttcaggtcttagatacccatggtcgcttgctaacagctctaggctatggtctgtggccttcaatggtgctgctttctgaagtcgttcaaactttcatcttagcagatttctgctattactatgtgaagagccttgttggtggacagcttgtgctacgccttccctcaggagttgtataaattgaagtttagttattcgagatcagagtagaaatacccaaaggcgttagtcaggtgctctttgttaaatccgcctttttggcactgtgaatttcctgtacaaacagcgttgtcatttccagcaagtacttgtgaattactgaggaggtcctaaccatggatttatctgttctgggaaatacatctcatatgaacttttgtaccgtgaattagcattcagtcttgtgatgcttttagtcttagaactttttagcttaccttcaattgtctcaaagaattttcgtctggttatcaatatgctaacaatttgaaaaatccaatttcctgtttttatcatctggttttgtagcaaagaaatagctttagcttctaag

SEQ ID NO: 2149 - DNA, 1091 bp, Raphanus sativus
ggaataacaatctcacatcatcatccatcagaacacaacagggaagagagagagagaatgaaggggggcacgaaaagtccgatccaggcggtgtggtcatgggtgaggaggcaaccaccgaaggtgaaggcttttctggcggtggtctcaggcatggctgctttggttctgctgagattcattgtccacgatcacgacaatctcttcgtggccgccgaagctgttcactccatcgggatctgtgtgctcatctacaaacttatgaaagaaaagacctgcgccggattgtcactgaaatctcaggagcttacggcgatatttctagcagttaggctgtattgcagctttgtgatggagtatgatatacacaccatcctggatctggctactcttggaacaactctctgggttatatttatgatccgttttaagttaaggcctagttacatgcaggacaaagacaactttgctctctattatgtgcttgtgccctgtgttgtcttagccgtgttgatccatccatcgacctctcacaacatattgaacaggatttcttgggcattatgtgtgtacctcgaagctgtttcagtactgcctcagctgcgcgtgatgcagaacaccaagattgttgaaccgttcacagcgcattatgtatttgcactaggagtagcaaggttccttagctgtgcacactgggttttacaggttgtggacacgagaggaagattgctggtagcattgggatatggattgtggccatcgatggttctcatctcagagattgttcaaactttcattcttgctgatttctgttactactacgtcaaaagtgtattcggagggcagcttgttctccgtcttccgtctggagtagtttaaagttacaaagatagaaaatactccaatggtgtagcttgcccaagtcaggaaaggcaggcagcttctttacctctgcccttatacagttttatgtgtcagaaggtgactcttgttacgaattaattttactgtgttgtatatttatgattattgaaggtggttttcacttctttgtggctgattgagaaaaaaaagaagcaaatagcgaatct

SEQ ID NO: 2150 - DNA, 1303 bp, Triphysaria pusilla
gaattttgatccaactcctattgatttaaaaaggtaagtgatttgttgggtcaataatgcaatctccatgtttccaccaatttcagggaaaagctaaattcaccttatttgcttccctttcacaggaaaagagaaaaaaaatctctttttaggggaatatatacatacacctgagcggacacaacgaggatgaggccaccgaagaggccgatccaagccgtgttgacatgggtgcggcggcagccgccgaaggtgaaggcgtttctagccgttatcagcggcatggcggcgcttgtaatcctacgcgccatcgttcacgatcacgacaatctattcgtcgcggcggaggctgtgcactcgatcgggattatggttcttatttacaaattgatgaaggagaggacttgtgcgggtctttcactcaaatctcaggagctaacagctatctttctggccgttcgattatactgtagttttgtaatggaatatgacatacacactctgcttgacatggccacattagctactactttgtgggttatttatacgatccgttttaaactaaactcgagttatatggcggacaaggacaatttcgccctatattatgtggctgctccttgtgctgttttggctttattgatccacccttcaacatctcatcacatcgttaacaggatcgcttgggctttctgtgtttacttagaagctgtttctgtattaccacaactacgagttatgcaaaacactaagattgttgaaccgtttaccgctcattatgtgtttgcattgggtgtggcgaggttcttgagctgtgctcactgggttcttcaggttttggacagccgtggtcatctcctcgtggcattaggttatgggctttggccaacgatggttctcatatccgaaattgtccaaaccttcattctcgctgacttttgctattactatgtaaaaagtgtttttggcggtcagcttgtgttacgccttccttctggagtggtttaacgagtcgatatttaaatcaacttcaacttaccaagaaaagatgttggctttatttaatctcggttaagtacaatgcaatatacttacttagcttgaacatgtagagcccgagggttaaaatcgatcctttgcacttttccttgtaattttgttctaacgtttttaccgtctctccgtctcgttctcttttcagtttagcggactattacaaattgttaattttccttttgtttttttgttagtttatcattggtgtatgagggattgttatatgaaaattttggacttgttctta

SEQ ID NO: 2151 - DNA, 1121 bp, Triphysaria pusilla
atcttcccaagccgaaaacccaggaaaagtgaaaggtaaatccctccgcaacatataaataaacagttatatctaccaaaaggacttcaaatcaacaaaaacacaattaatttcaaatctatttcggtagatatactcgtacaattatgaaggcaccgaggaggccgatccaagcggtgacgtcatgggtgcgacgtcaaccgccgaaggtgaaggcttttctagcggtagtcagcggcatggcggcgctcgttctcctccgcgcggttgttcacgatcacgacaatttgttcgtggcggcggaggctgttcactcgatcggaattggggttttgatttacaagttgattaaggagagaacttgtgccgggctttcgcttaaatcccaggagctaacagctatctttttggctgttagattgtattgcagtttcgtaatggaatacgatatccacactttgcttgacatggctacattggctacaaccttgtgggttatttatatgatccgtttcaaattgaaatcaagttacatggaggataaagacaacattcccctttattatgtggtgataccttgtgctgttgtagctttactaattcacccatctacatcacatcacatcatcaacaggattgcctgggccttttgtgtttacctcgaagctgtgtctgtgctacctcaactccgcgtcatgcaaaacacaaagattgttgagccttttacagctcattatgtatttgcattgggtgttgctaggttcttcagctgtgctcattgggttctccaggtcttggacacgcgtggtcacctcctcgtggcattgggatatggactctggccttcgatggttcttttatccgagattgttcagaccttcatcctagccgacttttgctattactatgtgaaaagtgttttcgggggacagctcgtattgcgccttccttctggagtggtgtaattactattatcgatggtttctataagctttattctagtgtgtttttggttcttacaaacctggttggttgcgaacgaggcagttcccacattgatgttaagtttacagaaaccatgttggatgaactgtatgagtaccaattagtttgtctttatg

SEQ ID NO: 2152 - DNA, 904 bp, Triphysaria pusilla
ggaaaagagagaaaaaatctctttttaggggaatttatacatacacacctgagcggacacaacaaggatgaggccaccgaagaggccgatccaagccgtgttgacatgggtgcggcggcagccgccgaaggtgaaggcgtttctagctgttatcagcggcatggcggcgcttgtaatcctacgcgccatcgttcacgatcatgacaatttatttgtcgcggcggaggctgtgcactcgattgggattatggttcttatttacaaattgatgaaggagaggacttgtgcgggtctttcgctcaaatctcaggagctaacagctatctttttggccttagattatactgtagttttgtaatggaatatgacatacacactctgcttgacatggccacattagctactactttgtgggttatttatacgatccgttttaaactgaactcaagttatatggccgacaaggacaatttcgccttatattatgtggcggctccttgtgctgttttggctttattgatccacccttcaacatcgcatcacatagttaacaggatagcttgggctttttgtgtctacttagaagctgtttctgtattaccacaactacgcgttatgcaaaacactaagattgttgaaccgtttaccgctcattatgtgtttgcattgggtgtcgcgaggttcttgagctgtgctcattgggttcttcaggttttggacagccgtggtcatctcctcgtggcattaggttatggtctttggccatcaatggttctcatatcagaaattgtccaaaccttcattctcgctgacttttgctattactatgtaaaaagtgtttttggcggtcagcttgtgttacgcctaccatctggagtggtttaaattagtcgaggcgtaattg

SEQ ID NO: 2153 - DNA, 905 bp, Thalictrum flavum
aggggttcttcagcgaagagaccaatatacgcagtagcagcatgggtgaaacgacaaccaccaaaggtgaaggctttcttggcggttgtttcagggatggctgctttggtttttctgaaattgatcgttaatgatcacgacaatctattcgttgcagccgaagctgttcatgctattgggatctgtgttcttatttataaacttatgaaagagaagacttgtgctggactttcactcaagtcacaagaaattacagctctatttctagctattagactgtactgcagttttgttatggaatatgacattcacacgctacttgatacagcaacattggggacaaccctctgggttatttacatgattcgttttaaattgagatctagttacatggaggataaagacaactttccaatatactatgtggtggtaccttgtgcggtctttgctcttatcattcatccatcaacatcacatcatatcctgaacaggattttctgggccttgtgcgtctatctggaagcagtttccgttttgccccagctgcgtgtgatgcagaatacaaagattgttgaaccatttacagctcattatgtattcgctttaggcgttgctaggttcttgagctgcgcccattgggttcttcaggtcctagatacccgaggtcgcttactgactgctctaggttatggactgtggccttccatggttcttatctcagaaattgtccaaacttttatcctcgcagacttctgttattattacatgaaaagccttgttggtggacagcttgttttacgtctgccctctggtgtagtgtaattctggagcttttgtgttcactgtatggggttaatgtgtccatgaataatttatttaggcgatgcggggcacatggtcatttt

SEQ ID NO: 2154 - DNA, 1239 bp, Amaranthus tuberculatus
ccttctttcatcccttttaaaaatcaattcttttgccattaatttccatttccatctcaacaacttcccaattttcattctttcccattattcttccaaccccaaatcaaccaattcacctaattttcattcttgtaaatccccttttcttgtctctttcccatcttcaactcatacccattaatccctgcaaattcttctccaatttccagtgattttctcaaacacccacaaaaaatgaagggaggaaaacgaaccccagtacaagctgtaactctatgggtgagaagacaacctccgaaggttaaagcttttctttctgtaattgctggaatggctgctttagttttccttagaatggttgttgatgatcatgataatctttttgttgctgctgaagctgttcatgccatcggtattgctgttcttatttataagctttccaaggagaaaacatgtgctggactctcactcaaatctcaagaacttacggccatctttttagctgttagattgtactgtagttttgtgatggaatatgatattcacactctactagatacagctacattggcgacaaccctctgggttatttatatgatccgctttaagttaaagtcgtcttatatggaggagaaagacaactttgctatttactatgtggtgggaccttgtgctttattgtctctacttgttcatccttccactgtccacaacattgtcaataggattagctgggcattttgcatctacctggaggctgtttccgtgttacctcagttaagagtcatgcaggaacactaagatcgttgagccattcacagcccattatgtttttgccctgggggttgcaagtatttttgagctgtgcacattgggttcttcaggtcttagatacccacggtcgtttgctaacggcattaggctatggcttgtggccttgtatggtgctgctttgtgaagtagttcaaacttttatccttgcagatttctgctattactatgtgaagagccttgttggtggacagctcgtgctgcgccttccctccggtgtagtgtaaacatttaggtacaaaggtgtaaatcagctgctttttgttagttcatcctttttcacactgagaatttcctgtaaaaacttgtctttaccgagctggttccgaccagggatgtatctaagccgggaatactagtcttatatacttctaaaacagtgaattaaacgttcagttgcctctg

SEQ ID NO: 2155 - DNA, 1223 bp, Eschscholzia californica
cgtcgtgtccttgtcctccctaccgacctaaatactattgtcttaccttactaagtacaatattaaacgttagtcgcccactcttcccccgtttcccttaaccttactttaattaccctactcatcatcttctatcattctatttcttagagagagaaacaagacttgtattagtaatactagagagagagagagagagaggagtgatgagggcaccaaaaaaaccagttcaagctgtagcaacatgggtgagaaggcaaccaccaaaggtgaaggctttcctcgccgtcgtctccggcattgcagctctgttttcctcagattcatcgtcaacgatcatgataatctctttgttgcagctgaagctgttcatgctctcggtgtatctgttcttatttataaactcatgaaagaaaagacttgtgctggactttcactcaaatcccagtacctcacagcgatatttttagctgttagactatattgcagctttgttatggaattcgatatacacacacttctagattcagcaacattagttacgaccctgtgggttatttatatgattcggtttaaactgaagtctagttacatggaggataaagataattttgctatttattacgtgctggtaccatgtgttctattagctcttgccgttcacccaacgacgtcacatcatattttgaacaggatttgttgggccctttgtgtatatcttgaagctgtttcagtactacctcagttgcgtgtgatgcagaatacgaagattgttgaaccatttacggctcattatgtatttgcattgggcgttgcgagattcttgagctgtgcccattgggtcctccaggttttagatactaggggacgcttactaacagctttgggttatggtttatggccttccatggttcttctgtctgaaattgtccagactttcatcctcgccgatttctgttattattatgttaagagtgtggttggtggccaacttgttttacgtctaccctcgggagtggtttgaatttgagctcatctcttatcctgtttacctgctaactgttcacatgaataacttaaaattagggtaatgtgggggattttgcgtttcttatggtacttttgatggcagtctgaaatgctgctcagtaattgtaaagttaggaacacatgatgctgttggctgaagtgtataagttaattaatgaagtatttgttgttcc

SEQ ID NO: 2156 - DNA, 1317 bp, Amorphophallus konjac
gaactcgagctcttctcccgtttgctgtctctctgctgcgtttcttcttccgctcgtggcgttcggatttgtactggtaaaaggatttgtactggtaaaagccgaagaggacgcacgtcgcagaggaagcaggggagaagagggggagggatcgaaggcgactccaggggaggaggaggaggagggcgcgatgaagggctcgaagaggtcgctgaacgcggcgctgggatggctgcggcggcagccgcccaaggtgaaggccttcctcgccgtggtggctgggatggcggccctggtgttcctccgcttcgtcgtgcacgaccacgacaacctcttcgtggccgcggaggtgtgccacgcggcgggcatcatcgtccttatctacaagctcaccaaagagcggacttgtgcaggactttcactcaaatcccaggaactaacagcattatttttagctgttagactgtactgtagctttgtcatggagtatgacatacacacacttcttgatacggctacacttgtcacaaccctctgggtaatttacatgtttcggtttaaactgaggtcaagttacatggaggatcaagacaactttgcaatatactatgtggttataccttgtgttattctagcccttttaattcacccgacaacaacacacaacttcataaacaggattttttgggctttttgtgtctacctggaagctgtttcagttcttcctcaattgcgtttgatgcaaaacacaaagattgttgaaccttttacagctcattatgtatttgcactgggagtagccaggtttcttagttgtgcacattgggttctccaggtactggatacccaaggacgcctgctgacagctttgggctatgggctgtggccacctatggttctcctttctgaaattgttcaaaccttcatccttgctgacttctgttactactatgtgaagagtttggttggtggacagcttgtgttacgccttccatccggagtggtgtaaagtttcaagcacatcctgttggtctggtttattaacacctgcacattagagatgacatctggttatgttcattcttgatgcatgttccctcgactcttcagttctgagttgactatgcaagcagtcctaaatgaggttaaatgttcatcttggtggactgttaagtgccaacatatgaataggatggaggagttttgtgtaccgtctgaagcatgccttaggatgataggatgcataaaacgcttaaggttatgtatcgtctttccaaattaaagatgctaggaaaatccttgtcagttttagactcg

SEQ ID NO: 2157 - DNA, 1480 bp, Aristolochia fimbriata
cgaccgcagcgcttctgcttctctgtcagcccgactcttttttccttccccccttccggccctctcgggagcttctttcagctcctcctgcggcctatttggtccggctcagcctccatcgccgttgattctcgtcgcctcctccggcaaggtcgccgattcctccgcttcgctgttgcctttccactgcggtgcgatgagagcgccgaggaggtcgatgaacgcctttgtcgggtgggtccggcggcagccacccaaggttaaatcttttctcgccgtagtcacgggcatggttgcgcttgtattgctcaggcttgtggttagggatcacgataatctctttgtcgccgccgaggctttgcatgctctcggaatttccgttcttatctacaagctcactaaggagaagacttgtgccggactttccctcaaaactcaggaattaacagctatatttttagccgttagactgtactgcagttttgttatggaatatgacatccacacgttgctcgattccgcaacattgataacaaccttgtgggttatttatatgatacgctttaagctgaagttcagctatatggaggataaagacaactttgctatatattatgtggtgggaccatgtgcagtactggctcttctaatccatccatcaacatcacaccatatttttaacaggatttgctgggcattttgtgtttatttggaagctgtttccgtattaccacagcttcgagtgatgcaaaacactaagattgttgaacccttcacagcccactacgtgtttgcattaggagtggccagattcttgagctgtgctcactgggttcttcaggtgttggatactcggggtcgtttattgactgcattgggctatgggttgtggcctccaatggttcttctctctgaaattgttcaaactttcatcctcgctgatttctgctactactatgtcaagagtgttgttggtgggcagcttgtattgcgtattccgtctggagtcgtgtgaaagttaacaagtttggtgcagtgtaaagtttcactgccacgaatggcattacgaagtacctcatatcctgcagtttgtattgcccctatagatacgtggatccctttgatggttgtcagttttttcgtttgttcatttagaggaaaaaatagaatgcttttaggtcctaatttagagaaaaaaaaagaagctttttagtccttatttagagaaaaaaaaagaacgtttcatagtctcttgtgaagcttttccctgtctgtagaatattattgtgatactcagttcttgccctcatacatggtgaaattttgtatttcaattgttagcaactagactctactttacctttgttgaaagaccaggcttaaatattctcaatatcattcataatctcttctctgacgctcatttctagtagttaagccaaagtcattcatacttccaacctaatctgcaatgaagcca

SEQ ID NO: 2158 - DNA, 941 bp, Brassica oleracea
aggaaaaaagagagaatgaaggggggcacgaaaagtccgatccaggcggtgtggtcatgggtgaggaggcaaccaccgaaggtgaaggcttttctggcggtggtctcaggcatggcggctttggttctgctgagattcatagtccacgatcacgacaatctgttcgtggccgcggaagctgttcactcaatcgggatctgtgttctcatctacaaactcatgaaagaaaagacttgcgccggattgtcactgaaatctcaggagcttacggcgatctttctagcagttaggctgtattgtagctttgtaatggaatatgatatacacaccatcctcgatctggctactcttggaacaactctctgggttatttttatgatccgttttaagttgagggctagtttcatggaggacaaagacaactttgctctctattatgtgcttgtgccgtgtgttgtgttagctgtgttgatccatccatcgacctctcacaacatattaaacaggatttcttgggctttgtgtgtgtaccttgaagctgtttctgtgctgcctcagctgcgcgtgatgcagaacaccaagattgttgaaccgttcacggcgcattatgtctttgcacttggagtagcaaggttccttagctgtgcacactgggttttacaggttgtggacacgaggggaagattgctggtggcattgggatatggattgtggccatcaatggttctcatctctgagattgttcaaactttcattcttgctgatttctgttactactacgtcaaaagtgtattcggagggcagcttgttctccggcttccgtctggagtagtataagttttaaaaaagaaagatagaaaatactccaatgatgatgtaaggtccgatgagcttgcctaagtcaggaaaggctgctctattttctctttaccctcctccgg

SEQ ID NO: 2159 - DNA, 1471 bp, Cannabis sativa
tatagatactaaatatataacattttagagctatataaggaagggaatgcctctaatttgtttgaaagttgaaatgcattaggttgaccattttggacccaaaaatctctctattctgattttctctcttattattattattattatatctcttaggtagtcctcacccgtcatccgcttcatctatttttttttttattatttttttcccatattgtccctgtctctctttcttttccctttctattcagaaattttctaggaaaatcaaaatactccgagaaaaataacctcatgagggctcccaagagaccgatccacgcagtttccacatgggtgaggcggcagccccccaaagtgaaggcctttttggctgtgatttcgggtatgactgctctggttttgctccgatttatcgttcacgatcacgataacctctttgttgctgcggaggctgtgcactccattgggatttctgtgcttatctataagcttatgaaggagaagacttgtgctgggctatcattgaagtcccaagaactaacagcaatctttttagctgttagattgtactgtagttttgtgatggaatatgatatacacacactacttgatctagcaaccctgggaacgaccctgtgggttattttcatgatccgttttaaattgaaatctagttacatggaggataaagacaactttgcaatttattatgtggtggtgccctgtgctgtattagctttgctcattcacccatcaacctctcatcatttgttgaacaggattttctgggctttctgtgtgtatcttgaagctgtttcagtgttgccacagttgcgggtcatgcagaacacaaagatcgttgaaccattcacggctcattatgtatttgcactgggtattgcgaggtttctcagctgtgcccattgggttctccaggttttagatacccgaggccagttgctcgtagctctaggatacggactgtggccctctatggttcttatctcagaaattgttcaaactttcatcttggccgatttctgttattactatgtgaagagcgtttttggaggacagcttgttctgcgactgccctcaggagtggtgtaaaccgagttttcgctgcagctgtagccagtgagcaacagtgccgccccataattaacttagctaggcacaatgttgcttctccatgtttagtgccccattttgcactcaacacaggcctaattctctttcatgtatcttggtcgaaattgaagtgggggatttaaatttgatatttatatatatcgaacatgatttacacagttaatttaacacttgcgttggtgtcattattccgcaccatgtttattttggacattttgtagtctccacttcataagatattgctcaaaccactaattagattataacaatataattggtgaccgtaccaaaaatgagaaaaaaaaaaccaaaaaaa

SEQ ID NO: 2160 - DNA, 1040 bp, Brassica napus
agactttttttaataatataacacaagacaagacggaagtagagaaaggaaaaaagagagaatgaaggggggcacgaaaagtccgatccaggcggtgtggtcatgggtgaggaggcaaccaccgaaggtgaaggcttttctggcggtggtctcaggcatggcggctttggttctgctgagattcatagtccacgatcacgacaatctgttcgtggccgcggaagctgttcactcaatcgggatctgtgttctcatctacaaactcatgaaagaaaagacttgcgccggattgtcactgaaatctcaggagcttacggcgatctttctagcagttaggctgtattgtagctttgtaatggaatatgatatacacaccatcctcgatctggctactcttggaacaactctctgggttatttttatgatccgttttaagttgagggctagtttcatggaggacaaagacaactttgctctctattatgtgcttgtgccgtgtgttgtgttagctgtgttgatccatccatcgacctctcacaacatattaaacaggatttcttgggctttgtgtgtgtaccttgaagctgtttctgtgctgcctcagctgcgcgtgatgcagaacaccaagattgttgaaccgttcacggcgcattatgtctttgcacttggagtagcaaggttccttagctgtgcacactgggttttacaggttgtggacacgaggggaagattgctggtggcattgggatatggattgtggccatcaatggttctcatctctgagattgttcaaactttcattcttgctgatttctgttactactacgtcaaaagtgtattcggagggcagcttgttctccggcttccgtctggagtagtataagttttaaaaaagaaagatagaaaatactccaatgatgatgtaaggtccgatgagcttgcctaagtcaggaaaggctgctctattttctctttaccctcctccggaacgaattaattttactgtgttgtatatttttgactattaaagttggtttcaa

SEQ ID NO: 2161 - DNA, 1441 bp, Cicer arietinum
ctaaagtcaaatatactttaatcaaaacatggaaattaatatttaatttattgaacctaacacaattactacttaaaattttgtgttacttttaagttgttttgttttggtttaatatttttatctctatcatccccctcatcaaatccaaagatccttccaatcgtttgttaccacggttgcagtttgggccattgaactgtctttgtgttctgttctcttgtcttttcaaaactctcaagaaataaaaataaattaaaaaaaaaagttacgcagctaccaaaatcagcgataccctaatttcattcatcatcaccatgagacctcagaaaacgtcgatccacgctatctccacatgggtcaggcgacagcctccaaaggtcaaggcttttcttgccgttgtttccggtatggccgctctcgtcctcctccgattcatcgttcacgatcacgataaccttttcgttgctgccgaggctgttcactctcttggaatttccgttcttatctataaactcatgaaggagaagacttgtgccggattatcactcaaatcccaggaattaacagctatgttcttagctgttaggctgtattgcagctttgtcatggaatatgacatacacaccatacttgatttggctacttttgtgactacggtgtgggttatttatatgattcgttttaaacttaaggctagttacatggaggagaaggataactttgcaatatactatgtggtgataccatgtgccgtgttagccttacttattcatccatcaacttctcatcatatattgaacaggattttttgggcattctgtgtatatctggaagctgtttcagtactaccccaactgcgggttatgcagaacaccaaaattgttgagccattcaccgctcattatgtatttgcactcggcgtagcaagattcttgagctgtgctcattgggttcttcaggtgctagatactcgtggacatttgttggttgccttgggttacgggttatggccgtcaatggttcttatctcagaaattgtccagaccttcatcttggcagatttctgttactattatgtcaaaagtgttttcgggggacagcttgttctacgtcttccatccggagttgtgtgattgataatctacaccctcaaattttcttttaacttaatcaggcatcatgtttggttgttaccaatgttagacttagagtacattttgtgttgacatgcttattcggttccttggtggaagtgtaaagttggggatgaaagtaaactaaatatattttatgtttgaggtaaggttatttattatggttggaagtgcttttatacctaagtctttattttcttagactaatagaattcagttttgttacaacaattccacatgcttactgagtcttggattgctgtagatcttttctttgcagcgcg

SEQ ID NO: 2162 - DNA, 1100 bp, Cleome gynandra
cagctttcccgagaaaatctggaaggaagaatataaaacgaaaagagcatgaaagcgacgaagaatccgatccatgcggtgtggacatgggtgaggaggcagcctccgaaagtgaaggcgttcctggcggtcgtaacgggcatggccgcgttggttcttctcagattcatcgttcacgatcacgacaatctcttcgttgccgccgaggctgtccattccatcgggatcgctgttctcatctacaagcttaccaaggaaaagacctgtgctggattgtcactgaaatctcaggagctaacagcgatatttctgggtgtgaggctgtactgcagctttgtaatggaatatgatatacatacccttctagacttggctactctgggcacaactctctgggttatattcatgatccggtttaagctaaggtctagttacatggaggacaaagacaactttgctctctattacttgcttgtgccgtgtgctgttttagcagtgttgattcatccatcaacgtcgcacaatattctgaataggatttcatgggcattctgcgtatatttggaagctatctcagtgttgcctcaattgcgagtgatgcagaacacaaagattgtggaaccattcacagctcattatgtatttgcacttggagtagcgagattcctgagctgtgcccactgggttttacaggttttggacacgcgtggtcgcttgttggtagcacttggttacggattatggccgtcaatggttctcatatcagaaatcgtgcaaacattcatcttggcagatttctgttactactacgtcagaagcgtgttgggagggcagcttgttctgcggcttccttctggagttgtgtaagtttgaaggcatagttgaatcatatttatcttctttttattattataattataataattataaagagaaggttggaattcaactcaacccttgtgtgtctgaggttgcaagtggcttccatctgatgaatcaatggtgttgtatattcagactttttggctaacgttattgacatcattcttacgttattgaacaaacaatggaatgttcattattaccattcattcatgggt

SEQ ID NO: 2163 - DNA, 1156 bp, Euphorbia peplus
tatttaaagctgagtttccgggcgaaagaatcgtctgagaaatctccgatgagggcgcacaagagaccgatctacgcggtgacgacatggctgcggcgacaaccttcaaaggtgaaggcttttttggctgtggttgccggaatgtctgctctcgttctccttcgattcatcgtccatgaccatgacaacctcttcgtcgctgccgaggctgtccactccattggcatcgttgtcctcatttataaactcatgaaggagaaaacttgcgctggactttcacttaaatcccaagaattaacagcaatgtttttagctgttaggctctattgtagttttgtcatggaatatgatatccatactatacttgacttagctacattggggaccactttgtgggtcatctacatgatccgtttcaaattgaagtctagttatatggtcgacaaagacaactttgctatatattatgttgtggtaccctgtgcagctctggcttttttaatccatccatcaacatctcataatttcataaataggatattttgggcattctgtgtctaccttgaagctgtctccgtactacctcagttgagggtcatgcagaacacaaagatagttgaaccatttacagctcattatgtatttgcacttggtgttgcaaggttcttgagctgtgcccattgggttctccaggttttagacagtcgtggacacttgctggtagcattggggtatgggttatggccttctatggttcttatctctgaaattgtccagactttcatcttagctgacttctgttattattacattaagagtgtatttggaggacaacttgttcttcgtcttccctctggagttgtgtagttgaaggtcattgagcaacattgccatctcaaattgatgattttcggcaacgttgcaaattcttttgttctcaatacaggtttatacctcgactgtgactggaattgaagtggcctgtttgtaaattttggaatgtaacttctagaaatatttatacttgcaaaaaacataattatcatagttggattaacttattttatcagtgttgatccttttgaagtttatagactatatatccatgcctttttacatctcttgtgttcacgaattgtccatccttggtgaactt

SEQ ID NO: 2164 - DNA, 1530 bp, Gossypium raimondii
cccagaggttgtgaagttaggctacttaatttcaaataaaaatccacccgaatcacttatcgttttctcaaatcccaatcaaaacgatagagatcggagattcgaggaaagacaatccaaataaaaatattttttccctattaaacaaaaagcttaaatcaaaccccaaaatccagaatcccacatcctctaaatccccaaaacgggaaaaaaaagaataaagaagacatgaggacacagaagaggccgatccatgcggtgtcgatgtgggtgagacgacagccgccgaaggtgaaggcttttttggcggtggtatcggggatggcggcattggttcttctccgagtcattgtaaatgaccacgacaacctcttcgtcgccgccgaggctgtccattctatcggaatctctgtcctcatctataagctcaccaaagagaagacttgtgctggactatcactcaaatcccaagaactaacagctatctttttagctgttaggctgtactgtagctttgtcatggaatatgacatacacaccttacttgatttagccacattggctacaacattgtgggttatttatatgatccgtttcaaactaaagtccagctacatggaagacaaggacaactttgtgatatattatgttgttgtcccttgtgcagtactagctctgtgtattcatccaacaacttcccataatctattgaaccggatttcctgggcattctgtgtatatctggaagctgtttcagttttacctcagttgcgagtgatgcaaaacaccaagattgttgagccttttacagctcattatgtgtttgcgttgggtgttgcaaggttcctcagctgtgcccactgggttctccaggttttagacagccgaggacgcttgctggtagccctgggttatggattgtggccttctatggttcttatatcagaaattgttcaaacttttattttagcagacttctgttactattatatcaagagtgtctttggagggcagcttgttctccgtctaccctctggggtggtctaagtgaagatgctattttgctgtggtcgatgagcttgctgccgaaagaaaacataacttggttactaatgtgactaggtgttcttgtttaatttctggtttttgctctgcacgtttcttgtgactgcaattagtggattgtttgtaaatttcgggatgcagaaactttgggtggatatttatagggaagcatttcatagatggtttagtttatggtatcaaatgcctaacctgccgcttatatgaagttatttattatagactattcctacatgtggaggtgaagaaagttataccttgctttgtcaaaatatcattcatggtcaagagtattattatacatgaacagaagtgattgttacaagtaatgtctattcctaacgagggccagtagcaccatcggaacggtccatgaaatagtgactgttgtgactcggctgagtccaagtcctgttggtagattaaggtcaccattaggtggccaag

SEQ ID NO: 2165 - DNA, 1345 bp, Lupinus angustifolius
aggttccaatcgaagcgccgagtaactgcagtacccaaattcagaattagggattcgaaattgagcattggtagatagtaaagaagaaagaatcgataagatgaggcctcagagaacgccgatccacacaatcacaacatgggtcaggaaacaaccaccaaaggtcaaggcttttctcgccgtcgtttccggcatggcggcgctcgttctcctccgctttattgttcacgatcacgacaatctcttcgttgctgctgaagctgttcactcaattggtatttctgtcctcatatataagctcatgaaggagaagacatgtgccggattatcactcaaatcccaggaattaacagctatctttttagctgttagattgtactgcagctttgtcatggaatatgatatacacaccctacttgattttgctacttttgcaacaactctctgggttatatacatgattcgtttcaaattgaaggctagttacatggaggagaaagataactttgcaatatactatgtggtgataccctgtgccgtgttagccttgcttattcatccatcaacttctcatcatctattgaacaggatttcctgggccttttgtgtatatctggaagctgtttcagtactaccccaactgcgggtcatgcagaacaccaaaattgttgagccattcacagctcattatgtatttgctttgggcgttgcaagattcttgagttgtgctcattgggttctccaggtgttagatactcgtggacatttgttggttgcgttggggtatggtttgtggccgtcaatggttcttatttcagaaattgtccagaccttcatcttagcagatttctgttactattatgtcaaaagtgtttttggagggcagcttgttctccgtcttccctccggagtggtgtgatcgaagatctgctttgctgcaaagtttcatttaaatttaacttaatctggcaatatgtctggttacccttctagagtacattttgtattaacacttgctgggttccttggtggaagctagttctgtgtaatgttgggatgaaggaaaactaaatatttatgtttaaggtacggtaatttatagttgaaaatgttttatacattgagtgtctatgttttaggctcttggatttcagttcttattatacctattccacgtgctcaagttctagagaagtatggtagaaccaccctacctaattcccacctaaggtgcattgttgttgagtccacaaatgttatcctaataatattcacacctcactcattgttgttgaccctatccgtgttagttgtgtagtatatcccaatattttcaattagttga

SEQ ID NO: 2166 - DNA, 1387 bp, Quercus alba
atgggaactctgttttttcaatttctcaagtttccacccactttcatcaattctagttatattttccaattccttttattttccctcactttctcgcccacactttcccggaaaacaaaaacccaacacccaacacacaaaaaaacttcctgataaaagcgatgagggcacagaaaacgccgatccatgcagtttcgacatgggtgcgtcgacaacccccgaaagtgaaggcctttttggctgtggtctcgggcatggcggcgctggttcttctccgattcatcgtacacgaccacgacaaccttttcgtagctgccgaggctgtacactccataggaatctccgtgctcatctacaagctcatgaaggagaagacttgcgctggactatcgctcaaatcccaggaattaacagctatttttttagctgttaggctctactgcagttttgttatggaatatgatatacacaccctacttgatttagctacatttttgacaaccttgtgggttatttatatgatccgttttaacctaaagtctagttacatggaggacaaggacaactttgcgatatattatgtggtgattccctgtgccgtgttagctttgtttattcatccgtcaacttctcaccatttcttgaacaggatcttctgggcattctgtgtatatctggaagccgtttcagtactaccccagttgcgggtaatgcagaataccaagattgttgaaccattcactgctcattatgtatttgctttgggtgtggcaaggttcctgagctgtgctcattgggttctccaggttttagatactcgcggacacttgctggttgccctgggttatggattatggccttctatggttcttatctcagaaattgtccagactttcatcttggcagacttctgttactattatgtcaaaagtgtttttggtggtcagctcgtcctccgtcttccatctggagtggtgtaacagagatcctcttggtccatgttcagcgggcgcagagccatctaagaattaacttaaccaggcaatgtggattttaccttgtttaagtgtcctttttgcactccacacagatctggttctccgtgttatgactattggtcaagtgggttgttgtaaagatggcggacgcagaaagctttgatatttatatattaaacatgattttcatagttgatttattttgtgtcaattgtaatatgtttgagctggtcacagtgtcagttattcccacttccaattatgtggtcaagctgtctaaatggttagttactgatgctcaaccaaagtgtagtgtacttgtctaaatggtatggaacaccaggcattttctggccttattgatcaatttaatgattccaatgccacgg

SEQ ID NO: 2167 - DNA, 1033 bp, Phalaenopsis aphrodite
cgcaaatcagccgaagttccggcctctcctcctccttccctaaccggaaaatttactggttgtatccgttcctcgacgttctcatagcgagcgaccggcgctgtcttccttcttaatttcttcttgctatctttttcatcgaactggtttgggattggatcgagctgcggatagcatgaggggttcggggcggcccattagtgttgtgaccagatgggttcgtcggcagccaccgaggatgaaggcgtttcttagcgttgttgcagggatggtggcacttgtgttactaagattcgttgttcaggaccacgatagcctcttcgttgcagccgaggcagttcacgccatcggcatctccgttcttatctataagctcgccaaggagaaaacctgtgccgggctttcactgaagtcacaggaattgacagctttatttttagctgttagactctactgcagttttgtaatggagtacgatatacacacattattggactctgccacgttagtcacaacattgtgggttatctacatgatccgttttaagttaaaatctagttacatggaggataaggacaactttgtcatctactatgtggtggtgccttgtctggtactagccttcgcagttcatcctacaacctcgcacaacattgtgaacaaaatttcctgggcattctgtgtttatttagaagctacgtcagtgttgccacaattacgtttaatgcaaaacacgaagattgttgagccctttacagcacattatgtatttgcattgggaattgcgaggttcttgagctgtgcccattggatccttcaggttttggatacaagaggacgattgctgaccgcccttgggtatggcttgtggccttccatggtgcttctctctgaaatagttcagacattcattctcgctgatttctgctactactatgtgaagagcgtttttggcggacaacttgtgctgcgtcttcctgctggtgtcgtttgaatttagcagcagcagctccaacggtaagaattgcctttt

SEQ ID NO: 2168 - DNA, 1323 bp, Solanum tuberosum
ggtgtcccagtccaactccaaacaggattcctaaattactagtgctatttttttcattttgaagttccaatatttcaatcttagatttcatcgtcgaatttcgggtaaatccacaaatcgagaaaaatcagtatgaggacgacaaggaggccgatccaagtcgtgtcgacatgggtccgccggcaaccgccaaaggtcaaggcttttctggccgtcattaccggtatggcggcgttggtgttgctacgcgccatcgtccacgatcacgataatcttttcgtcgccgctgaagctgttcattcaattggaatctccgttctcatctacaagctcatgaaagaaaaaacttgtgccggtctttcactcaaatcccaggagctcactgctatgtttttggctgttagactgtattgcagttttgtcatggaatatgatatacacaccttacttgatttagctacgttagctacgaccttgtgggttatttatatgatccggtttaatcttagatcaagttacatggaggacaaagacaattttttaatctattacgtggtgatcccttgtgctgccttagctttattaattcatccatctacatcacatctcttcgtcaatagagtcttctgggcgttctgtgtttacttggaggcagtttctgtgctacctcaacttcgtgtcatgcaaaacactaagatagttgaaccattcacagcccattatgtatttgcattgggtgttgcaaggttcttaagctgcgctcactgggttctccaggttttggacagtcgcggccatctgctggtagcattgggtcatggtctatggccttctatggttttgatatctgaaatagttcaaacctttatcctagcagacttctgttactactatgttaaaagtgttttcggtggacagctggtaatgcgccttccttctggggtcgtgtaattgatgattgtgatagttatggacagaaatttcacattcgtttgtcacttttcttttggttatcttgggtttctctagaaggtcccagctcttgtctaggacccttcaggcgcaaaatcaggcatgcgccttttgtgaagttagcactattttaaatatataagcagtagattttcttgctatgatagactattttactttatttagtagttagcactaacatatggcttttggatatgtactcatttttgtacttgtgtactaatgtaccacaatgaatgataaacgattctgacataactttccctgaatgtatccctcccctcgccctttccctttcaggatggtcatgtaaaaaaaaaaaaaaaaaaa

SEQ ID NO: 2169 - DNA, 1041 bp, Salvia sclarea
aggttttctgtaaaaatatgaaagcaccgaggagaccgatccaagcggcggcgacatggctacgacggcagccgccgaaggtgaaggcgtttctggccgtgattagcggcatggcggcgcttgttctcctccgtgcaattgtccacgatcatgataatctgtttgtggcagcagaggctgttcattcgatcggaattgctgttctgatttacaagttgatgaaggagaggacctgtgccgggctttcgctgaagtcgcaggagctaacagctatctttttggctgttagattgtattgcagttttgtcatggagtacgacatacacactgtgcttgacttggctacactggctacgaccttgtgggttgtttatatgattcgatttaagttgagatcgagttatatggaggataaagacaacattgcaatatactatgtggttgtcccttgtgctgttatagccttaatagttcacccatcgacatcacatcacgtcgtcaacaggattgcctgggcattctgtgtttacctggaagctgtttctgtcctacctcagctgcgtgttatgcagaacacaaagattgttgaaccttttacagctcattatgtatttgcattgggagttgctaggtttttgagctgtgcccactgggttctccaggttttggacactcgtggtcatcttctcgtggcattgggttacggactctggccttcgatggttctaatatccgaaattgttcagaccttcatcctggccgacttttgctattactatgtgaaaagtgtgttcgggggacagctcgtgttgcgccttccttctggagtggtgtaaatgtatggggctgtataagattattttctttgttttcttttcttttctttttggtctagatggctctgtttttggccagcagttcttagagcataggaatcttgtcggtcaaaaacttggcagtcattatgaatttggatgtttaaattagtctgaaatcgccacaatcatatttggtttactgcaacagtaccaatcctcgtgc

SEQ ID NO: 2170 - DNA, 1233 bp, Silene vulgaris
gaaacctaatccccaaatcaaaccatttctgtaaagagataaaccaaatccctaaatcaatcgaaaatgaggccgcaaagaagaccgatccacacaataactttatggctaaaacgccaaccaccaaaggtcaaggcgtttctcgcggtggtcgccggaatggcggccttggttttacttagggctgtcgtgcacgatcacgataatctcttcgtcgccgccgaagctgttcacgccattggtatcgctgttcttatatataagctcgccaaggagaaaacttgcgccgggctctcgctgaagtcacaagagctgactgctatttttctagcaataaggctgtactgtagttttgtcatggaatatgatatacatacgctgcttgattcagctacgttggcttttaccctgtgggtaatttatatgattcgattcagcttgaggtcaacttatatggaggataaggacaactttcctatatattatgtgttggctccatgtgctgttttagcattcctagttcacccgtcaacttcacacaatattataaacagaattctgtgggcaatgtgtgtatatctagaagctgtttccgtgctgccacagttacgggttatgcaaaatacaaagattgttgaaccatttacagctcattatgtgtttgcacttggagtagcaaggtttttgagttgtgcccactgggttcttcaggttttggatagtcgtgggcaccttcttactgctctgggctatggattatggccatcctttgtcctcatctcggagattgttcaaactttcatcctcgcagacttttgttattattatgtcaaaagcatcttcggaggtcaacttgttatgcgacttccttcaggagttgtgtaattctataacacgacgtggcaagctgcaccaacaatttggattagcgatctcaaaggtggattttattaaattgttcagatgtattcgctcatggtgcaggccttcacagttgtttgctatcaggcaaatatgtcacttgttcagacatagccatttttctagggctgttgattaaaagtatgtcacaaagtatgaagtgcttgggtttatttatctagaagaactcattaacttttatggtagccaacagtcagatctgtaacagatatccggttataactaggtcagcgaaaaaaccggtatgtgtattttgcgttctggaagtttcaaattatttctggacttttt

SEQ ID NO: 2171 - DNA, 1276 bp, Solanum phureja
aggtgcatagttagtggtgtcccagtccaactccaaacaggattcctaaattactagtgctatttttttcattttgaagttccaatatttcaatcttagatttcatcgtcgaatttcgggtaaatccacaaatcgagaaaaatcagtatgaggacgacaaggaggccgatccaagtcgtgtcgacatgggtccgccggcaaccgccaaaggtcaaggcttttctggccgtcattaccggtatggcggcgttggtgttgctacgcgccatcgtccacgatcacgataatcttttcgtcgccgctgaagctgttcattcaattggaatctccgttctcatctacaagctcatgaaagaaaaaacttgtgccggtctttcactcaaatcccaggagctcactgctatgtttttggctgttagactgtattgcagttttgtcatggaatatgatatacacaccttacttgatttagctacgttagctacgaccttgtgggttatttatatgatccggtttaatcttagatcaagttacatggaggacaaagacaattttttaatctattacgtggtgatcccttgtgctgccttagctttactaattcatccatctacatcacatctcttcgtcaatagagtcttctgggcgttctgtgtttacttggaggcagtttctgtgctacctcaacttcgtgtcatgcaaaacactaagatagttgaaccattcacagctcattatgtatttgcattgggtgttgcaaggttcttaagctgcgctcactgggttctccaggttttggacagtcgcggccatctgctggtagcattgggtcatggtctatggccttctatggttttgatatctgaaatagttcaaacctttatcctagcagacttctgttactactatgttaaaagtgttttcggtggacagctggtaatgcgtcttccttctggggtcgtgtaactgatgattgtgatagttatggacagaaatttcacattcgtttgtcacttttcttttggttatcttgggtttctctagaaggtcccagctcttgtctaggacccttcaggcgcaaaatcaggcatgcgccttttgtgaagttagcactattttaaatatataagcagtagattttcttgctatgatagactattttactttatttagcagttagcactaacatatggcttttggatatgtactcatttttgtacttatgtactaatgtaccacatgaatgataaatgattctgacataactatccctgaa

SEQ ID NO: 2172 - DNA, 1063 bp, Eutrema halophilum
acctttttttcactttgccgagaacagaagagaaagaaaaaggggaaaggggaaaaacgagaattgagcatgaaggcgaccaagaatccgatccacgcggtgtggtcatgggtgaggaggcaaccaccgaaggtgaaggcttttctcgcggtggtcactggcatggcggctttggttctgctcagattcattgttcacgatcacgacaatctcttcgttgccgccgaagctgttcattccatcgggatctgtgttctcatctacaaactcatgaaggaaaagacttgtgccggattgtcactgaaatctcaggagcttacggcgatatttctagctgttaggctgtattgcagctttgtaatggaatatgatatacacaccattctggatttggctactttgggaacaactctttgggttatatttatgatccgttttaagttaagggcaagttacatggaggacaaagacaactttgctctctattttgtgcttgtgccctgtgctgtgttagctgtgttgatccatccatcgacttctcacaacatattaaacagaatttcgtgggcattatgtgtataccttgaagctgtttcagtgctgcctcagttacgagtgatgcaaaacacaaagattgttgaaccgttcacggctcattatgttttcgcgcttggagtagcaagattccttagctgtgcccactgggttttacaggttgtggacacgcggggacgattgcttgtcgcattgggttatggattgtggccatcaatggttctaatctcagaaattgttcaaactttcatcctggctgatttctgttactactacgtcaaaagtgtattcggaggacagcttgttctccggcttccgtctggagtagtataagtttaaaagatagaatactccagtgaatgtaatatccgatgagcttgccggaaattcaaatgggggaaagacagctcaattttaatctacctctgatcctacggtttatgtttctggggtgacgaattaattttactgtgttatgtatatttttgactattgatttggtttttca

SEQ ID NO: 2173 - DNA, 1062 bp, Eutrema parvulum
tttcctgttttcactttgcccagaaaatcagagacaaaacagaagagaaaggaaaaaagaaaaaagaaaaagggaaaattgagcatgaaggcgcccaccaaaagtccgatccacgcggtgtggtcatgggtcaggaggcaaccaccgaaggtgaaggcttttctcgccgtggtcactggcatggcggctttggtcctactcagattcattgttcacgatcacgacaatctcttcgttgccgccgaagctgttcattccatcgggatctgtgttctcatctacaaacttatgaaggaaaagacctgtgccggattgtcactgaaatctcaggagcttacggctatatttctagctgttaggctgtattgcagctttgtaatggaatatgatatacataccattctggatttggctactttgggaacaactctctgggttatatttatgatccgttttaagttaagggctagttacatggaggacaaagacaactttgctctctattttgtgcttgtgccctgtgctgtgttagctgtgttgatccatccatcgacttctcacaacatattaaacagaatttcgtgggcattatgtgtataccttgaagctgtttcagtgctgcctcagttacgagtgatgcaaaacacaaagattgttgaaccgttcacggctcattatgttttcgcgcttggagtagcaagattccttagctgtgcccactgggttttacaggttgtggacacgcggggacgattgcttgtcgcattgggttatggattgtggccatctatggttctgatctcagaaattgttcaaactttcatcctggctgatttctgctactactacgtcaaaagtgtattcggagggcagcttgttctcaggctcccatctggagtcgtataagttaaaaaagatagaatactccgatgagctttgcctgaaattcaaaatcgggagaggcagctcaatttttctttacctctgatcttaccgtttatgtgtccaagggtgacttggtaccgaattaattttactgtgttgtatatttttgactattga

SEQ ID NO: 2174 - DNA, 903 bp, Eutrema parvulum
gaagaagtagaagaaggagaaatcgagcatgaaggcaaccaagtctccgatccacgcggtttcgtcatgggtcaggagacagcctccaaaggtgaaggctttcctcgcggtcgtgtcgggcatggcggctcttgttctgctcagattcatcgttcacgatcacgacaatctcttcgttgccgccgaagctgttcattccattggaatctctgttcttatctataaactcatgaaggaaaagacctgtgctggattgtcattgaaatctcaggagcttacagcaatatttttagctgtgaggctttactgcagcttggttatggaatatgacatacacaccattctggacttggctactttggctacaacactctgggttatatttatgatccgttttaagttaagggctagttacatggaggacaaagacaactttgctctctattatgtgcttctgccctgtgctgtgttagctgtattgattcatccatcaacttcgcatattatattgaatagaatattctgggcattctgtgtatacctcgaagctgtttcagtactgccacagttgagagcgatgcagaacacaaagattgtcgaacccttcacggctcattatgtttttgcacttggagtagcgagattccttagctgtgcacattgggtcctacaggttgtggacagccggggacacctgcttgtagcactgggttacggactatggccatcgatggttctaatctcagaagtcgtccaaacattcatcttggcagatttctgttactactacgttaaaagtgtttttggaggccagcttgttctccggcttccatctggagttgtgtaaacaaaaaaaaaggaaaaaagataaatactttgatctcaactttgctcaagttactc

SEQ ID NO: 2175 - DNA, 1272 bp, Solanum lycopersicum
ccacaaggtaggtgcatagttagtggtgtcccagtccaactccaaagaggattcctaaattactactgccatttcattttgaagttccaatatttcaatctgtagatttcatcatcgaattttgggtaaatcaactaatcgagaaaaatcagtatgaggacgacacggaggccgatccaagtcgtgtcgacatgggtccgccggcaaccgcctaaggtcaaggcttttctggccgtcattaccggtatggcggcgttggtcttgctacgcgccatcgtccacgatcacgataacctcttcgtcgccgctgaagctgttcattcaattggaatctccgttctcatctacaagctcatgaaagaaaaaacttgtgccggtctttcactcaaatcccaggagctcactgctatgtttttggctgttaggctgtattgcagttttgtcatggaatatgatatacacaccttacttgatttagctacgttagctacaaccttgtgggttatttatatgatccggtttaatcttagatcaagttacatggaggacaaagacaattttttaatctattacgtggtgatcccttgtgctgccttagctttactaattcatccatctacatcacatctcttcgtcaatagagtcttctgggcgttctgtgtttacttggaggcagtttctgtgctacctcaacttcgtgtcatgcaaaacactaagatagttgaaccattcacagctcattatgtatttgcattgggtgttgcaaggttcttaagctgcgctcactgggttctccaggttttggatagtcgcggccatctgctggtagcattgggtcatggtctatggccttctatggttttgatatctgaaatagttcaaacctttatcctagcagacttttgttactactatgttaaaagtgttttcggtggacagctggtaatgcgccttccttctggggttgtgtaactggcgattgtgatagttatggacagaaatttcacattcgtttgtcacttttcttttggttatcttgggtttctgtagaaggtcccagctcttgtctaggacccttgaggcgcaatgcgccttttgtgaagttagcactatcttaattatataagcagtagattttcttgctatgatagactattttactttgtttagcagttagcactaacatatggcttttggatatgtactcatttttgtacttatgtactaatgtacaatgaatgataaatgatttctgacataacttttcctgaa

SEQ ID NO: 2176 - DNA, 1192 bp, Tragopogon dubius
tacaacaaaagatctcaaatattcactgacttttcccctaaaattctcaccctaatcggccacccaatctccactgtaaccaaaccctaaccaccaccaccgccatcaccggcaacgttatcatcaaatcagcagtagatatatagagagaacaatcgcaagaacaagaatttgaaaaacaaatatgaggccaccaaagaagacgatccacgtgatatcgtcatgggtacggcggcaaccaccaaaggtaaaagcttttctcgccgtagtcaccggcatgttggccttggtgttgttacgtgtgatcgtgcacgatcatgacaatcttttcgttgctgccgaggctgttcactccatcggaatctccgttcttatctataagcttatgaaggaaaaaacttgtgctggtctatcactaaaaacacaagacctaactgccttgttcttggctgttagactatactgtagttttgtcatggagtatgatatacacaccttgcttgatttggctacattagccacaacattgtgggttatatttatgattcgtttcaaactcaagtcaagctacatggaggataaagacaactttgcaatgtactatgtggcggttccttgtgctatactagctttgttaattcatccatcaacgtcacatcatattgttaacaggatattttgggcattttgtgtttatcttgaagccgtttcagttctacctcaacttagggttatgcagaacacaaagatcgttgaaccatttactgctcattatgtatttgctctcggtgttgcaaggttcttgagttgtgctcattgggttcttcaggttttggatagtcgtgggcatttacttaccgccttgggctacgggttatggccgtcaatggtgctcatctcagagattgtccaaacattcatattagcagacttctgttactactacattaaaagtgtatttggaggacaacttgtattgcgtctaccttctggggtggtttaaattgaaagtagaatggtgcaatcgaaatacatttacagtacttggtggtcttgttagttttatctttcttccatggatgatttgtacatttgtgacattgtcgcttttcttatttacaaccctagttttactggaaccaaaatcagctttaattatgggattataatagtgttcagaaaagatatttgt

SEQ ID NO: 2177 - DNA, 1308 bp, Trigonella foenum-graecum
gttttatttctgttgggtgttctgttctttctatctctctctctctctctctatccccttctcacaaatctatagatccttccaatctttgtcccacgtttaggccaagaaagagaagaactatctttgtctttgtgctgtgttgtgtttttccccaaagaaaacaaacccttcaacaacgatgaggcctcagagaacatcgatccacgccatctccacatgggtcaggcgacaaccaccaaaggtcaaggcttttctcgccgtcgtttccggtatggccgctcttgttctcctccgattcatcgttcatgatcacgataatcttttcgtcgccgctgaagctgttcactcgcttggaatctccgttcttatctataaactcatgaaggagaagacttgtgccggattatcactcaaatcccaggaattgacagctatatttttagctgttaggctgtattgtagttttgtcatggaatatgacattcacaccatacttgatttggcgactttcgtgacgacggtgtgggttatatacatgattcgttttaaattgaaggcgagttacatggaggagaaggataactttgcaatatactatgtgctgataccctgtgccgtgttagccttgctcattcatccatcaacttctcatcatatattgaaccggattttctgggcattctgtgtatatctggaagctgtttcagtactaccccagttgcgggtcatgcagaacactaaaattgttgagccattcactgctcattatgtatttgcacttggtgtagccagattcttgagctgtgctcattgggttcttcaggtgttggatacccgtggacatttgttggttgccttggggtatggtttatggccgtcgatggttcttatctcagaaattgtccagacattcatcttagctgatttctgttactattatgtcaagagcgtttttggaggacagcttgttctacgccttccctctggagtggtgtgattgaagatctacaccttcatattttctttttaacttaatcaggcatcatgtttggttacccatgttagacttagagtacattttgtgttgacatgcttattctgtaccttggtggaagtgtaaagttggggatgaaagataactaaatatattttatgttcgaggtacggttatttattatggttggaaatgctttatactacataaagtatctatttgcttagagttttctcaaagttctactcagtcttaggttgtggtctagatgttctacttcgaaagtggataaaatcaatatactacttcag

SEQ ID NO: 2178 - DNA, 1106 bp, Vicia sativa
ctctaatatccccttctctctgaaatctatagatccttccaagaaagggaacaactatctttgtctttgtgctgtgtgttgtctttgtgttttcgagcactcagaagcaaacccttttcgccatgagacctcagaaaacatcgatccacgccatctccacatgggtccgccgacaaccacccaaggtcaaggcttttctcgccgtcgtttccggcatggccgctcttgttctcctccgattcatcgttcacgatcacgataatctctttgtcgctgctgaggctgttcactccctcggtatctccgttcttatctataaactcatgaaagagaaaacctgtgctggattatcactcaaatcccaggaattaacagctatgtttttagctgttaggctgtattgtagttttgtgatggaatatgacattcacaccatacttgatttggctactttcgtcactacggtgtgggttatatacatgattcgatttaagctaaaggctagttacatggaagagaaggataactttgcgatatactatgtggtgttgccctgtgctgtgttagccttggttattcatccatcaacttctcatcatatattcaacaggattttctgggctttctgtgtatatctggaagctgtttcagttctaccccaacttcgggtcatgcagaacaccaaaatcgttgagccattcactgctcattatgtatttgcactgggtgtagcaagattcttgagctgtgctcattgggttctccaggtgttagatacccgtggacatttgctggttgccttaggatatggtttatggccgtcaatggttcttatctcagaaattgtccagacattcatcttagccgatttttgttactattatgtcaaaagcgtttttggaggacagcttgttctacgtcttccctctggagtggtgtgattaaagatttatgccctcacattttcttttaacttaatcaggcatcatgtttggttactcatgttagacttagagtacactttgtgttgacatgcttattctgttccttggtggaaagtgtaaagttggggatgaaagtaaactgaatatattttatgttatgcg

SEQ ID NO: 2179 - DNA, 1087 bp, Taraxacum officinale
gaatcggccatccaatcttcaccgtaatcaaaccctaaccaccaccactggcagcggcatcgtcaaatcagcgatttagataggaagaacaatcgcaagcacaagggtttgaaaaaacaaacatgaggccaccaaagaggatgatccacgtgatatcgtcatgggtacggcggcaaccaccaaaggtgaaagcttttcttgccgtagtcgccggcatgttggccttggtgttgctacgtgtgatcgtgcacgatcatgacaatcttttcgttgctgccgaggctgttcactccatcggaatctccgttcttatctataagcttatgaaggaaaaaacttgtgctggtctatcattgaaaacacaagaactaacagccttgtttttggctgttagactctactgcagttttgtgatggagtatgatatacacaccttgcttgatttggctacattggctacaacattgtgggttatcttcatgatccgtttcaaactcaaatcaagttacatggaagacaaagacaactttgcaatgtactatgtggcggttccgtgtgctatactagctttgttaattcatccatcaacatcacatcatattctaaacagaatattttgggcattttgtgtttatcttgaagcagtttcagtcctacctcaacttagggttatgcaaaacacaaagatagtcgaaccattcacggctcattatgtatttgctctcggtgttgcacgattcttgagttgtgctcattgggttcttcaggttttggatagtcgtggacatctacttacggccctggggtacggattatggccgtcaatggttctgatctcagagattgtcaaaccttcattttagcagacttctgttactactatgtgaaaagtgtttttggaagacaacttgtgttgcgtctgccgtcaggggtggtgtaatttgagcatctagaaaggaaatggtgcccattgaagtatatttacagtactttgtgttcttgttagtttattttggattttttgtacatttgtgacattgtgcgtttcttatttacaaccctaattttactggaattaggactcttt

SEQ ID NO: 2180 - DNA, 974 bp, Rosmarinus officinalis
attttctctctcctaaaaaattttccctcagttttccttttcattcagacagcaaactctgaattctaaatctaaataaaactatatatagatagatttttaaatttgtaggttttctgtaaaaatatgaaggcaccgaggagaccgatccaagcggcggcgacatggctgcgacggcagccaccgaaggtgaaggcgtttctggccgtgattagcggcatggcggcacttgttctcctccgtgcaattgtccacgatcatgacaatctgtttgtggcagcagaggctgttcattcgatgggaattgctgttctgatttacaagttgatgaaggagaagacctgtgcggggctttcgctgaagtctcaggagctaacagctatctttttggctgttagattgtattgcagttttgtcatggagtacgacatacacactttgcttgacttggctacgctggctacgaccttgtgggttgtttatatgattcgatttaagttgagatcgagttatatggaggataaagacaacattccaatttactatgtggttgtcccttgtgctgttatagccttaatagttcacccatctacatcacatcacgtcgtcaacaggattgcctgggcgttatgtgtttacctggaagctgtttctgtcctacctcagctgcgtgttatgcagaacacaaagattgtcgaaccttttacagctcattatgtatttgcattgggagttgctaggtttttgagctgtgcccactgggttctccaggttttggacactcgtgggcatcttctcgtggcattgggctatggactctggccctcaatggttctaatatcagaaattgttcagaccttcatcctggccgacttctgctattactatgtgaaaagtgttttcgggggacagctcgtgttgcgccttccttctggagtggtgtaaatgtatgaagctatataagattattttca

SEQ ID NO: 2181 - DNA, 1014 bp, Glycine max
ttcacaattctcatctcattgattgcttaccatcaattaggattaggaaggaacgcaaaatcatcaaatcaaataaaagaattaatcatgaggagtgggaaaaagtctattcacgcgatcacgacatgggtgcggcggcagcccccaaaggtgaaggcttttctcgccgtcgtttccggcatggcggctctcgtccttctccgcttcatcgttcacgatcacgacaaccttttcgtcgccgccgaggctgttcactctcttggaatttctgttctcatctacaagctcatcaaagaaaaaacttgtgccggattatcgctcaaatcccaggaattgacagctatatttttagctgttaggctgtactgcagttttgtcatggaatatgatatacacaccctgcttgatttggctacttttgccacgacactgtgggttatatacatgattcgttttaaattgaagtctagttacatggaggagaaagacaactttgctatatactatgtggtgataccatgtgctgtgttagccttgtttattcatccatcaacttcacatcatttattgaacaggatttcctgggcattctgtgtatatctcgaagctgtgtcagtactgccccaactgcgagtcatgcagaacacccaaattgttgagccattcacagctcattatgtatttgccctgggtgtggcaagattcttgagctgtgctcattgggttcttcaggtgttagatagtcgtggacatttgttggttgccttggggtatggattatggccgtcaatggtgcttatttctgaaattgtccagacttttatcttagcagatttctgttactattatgtcaaaagtgttttcggcggacagcttgttctccgcctaccttctggagtggtgtaatagaagattcacttcactacatacttgcatttaaattaacttaatcaagcaatatggtcggttatcattgttggagtccatattgcattgaaaaagtatggttccttg

SEQ ID NO: 2182 - DNA, 1070 bp, Glycine max
ttccaatccaacgttggttgtgtgtgtttgtgttgggaggattgggattgggattggaatcagcgaccccatgagacctcagagaacgtcgatccacgccgtcacgacatgggtgaggcgacagcccccaaaggtgaaggcttttctcgccgtcgtttccggcatggcggccctcgtcctccttcgcttcatcgtccacgatcacgacaacctcttcgtcgctgccgaggctgtccactccctcggaatttccgtcctcatctacaagctcatgaaggagaggacatgtgctgggttatcactcaaatcccaggaattaacggctatctttttagctgttaggctgtactgcagttttgtcatggaatatgatatccacaccttacttgatttcgctactttcgtaacaacgctctgggttatatacatgattcgttttaagctgaaggctagctacatggaagagaaggataactttgcaatatactatgtggtggtaccctgtgctgtgttagccttgctcattcatccatcaacttctcatcatttattaaacaggatttcctgggcattctgtgtatatctagaagctgtctcagtcctgccccaactgcgggtcatgcagaacaccaagattgttgaacctttcacagctcattatgtatttgcattgggtgttgcaagattcttgagctgcgctcattgggttcttcaggtgttagatagccgtgggcatttgctggtggccttggggtatggtttatggccatcaatggttcttatctcggaaattgtccagaccttcatcttagcagatttctgttactattatgtcaaaagtgtcttcgggggacaacttgttctacgtcttccctctggagtggtgtgattgaagatctgctttggtgtgtactgtcacatttgattttaacttaatcaggctttatggttggttacccttgttcgagtacattttgtgttgacacacttgtttggttccttggtggaatgtaaagttggggatgaaagaaactaaatatatttatgtttacggtactgttatatatggt

SEQ ID NO: 2183 - DNA, 1364 bp, Spinacia oleracea
atattatatgtatttatttaggattaaatatatgatctttagctaatcaacacaccaccataactccaccacctcctcctcctccgttcctaaatcaaaattgaatccgccattaatttatagcaggagaagatcgaaaaaccctagagatcgaaaaaatcccccaaatttgaagaaatgaggccgcagagaaggacgatccacactataatggcttggttaagaaggcagccgccgaaggtgaaggcatttcttgctgtggtcaccggaatggcggcgttggttttgctaagagctgtggttcgcgaccacgataatttatttgtcgccgccgaagctgttcatgttattggcatcgccgttctcatctataaactaaccaaggagaaaacttgtgctggactctcactaaagtcgcaggagcttacggctatctttttagctgttaggctgtattgcagttttgtcatggaatatgacattcacactctacttgattcagctaccttggttttcacattgtgggtcatatatatgattcgatttaacttgaggtcaacatatatggaggagaaggacaactttgctctatattatgtgttactaccatgtgctattttagcatgtgctgttcatccatcaacttcgcacaatattttaaacagaacattgtgggcgttctgtgtatatttagaagctgcctcggtgctgccgcagcttcgggttatgcaaaatacaaagatcgttgaaccatttacagcgcattatgtgtttgcgctaggagtagcaagattcttgagctgtgcccactgggttcttcaggtattggacagtcgtgggcaccttctaactgctttgggctatggattatggccatcttttgttcttatctcggagattgtgcaaactttcattctggcggatttctgttattattatgttcaaagcatctttggagggcaacttgtcctacgccttccatcaggagttgtgtaaactacagtttataggagactgcgtcaacaaaaatgttattggaagctcaatggatggttttattttgcttattcaaccgtctctgcactccatacgggctatcatgcgcttctagtgtgactatagccctatccactaagggttgtgtaaaagttagagatgaaaggagaacgttgtatgaatgttgaattaaaacgttatttacttgacaaatacattaattttttagcatcagaaactcatatatatctcatagattactggtatttcatgtgcttgtgcctgtattacctatttacacgaatcaggatttcttgtcttacacctctcagtttatgtagagttcaatctcacgttatgaatttcaa

SEQ ID NO: 2184 - DNA, 1123 bp, Arabidopsis lyrata
acctttttcacttttgccgagaaaatcagagacagaagaagaagaagaagaagaaaagcgaaaaaaaggcaaaacatgaaggcgacggcgaagactccgatccacgtggtgtggtcatgggtaaggagacaacctccaaaggtgaaggcttttctcgccgtggtcactggcatggcggctttggttcttctcagattcattgttcacgatcacgacaatctcttcgttgccgctgaggctgttcattccatcgggatctgtgttctcatctacaaactcatgaaggagaagacctgtgccggattgtcacttaaatctcaggagcttacggcgatatttctagctgttaggctgtattgtagctttgtaatggaatatgatattcataccattttggacttggctactttgggaacaactctctgggttatatttatgattcgtttcaagttaagagctagttacatggaagacaaagacaactttcctctctattatgtgcttctgccctgtgttgttttagctgtgttcatccatccatcgacctctcatcacatattaaacaggatttcatgggcattatgtgtataccttgaagctgtttctgttctgcctcagctacgagtgatgcagaacacaaagattgttgaaccgttcacagctcattatgtttttgcacttggagtagcaaggttcctcagctgtgcccactgggttttacaggttgtggacacgcggggacggttgcttgtagcattgggttatggattgtggccatcaatggttctgatctcagaaattgttcaaactttcatcttggcagatttctgttactactacgtcaaaagcgttttcggaggccagcttgttctccggcttccgtctggagtggtataagttaaaaggatagaaatactcaaatgatgtccgacgagcttgccggaaattcttatcggaaagacagctcagtttttctttacctctgatttcaccgtttatgtgtctgaggttgcaccaagtgactcgtaacgaattaattttactgtgttgtatattcttgactatcaagggatttattgtcttttaggcagataagttatctttggtcaaactgactttgttt

SEQ ID NO: 2185 - DNA, 1296 bp, Cichorium intybus
tgcaaagaaagatctcatatattcaccgacttttcccctaaatttcttcccgaatcggccacccgatctccaccgtaatcaaaccctaaccaccaccgccggcataagcatcatcgaatcagcaaaatatagcgagagaacaatcgcaagcaaaaggatttgaaaaacaaatatgaggccaccaaagaggacgatccacgtgatatcgtcatgggtacggcggcaaccaccaaaggtgaaagcttttctcgccgtagtcactggcatgttggccttggtgctgttacgtgtgatcgtgcacgatcatgacaatcttttcgttgctgctgaggctgttcactccatcggaatctccgttcttatctataagcttatgaaggaaaaaacttgtgctggtttatcactaaaaacacaagaactaacagccttgttcttggctgttagactgtactgcagttttgttatggagtatgatatacacacattgcttgatttggcaacattggctacaacattgtgggttatctttatgattcgtttcaaactaaaatcaagctacatggaggacaaagacaactttgcaatgtactatgtggcggtaccttgtgttatactagctttgttaattcatccatcgacatcacatcatattgtaaaccgaatattttgggcattctgtgtttatcttgaagccgtttcggtcctacctcaacttagggtcatgcaaaacacaaagatagtcgaaccattcacggctcattatgtatttgctcttggtgttgcaaggttcttgagttgtgctcattgggttcttcaggttttggatagtcgtggacatctacttaccgccctgggctatggattatggccatcaatggttctcatctcagagattgttcaaacattcatattggcagacttctgttactactacatgaaaagtgtttttggaggacaacttgttttgcgtctaccttctggagtggtgtaatttgaagtacatttacagtaattggtgtttgtgttagtttatctttccttggtggatgatttgtacatttgtgacattgtggtgtttcttatttacaaccctaattttactggaatttaaaattaggttccattatgatattataaaactcgtagtcagaattattttcagggctttttaatgctttatggccatctttttctaaggtatatattgtttgtagttttcatattgtgggtccttgggtcacgtttagcttttggacccgtcaagtgaaaaggttaaatgcaagaaagtactttcat

SEQ ID NO: 2186 - DNA, 1162 bp, Cirsium arvense
gaaataaccgatctccaacctaaatttcccccaaaattcccctgctcttcgccaccgaatctccaccgtggtcaaaccctagccaccgccgccgttacacttccaccaccgtcgtagaaattacataggggaaaagcaaacgtagattcgcaaaagaatcatgaggccaccgagaaagacgatccacgtgatatcgtcatggatacggcggcaaccgccaaaggtgaaagcttttctggctgtagtcaccggcatggtggccttggtgttgctacgtgcgattgtgcacgatcatgacaatctatttattgctgccgaagctgttcactccattggaatcgccgtccttatatataagctctctaaagaaaaaacttgtgctggtatatcactgaaatcgcaagaactgacggctatgtttttggctgttagactttactgtagtgtggtcatggaatatgatatacacaccctgcttgatttatctacattagctgcaactttgtgggttatctttatgattcgtttcagactcaagtcaagctacatggaggacaaagacaactttgcaatgtactatgtggttgttccttgtgcggtattagctttgttagttcatccatcaacatcacatcacattatgaacaggatattttgggcattttgcgtttatcttgaagcagtttctgttctacctcaacttagggtcatgcagaacacaaagattgttgaaccattcacagcccattatgtattcgctctcggtgttgccaggttcttgagttgtgctcattgggttcttcaggttttggatagccgtggccatctacttactgctctaggttacggtttatggccgtccatggttctaatctcggaaatcgttcagactttcatactagcagacttctgttactactatgtgaagagtgtttttggaggacaacttgttttacgtctaccttctggagtggtctaagctaaaaaatcgtatcgtggatctcttaactcttcgggatgtggtcttcgattttcatttccatttatacatgtccaagttttagtttattaacctttgccgcatgtgattggggtttttttcgcaaatgggtggatggttgtaaatttggcaacatgcttgtggtttaaattataaccccct

SEQ ID NO: 2187 - DNA, 1164 bp, Fagopyrum esculentum
aggaagaaaaaggaatcaacgaattcaaaggatgaaaggagggaaaaagaggcctttgcaagcggtggcgatgtgggtaaggcgtcagccgcccaaggtgaaagctttcctttcggttgttgccggcatggcggctctcgtcttcatccggatgatcgttcacgaccacgacaatctcttcgtcgctgccgaggctgttcactccgttggcgtctgcgttcttatttacaagctcagcaaggagaaaacttgtgctggattatctctcaaaactcaggagttaacagctctgttcttaactgttagactctattgcagtgttgtgatggaatatgacatacacacaatactggacacagctacacttgtaacaaccctctgggttatctttatgatccgttttaaactcagatccacttatatggaggacaaagacaactttgcaatgtactttatggtgataccttgtgtcgctctgtctctactgattcatccgacaaccacacacattctggtcaataggattctctgggccttctgtgtttatctagaagctatttcagtactgcctcagctaagagtgatgcaaaatacaaagattgtcgaaccatttacggctcattatgtttttgctcttggagtggcaagattcctgagttgtgcacactgggtgcttcaggtattggacaccaggggtagtttgttgacagctttaggatacgggttatggccttcgatggttctgctctctgaaattgttcagacattcatactggccgacttttgctactattacgtaaagagtatctttggaggacagcttgttctacggctcccgtcaggagtggtgtaatactcggaaatacaggcttcctcgcagcaaacccatcacatctatgttagttagaatttttttgttttagctttagaaattccatgtatggaaagttaacttatgaaaattcccatgattcagttaaaagaaagttaacttagtgtaagaatccttgagcatcttttagccgtaatcagcgtgtgaattttggccatgtttggaaaatctagaacaactgatgtagatccagtactcttgagtctatgattaacttgccttctgatcaacccgacatatagcataattcagcagccatggagttgaggact

SEQ ID NO: 2188 - DNA, 1226 bp, Vitis vinifera
actcatcacacatccaaatcaaaatctcattttttttacccggacgccccactgattctccgtcctcgcccttttttttttccctcactttctcgccggccaaacaagggcaaaaacagaaaacaaagggaccaccgccatgaggcctccacgaagaccgatccacaccgtgtccgcatgggttcggcggcaaccgcccaaggtcaaggccttcctggccgtcgtctccggcatggctgcgctggcgctgctccgcatcgtcgttcatgatcacgataatctatttgtcgcagctgaggccgttcactctatcggaatctgtgttctcatctacaagctcatgaaggagaaaacttgtgctggactttcactcaaatcccaggaattaacagctatattcttggctgtgagattgtactgtagttttgtgatggaatatgacatacacactctacttgattcagctacattgggcacaaccttgtgggttatttatatgattcgctttaggttaaagtccagttacatggaggataaagacaactttgcaatatattatgtggtgggaccctgtgctctgttagctttggttattcatccatctacatcgcatcattttgtgaacaggattttctgggctttctgtgtgtatctggaggctgtttctgtcctacctcagttgcgagtcatgcagaacacaaagattgttgaaccattcactgctcattatgtatttgcattgggtgttgcgaggttcttgagctgtgcccattgggttctccaggtcttggatacccgtggacacttgctagtagctctcggctatggattatggccttccatggttcttatttcagaaattgtccaaacattcattttagcagacttctgttactactatatcaaaagtgttgttggaggacagcttgtgctgcggcttccctcgggagtggtgtgaccagtgatctcttgtgctataccatatgagcatactgccccgaaaattaacttaagaatataggccatgcggctggatgctcttctttttaagtacctccttcctgctctacacgacggttcatgttagtatctggttctctcttgcattcatgactgaaaatcaaatgagtcgattgtaaagttggggatgcatgagttggggtggatgtttgaattcaaaaacacagttgattttatcacagttgggttaacttattttgtgtcaa

SEQ ID NO: 2189 - DNA, 1345 bp, Humulus lupulus
ttttcacgcaaaatctctcccttaaaatcttttttctctctcctcataattatctctttcacaacctcaccagatttattaattttattttatattattctttttcccaaagtgtcccggtctctctatattttccctttcttatcagaaaatttccaggaaaatcgacgcacaccgagaaaaataacctcatgaaggctcccaagagaccgatccacgcagtttccacatgggtcaggcgacagccccccaaagtgaaggcctttttggctgtgatttcgggtatgacggctctggttttgctccgatttatcgttcacgatcacgataacctttttgtcgctgcggaggctgtgcactccattgggatttctgtgcttatctataagcttatgaaggagaagacttgtgctgggttatcactgaaatctcaggaactgacagcgatctttttagctgttagattgtactgtagttttgttatggaatatgatatacacaccctacttgatctagcaaccctgggaacaaccctgtgggttattttcatgatccgttttaaattgaagtctagttacatggaggataaagacaactttgcaatttattatgtggtggtgccctgtgctgtgttagctttgctcattcacccatcaacctctcatcatctgttgaacaggattttctgggctttctgtgtgtatcttgaagctgtttcagtgttaccacagttgcgggtcatgcagaacacaaagattgttgaaccattcacggctcattatgtatttgcactgggtatcgcgaggtttctcagctgtgcccattgggttctccaggttctagatactcgaggccagttgcttgtagctctaggatatggactatggccctcgatggttcttatctcagaaattgttcaaactttcatcttggccgacttctgttattactatgttaagagcgtttttggagggcagcttgttctccgactcccatcaggagtggtgtaaactgaggtctcgccgagcaaacaccttggcccccataattaacttaattaggcatgttgttgcttgtacccctttttgcactcaacacgggcctagttctctctcatcttatcttggtcgaaattgaagtgggatgttttgaagttggggatttgaatttgatatttatatatatcgaacatgattcacacagttaattttacttgcgtcggttccattattccgcaccaagattattttggacattttgtagtctctactttagaggatattgcttaaatcactaattagattattaacagtatagttggtgtgtttgacaaagggttgttagt

SEQ ID NO: 2190 - DNA, 1335 bp, Ipomoea nil
ggaaataaaatgagaaaaatcagtttggagagaggtggcggagcaaattgaagggcctataaccttaaaacccctttgaatttctaaaattggaaccctaaagacctaaacactaaaaattaggtagtaaatctgtgagaagaagaggcacagcagcatgaagatgcctcggagaccgatccaagccgtaacgacatgggtaaagcggcaaccgcccaaggtgaaggccttcctggccgtgatcaccggcatggcggcgctggtgatgctccgagccatcgtccacgatcacgacaacctctttgtcgctgccgaggctgttcactccattggaatctgcgtcctcatctacaagctcatgaaggaaaaaacttgcgctgggctttctctcaaatcccaggagctgacagctatgtttttagctgttagactgtattgcagcttcgtcatggagtatgacatacacactttgcttgacatggctacgctggctacaactttgtgggttatttatatgattcgttttaatctaaaatcgagttacatggaggacaaagacaatttcgcaatgtattatgtggtggttccatgtgctgttttagcttttttaattcacccaactacatcgcatcacattgtaaacaggatcttctgggctttctgtgtatacttggaggcagtttcggtgctacctcaactccgtgtcatgcagaacactaagattgttgaaccatttacagcacattatgtatttgcactgggtgttgcgagattcttaagctgtgctcactgggttctacaggttttggatagtcgtggccatctcctagtggcattgggtcatggtctatggccttctatggttctgatatctgaaattgtgcaaactttcatcttggcagacttttgttactactatgtgaaaagtgtttttggaggacagctggttttgcgccttccttcgggggtagtgtgagtgctgattgcaacacacacacgccttctgttttctatattcttttgctctctatagcgttccagggacaaagtggtcaagtggggagtggatgtaatttgtagttgacagttgaagcaaaacgtgattatcctgaatgagttgaccttggagaaatctcaatgctttctgaacactaacttacgatctgagaatatgtatttcatcgatgttttatcccctccctccctaagctttaaagctgtgcaatgggttgtttatcttattctccaacttgtgctcatttctatcttttcaatttccacttgcacttgaacattagaaccctttctttctttaacttagatgatgtacactcg

SEQ ID NO: 2191 - DNA, 1323 bp, Cucumis melo
aacccacagccgtagaaaccgaaccattctcacccgactcttcctcatccctcttctcgccgagacacagagagtctcaatcacgtaatgaaggcaaccaagaggccaattcaggccgtagccacatgggttcgccgtcaaccccccaagatcaaggcctttctggccgtcgtctcgggaatggctgctcttgttttcttgcgctttgtggttcatgaccacgacaatcttttcgtcgctgccgaggctgttcacgccatcggaatctccgtcctcatttacaaactcatgaaagagaggacttgtgcaggactttcactgaaatctcaggaactaacggcactttttctagctgttagactctattgtagttttgttatggaatatgatatacatacactactggatacagcaactctggtaacgaccctttgggttatttatatgattcggtttaagcttagatccagctatatggaggacaaagataatttccccatatactatgtggcggtaccctgtgctctgctatcttttgtgatccatccaacaactgtgcataacataattaatagaatagcatgggcattttgtgtttatcttgaagctgtttcagtattacctcagctgcgcgtcatgcaaaatacaaagatcgttgaaccgtttactgcacattatgtgtttgccttaggagttgcaaggttcttgagttgtgcgcattgggtcctacaggtcttggatactcgtggacgtttgttaacagcattgggttatggattatggccatccatggttctcctatcagaaatcgttcagactttcattcttgctgatttctgttattattatgtcaagagtcttgttggtggacagctcgttctacgccttccttctggagtggtgtaacttcaacaaaacgatgtatgccacatgacaggaaatgagagagaccgtcttgctcatcttaggctctaattgtgaaggtaggatatggtctcagttgttggattaatacttatacatgaaatgtgaaggatgcacaagttttcaagacataggatatggtctgtagcagtttttggtttcttgtttttttttcttataacatggtcttattactctagattttcaccaccatattctctcaaaaaggtatggttttaagatggaaaataatatgtatcacggggttttgttgcttcctgttgaagatgaaaccatagttaagcctaacctgcagtgcatatggcctgtcttgtccatttttgcatttaagaaagctgtagtggaaatatttatatccaatggaagaatctttctcta

SEQ ID NO: 2192 - DNA, 1360 bp, Momordica charantia
gggattaagaaaaaggccaaaggcgcagccgcagacgcagccgtattccgagtctgacctgactcttctaccacgcgcgtccacaagcacgtaatgaaggcaaccaagaggccgattcaggccgtcgccacatgggttcgccggcaaccgcccaagatcaaggcgtttctcgccgtcgtctccggaatggctgctcttgttttcttgcgctttgttgttcatgatcacgacaatcttttcgtcgctgccgaggctgttcacgccatcggaatctccgtccttatttacaaactcatgaaggagaggacctgcgcaggactttcactaaaatcgcaggagctaacagcaatttttctagctgttagactctattgcagttttgtcatggaatatgatatacatacactactggattctgccactttggtaacgacgctgtgggttatttatatgattcgatttaagctgagatccagctacatggatgacaaagacaatttccctatttactatgtggtgataccttgtgctatactatctcttgtgatccatccaacgactgtgcataacataataaatagaatagcatgggcattttgtgtttatcttgaagccgtttcggtattacctcagctccgggtcatgcaaaatactaagattgttgagccgtttacggcacattatgtatttgccttgggagttgcaaggttcttgagttgtgcacattgggttctacaggtcttggatactcgtggacgtttgttaacagcattgggttatggattatggccatccatggttctcctatcagagattgttcagactttcattcttgcagatttctgttattattatgtcaagagcctcgttggtggacagcttgttctacgccttccctccggagtggtgtaacttcaacagatcaacagaactgcagccacacgatgcaaaatgagagaggttttcttggttgtcttaggctctaattgggaaggtaggatatgggtcttagttgttggaattatgcttatacatgaaatgtgaaggatgcacaagtctaagactcgcagttggtagtaattttttaaaaatcatggtctactcttatgtactctagatctccaccatcttctctcgaaaggtctgattttaaattttctatcacggggtcttgttgctgcctgttgaacctgaaacaaagagataaacttaacaagttccaaagagaaatatctatctcgaacgaacgaatttttcttgtggcttcaagtaccaaccctaatgctctttccttggcgaacgagttcaattagctcattgttgtgaccaataaaggcctctgtctaatttcttctggact

SEQ ID NO: 2193 - DNA, 1313 bp, Nicotiana benthamiana
tattctattttcaccaatattcacctcctcctatatttcaatcttaaattttaacttctttatcgaattttaggcatatccatccgcaatcgagaaaaactaaacaagcaacatgaggacgacacggaggccgatccacgccgtgtcgacatgggtccgccggcaaccgccaaaggtgaaggcttttctggcggtcatcaccggcatggcggcgcttgttctcctacgtgccatcgttcacgatcacgataacctcttcgtcgccgccgaggctgttcactccattggaatctccgttctcatctataagcttatgaaagaaaaaacttgtgccgggctttcactcaaatcgcaggagctcactgctatgtttttggctgttagattgtattgcagttttgtaatggaatatgatatacacactttacttgatctagctacattggctacgaccttgtgggttatttatatgatccgttttaagcttaaatcaagttacatggaggacaaggacaactttttaatctattacgtggtgatcccttgtgctgccttagctttattaattcatccatctacatcacacctcttcgttaatagagtcttctgggctttctgtgtttacttggaggcagtttctgtgctacctcagcttcgtgtcatgcaaaacactaagatagttgaaccattcacagctcattatgtatttgcattgggtgttgcaaggttcttaagttgtgctcactgggttcttcaggtcttggacagtcgcggtcatctgctggtagcattgggtcatggtctatggccttcaatggttcttatatccgaaattgttcaaacctttatcttagcagacttctgttactactatgttaaaagtgttttcggtggacagctggtcatgcgccttccttctggagtagtgtaactgatgattgtgctagtcatggacagaaatttcacatgcgttggttgccttctttttgcttatctttggtctctctacaaggtcaaaacctggtctagggctctccaggtgtaaaatcaagattcccgtggtctgtgaagttagtattatcaaaaatattttctggtaatcctagattatactttacttttttagcagttagcattgtcttaaaattaagcagttgattttctctcaatcctagattactttactttgttagcacagttagcactaacatcatatggctttcagatatgtactcatttttgtacttatgtactattgtaccacaatgaatgattaatgattctgattccgacacaattgtctctgcttgttg

SEQ ID NO: 2194 - DNA, 1278 bp, Nicotiana benthamiana
acaagctttactgcaatcaagtaaagtaagttacaagaaggatatatacatcgacgtgtacaaacgctccaaatttgaattacattgtcgatttttttcttttccgaatttcacaaacgaagaaagcagaatgaaagcgccgaggaggccgatccacgccatgtcaacatgggttcgacggcaaccgccaaaagtgaaggcttttctggcggtggtcgccggcatggcggcgttagtgctgctacgcgccattgtccacgatcacgacaaccttttcgtggctgccgaagctgttcacgccattggaatctccgtccttatctataagctcatgaaagaaaaaacttgtgctgggctttcactcaaatcccaggagctcactgctatgtttttggcggttagactgtattgtagttttgtcatggaatatgatatacacacgttacttgatttagctacattggctacaaccttgtgggttatctatatgatccgttttaaacttaaatcaagttacatggaggacaaagacaattgtgcaatttattatgtggccatcccttgtgctgccttagccttactgattcacccatcaacatcacatcatttcatcaacagaatcttctgggctttctgtgtttacttggaagcagtttccgtactacctcaacttcgtgtcatgcaaaacattaagatagttgaaccattcacagctcattatgtatttgcattgggtattgcaaggttcttaagctgcgctcattgggttctccaggttttggacagtcgtggccatctgctagtagcattgggtcacggtctatggccttctatggttcttctatctgaaattgttcaaaccttcatcttagcagacttctgttactactatgttaaaagtgttttcggaggacaactggttttgcgccttccttctggggttgtgtaactgacgtttgtgctaagtgatggacaaggttctcgtccccttcttgccttgcatttgctttttcttcttttttgtatctacgcagtccaacttggtctaggttctccggcggcaagaccaagactggaagttatgtaaagctagcactttctaaatgtagtagttgattttctggcaatcatagtttaaatttttctgtgagctctaatcttacagcttcagaaaggtagttacacttgtagttctcatgaattaaattgaatgattaatgatgctgattttgacataaggtatagtgcctgtttgatgacagtattaacaacttggtt

SEQ ID NO: 2195 - DNA, 1537 bp, Cajanus cajan
aaataataagcttagcgtttagggcgttgtttgtcataagataaaatagtactatccttcgatgaatctgtttgagtttggagagagaaaacaaaaataaaaaacaatcacattgtgtttccgttttggagttcgtcaatctctctctctctctctcgctgaagttccaatccaacgttgctttgagtttaaccgagtagcgtgtgtgcgtgtgttggagcattggtttggggtgtcgaaaagttctatcaatgaggcctcagagagcttcgatccaccacctcaccacatgggtcaggcgacaacccccaaaggtcaaggcttttctcgccgtcgtttccggcatggcggctctcgtgctcctccgcttcatcgttcacgatcacgacaacctcttcgtcgccgccgaggctgtccactccctcggaatttccgtcctcatctataagctcatgaaggagaagacctgtgctgggttatcactcaaatcccaggaattaacagctatctttttagctgttaggctgtactgcagttttgtcatggaatatgatatccacaccgtacttgatttgtctactttcataacaacgctgtgggttatatatatgattcgttttaaactgaaggccagttacatggaggagaaggataactttgcaatatactatgtggtggtaccctgtgctgtgttagccttgcttattcatccatcaacttctcatcatataataaacaggattttttgggcgttctgtgtatatctggaagctgtctcagtattaccccaattgcgggtcatgcagaacaccaagattgttgagccattcacagctcattacgtatttgcactgggtgttgcaagattcttgagctgtgctcattgggttcttcaggtgttagatagccgtggacatttgttggtagccttggggtatggtttatggccatcgatggttcttatctcagaaattgtgcagaccttcatcttagcagatttctgttactattatgtcaaaagtgtttttgggggacagcttgttctacgtcttccttctggagtggtgtgattgaagatccgctttggtgtgtactagcacatttggttttaacttaatcaggcataatggttggttacccttgttagagtactttttctgttgacacacttgtttggttccttggtggagtgtaaagttggggatgaaagtaaactaaatatatttatgtttttaaggtacggttatttgtagttggaagtgctttacagatgaagcctctatttgcttggaccattggaattttgttattgttataactattccacgtgctcaagttctacggaaagtcttacattgaaccctctgtacccagaagtacgtggaatgtgcggtatagatgcattccacagaaccaatctaaattattaagaacctagagtacagatgttaccttaaatctgaatgttgacacacgccacaatgtgaattctgcccatgacgcctgatgaatcctaactgatctaagaaaatggttg

SEQ ID NO: 2196 - DNA, 1274 bp, Primula obconica
tctctctctctctcatcgcatcagatcaccatgagaccgggccgcaagaacccgatccactccgtgtcgatgtgggttcgccgccagccgccaaaggtgaaggcttttctcgccgtcgtcgccggcatggcggcgctggtgctgctgcgtgtcatcgttcacgaccacgacaacctctttgtcgccgcggaggccgtacactctatcggaatatgtgtacttatctacaagctcatgaaggagaaaacttgtgccgggctctcactcaagactcaggagctgacggccatttttttagctgttaggctgtactgtagctatgtcatggaatatgacatacacaccttgcttgatttatccacgttggctgcgactctatgggttatttatatgatccgtttcaaacttaagtcgagctacatggaggacaaagacaacttaccgatatactatgtgttggcaccctgtgctgtgttggcgtttctaattcatccatcaacatcacatcatttcatcaacagaatcttctggtctttctgtgtatatctggaagcagtgtctgtgctacctcagctgcgcgtcatgcaaaataccaagattgttgaaccatttacagctcattatgtgttcgcgttgggagttgccagatttttgagctgtgctcattgggttttgcaggttttggacactcgtggacgactcctcacagctttgggttatgggctatggccttcgatggttcttttatctgaaattgttcaaactttcatattagcagacttctgttactactatgtcaaaagcgtctttggaggtcagcttgtgcttcgtcttccttcgggagttgtctaacgaaaaactatacaatggtgtggctgcattaaagctaaatggatgctcaaatatttagttatgtctgctctgtatcttccttgaagcttttttaatggttagtaattatatttagtgctgtacatttcggggatgcaagaagctgtagtggggattattttaatttaaccaaaaagcaaaagaagtttatgggtgttgattgacttttcttgttcacacactcaagtaatctgtcggcttgtttgatgaaggcaggtttttaagtaatgtgctagaaattggattttgaaaaatatgattcatggaattatatttttaccgtcgaccaaatgttttgggatccaatttcaggacattttaccgatagcattgcaattgatattggatgtatcaacttgaacatgatcgtagatcatattgtt

SEQ ID NO: 2197 - DNA, 1158 bp, Carthamus tinctorius
gggggatctcccaaaaaatttcccccaaaattcccctgcttctcgccaccaatctccgccgtagtcaaaccctagccaccgccgccgtcgttactccatccaccaccactagcagaaaacacacagaggcaaacacaaacacagattcgcgagccaaaacatgaggccaccgaagaagacgatccacgtgatatcgtcgtggatacggcggcaaccgccaaaggtgaaagcttttctggctgtagtcgccggcatgttggccttggtcttgctacgtgcgattgtgcacgatcacgataatctattcattgctgccgaagctgttcactccattggaatcgccgtcctcatatataagctctccaaggaaaaaacttgtgctggcatatcactcaaatcgcaagaactgacggctatgtttttggctgttagattgtactgtagcgtcgtcatggaatacgatatacacaccctgcttgatttatctacattagctgcaacattgtgggtcatctatatgatccgtttcagactgaagtcaagctacatggaggacaaagacaacttcgcaatgtactatgtggctgttccttgtgcggtattagctttgttagttcatccatcaacatcacatcacattatgaacaggatattttgggcattctgtgtttatcttgaagcagtttctgttctacctcaacttagggtcatgcagaacacaaagattgttgaaccattcacagctcattatgtattcgctcttggtgttgccaggttcttgagttgtgctcattgggttcttcaggttttggatagccgcggccatctgcttactgctctaggttacggtttatggccgtccatggttctaatctcggaaatcgttcagactttcatattagccgatttctgttactactatgtgaaaagtgtttttggaggacaacttgttttacgtctaccttctggagtcgtctgagccaaaaaccgtatcatggatctacctcttcgggatgattttcatttccattaatacatgtccaagttttagttcattaaccttgccgcatgtgattggggtctttagcaaatgtgtggatgggtgtaaatttggcaacatggttgtgggtttactctaaattataacccctttctcaa

SEQ ID NO: 2198 - DNA, 1372 bp, Glycine max
attgcagcgagtcagcgagtcaagttgacgttgacattgacgttggagtcgagttgtgccctaattggctaattcagaaagaattgaattcggggaagagattcacaattctcatctcattgattgcttaccatcaattaggattaggaaggaacgcaaaatcatcaaatcaaataaaagaattaatcatgaggagtgggaaaaagtctattcacgcgatcacgacatgggtgcggcggcagcccccaaaggtgaaggcttttctcgccgtcgtttccggcatggcggctctcgtccttctccgcttcatcgttcacgatcacgacaaccttttcgtcgccgccgaggctgttcactctcttggaatttctgttctcatctacaagctcatcaaagaaaaaacttgtgccggattatcgctcaaatcccaggaattgacagctatatttttagctgttaggctgtactgcagttttgtcatggaatatgatatacacaccctgcttgatttggctacttttgccacgacactgtgggttatatacatgattcgttttaaattgaagtctagttacatggaggagaaagacaactttgctatatactatgtggtgataccatgtgctgtgttagccttgtttattcatccatcaacttcacatcatttattgaacaggatttcctgggcattctgtgtatatctcgaagctgtgtcagtactgccccaactgcgagtcatgcagaacacccaaattgttgagccattcacagctcattatgtatttgccctgggtgtggcaagattcttgagctgtgctcattgggttcttcaggtgttagatagtcgtggacatttgttggttgccttggggtatggattatggccgtcaatggtgcttatttctgaaattgtccagacttttatcttagcagatttctgttactattatgtcaaaagtgttttcggcggacagcttgttctccgcctaccttctggagtggtgtaatagaagattcacttcactacatacttgcatttaaattaacttaatcaagcaatatggtcggttatcattgttggagtccatattgcattgaaaaagtatggttccttggaagaatctggttctttgtaaagttagagatgaagggaaaacaagatatttatgttgaaggtacagtatttgtagctggaaatgctttacacataacatgtctatttgcttaggctcttgaaattcagttcttgacataacttttccatgttatcgtattttaactgcttgacttgagccaatgagggaatcgtcataaagttgatttgaagtatctgttgaaggttttctttatccgtatccaaaattagctggag

SEQ ID NO: 2199 - DNA, 1556 bp, Glycine max
aaaaaaaaaaaaatattatacgattcaccaatctgtttgtgtttgagttgaattgaaacttttggagagagaaaagaaaaaaaaaatcaatctgcattttggcattggggtcttgtttagtttgttccaatccaacgttggttgtgtgtgtttgtgttgggaggattgggattgggattggaatcagcgaccccatgagacctcagagaacgtcgatccacgccgtcacgacatgggtgaggcgacagcccccaaaggtgaaggcttttctcgccgtcgtttccggcatggcggccctcgtcctccttcgcttcatcgtccacgatcacgacaacctcttcgtcgctgccgaggctgtccactccctcggaatttccgtcctcatctacaagctcatgaaggagaggacatgtgctgggttatcactcaaatcccaggaattaacggctatctttttagctgttaggctgtactgcagttttgtcatggaatatgatatccacaccttacttgatttcgctactttcgtaacaacgctctgggttatatacatgattcgttttaagctgaaggctagctacatggaagagaaggataactttgcaatatactatgtggtggtaccctgtgctgtgttagccttgctcattcatccatcaacttctcatcatttattaaacaggatttcctgggcattctgtgtatatctagaagctgtctcagtcctgccccaactgcgggtcatgcagaacaccaagattgttgaacctttcacagctcattatgtatttgcattgggtgttgcaagattcttgagctgcgctcattgggttcttcaggtgttagatagccgtgggcatttgctggtggccttggggtatggtttatggccatcaatggttcttatctcggaaattgtccagaccttcatcttagcagatttctgttactattatgtcaaaagtgtcttcgggggacaacttgttctacgtcttccctctggagtggtgtgattgaagatctgctttggtgtgtactgtcacatttgattttaacttaatcaggctttatggttggttacccttgttcgagtacattttgtgttgacacacttgtttggttccttggtggaatgtaaagttggggatgaaagaaactaaatatatttatgtttacggtactgttatatatggttggaagtgctttacacataaagtctctatttgcttggactcttggaatttagttattgttatataactattccttgtgctcaagttctacagtaagtcttggattgaaccctgcctacgtaaaaatgcgtggactgtgcggtttagatctattctatgcagttggaatactgtgagttttatgtatggtgcattgcacaaagcaaatctaaattgttgagtccagagatgttatcttaaatgttaatgttgacatgcctccatgtgaatcctgctcatcatgcatgaggaatccttaccgatcttcgaaaatggttgcattcagttttcgaattctcttttcggagccttcctagattttaa

SEQ ID NO: 2200 - DNA, 1407 bp, Triphysaria pusilla
tttttttttctaaacaactcgattttatttactcttcttctcaagatttccgtttattgtatcttcccaagccgaaaacccaggaaaagtgaaaggtaaatccctccgcaacatataaataaacagttatatctaccaaaaggacttcaaatcaacaaaaacacaattaatttcaaatctatttcggtagatatacttgcacaattatgaaggcaccgaggaggccgatccaagcggtgacgtcatgggtgcggcgacaaccgccgaaggtgaaggcttttctagcggtagtcagcggcatggcggcgctcgttctcctccgcgcggttgttcacgatcacgacaatttgttcgtggcggcggaggctgttcactcgatcggaattggggttttgatttacaagttgattaaggagagaacttgtgccgggctttcgcttaaatcccaggagctaacagctatctttttggctgttagattgtattgcagttttgtaatggaatatgatatccacactttgcttgacatgactacattggctacaaccttgtgggttatttatatgatccgtttcaaattgaaatcgagttacatggaggataaagataacattcccttgtattatgtggtgatcccttgtgctgttatagctttattaattcatccatctacgtcacatcacatcatcaacaggattgcctgggcattctgtgtttaccttgaagctgtttctgtgcttccccaactccgtgtcatgcaaaatacaaagattgttgagccttttacagctcattatgtatttgcattgggtgtcgctaggttcttcagctgtgctcactggattctccaggtcttggacacgcgtggacacctcctcgtggcattgggttatggactctggccttcgatggttcttttatccgagattgttcagaccttcatcctagctgacttttgctattactatgtgaaaagtgttttcgggggacagctcgtattgcgccttccttctggagtggtgtaattactattatcggtggtttctataagctttattctagtgtgtttttggtccttggttcttaaaaacctggttggttgcgaacgaggcagttcccacattgatgttaagtttacagaaaccatgttggatgaactgtatgagtaccaattagtttgtctttatgttttttttttttatgaagattagtcgattctagtgtaagcatttcggctaatgatcacagtgcttattttattacatgggcttgtcttgtatcttccggttttacgctaatagacgctaatagtgtacgactactgctaatagtgtacgactactaatgattaattttataggcaacaaaaactaacaaggcaaaaaaatacaagagcttgcttagact

SEQ ID NO: 2201 - DNA, 2441 bp, Rosmarinus officinalis
cggccgggggaagcaatttcttcttctccatttcccctttctgtctctctccgggaaaattttctctctcctaaaaaattttccctcagttttccttttcattcagacagcaaactctgaattctaaatctaaataaaactatatatagatagatttttaaatttgtaggttttctgtaaaaatatgaaggcaccgaggagaccgatccaagcggcggcgacatggctgcgacggcagccaccgaaggtgaaggcgtttctggccgtgattagcggcatggcggcgcttgttctcctccgtgcaattgtccacgatcatgacaatctgtttgtggcagcagaggctgttcattcgatgggaattgctgttctgatttacaagttgatgaaggagaagacctgtgcggggctttcgctgaagtctcaggagctaacagcgatctttttagctgttagattgtattgcagttttatcatggagtacgacatacacactttacttgacttggctacactggctacgaccttgtgggttgtttatatgattcgatttaagttgagatcgagttatatggaggataaagacaacattccaatttactatgtggttgtcccttgtgctgttatagccttaatagttcacccatctacatcacatcacgtcgtcaacaggattgcctgggcgttatgtgtttacctggaagctgtttctgtcctaccccagctgcgtgttatgcagaacacaaagattgtcgaaccttttacagctcattatgtatttgcattgggagttgctaggtttttgagctgtgcccactgggttctccaggttttggacactcgtggtcatcttctcgtggcattgggctatggactctggccctcgatggttctaatatcagaaattgttcagaccttcatcctggccgacttctgctattactatgtgaaaagtgtttttgggggacagctcgttttgcgccttccttctggagtggtgtaaatgtatggggctatatacgattactttcattgttttctttttctttgggtctagatggctctgttttagtcagcggttcttacagcatgggaatctggttggtcggaaacttgccagtaactatatttggatgtttaaattagtctgaagtcgtcacaatcataattaaaatcatatttgattttaattatgaataccactgtaagcatttccgtctgagctgatgaacagaatgttttatttcgttctgtttgattgtcgacattcgattttgcttggacattccgttgctctcctgcttgcattaagtttacttcgttgatcagaataccatattgaagtttgtacatgatctgatttttctagtagcattaatgaagattgatgagcgaaaacaattgattgcccaaacctcacagttcttcataaatataactaatgctatgatcaaatgactcgacaataatggtataataactgacataaattgggtactctcagatgatatatggctccaaaatgagaaggatcacagttctgagcaactctttccattgataaaatcaactactttcgtcgctgccagatccagtgcaatggcgactgcgttcaaattctcccgaaactcctcagctgttggcttgtcaccgtcaacaatgtctgtcacagctttcaaaaatatagtgggcacgttcaagagatgtgccacataagcaatagctgctccctccatgtccttgacagttgcatcgtttgcaagaattgctgcttcatcttgtgggcagatatctaaagaatcgccagtagataattttccaacctttaagctaagctccttagcgagattaggtgtggagaaggttttacgagagccaacaccatataggtcaaatacagggataggaattctcctgtcgtggaaggcaacatctgatgcaagaaatacatcgcctattgaagcaccttttgccttgaatcctccagcagttcctgcatttatgataaggtctggctgtaaagcttgaatagaagcataagccagaagagatgctgacaccgtgcccacacaatcaacccccaatgttgcgtctttgcctggacacacaatatttatgtgcaaatgtttatatttaccgctgtacctcacccaaggaaccccctttgggaacacagactcaggctcctcagcaagctcaaacttattcactagcggcaacgcttcagtttgcatagcgattatgaagagaatattggagattggacgcttatgagtagagtcgtcgccggaatcagccgtagctttgtcgtcgtgaggtggcgccatcgatcgcaatctggccgtcactcttctacctcactgcgaattggaatcggaactttcttctcttttaatatctcttcgccgttcctctccggtgaaaatatctgagagagaagt

SEQ ID NO: 2202 - DNA, 995 bp, Glycine max
ataaaatcaaatacagtaccaaaaaagaataaatttttggtttggtggaaagagaaagaaaagaagggatcatcatgaggagtgggagaaagtcgatccacgcaatcacgacatgggtgcggcggcaacccccaaaggtcaaggcttttctcgccgtcgtttccggcatggcggctctcgtccttctccgcttcatcgttcacgatcacgacaaccttttcgtcaccgccgaggctgttcactctcttggaatttctgttctcatctacaaactcatcaaagaaaaaacttgtgccggattatcactcaaatcccaggaattgacagctatatttttatctgttaggttgtactgcagttttgtcatggaatatgatatacacaccctgcttgatttggctactttggtaaccacactgtgggttatatacatgattcgttttaaattgaagtctagttacatggaagacaaagacaattttgctatatactatgtgatgataccctgtgctgtgttagccttgtttattcatccatcaacttcacatcatttattgaacaggattgcctgggcattctgtgtatatctcgaagctgtgtcagtactgccccaactccgagtcatgcagaacaccaaaattgttgagccattcacagcacattatgtatttgccctgggtgtcgcaagattcttgagctgtgctcattgggttcttcaggtgttagatagtcgtggacatttgttggttgccttggggtatggattatggccgtcaatggtgcttatttcagaaattgtccagacttttatcttagcagatttctgctactattatgtcaaaagtgttttcgggggacagtttgttctccgcctaccttctggagtggtgtgatagaagattcacatcactgcatacttgtgtttaaattaacttaatcaagcaatatggtcggttgtcattgtcggggtccatattgcgttgaaaatgtttggc

SEQ ID NO: 2203 - DNA, 1204 bp, Glycine max
tcttgtttagtttgtttgttccaatccaacgttggtttggttgtgtgtgtgagtttgtgttgggaggaataggaatagcattgggaatcaatcagcgaccccatgagacctcagagaacgtcgatccacgccgtcacgacatgggtgaggcgacagcccccaaaggtgaaggcttttctcgccgtcgtttccggcatggcggctctcgtgctccttcgcttcatcgtccacgatcatgacaacctcttcgtcgctgccgaggccgtccactccctcggaatttccgtcctcatctataagctcatgaaggagaagacatgtgctgggttatcactcaaatcccaggaattaacagctatctttttagctgtaaggctgtactgcagttttgtcatggaatatgatatccacaccttacttgatttcgctactttcgtaacaacagtgtgggttatatatatgattcgttttaagctcaaggctagctacatggaggagaaggataactttgcaatatactatgtggtggcaccatgtgctatgttagccttactcattcatccatcaacttctcatcatttattaaacaggatttcctgggcattctgtgtatatctagaagctgtctcagtcctgccccaactgcgggtcatgcagaacaccaagattgttgagccattcacagctcactacgtatttgcactgggtgttgcaagattcttgagctgtgctcattgggttcttcaggtgttagatagccgtgggcatttgttggtggccttggggtatggtttatggccatcaatggttcttatctcggaaattgtccagaccttcatcttagcagatttctgttactattatgtcaaaagtgtcttcgggggacagcttgttctacgtcttccctctggagtggtgtgattgaagatctgctttgatgtgtactgtcacatttgattttaacttaatcaggcattatggttggttacccttgttcgagtacattgtgttgacacacttgtttggttccttggtggaatgtaaagttggggatgaaagaaactaaagatatttatgtttaggttactgttatatatggttggaagtgctttacacgtaaagtctctatttgcttggactcttggaatttagttattgttataactattccatgtgctcaagttctacagtaagtcttagattg

SEQ ID NO: 2204 - DNA, 1180 bp, Acacia harpophylla
gaagaaaaaaaagaactatccttgatccttctctgtggtttttcccttgtccatcgccgtgcaactgcagtttcgctcgaatttagcagaggctcaaaattcaaccctatttcagaaattgggggcgagaagtgaaaatttttctgacgccccaatcaactcactctcaatctccggtttcattgatcaagcaaaatcgattttcttcgattagctgtgatttgtggccaccataaagtaaaagatctgcaggcaaatccagagggagaagacaagtgaaaagtcacaaaaggacgtcgtcatgaggcctcagaagaatccgatccacaccatctcgacatgggtcaggcgacaaccgccaaaggtgaaggcttttctggccgtcgttaccggtatggcggctcttgtgttgcttcgagtcattgttcacgatcatgataaccttttcgtagcagcagaggccgttcactctttaggaatttccgttctcatttataagcttatgaaagagaagacgtgtgctggactgtcactcaaatcccaggaattaacagctatatttttggctgttaggctgtactgcagttttgtcatggaatttgatatacacactctacttgatttagctactttagcgacaaccctgtgggtcatttttatgatacggtttaagctcaagtctagttacatggaggagaaggacaactttgcaatatactatgtggtgataccctgtgctgtgatagccttgttaattcatccgtccacttctcatcatatattgaacaggatcttttgggcattctgtgtatacctagaagcggtttcagtgttaccccaactgcgggtcatgcagaacaccaaaattgtcgagccattcacagctcattatgtatttgcattgggtgtagcaagattcctaagctgtgctcattgggttcttcaggtgttagatagccgtgggcatttgttggttgccctgggatatggtttatggccatctatggttctcatctcagaaattgtccagactttcatcttggcagatttttgctactactacgttaaaagcgtgcttgggggacagcttgttctccgtcttccctctggagtggtgtgatttgaagatcttctgcgatgagctcattctcacctggatttaacttaatctgccaacccg

SEQ ID NO: 2205 - DNA, 994 bp, Brassica oleracea
gccgagaaaatctgagaaaaagcgaaaagttgaggatgaaaagtccgattcacacggtgtggtcatgggtgaggaggcagccaccgaaggtgaaagcctttctcgcggtggtcaccggcatggcggctctggttctgctcagattcattgtccacgatcacgacaatctcttcgttgccgccgaagctgttcattcaatcgggatctgcgtgctcatctacaaactcatgaaggaaaagacatgtgctggattgtcgctgaagtctcaggagctgacggcgatatttctagctgtgaggctgtattgcagctttgtgatggaatatgatatacacaccgttctggatctggctactttggggacgactctctgggttatttttatgatccgttttaagttgagggctagttacatggaggacaaagacaactttgctctctattatgtgcttgtgccgtgtgttgtgttagctgtgttgatccatccatcgacctctcacaacatattgaacaggatttcgtgggcgttatgtgtttaccttgaagctgtttcagtactgcctcagctgcgagtgatgcagaacacaaagattgttgaaccgttcacggcgcattatgtatttgcacttggagtagcaaggttcttaagctgtgcccactgggttttacaggttgtggacacgagggggagattgctggtagcgttaggttatggactgtggccatcgatggttctcatctcagaaattgttcaaactttcatccttgctgatttctgttactactacgtcaaaagcgttttcggagggcagctagttctcaggcttccgtctggagtagtataagttactctcagtgatgatgtaatacggaaagagacggctcaatttttcctttacatttgatcttgacgtttgtgtctgaggtgacgaattaatttcactgtgttgtatgtttagttaccattgacgggtgtttacatgtctttccggtt

SEQ ID NO: 2206 - DNA, 1091 bp, Brassica napus
aggcaggtatcgatagtgatcaatcgtatggcatacgcggggcgagaaattgaaaaaaggaaagttgaggatgaaaagtccgattcacacggtgtggtcatgggtgaggaggcagccaccgaaggtgaaagcctttctcgcggtggtcaccggcatggcggctctggttctgctcagattcattgtccacgatcacgacaatctcttcgtcgccgctgaagctgttcattcaatcgggatctgcgtgctcatctacaaactcatgaaggaaaagacatgtgctggattgtcgctgaagtctcaggagctgacggcgatatttctagctgtgaggctgtattgcagctttgtgatggaatatgatatacacaccgttctggatctggctactttggggacgactctctgggttatttttatgatccgttttaagttgagggctagttacatggaggacaaagacaactttgctctctattatgtgcttgtgccgtgtgttgtgttagctgtgttgatccatccatcgacctctcacaacatattgaacaggatttcgtgggcgttatgtgtttaccttgaagctgtttcagtgctgcctcagctgcgagtgatgcagaacaccaagattgtggaaccgttcacggcgcattatgtatttgcacttggagtagcaaggtttcttagctgtgctcactgggttttacaggttgtggacacgagggggagattgctggtagcgttaggttatggattgtggccatcaatggttctcatctcagaaattgttcagactttcatccttgctgatttctgttactactatgtcaaaagcgttttcggagggcagctagttctccggcttccgtctggagtagtataaagttactctcagtgatgtaatacggaaaggagacggctcaattttttctttacatttgatcttgacgtttgtgtctgaggtgacttggtaacgaattaatttcactgtgttgtatatttagttaccatcgatgggtgtttacatgtctttccggttactttactccctttcatactataatagtgattggtaaaaagcaaataacgaacct

SEQ ID NO: 2207 - DNA, 1237 bp, Centaurea maculosa
gtacggcggggtcggagtttatagatatataaccgatctcccccaaaattttcccccaaaattccgccaccaatctccgccgtagtcaaaccctaaccaccaccaccagcaccaccgccgccgccgctactccatccaccaaccaccactagcagaaaacacacacagatttcacaaacaaaaccatgaggccgccgaggaagacgatccacgtgatatcgtcgtggatacggcggcaaccgccgaaggtgaaagcttttctggccgtagtcgccggcatgttggccttggtgttgctacgtacgattgttcacgatcatgataatctattcattgctgccgaagctgttcactccattggaatcgccgtcctcatatataagctctccaaggagaaaacttgtgctggcatatcactcaaatcgcaagaactgacggctatgtttttggcggttagactgtactgtagcgtcgtcatggaatatgatatacacacactgcttgatttatctacattagctgcaacatcgtgggttatctatatgattctcttcagactgaagtcaagctacatggaggacaaagacaactttgcaatgtcctatgtggttgttccttgtgcggtattagctttgttagttcatccatcaacatcacaccacattgtgaacaggatattttgggcatactgcgtttatcttgaagcagtttctgttctacctcaacttagggtcatgcagaacacaaagattgttgaaccattcacagctcattatgtattcgctctcggtgttgccaggttcttgagttgtgctcattgggttcttcaggttttggatagccgtggccatctgcttactgctctaggttacggtttgtggccgtccatggttctaatctcggaaatcgttcagactttcatattagccgacttctgttactactatgtgaaaagtgtttttggaggacaacttgttttacgtctaccttctggagtcgtctgagccaaaaaccgtatcgtggatctacctcttcgggatgattttcatttccattaatacatgtccaagttttagttcattaaccttgccgcatgtgattggggtcttttagcaaatgtgtggatggttgtaaatttggcaacatggttgtggttaaactttaaattataacccctttctttaaatggatttgcagatgttctttgagaaaaaaaaaaaaaaaaggcggccacgac

SEQ ID NO: 2208 - DNA, 843 bp, Cucumis sativus
tcccaaatcctgtaatgaaggcaaccaagaggccaattcaggccgtagccacatgggttcgacgtcaaccccccaagatcaaggcctttctggccgtcgtctctggaatggctgcccttgttttcttgcgctttgtggttcatgaccacgacaatcttttcgtcgctgccgaggctgttcacgccatcggaatctccgtcctcatttacaaactcatgaaagagaggacttgcgcaggactttcactaaaatctcaggaactaacggcaatttttctagctgttagactttattgtagttttgttatggaatatgatatacatacactattggatacagcaactctggtaacgactctttgggttatttatatgattcggtttaagcttagatccagctacatggaagacaaagataatttccccatttactatgtggcggtaccctgtgctctgttatcttttgtgatccatccaacaactgtgcataacataattaatagaatagcatgggcattttgtgtttatcttgaagctgtttcagtactacctcagctgcgcgtcatgcaaaatacaaagattgttgagccgtttaccgcacattatgtgtttgccttaggagttgcaaggttcttgagttgtgcacattgggtcctacaggtcctggatacacgtggacgtttgttaacagcattgggttatggattatggccatccatggttctcctatcagagatcgttcagactttcattcttgctgatttctgttattattatgtcaagagtcttgttggtggacagcttgttctacgccttccctctggagtggtgtaacttcaacaaa

SEQ ID NO: 2209 - DNA, 1204 bp, Lupinus angustifolius
ggtgcagtgagtaaaattatagagaaattggtattggaaaaaagaagaaagagagtatgaggggtgagagaaacacgatccacgttataagctcatgggtacggcgacaaccaccaaaggtgaaggcttttcttgcggttgtttccggcatggcggcgttggtgctgctccgcttcattgttcacgatcacgacaacctttttgttgctgctgaggctgttcattccattggtatttctcttctcatttacaagctcatgaaagagaagacttgtgccggattatcactcaaatcgcaggagttaacggcgatgtttttagctgttaggctgtactgcagttttgtcatggaatatgatatacacaccctacttgatttggctactttggcaacaacactctgggttatatacatgattagtttcaatttgaaatctagttacatggaggagaaagataattttgcaatctattatgtggtgataccctgtgcagtgttagccttgtttattcatccatcaacttctcatcatttattgaacaggattttctgggcattctgtgtatatcttgaagctgtgtctgtactaccccagctgcgggttatgcagaacacccaaattgttgagccattcacagctcactatgtatttgcactgggtgttgcaagattcctgagctgtgctcattgggttctccaggtgttagatagtcgcgggcatttgttggttgctttggggtatggtttatggccgtcaatggttctaatctcagaaattgtccagactttcatcttagcagatttttgttactattatgtaaaaagtgttttcgggggacagcttgttctccgtcttccctctggagtggtgtaattgaagattcacttcactgtataacttgcatttgaagtaatttaatcaagagaaatggtcagttatcattaatagagtccactttgtgctcacaaagtttgattccttggaagaagcttgttctttgtaaagttggggaatgaaggaaaactagttatttatgtataaggtccaactaaggatttgtagttggaaatgctttacatatgatgtcttgagaccaaataaaaaatgaggctcattttttggtcatccagattgaattacagaacactacattttttgacagctattatattgtccatgatgatcaaagacaaaacaagtca

SEQ ID NO: 2210 - DNA, 1353 bp, Nicotiana benthamiana
cacaggttagtgtccaacaagatcgactcctaactaatgaattctttcactacatattctattttcaccaatattcacctcctcgtatatttcaatcttaaattttaatttcattatcgaattttaggcatatccatccgcaaatcgagaaaaacaaaacaagcagcatgaggacgacacggaggccgatccacgccgtggcgacatgggtccgccggcaaccgccaaaggtgaaggcttttctggcggtcatcaccggcatggcggcgcttgttctcctacgtgccattgttcacgatcacgataacctcttcgtcgcggctgaggctgttcactccattggaatctccgttctcatctataagctcatgaacgaaaaaacttgtgccgggctttcactcaaatcgcaggagctcactgctatgtttttggctgttagactgtattgcagttttgtcatggaatatgatatacacactttacttgatctagctacattggctacgaccttgtgggttatttatatgatccgttttaagcttaaatcaagttacatggaggacaaagacaattttttaatctattacgtggtgatcccttgtgctgctttagctttattaattcatccatctacgtcacatctcttcgttaatagagtcttctgggctttctgtgtttacttggaggcagtttctgtgctacctcagcttcgtgtcatgcaaaacactaagatagttgaaccattcacagctcattatgtatttgcattgggtgttgcaaggttcttaagctgtgctcactgggttctccaggtcttggacagtcgcggtcatctgctggtagcattgggtcatggtctatggccttcaatggttcttatatccgaaattgttcaaacctttatcttagcagacttctgttactactatgttaaaagtgttttcggtggacagctggtcatgcgccttccttctggagtagtgtaactgatgattgtggtagtcatggacagaaatttcacatacgtttgttgccttccttttgcttatctttgatctctctacaatctggtctagggctctccaggcataaaatcaagagtgcggtggtctgtgaagttggtattatctaaaatattttctggtaatcctagattatactttacttttttagcagttagcattatcttaaaattaagtagttgatttctctcaatcctagattacttttttagcacagttagcactaacatcatatcgctttcagatatgtactcatttttgtacgtatgtactaatgtaccacaatgaatgattaatgattctgattccgacacaattgtctttgcttgtt

SEQ ID NO: 2211 - DNA, 1178 bp, Nicotiana benthamiana
gctccaagtttttacttacattgtcgatttttctcttttccaaattgcagaactaagaaagcagaatgaaggcgccgaggaggccgatccacgccgtatcaacatgggttcgacggcaaccgccaaaggtgaaggcttttctggcggtggtcgccggcatggcggcgttagtgctgctacgcgccattgtccacgatcacgacaaccttttcgtggctgccgaagctgttcacgccattggaatctccgtccttatctataagctcatgaaagaaaaaacttgtgctgggctttcactcaaatcccaggagctcactgctatgtttttggcggttagactgtattgtagtttcgtcatggaatatgatatacacaccttacttgatttagctacgttggctacaaccttgtgggttatctatatgatccgttttaatcttaaatcaagttacatggaggacaaagacaattgtgcaatttattatgtggcgatcccttgtgctgccttagccctactgattcatccatcaacatcacatcatttcatcaacagaatcttctgggctttctgtgtttacttggaagcagtttccgtgctacctcaacttcgtgtcatgcaaaacactaagatagttgaaccattcacagctcattatgtatttgcattgggtattgcaaggttcttaagctgcgctcattgggttctccaggttttggacagtcgtggccatctgctagtagcattgggtcacggtctatggccttctatggttcttatatctgaaattgttcaaaccttcatcttagcagacttctgttactactatgttaaaagtgtttttggaggacagctggttttgtgccttccttctggggtcgtgtgactgacgtttgtgctaagtgatggataaggttctcgtcccccttcttgccttgcatttgctttttcttctttttttttttgtatctacgcagtccaacttggtctaggttctccggtggcaagaccaagactggatgttatgtaaagctagccctttctaaatgtagtagttgattttctggcaatcatagttaaaaaattttctgtgagctctaattttacagcttcagaaaggtagttacacttgtagttctcatgaattaaactgaatgattaatgatgctgattttgacat

SEQ ID NO: 2212 - DNA, 1282 bp, Lippia dulcis
ctttccattaaaaaaagccctttctttgcaccttatttcaagcgaaaaatattagggaattttgttttgtaaatccacacgcacacacagagtaacgcagacagaggatgaagccaccgaagaggccgatccaagccgtgacgacatgggtgcggcggcagccgccgaaggtgaaggcgtttctagccgttatcagcggcatggcggcgcttgttctcctccgtgcaattgttcacgatcacgacaatctctttgttgcggcggaagctgtgcactcgatcggaatttctgtccttatttataagttgatgaaggagaggacttgcgcaggactttcactcaaatcccaggagctaacagctatctttttggctgttagattatactgcagttttgtcatggaatatgacatacatacactgcttgacatggctacattggctactaccttgtgggttatttatatgatccgatttaaattgaagtcgagttatatggaggataaagacaattttgcactatattatgtgttgggtccttgtgctgttttagcttttgttatccacccatctacatcgcatcacatgattaacaggatttcttgggcattctgtgtctacctagaagctgtttcagttctaccacaactgcgtgtaatgcagaacactaagattgtcgaaccattcactgctcattatgtatttgcattgggtgttgcgaggttcttgagctgtgctcattgggttctccaggttttggacagtcgtggtcaacttcttgtggcattgggttatggactttggccttctatggttcttatatcagaaattgttcaaaccttcattctggctgacttttgttattactatgtaaaaagtgttttcggaggccagctcgtattgcgccttccctctggagtggtgtaattagtcactgtacaagcttattctagttgttttcttggtggttaccaaggtctcttaagcaaaaatctaaatctaacggggttcagcaaaattggatgtttgtaacaacagtacttaccagaaatctatattggcttaaattttatctcagcactaatctgggtttttttgtcttggtagcatttgaaagacgtgttctcatggctcgcaaatacttagcttgaatattttaggagccaatgcacttgaaaaaaaaattattgccccctttgatcttcgacacttgtagcttactttagcttttcagatggtcggatttactcttgtttccatgttatttactgtactactcgaga

SEQ ID NO: 2213 - DNA, 1595 bp, Glycine max
gcgagtcagcgactaagttgacgttgacttgacgttgacgtttgagcgagtcgagttgtgccctaattcagaaagaattgaattcggggaaggaagttctgaatttctcattgaaggaacgcaaaatcataaaatcaaatacagtaccaaaaaagaataaatttttggtttggtggaaagagaaagaaaagaagggatcatcatgaggagtgggagaaagtcgatccacgcaatcacgacatgggtgcggcggcaacccccaaaggtcaaggcttttctcgccgtcgtttccggcatggcggctctcgtccttctccgcttcatcgttcacgatcacgacaaccttttcgtcaccgccgaggctgttcactctcttggaatttctgttctcatctacaaactcatcaaagaaaaaacttgtgccggattatcactcaaatcccaggaattgacagctatatttttatctgttaggttgtactgcagttttgtcatggaatatgatatacacaccctgcttgatttggctactttggtaaccacactgtgggttatatacatgattcgttttaaattgaagtctagttacatggaagacaaagacaattttgctatatactatgtgatgataccctgtgctgtgttagccttgtttattcatccatcaacttcacatcatttattgaacaggattgcctgggcattctgtgtatatctcgaagctgtgtcagtactgccccaactccgagtcatgcagaacaccaaaattgttgagccattcacagcacattatgtatttgccctgggtgtcgcaagattcttgagctgtgctcattgggttcttcaggtgttagatagtcgtggacatttgttggttgccttggggtatggattatggccgtcaatggtgcttatttcagaaattgtccagacttttatcttagcagatttctgctactattatgtcaaaagtgttttcgggggacagtttgttctccgcctaccttctggagtggtgtgatagaagattcacatcactgcatacttgtgtttaaattaacttaatcaagcaatatggtcggttgtcattgtcggggtccatattgcgttgaaaatgtttggctccttggaagaatctggttctttgtaaagttagagatgaagggaaagctagaaatttatgttgaaggtacagtatttgtagctggaaatgctttacatataacatgtctatttgcttaggctcttcaaattcagttcttgacagaacttttccacgttatcgtattttaactgcttgacttgagccaatgagggagtcgtcataaagttgctttgaagggattatattttccgtcacatttagattaaagtatttgttgaaggttttctttttccgtatccaaaattagcttgagagtttaatgcctcgtataaacacggtccatgctaatgatggatttgaggatagtagtgacgaacaataagatcaattaggtccctgctacgaatatcttcaaaaacaatcgtaactccaaaacccagtaagtatcaagttcattgcaacggttaaagctgtcatcgtttggtgtgtt

SEQ ID NO: 2214 - DNA, 1525 bp, Glycine max
aagtaatatccttagggtttagagggaacatattggtgtttgtttatcataaaattaaaaatagtacaatccatcaatctgtttgagttgaattgaaacttttggagagagaaaagaaaacaaaaacaaaacatcaatctgcattttggcattgggctcttcttgtttagtttgtttgttccaatccaacgttggtttggttgtgtgtgtgtgtttgtgttgggaggaataggaatagcattgggaatcaatcagcgaccccatgagacctcagagaacgtcgatccacgccgtcacgacatgggtgaggcgacagcccccaaaggtgaaggcttttctcgccgtcgtttccggcatggcggctctcgtgctccttcgcttcatcgtccacgatcatgacaacctcttcgtcgctgccgaggccgtccactccctcggaatttccgtcctcatctataagctcatgaaggagaagacatgtgctgggttatcactcaaatcccaggaattaacagctatctttttagctgtaaggctgtactgcagttttgtcatggaatatgatatccacaccttacttgatttcgctactttcgtaacaacagtgtgggttatatatatgattcgttttaagctcaaggctagctacatggaggagaaggataactttgcaatatactatgtggtggcaccatgtgctatgttagccttactcattcatccatcaacttctcatcatttattaaacaggatttcctgggcattctgtgtatatctagaagctgtctcagtcctgccccaactgcgggtcatgcagaacaccaagattgttgagccattcacagctcactacgtatttgcactgggtgttgcaagattcttgagctgtgctcattgggttcttcaggtgttagatagccgtgggcatttgttggtggccttggggtatggtttatggccatcaatggttcttatctcggaaattgtccagaccttcatcttagcagatttctgttactattatgtcaaaagtgtcttcgggggacagcttgttctacgtcttccctctggagtggtgtgattgaagatctgctttgatgtgtactgtcacatttgattttaacttaatcaggcattatggttggttacccttgttcgagtacattgtgttgacacacttgtttggttccttggtggaatgtaaagttggggatgaaagaaactaaagatatttatgtttaggttactgttatatatggttggaagtgctttacacgtaaagtctctatttgcttggactcttggaatttagttattgttataactattccatgtgctcaagttctacagtaagtcttagattgaaccctgcctacgtaaaaatatgtggactgtgcgcggttttgatctattgcatgcagttgaatactgcgagttttatgtatgttgcattgcagaaaacaaatctgaattattgagtccagagatgttatcttaaatcttaatgttgcaattcctcattgtg

SEQ ID NO: 2215 - DNA, 1135 bp, Triphysaria pusilla
gaagagaaaaaaaaaaatctccgattagggtaatcaatttacaaatccacaggcgtatatacatacatacacgggcgatatacatatatatagcaaagatgaggccgccgaagaggccaatccaagccgtgttttcatgggtgcggcggcagccgccgaaggtgaaggcgtttatagccgtcatcagcggcatggcggcgctcgtaatcctacgcgctatcgttcacgatcacgacaatttattcgtcgcggcggaggctgtgcattcgatcgggattttggttcttatttataaattgatgaaggagaggacttgcgcaggactgtctctcaaatctcaggagctaacagcaatctttttggccgttagattatattgcagttttgtaatggaatatgacatacacactctgcttgacttggcgacattagttactacaatgtgggttatttatacaatccgttttaaactgaactcgagttatatggcggataaggacaatctcgccctatattatgtggcggctccttgtgctgttttggctttattgatccacccatcaacatcgcatcacatcgtgaataggatcgcttgggctttctgtgtctacttagaagctgtttctgtattaccacaactacgcgtaatgcaaaacactaagattgttgaaccgttcacggctcattatgtgtttgcattgggtgttgcgaggttcttgagctgtgctcactgggttcttcaggttttggacagccgtggtcatctcctcgtggcactaggttatggactctggccatcgatggttcttatatcagaaattgtccaaaccttcattctcgctgacttttgctattactatgtaaaaagtgtttttggcggtcagcttgtgttacgcctaccatctggagtggtttaaattagtcgaggcgtaattgatatttaaatcaacttcaacttactaagaaaagatgttggctttattttatctctcggatctggtttttgtttttatagagttggttccttttgtaatcttattctgaacatgcgttgagtgcttaacttggacatgtatacccaaagtggtgaaaaatcgattcttatctactttttttacgtaaaaaaaaaaaaaaa

SEQ ID NO: 2216 - DNA, 1157 bp, Triphysaria pusilla
ttagggtaatcaatttacaaatccacaggcgtatatacatacatacacgaccgatatacatacataacaaagatgaggccgccgaagaggccaatccaagccgtgttttcatgggtgcggcggcagccgccgaaggtgaaggcgtttatagccgtcatcagcggcatggcggcgctcgttatcctacgcgccgtcgttcacgatcatgataacctattcgtcgcggcggaggctgtgcattcgatcgggattttggttctaatttataaattgatgaaggaaaggacttgcgcaggactgtctctcaaatctcaggagctaacagcaatctttttggccgttagattatattgcagttttgtaatggaatatgacatacacactctgcttgacttggcgacattagttactactttgtgggttatttatacaatccgttttaaactgaactcgagttacatggcggataaggacaatctcgccctatattatgtggcggctccttgtgctgttttggctttattgatccacccatcaacttcgcatcacatcgtgaacaggatcgcttgggctttctgtgtctacctagaagctgtttctgtattgccgcaactacgcgtaatgcagaacactaagattgttgaaccgttcactgctcattatgtgtttgcgttgggtgtcgcgaggttcttgagctgtgctcactgggttcttcaggttttggacagccgtggtcatctactcgtggcactaggttatggactctggccatcgatggttcttatatcagaaatcgtccaaaccttcattctcgctgacttttgctattactatgtaaaaagtgtttttggcggtcagcttgtgttacgcctaccatctggagtggtttaaagcgtaattggatatttaaatcaacttcaacttaccaagaaaagatgttgcctttttttaatctctcggagtttttgtttttatagagtgggttccttttgtaagcttattttgaatctgtgatgagtacttaacctgaacatgaacatgtaaagcccgagtggggaaaactcgattcttagcacttttttcatacatttttactgtttctctcttttcagtttagtggattattataaccttttctattgatatatgttgatttg

SEQ ID NO: 2217 - DNA, 1337 bp, Citrullus lanatus
tcaaacccaaaggcgcacaaaccgaaccattctgacctgactcttctaccttctgcgcgccgtgagagagagagactgaagaaaagagagacaaccccaaaatgaaagcaaccaggaggccaattcaggccgtcgccacatgggttcgccggcaaccccccaagatcaaggcttttctagctgtcgtctctggaatggctgctcttgttttcttgcgctttgtggttcatgaccacgacaatcttttcgttgccgccgaggccgttcacgccattggaatctccgtcctcatttataaactcatgaaggagaggacttgcgcaggactttcactaaaatctcaggaactaacggcaatttttctagctgttagactctattgtagttttgtcatggaacatgatatacatacactactggatacagcaactttggtaacgactctatgggttatttatatgattcggtttaagcttagatccagctacatggacgacaaagataatttccccatttactatgtggtgataccctgtgctctgatatcctttgtgatccatccgacaaccgtccataacataataaatagaatagcctgggcattttgtgtttatcttgaagctgtttcagtactacctcagctccgtgtcatgcaaaatacaaagattgttgagccgtttaccgcacattatgtgtttgctttgggagttgcaaggttcttgagttgtgctcattgggtcctacaggtcttggatactcgtgggcgtttgttaacagcattgggttatggattatggccatcgatggttctcctatcggagatcgttcagactttcattcttgctgatttctgttattattatgtcaagagccttgttggtggacagctcgttctacgccttccctcaggagtggtgtaacttcaacaaaacggcatatgccacaccagaggaaatgagagaggctgtcttgctcgtctgaggctctatctgggaaggtaggatatgggtcttagctgttggactaatgcttatagatgaaatgtgaaggatgcataagttttcaagacacgtagtctgtagaagtttttgttttttttataacatggtcttacttatttactctagatttccaccatcttctttcaaaaggtctgattttaagatgaaaataatatctatcacggggttttgttgctgcctgttgaaagatgaactcatagatagacctaacctgcagtgcatatggcctgtcttgtctatttctgcaattaagaggctgtaacgggaaatatctatctgggatgaacaaatctttctttaggtatcaaaccccaa

SEQ ID NO: 2218 - DNA, 2448 bp, Rosmarinus officinalis
tcttcctctccatttcccctttctgtctctctccgggaaaattttctctctcctaaaaaattttccctcagttttccttttcattcagacagcaaactctgaattctaaatctaaataaaactatatatagatagatttttaaatttgtaggttttctgtaaaaatatgaaggcaccgaggagaccgatccaagcggcggcgacatggctgcgacggcagccaccgaaggtgaaggcgtttctggccgtgattagcggcatggcggcgcttgttctcctccgtgcaattgtccacgatcatgacaatctgtttgtggcagcagaggctgttcattcgatgggaattgctgttctgatttacaagttgatgaaggagaagacctgtgcggggctttcgctgaagtctcaggagctaacagctatctttttggctgttagattgtattgcagttttgtcatggagtacgacatacacactttacttgacttggctacgctggctacgaccttgtgggttgtttatatgattcgatttaagttgagatcgagttatatggaggataaagacaacattgcaatttactatgtggttgtcccttgtgctgttatagccttaatagttcacccatctacatcacatcacgtcgtcaacaggattgcctaggcgttatgtgtttacgtggaagctgtttctgtcctacctcagctgcgtgttatgcagaacacaaagattgtcgaaccttttacagctcattatgtatttgcattgggagttgctaggtttttgagctgtgcccactgggttctccaggttttggacactcgtggtcatcttctcgtggcattgggctatggactctggccgtcgatggttctaatatcagaaattgttcagacctccatcctggccgacttctgctattactatgtgaaaagtgttttcgggggacagctcgtgttgcgccttccttctggagtggtgtaaatgtatgaagctatatacgattactttcattgttttctttttctttgggtctagatggctctgttttagtcagcggttcttacagcatgggaatctggttggtcggaaacttgccagtaactataaatttggatgtttaaattagtctgaagtcgtcacaatcataattaaaatcatatttgattttaattatgaataccactgtaagcatttccgtctgagctgatgaacagaatgttttatttcgttctgtttgattgtcgacattcgattttgcttggacattccgttgctctcctgcttgcattaagtttacttcgttgatcagaataccatattgaagtttgtacatgatctgatttttctagtagcagtaatgaagattgatgagcgaaaacaattgattgcccaaacctcacagttcttcataaatataactaatgctatgatcaaatgactcgacaataatggtataataactgacataaattgggtactctcagatgatatatggctccaaaatgagaaggatcacagttctgagcaactctttccattgataaaatcaactactttcgtcgctgccagatccagtgcaatggcgactgcgttcaaattctcccgaaactcctcagctgttggcttgtcaccgtcaacaatgtctgtcacagctttcaaaaatatagtgggcacgttcaagagatgtgccacataagcaatagctgctccctggtacagtgggatcaaacaaacttacaattgctggaggtgaagtaatctagtcaatcctaagggacgttatttcattttgattctttgacaccaagcaatgttctccatagttttcatttacctttacgaatattgcctagcgccaacatctacagcattgacttcttcacgcaaatgtcagtatctgactttaagaaatagcaagtttgagaacaaagagttacctccatgtccttgacagttgcatcgtttgcaagaattgctgcttcatcttgtgggcagatatctaaagaatcgccagtagataattttccaacctttaagctaagctccttagcgagattaggtgtggagaaggttttacgagagccaacaccatataggtcaaatacagggataggaattctcctgtcgtggaaggcaacatctgatgcaagaaatacatcgcctattgaagcaccttttgccttgaatcctccagcagttcctgcatttatgataaggtctggctgtaaagcttgaatagaagcataagccaaaagagatgctgacacagtgcctacgcaatcaacccccaatgttgggtctttgcctggacacacaatattgatgtgcaaatgtttatatttaccgctgtacctcacccaaggaaccccctttgggaacacagactcaggctcctcagcaagctcaaacttattcactagcggcaacgcttcagtttgcatagc

SEQ ID NO: 2219 - DNA, 1076 bp, Arabidopsis thaliana
acttttgccgagaaaatcagagacagaagaagaagaaaagcgaaaaaaagcaaaacatgaaggcgacgacgaagactccgatccacgtggtgtggtcatgggttaggagacaacctccgaaggtgaaggcttttctcgccgtggtcactggcatggcggctttggttcttctcagattcattgttcacgatcacgacaatctcttcgttgccgctgaggctgttcattccatcgggatctgtgtgctcatctacaaactcatgaaggagaagacctgtgccggattgtcactgaaatctcaggagcttacggcgatatttttagctgttaggctgtattgtagcattgtaatggaatatgatatacataccattcttgacttggctactttgggaacaactctctgggttatatttatgattcgtttcaagttaagagctagttacatggaggacaaagacaactttcctctctattatgtgcttgcgccctgtgttgcattagctgtgttcatccatccatcgacctctcataacataataaacagaatttcatgggctttatgtgtataccttgaagctgtttcagtactacctcagctacgagtgatgcagaacacaaagattgttgaaccgttcacggctcattatgtttttgcacttggagtagcaaggttcctcagctgtgcccactgggttttacaggttgtggacacgcggggacggttgcttgtagcattgggttatggattgtggccatcaatggttctgatctcagaaattgttcaaactttcatcttggcagatttctgttactactacgtcaaaagcgttttcggaggccagcttgttctccggctaccgtctggagtagtataagttcaaaagatagaaataccccaacgatgtcctgcgatgagcttgacggaaattctaattgggaaagatagctcaatttttctttacctctgatttcatcgtttatgtgtcttgaggtttcaccaagtgtctcggttacgaattaattttacagtgttgtatattttgcctatcaagggatttaacgtctttcaggtc

SEQ ID NO: 2220 - DNA, 1954 bp, Brassica rapa
tagtttacctttttttttcttctcactttgccgagaaaatctgagaaaaaaagcgaaaagttgagaatgaaaagtccgattcacacggtgtggtcatgggtgaggaggcagccaccgaaggtgaaggcctttctcgcggtgatcaccggcatggcggctctggttctgctcagattcattgtccacgatcacgacaatctcttcgtcgccgctgaagctgttcattccatcgggatctgcgtgctcatctacaagctcatgaaagaaaagacctgtgctggattgtcgctgaagtctcaggagctgacggcgatatttctagctgtgaggctgtattgcagctttgtgatggaatatgatatacacaccgttctggatctggctactttggggacgactctctgggttatttttatgatccggtttaagttgagggctagttacatggaggacaaggacaactttgctctctattatgtgcttgtgccgtgtgttgtgttggctgtgttgatccatccatcgacctctcacaacatattgaacaggatttcgtgggcgttatgtgtttaccttgaagctgtttcagtgctaccgcagctgcgagtgatgcagaacacaaagattgttgaaccgttcacggcgcattatgtatttgcacttggagtagcaaggttcttaagctgtgctcactgggttttacaggttgtcgacacgagggggagattgctggtagcattaggttatggactgtggccatcgatggttctcatctcagaaattgttcaaactttcatccttgctgatttctgttactactacgtcaaaagcgttttcggagggcagctagttctcaggcttccgtctggagtagtataagttactctcagtgatgtaatacggaaagagacggctctatttttcctttacatttgatcttgacgtttgtgtctgaggtgacttggtaacgaattaatttcaccgtgttgtatgtttagttaccattgacgggtgtttacatgtctttccggttactttactccctttcatactataatagtgattggtaaaaagcaaataacgaaccttaacaagctattttgattacactgggaagaagaaacgtctgaaagttttgaagttttttattattatagatcactggaagtgagtgacactgcgaatgatgttgaaacgcatttttaaagaaccacggttgttacataaaaatagcacaagtagagagttagaggtctgaaagggttttcccatggatgaagttgatcactttagtggcagtttcctctagcgcagaggtcacaacagccaagttctgtaagaattcttctgccgtcggtttgtctccgtcgatcagatcggtcacggcttttaagaatatcactggtactttcagaagttcagcaacataggccaccgcagcaccctgaacaatccagagccacacaagagtttcaacttatttttatactcttgctagattccagaaatcagagaggtgttaacatgacattacctccatgtcctttagtgtagcatcattggcaatgatcaatgattcatcttgcgtggacatatccaaggaatcaccagtagataacctgccaatctgataacaaccaatcttatttaacaatgcttttgatatcgtgaaacttgagaaacagtttttgactaagcaaccttcaaatttagttccttgaggagattgggggttgagaatgcctgtcgaagaccaactccatacagatcaaacatctacaagcgagacacaaaacagtcactcaggaacttgcgaaatgaaatggggcaaaagaccagaacaagaagtggagaaaagaagaagaaggtaccggaataggtattctcctatcatggaagacaacatcagatacaaggaatacatctcctatgttggctcctttaacctgaatattgt

SEQ ID NO: 2221 - DNA, 909 bp, Brassica napus
agaaaaagcgaaaagttgagaatgaaaagtccgattcacacggtgtggtcatgggtgaggaggcagccaccgaaggtgaaggcctttctcgcggtgatcacaggcatggcggctttggttctgctcagattcattgtccacgatcacgacaatctcttcgtcgccgcagaagctgttcattccatcgggatctgcgtgctcatctacaagctcatgaaagaaaaaacctgtgctggattgtcgctgaagtctcaggagctgacggcgatatttctagctgtgaggctgtattgcagctttgtgatggaatatgatatacacaccgttctggatctggctactttggggacgactctctgggttatttttatgatccggtttaagttgagggctagttacatggaggacaaggacaactttgctctctattatgtgcttgtgccgtgtgttgtgttggctgtgttgatccatccatcgacctctcacaacatattgaacaggatttcgtgggcgttatgtgtttaccttgaagctgtttcagtactgcctcagctgcgagtgatgcagaacaccaagattgttgaaccgttcacagcgcattatgtatttgcacttggagtggcaaggttcttaagctgtgctcactgggttttacaggttgtggacacgagggggagattgctggtagcgttaggttatggattgtggccatcaatggttctcatctcagaaattgttcagactttcatccttgctgatttctgttactactatgtcaaaagcgttttcggagggcagctagttctccggcttccgtctggagtagtataagttactctcagtgatgtaatacggaaaggagacggctcaattttttctttacatttgatcttgacgtttgtgtctgag

SEQ ID NO: 2222 - DNA, 977 bp, Brassica napus
gacctttttttttcttctcactttgccgagaaaatctgagaaaaagcgaaaaattgagaatgaaaagtccgattcacacggtgtggtcatgggtgaggaggcagccaccgaaggtgaaggcctttctcgcggtgatcaccggcatggcggctctggttctgctcagattcattgtccacgatcacgacaatctcttcgtcgccgctgaagctgttcattccatcgggatctgcgtgctcatctacaagctcatgaaagaaaagacctgtgctggattgtcgctgaagtctcaggagctgacggcgatatttctagctgtgaggctgtattgcagctttgtgatggaatatgatatacacaccgttctggatctggctactttggggacgactctctgggttatttttatgatccggtttaagttgagggctagttacatggaggacaaagacaactttgctctctattatgtgcttgtgccgtgtgttgtgttggctgtgttgatccatccatcgacctctcacaacatattgaacaggatttcgtgggcgttatgtgtataccttgaagctgtttcagtgctaccgcagctgcgagtgatgcagaacacaaagattgtggaaccgttcacggcgcattatgtatttgcacttggagtagcaaggttccttagctgtgctcactgggttttacaggttgtggacacgagggggagattgctggtagcgttaggttatggactgtggccatcgatggttctcatctctgaaattgttcaaactttcatccttgctgatttctgttactactacgtcaaaagcgttttcggagggcagctagttctcaggcttccgtctggagtagtataagttactctcagtgatgtaatacggaaagagactgctctatttttctttacatttgatcttgacggtttgtgtctgaggtgacgaattaatttcactgtgttgtatgtt

SEQ ID NO: 2223 - DNA, 1117 bp, Ricinus communis
cttctctctgtgcaaagaagagagaaatatagtgaacagataaggagagtaacgaaagtaaagatgaaagggacaaagaggccgatccacgctgttgcaacatgggtacgaaggcaaccaccaaaggccaaagctattttagcagtggtgtctggtatggctgctttagtttttcttaggatggttgttcatgatcacgataacctttttgttgctgctgaggctgttcatgccgttggtatctctgtcttaatttataagctcatgaaggagaagacttgtgccgggttatcactgaaatcacaggagctgacagctatctttttagctgctagactctactgcagctttgtcatggaatatgacatacacacactacttgattcggccacactgctgacaaccctatgggttatttatactatccgcttcaaattaagatccagttacatggatgacaaagacaactttgcaatatactatgtcttgataccttgtgctgtgctatctttgattattcatccaacaacgcagcatcatatatttaataggatttgctgggctttctgtgtttatcttgaagctgtttcagtgttgcctcagcttcgtgtcatgcagaacacaaagattgttgaacccttcacggcacattatgtatttgcacttggagttgcaaggttcttgagttgtgcacattgggtgcttcaggtactggatactcggggacgccttctgactgcactgggctatggattatggcctcctatggtcctcctttcagaaattgtacagacattcattcttgctgatttttgctactactatgtcaagagtctcgtaggtggacagcttgttctacgtctcccctcaggagtagtgtaagccaatttaatgtgtagaacagtaaagtgcatccacagactggctaaatgtagggcagtgcagcttcttgcttctcaagccatatggagcacctgggttagcttgtatactcacattcttctttccagccaattggagattattgtagtatgtggaccgtaaagttggaagtgcattggattttgatattatcataacttaataatttaacagaagtaacttaccataatcagag

SEQ ID NO: 2224 - DNA, 1030 bp, Chelidonium majus
aagagtgatgagggcaccgaagagaccaatccacgccgtagcgacatgggtgaagcggcaaccaccgaaagtaaaggcccttctcgccgtcgtctccggtatggcagctcttgtctttctgagatttatcgtcaacgatcacgacaatctatttattgctgccgaggccgttcactctatcggtgtctcagttcttatttacaagctcatgaaggaaaaaacctgtgctggactttcgctcaaatctcaggaattaacagcaatatttttagctgttagactgtattgtagttttgttatggaatatgatatacacacacttctagattcagctacattggggacaaccctatgggttatttatatgattcgttttaaattgaagtctagttacatggaggacaaagataactttgcaatttattatgtgctgataccttgtgtcatattagctcttgtcattcatccgtcgacggcacataacattttgaacaggattttctgggccctgtgtgtttatcttgaagcagtttcagtactacctcaattgcgtgtgatgcagaacacaaagattgtcgaaccatttacggctcattatgtatttgcattgggagttgctaggttcttgagctgtgcccattgggtcctacaggtcttagataccagaggacgcctactgacagctttgggttatgggctgtggccttccatggttctcctatcagaaatcgtccaaactttcatccttgccgacttctgctactattatgtgaagagtgttgttggtggacaacttgttctacgtctcccatctggagtggtgtgagttattcaaggttcttcttttatgcagtgtatgcactaactaactattcacaggaataacttaaatagagaatgtgggtttggcttttcttccttttcttctattgtcactcctcttcttgttgtagtcatgactaaaatgatactcgcctgcacggtaattgtaaagttaggatcgctggggtggatttgtattttccatggc

SEQ ID NO: 2225 - DNA, 1324 bp, Eucalyptus grandis
atagctccaaattcctcttcaacggaacctgcaacacacggcccccttctctcttccaagccgatcttttctcggtcaattttccgtcactttcccgagaaacgccacagaagagagagagagagagagagagggagagagaacacagcgcgggatcgatcgatcggaggaaaggttcgattttgatgcgatatgagcctgcagaagaggccgatccacgcggtggctacatgggtgcggaggcagccccccaaagtcaaggcctttctggccgtcgtctccggcatggcggcgctggtcctgctccggttcgtcgtccacgaccatgacaacctcttcgtcgccgccgaggccgttcactccatcggcatcggcgtccttatttataagctcatgaaggagaagacttgcgctgggctatcactcaaatcccaggaactaacagctatatttttagctgttaggctgtactgcagttttgtaatggaatatgacatacacacaatcctggacttatctacgttggcagcaaccctgtgggttatgtatatgatccgtttcaagttgaagtccagctacatggaggacaaggacaactttgctaattattatgtgttgataccttgtgctgtgttggcattgtttattcatccgtcaacttcgcataacctagtaaaccggatatcatgggcatttgctgtctacctagaagctgcatcagtactaccacagctgcgtgttatgcagaacacaaagatcgtcgaaccattcacagcacactatgtgtttgcattgggagtggcgagatttttggcctgtgcccattgggtacttcaggttctagacagccgtgggcacttactggtggcactgggttatgggttatggccttccatggttcttatctccgagattgtccaaacattcattttagcagatttctgctattactatgttaaaagtgtgctcggaggacagcttgttctacgtctcccctctggggtggtatgaactacgcattgagattcagatgaggaaatggggatggatattcactattctcgtagtcttgcgctctctacctgttttatattccagaagaatgttctggtttacttgttatggatgcacatccagcagattgcttctagtaagaagcaagtgtcagcagctttggttggatgttttttttaatgtatgattacaatcgggaatgatataggattttgcagcaacaatttctcatggtattactctctctctctctctctctctctttctcttagcgcacacgcacacaaatattggagctaatttgcacagc

SEQ ID NO: 2226 - DNA, 1321 bp, Fagopyrum esculentum
gatcttcagaaaatttgagcataattaaatataataaaactaatgaaatcacaatcgatcgcaagacgcgatcttgattgaagatcgaccatttgggcccatcctcccaccgatatttgactatcccaaaccgcaaatccagagaggagagtggatctctgaaattcgatccaaaataacctaacaacaatactagaatcgtaagagctaaattggtcatttgaagagcagacgtagaagagtaaggaaggatgaagggaggaaagagaccgatccacgtgctgacgtcatggataaggcgccagccgtccaaggtcaaggcttttttggcggtcgtcgccggcatggcgaccctcgtattcctccggatgatcgttcatgatcacgacaaccttttcgtcgccgccgaggctgttcacgccattggcatctccgttcttatctacaagctcactaaggaaaaaacttgtgccggcttatcacttaagacacaagaactgacagctatgtttttagctgttagactctattgcagctttgtgatggaatacgacatacatacagttctggatacagcaacactggcaacaactctctgggttatttatatgatccgttttaaactcaaaaccacctatatggaatctaaagacaatttcaaaacttactatgtggcgataccttgtgttgtcttatctcttcttattcatcccacaacctcccataatattgtgaataggatttcctgggctttctgtgtctatctggaggcagtttcagttctaccacagctaagagtcatgcagaataccaagattgttgaaccatttaccgctcattatgtgtttgcccttggagttgcaagatttctgagttgtgcacactgggttcttcaggtgttggacactagagggcatctgctgacagctctgggattcggattatggccttctatggtgctgctatcggaaattgttcaaaccttcatcctggctgatttttgctattattatgttatgagtgtggtcggaggtcaccttgttctacgcctcccctcgtgaagcctcaaaaatgcacaactagcagaacgtatatactccttttatttatggtgacaagtgtgctgcaagatggattttaggggtggggtgctttctgttaactcggtgtttaatttgtcactttctagtgttggctaggatctatgtaattatttttcactctaaacacacagcactgtatgtttccattggaaattccctcgtgatattgcatgtttccactggaaccagtttattttgccagatatcatacaatttcc

SEQ ID NO: 2227 - DNA, 977 bp, Flaveria ramosissima
caatacatacacgtacacagagcacacacaagcacaagctcttgcaaaatcaaacatgaggccaccaaagaggacgatccacatcatatcgtcatgggtgcggcggcaaccaccaaaggtgaaagcttttctcgccgtagtcactgggatgttggccttggtgctgctgcgtgtgatcgtgcacgatcatgacaacctcttcgttgctgccgaggctgttcactccatcggaatctccgtcctcatctataagctcatgaaggagaaaacttgtgctggtttatcactgaaagcacaagaactaacagctatgttcttggctgttagattatactgcagttttgtaatggaatatgatatacacaccttgcttgatttggctacattggttactacattatgggtgatctttatgattcgttttaaacttaagtcaagctacatggaagacaaagacaactttccaacttactatgtggcggttccttgtgctgtactggctttgttaattcatccatcgacttcacatcatattatcaacaggatcttctgggcattttgtgtttaccttgaagcagtttcagttcttcctcaactcagggttatgcagaacacaaagattgttgaaccattcacggctcattatgtatttgctcttggagttgcaaggtttttgagctgtgctcattgggttcttcaggttttggatagtcgcgggcatctacttacagctctaggttatggattatggccatctatggttctcatctctgagatcgttcagactttcattctagcggacttttgttactattacgtgaaaagtgtttttggaggacaacttgtgttgcgtctaccctctggagtggtgtaataagctccaaggaaatgctggcattgaactctacattttacatcttgtcagttttacctactttcagtcagatggattgatggatggatgggtgtatttgtac

SEQ ID NO: 2228 - DNA, 833 bp, Lotus japonicus
atgatgacgggtgacaagaaaaagccgatccacgccatcaccacatgggtgcggcggcagccaccgaaggtcaaggcctttctcgccgtcgtttctggcatggcggctttggtggttctccgcttcattgttcacgaccacgacaacctcttcgtagccgctgaggctgtccactcccttggaatttctcttctcatctacaagctcatcaaagagaagacatgtgccggattgtccctaaaatcccaggaattaacagctatgtttctagctgtcaggctgtactgcagttttgtcatggaatatgatatacacactttgcttgatttgtctactttggcaacaacattgtgggttatatacatgattcgttttaatttgaagtctagttacatggaggagaaggacaactttgcaatatactatgtggtggcaccctgtgctgtcttagccttgtttattcatccatcaacttctcatcatttattgaacagaattttttgggcgttctgtgtttatctggaagccgtgtcagtgctaccccaattgcgagtcatgcagaacacccaaattgttgagccattcacagcacattatgtatttgcattgggtgttgcaagattcctgagctgtgctcattgggttcttcaggtgttagatagtcgtggacatttgttggttgccttggggtatggtttatggccttcaatggttcttatctcagaaattgtacagacttttatattagcagatttctgttactattatgtcaaaagtgttttcgggggacagcttgttctccgtcttccctctggagtggtgtgattgaagat

SEQ ID NO: 2229 - DNA, 1359 bp, Olea europaea
ttcgacatgggttcggcggcagccgccgaaagtgaaggcgtttctggcggtggtcagcggcatggcagcgctggtgcttctccgtgttattgttcacgatcatgacaacctttttgttgccggcgaggccgttcactccatcggaatttcggttcttatttacaagctcatgaaggaaaaaacctgcgctgggctttcactcaaatcccaggagttaacagcattgtttttggccgttagattgtattgcagttttgtcatggaatatgatatacacacgttgcttgacttatctactttggctacaaccttgtgggtgatgtatatgattcgttttaaactgagatccagttacatggaggataaagacaattttgcttggtattatgtggtggtaccttgtgctggtttagctttgctaattcatccatctacatcacatcactttgtcaacagaattgcctgggctttctgtgtttacctggaagctgtttccgtgctacctcaattgcgtgtcatgcaaaacacaaagattgttgaaccatttacagctcattatgtattcgcattgggtgttgcaaggttcttgagctgcgctcattgggttctccaggttttggacagtcgtggtcatctgcttgtagcattgggttatggtctgtggccgtcgatggttcttatatcagaaattgttcaaaccttcatccttgcagacttttgttactactatgtgaaaagtgtttttggaggacagcttgtgttacgccttccttctggagtggtgtaattaatggtcgttcgagttttcctttgtaagttattttttgcacaccacacagcttgtcctggtcactggttcttcatcgtaaaaattggtggatggaatgtggaaagatggcaaatacaagaaacttgggtttttaagtcaaccagttgatttgctagaaattagattggctgggttgtatgagttatttgttcaatttagtggatttgggatgtgattccatggacttatgtatgcacatgaactttaaatcaaggttcatcgtactttgtttctacttccgtgtggttaatccaacattttccctggttttatgcgtggttattaaacccggactggatcagcctgtctgaccgggaactccatgaacctgacctggtctggtcctgtcagcataattggaccaatgcagaattgaactgtcattggctcgctagaactccaaggattttgctaaaacccggtgaattgtgaagcagccaagtgggccattgttgaacggtttaatatgtttggttcatgttagttatcaaacttcattttgtttcaaatggacctcaacttgcgcaaag

SEQ ID NO: 2230 - DNA, 927 bp, Carica papaya
attgactagtaggagaagccccagagagagagagagagagagagagagagagagagggagagcggagacgcgacacaatgaaggcgacaaagaggccgatccatgcggtggcgacatgggtgaggaggcagccacctaagatcaaggcctttttagccgtagtctcgggcatggcggcgcttgtcttcctcagaatggtggtccacgatcacgacaacctctttgtggctgcagaggctgttcacgccctaggaatctccgtcctcatttacaagctcatgaaggagaagacttgtgctggactgtcactgaaatcacaggagctaactgctatatttttagctgttagactgtattgcagttttgtcatggaatatgatatgcataccctgcttgattcggctacattggttacaactctctgggttatttatatgattcgctttaagctaaggtccagttacatggaagacaaagacaactttgcaatttattatgtggtaattccatgtgctcttctatcgttacttattcatccaacaacacagcataacataatcaacaggatttcctgggctttttgtgtttatcttgaagctgtttcagttctacctcagctacgggtcatgcaaaacacgaagattgttgaaccattcacagcacattatgtatttgcattggggattgcaaggttcttgagttgtgcacattgggttctccaggtattggatacccgagggcgcctattgacagcattaggtcatggattgtggccgtctatggtccttttctcagaaattgtccagactttcattcttgccgatttctgctactactatgtgaagagcatcatgggtggacaactcattctgcgtctaccttctggggttgtatgaatctacaaaaataccatgcagagcacacaga

SEQ ID NO: 2231 - DNA, 1277 bp, Petroselinum crispum
cactcactcctcttctacacagggagtgtaattttcatgacttcaattccaaacaaactactatacaaaccccccagtttacatactaaatcacaaatttgtgttgaacccaaatcaagattttggaaattagaggatgagggcacctaagaggccgatctatatgattacaacatgggtgaaacgacaaccaccaaaggtgaaagcttttcttgctgttgtcgccggtatggcggctcttgtgttgcttagagctattgttcatgatcatgataatctttttgttgctgctgaatctgttcatgctgttggtatctctgttcttatctataaactcatcaaagaaaaaacttgtgctgggctttcactcaaatcccaggaattgacagctctgtttttggctgtcagactgtactgtagtcttgtaatggaatatgacattcatactgtgcttgattcagcaacacttgctacaactctgtgggtcatttatatgattcgctataaactgaggtcaagctatatggaggagaaagacaacttcacaatctatcatgtggtgattccttgtgcagtattagctattttagttcatccgtcgacgtcacacaatttccttaacagaatatcctggggattttgtgtatatttggagtccgtttcagtgctacctcaactgcgggtcatgcagaatactaagattgttgaaccatttacagctcattatgtatttgctttgggggttgcaaggttcttgagctgtgctcattgggttctccaggttttggacactcgtggccatcttcttgttgctctaggatatggactctggccttctatggttcttattgcagaagttgttcaaacctttatactagcagacttttgttactactatgttaaaagtgttttcggaggacaacttgtcttgcgccttccatctggagtagtttagttgaggatgtaacgtctaaaagttgactaatatatggtggttaccctcctttagttagtatcccttatgtattctccgacagaatcctgtccatttagaatcagtgcatgttataaggaccgaaaatctgtgaagaggatagtttctgaagttgggaatatggaattcaatgggcacttatattacagtactagcgcgaattcgaccaaaaaagtctaatgtgttgacatggtgttctgtaatctgatatacaaagacatttgaagaagaaaattgctagggctgccaaaatggttcccaaaatatttctcaaatgtctggg

SEQ ID NO: 2232 - DNA, 965 bp, Raphanus sativus
gaaaagtccgatccaggcggtgtggtcatgggtgaggaggcaaccaccgaaggtgaaggcttttctcgcggtggtctcaggcatggctgctttggttctgctgagattcattgtccacgatcacgacaatctcttcgtggccgccgaagctgttcactccatcgggatctgcgttctcatctacaaactcatgaaagaaaaaacctgcgctggattgtcactgaaatctcaggagctcacggcgatatttctagctgttaggctgtattgcagctttgtgatggaatatgatatacacaccgttctggatctggctactctgggaacaactctctgggttatatttatgatccggtttaagttgaaggctagttacatggaggacaaagacaacttcgctctctattatgtgcttgtgccgtgtgttgtgctggctgtgttgatccatccatcgacctctcacaacatattaaacaggatttcttgggcattatgtgtataccttgaagctgtttcagtactgccccagctgcgagtgatgcagaacaccaagattgttgaaccgttcacggcgcattatgtatttgcacttggagtagcaaggttcctaagctgtgcccactgggttttacaggttgtcgacaccaggggaagattgcttgtagcattaggttatggattgtggccatcaatggttctcatctcagaaattgttcaaactttcatcctggcagacttctgttactactacgtcaaaagcgtttttggagggcagcttgttctaaggcttccgtctggagtagtataagttactatcagtgatgtaatacggaaagagacggatcattttttttctttacatttaatctcaacgtttgtgtctgagatgacttggtaacgaattagtttcactgtgttgtatattttgttgactattgactggtgtttccatgtctttccggttg

SEQ ID NO: 2233 - DNA, 1314 bp, Fragaria vesca
aaacttttcccctcactttcgtcgccgattccacacttctccggcgaaactagaaaaagcgacaaaaccagagagaaaaggcgacgagttcaaaattccgatgagggccccgaagacgccgatcaacaccgtgtcgacatgggtccggcgccaaccgccgaaagtgaaaggctttctggccgtggtggcgggcatggcggctctggttttgctccgattcgtcgttcacgatcatgataacctcttcgtcgcagctgaggctgtccactccggcggaatcttagtcctcatctataagctcatgaaggagaagacttgcgccgggctgtcactgaaatcgcaggagcttacagcaatgttcttagctgtgagattgtactgcagtgttgttatggaatatgacatacacactttgcttgatttagctacactggtgaccaccctctgggttatttatatgatccggtttaatttgaagtctagttatatggaggacaaagacaactttgcaatatactatgtggtggcaccatgtgctctactagctttgtttatacatccgtcaacttctcatcatttattgaacaggatttcctgggccttttgtgtatatttagaagctgtttcagtactgccccagttgagggtgatgcagaatacaaagattgttgagccattcacagctcattacgtgtttgcacttggtattgcaaggttcctgagctgtgcccattgggttctccaggtattggatactcgcggacacttgctcgtggccttggggtatgggttgtggccttctatggttcttatttcggaaatcgtccagactttcatattagcagacttctgctactactatgtcaaaagtgttttcggaggacagcttgttcttcgtcttccttctggagtggtatgatttcaatctgcttgtgctgtggtctatgagcacactgtcgtcaacacttaacttagctagcatgtttgttcatccttatttagttcccctttttgctctccacaagtttctagttctgtctttctatgagaaaaaaaaaaaaatcacaactggagatgaagtgggttgcttgtaaagttggggatggatggagtgaactaaaatttgtatttataatttagacatgatttggttccactttttctatgggtgttaacattttgttaaagctttaccatcggcttcgatgatttacatccccatgatctgcggaagcatataatctacagttgtctgggtcaagtctgttgtggttcctgggttattagtagtagagatatatacattattggaga

SEQ ID NO: 2234 - DNA, 1159 bp, Helianthus annuus
atattaatatatactcaccgactccgccccaaatttctccccaaatcggccacccaacctccaccctactcaaaccctaaccaccacaatcaacaaccatcttcaaagcaagagtcaaacatgaggccaccaaagaagacgatccacataatctcgtcatgggtacagcggcaaccgccgaaggtgaaggcgtttcttgccgtagtcgccggcatgctggccttggtgttgcttcgtgcgattgtgcacgatcatgacaatctcttcgttgctgccgaggctgttcactccatcggaatctccgtccttatttacaagctcatcaaggaaaaaacttgtgctgggctatcactgaaaacacaagaactaacagctatgttcttggctgttagattatactgcagttttgttatggaatatgatatacacaccttgcttgatctggctacattggccacaacattgtgggtcatcttcatgattcggttcaagctcaaatcaagctacatggaggacaaagacaacttcgccatgtactatgtggtggctccctgtgcggtattagctttgttaattcatccgtcaacttcacattatatcatcaacaggatattttgggcattttgtgtttatcttgaagccgtttcagtcctacctcaactcagggttatgcagaacacaaagattgttgaaccattcacggctcattacgtttttgcacttggtgttgcaagattcttgagctgtgctcattgggttcttcaggttttggacagtcgtggacatctacttacagcccttggttacggattatggccgtcaatggttctcatctcggaggtcgttcaaacgtttatcctagcagacttctgttactactacgtgaaaagtgttttcggaggacagcttgttatgcgtctaccttcgggagtggtgtaagtttgaagaaacctagtggcgttcaactatacatttgcttgttaatttacctttcctccaatacagtcactcatgtggatggactatttgtacatttttgccccttttttaacttaaaacccttgtttcactactcttcttcaattatgattattagtttcagtgcctctaatgctttggtttactttatcatcaatgaaaattacaagatccatgtttt

SEQ ID NO: 2235 - DNA, 893 bp, Allium cepa
accaaagaggcaaataaacatggtgatttcatgggtaaagcgtcagccaccaaaagtaaaagcttttctgagcgtcgtgtccgctatggctgctcttgtttttctgagattcattgtccatgatcacgacaacctttttgttgctgctgaggctgctcacgcgattggaatttccgttcttgtttacaagctcaccaaggagaaaacttgtgctggactatctctcaagtctcaggagctaacggctttatttttagcagttcggttatactgcagttttgttatggaatatgatattcacactgtgttggactctgcaacccttgcatccacgttgtgggttatttatatgatgcggtttaagttaaaatctagctatatggaggacaaagacaattttgcaatgtactacgtggtagtaccttgtgcggcattagacttttaactaaaattaaacaatccttctacatcacacaacatcctcaatcgaatttgctgggcgttttgtgtttatttagaagctgtttcagtcttaccccagctacgtctgatgcaaaacacaaagattgttgaaccgtttacatctcactatgtctttgcattgggagtcgcgagatttctcagctgtgcgcattgggttctacaggtgttggatacacgtggtcgactgctgactgcattgggatatgggctgtggccatcaatggttcttctctctgaattgttcaaactttcatccttgcagatttttgctactactatgtgaaaagtactttgggtgggcaactcgtgatgcgtttaccttccggcgtagtgtgagtgtaacccataaatttatgtagaatttgaaatatgggtaatatttatttcgaccattttctttctttcttttt

SEQ ID NO: 2236 - DNA, 1032 bp, Ambrosia trifida
tactcatcatcatcatcacctactttcccccaaaacctgtcccttgagttgaaatcaatctccatcgtaatcaaaccctaaccaccacaacccctatgagaccaccaaagaagacgatccaggttgtatccacatgggtacggcgtcaaccacccaaggtcaaagcctttctcgccgtcgtcaccggcatgctggccttagtactcctccgtgctattgttcacgaccatgataacctcttcgttgctgctgaagctgttcactccattgggatctccctccttatttataaactcatgaaagagaaaacttgtgctgggttgtcactgaaagcacaagaactaacagctattttcttggctgttagattatattgcagtcttgtaatggaatatgatatacacaccttgcttgatttggctacattggttacgacattatgggttatctttatgattcggtttaaacttaaatcaagctacatggaagacaaagacaactttgcaacatactatgtggcggttccatgtgccgtactagctttggtaattcatccatcgacatcccatcatattatcaacaggatattttgggcattttgcgtttatcttgaagcagtttcagtcctaccccaactcagggttatgcagaacacaaagattgttgaaccattcacagctcattatgtatttgctcttggtgttgcaaggttcttgagctgtgctcattgggttcttcaggttttggatagccgcgggcatttacttacagccctcggttatggattatggccgtctatggtacttatctcagagatcgtccagaccttcattctagcggacttctgttactattatgtgaaaagtgttttcggaggacaacttgttttgcgcctaccttctggagtggtgtagtaaggttgaggaagttttgaccaaaggttaaactctacatttacttattgttagtcttaccttcagaggcagtctcaggtggatgtgtgatttgtacatttgtgcctgtgtcatttac

SEQ ID NO: 2237 - DNA, 1609 bp, Malus domestica
gtaccgaaaacccgaaaagatcaccagaaccgaacagtccaattaagaaaggaaatctctccctctcccctctttctctctctaaattctgagggatcctgtttccgcaccacaactactcacaataattagttttacctcactttctctctaccacatcaaactttccggggaaatcaaggggccgagagaatcacaaaagggggaaaaaaaggaaaaatcaaagcaaaaccaaacctcatgagggctccgaagaggccgatccacaccgtatggacatgggcgcgacgccagccgtccaaagttcaggcctttctggccgttgtttcgggcatggcggcgctggttctgctccgattcatcgtccacgatcacgacaacctctttgttgcagctgaggctgtgcactcgattggaatctccgttcttatctacaagctcatgaaggagaagacttgcgctgggctatcactcaaatcgcaggaactgacagctatgtttttagctgtgagattatactgtagtgtagttatggaatatgatatacacaccctgctagatttagctacgctggtgacgaccctctgggtcatttatatgatccggttcaacttaaagtctagttacatggaggacaaggacaacttcgcaatatattatgttgtggttccatgtgctctactagctctgtttattcatccatcaacttctcatcatttgttgaacaggatttcctgggcattttgtgtgtatctggaagctgtttccgtactgcctcagttgcgggtcatgcaaaacacaaagattgttgagccattcacagcacactatgtgtttgcactgggcgtcgcaaggttcctcagctgtgcccattgggttctccaggtattagatacacgtgggcagttgcttgtagccttgggctatgggttatggccttccatggttcttatttcagaaattgtccagactttcatattagcagacttctgttactactacattaaaagtgttttcggagggcagcttgtcctgcgtctcccttctggagttgtatgagttagctctggttctgctttggtccgcgagcgcactgccgtcaaagacttttaacctagctaggcaatgtggctggtgaatggttgtttaagttccccttttttatacttcctcgtatcactatacctgggtagatgagttgaattactcctatttgacttcaaaacagcaatttcatcttgtagtgccaattgcttaatcactagctcccccatcttgtctttaaatatatgccctctctcgtacacctttcggttgattatttcttcgagcatggatgaattggagcaggacgagcctcgtcggcgcactgcagtaccataggtgcgacaatatccatgaccatcttcatctgcaatcccatcaaatatcttatctcgtgcagctatgttctgttccgactcgctcagttcattaagtcgttgattatattcttcccaagtagtttcaaaagacttttgacatgaattttcagaaatgcgttcgtgttttttctagtctgtgctaacattttgccaaaagtttacttgagtggattctcattgctgcc

SEQ ID NO: 2238 - DNA, 994 bp, Arnica chamissonis
aaccaccgccaccactaccctgccatctctaaaccagctaataaatacgtagacagaacacacacaagcacaggattttgaaaaatcaaagatgaggccaccaaagcggacgatccacatgatctcgtcatgggtacggcggcaaccaccaaaggtgaaagcttttctcgccgtagtcaccggcatgttagccttggtgttactgcgtacgatcgtgcacgatcatgacaatctcttcgttgctgccgaggctgttcactccatcggaatctccgtccttatctataagctcatgaaggaaaaaacttgtgctgggttgtcactgaaagcacaagaactaacagctatgttcttggctgttagattatactgcagttttgtaatggagtacgatatacacaccttgcttgatttggctacattggttacaacattgtgggttatctttatgattcgttttaaacttaaatcaagctacatggaagacaaagacaactttgcaacttactatgtggcggttccttgtgctgcattagctttgttaattcatccatcgacttcccatcatattatcaacaggatattttgggcattttgcgtttatcttgaagcagtttcagtcctacctcaactcagggttatgcagaatacaaagattgttgaacccttcacggctcattatgtatttgctctcggtgttgcaaggttcttgagctgtgctcattgggttcttcaggttttggatagtcgcgggcatctacttacagccctgggttatggattatggccgtctatggttcttatctcagagatcgttcaaaccttcattctagcagacttctgttactattacgttaaaagtgttgttggaggacaacttgttttgcgtctaccttctggagtggtgtagtaagtttttgaggaaatggtggcattgaactctacatttacttcttgttagttttaccttcagtaaagtcaggtggatgggtga

SEQ ID NO: 2239 - DNA, 1182 bp, Cucumis sativus
aaagaagactcaactgattcggatacgttgacccgaacactcaattcagccccgctcgcagtatttttctcaaatctcaaatttcatcgtcaccggttcacctctttttctcttggtcggctgctcgccggaagattaaccctcccccgcctccagttagccctgcaaccttacagaagaagaagggataacaatcatttcatctcatgaggccggcaagaaatccgatccacatcgcgtcggtatgggtccggcgacagccgccgaaggtgaaggcctttatggccgtcgtgcttggcatgctaactttggtggtacttcgattcatcgttcacgatcatgacaatctatttgtcgctgccgaggcattgcactcaattgggattttggttctcatctataagctcaccaaagagagaacttgtgctggattatcgctcaagtctcaggagttaactgccattttcttggctgtgaggttgtattgtagttttgttatggagtttgatatacacaccctgttagatttagcaacactggccacaaccttgtgggtgatatatatgatccgtttcaaactcaagtcaagctacatggaggataaagacaactttgcattatattatgtgatagcaccttgtgctgtattggctttacttattcatccatcaacttctcatcactttgttaacagagttttctgggcattttgtgtgtatctggaagctgtttcagtgttgccccagttgcgagtgatgcagaacactaagattgtcgaaccgtttactgctcactatgtatttgcattgggtattgcaagattccttagctgcgctcattgggttctccaggtattggatagtcgtggacaccttttagtagctctcggttatgggttatggccatctatggttctaatctcagaaattgtgcagacttttatcctagctgacttctgttactattatgtgaagagcgttttggggggacagctcgtcatccgactcccatctggagtggtgtgacatatagatatcgtgtcatgtgttttttttttgtccatagccaggccaagttcttttcttgatgtgtttgcaggtatggggttgatattgttatcataacttcaaatcaccttggctgcatgtaaataaattattaaagaagattgatgattgatca

SEQ ID NO: 2240 - DNA, 1153 bp, Panax ginseng
taagtttttttctttttttagtttttttgggttttttatttttttttttaacgcagagtacatggggatcctaataaattagacctagaagaaagaggagagagaaaaactcatacacagtgaaacatgaggccaccgaagaggccgatccacgcggtgtcgacatgggtccggcgacagccgccaaaggtgaaggcttttcttgccgtcgtggccggaatggctgcgctggtcctgctgcgagccatagttcacgatcacgataacctctttgttgccgctgaagctgttcactccattggaatctctgtccttatctataaactcatgaaggaaaaaacttgtgttgggctctcacttaaaacacaggaactaacagctatgtttttggctgttagactgtactgcagttttgtcatggaatacgatatacacaccttgcttgatttagctacattgggtacgaccttgtgggtcatttatatgattcgctttaaactgagatcaagttatatggaggacaaagacaactttgcaatatattatgtggtggttccttgtgcagtgtttgctttgttaattcacccatctacgtcacatcatttcatcaacagaattttctgggcattctgtgtttatctcgaatctgtttctgtgctaccacagttgcgggtcatgcaaaatactaagattgtagaaccattcacatctcattatgtatttgcactaggtgtttcaaggttcttgagctgtgctcattgggttctccaggttttggacactagtggccatctgcttacagctctggggcatggactgtggccttctatggttctgatctcggaagttgttcaaacattcatattagcagacttctgttactactacataaaaagtgttttcggagggcaacttgttttgcgccttccttccggagtagtctaacagaggatgcagctgttaaaaagttaaaacataacggtttactcttcatttttaatttttgctttccagagtccattttggtcaaatgtttttccatcgtactgatgtgtaaaatcagctaagtgggtggtttgtaaagattgggatgtggaattttaagtaaatgtaagtttgaactttgaatgcatgcatggtcctattagttttt

SEQ ID NO: 2241 - DNA, 1287 bp, Panax ginseng
ttgacggaagcggatttctatcgagagtactacatattttcccagaaactcaggcagcccacagagacacaaggacaggacacagcatgagaccaccgaggaggccgatcaacgccgtattgacatgggccaagagacaaccgccgaaggtcaaggcttttatcgccgtcgtctccggcatgatctcactggtcttgcttcgaatcatcgttaatgatcacgataacctctttgttgccgctgaaatagttcacttcattggaatctctgtccttatatataagctcatgaaggaaaaaacttgtgctggactctcactcaagtcccaggagctaacagcattgtttttggctgttagactgtactgcagtttcgtcatggaatatgatattcacaccttgattgatttagctacattgggtacaaccttgtgggttatatatatgattcgctttaaactgaggtcaagttatatggaggacaaagacaactttgcaatatattatgtggtggttccttgtgcagtgttagctttgttaattcatccatctacatcacataatttaattaatagaattttctggggattttgtgtatatctagaatctgtttctgtgctaccccaactacgggtcatgcaaaatacgaagattgttgaaccattcacatctcattatgtatttgctttgggtgttgcaaggttcttgagctgtgctcattgggttctccaggttttggacactcgtggccatctgcttactgctctgggatatggactgtggccttctatggttcttatttcagaaattgttcaaacattcatattagcagacttctgttactactacgtaaaaagtgttattggaggacaacttgtattgcgccttccttccggagtagtttaatggagaatgcagccattgaaaagttgacttaaatatggtgttttattttctttagttgttttctggtctccgcacagtccatgttggttaagggttcttccatgtagtgatgaatgaaaattagttaagtggatgacttgtagagatgggaatgtggaattttaatggatatctaaattaaacttcttgttacccagaattaagatatctttattctgtgctgtatgattcatactggatgtgttgtgttctaatcagttgatgaacggtgaatgatggcaacctttgttagcagcattactatggtaaaatgatttttatactacaaaaaaaaaaaaaaacaaaaaaaaaaacaaaaaaaaaaacaaaaaaacaaacgtag

SEQ ID NO: 2242 - DNA, 1345 bp, Quercus alba
ctcgttcacggttcctacacgcatcaaacaataactaataaaccaacgtgtacacgacgggagtcagagagagagagagagagagcgagagagaaatcagagtttcctaaaatagaacaaataccaaactaccgcatcagagcgagagagagagagagagagagagagaggcaatgaagggagcgaagacgccgatccactcggtggcgatgtgggtacgaaggcaaccgccgaaggtgaaggcgtttctggcggtggtttcgggcattgcggcgcttgtgttcctgcgactggtcgttcacgatcacgacaacctttttgttgccgccgaggctgttcacgctcttggaatcgctgtcctcattttcaagcttaccaaggagaagacatgtgctgggctttcactcaaatcacaggaactaacagctatatttctggctgttagactctattgcagttttgtcatggaatttgatatacacacactacttgattctgcaacattggtgacaaccctctgggttatctatatgattcgttttacattgaagtctagttacatggatgataaagacaacttcaaatcttactacgtgttgctaccttgtgctgtgctatcattattaattcatcccacaacgcagcattatatcatcaataggattttatgggcattctgtgtttatcttgaagctgtttcagtgctaccccaactgagggtaatgcagaatacaaagattgttgaaccattcacagcacattatgtatttgcactgggagttgcaaggttcttgagttgtgcgcattggattctccaggtattggatactcatggccgcttgctgactactttgggttatggtttgtggccttctatggttctcctctctgaaattgtccagactttcattcttgcagatttttgttactactacgtcaaaagccttgttggtggacaacttgttctgcgcctcccctccggagtggtgtaagcttgaaatgctgcaatcttttttatataaatatgtagttcagttgaatcattcaaccttggcaagttgaccatgtaatgtcattgatagtatttagcagttaggaggtttagatagtttcttcttgacatgatgtaagtttcgtgagctatcctcccttttttttggttcagttatttgttctgattatgaacttcacatagaaatgtcaattctctatgattatatgactgtatgactaattctgtcaattatagttaactgagatggtggtagttatttggacaatttttaaacttcagtcgccgataatataaaccgatagcatgggggattagtttgcaactgaccca

SEQ ID NO: 2243 - DNA, 1407 bp, Arachis hypogaea
cgagaagtagcagcagtagctgaaacctctaataagtattaataaattacgcattaacattacttctctcaccttctccaatcactcaatccctcgtttcaattcccactttcccacttctcaaaagccaacacaccaatcgatcgaacttcattcacttcgcacagattgtgaacaaagagtttagcttttttcagtaatgaggggtcagagaatgtcgatccactccatgaccacgtggctcaagcggcagccaccaaaggtgaaggctttcctcgccgtgatttccggcatggcggcgcttgttctgctccgcttcatcgtccacgaccacgacaacctattcgtcgccgccgaggctgttcactccctcggcatctctgttctcatctataagctcatcaaggagaagacctgcgccggattgtcactcaagtcccaggaattaacagctatctttttagctgttaggctgtactgtagttttgtcatggaatatgatatacacacactactcgatttcgctactttcgtaactacaatgtgggtcatatacatgattcggttcaaactgaaggctagttacatggaagagaaggataactttgcgatatactatgtggtgataccctgtgctgtgttggccttgcttattcatccatcaacttctcatcatttattgaacaggattttctgggcattctgtgtatatctggaagcagtttcggtattacctcaactgcgggtcatgcagaacaccaaaattgttgagccattcactgctcattatgtatttgcgctgggcgttgcaagattccttagctgtgctcattgggttcttcaggtgttagatacccgtggacatttgttggttgccttggggtatggtttatggccaccgatggttcttatatcagaaattgtccagaccttcatcctagcagatttctgttactactatgtcaaaagtgtttttggaggtcagcttgttcttcgtcttccctctggagtggtgtgagtgaaggatctgtttcaatggatacacatttaacttaatcaggcaatatggtgggttacccttgttagagtacactgtgtgtttacacacttatttggttccttggtggaagctggttctgtaaaatttggagatgaaagaaaactaattatttatgcttaatgtacggttatttatagttgaaaagtcgtttatacatggagtctccattttgattaagctggatttttgttgtcaccatttcaaatgctaaagttataaacaaagtcttacgtggagctctgcctacttaacggatctagaagttacacaattgtgaatgttgccctctagcacgatgataaacttgtgattcataatataaaatttcttgataagggttttgttga

SEQ ID NO: 2244 - DNA, 1651 bp, Populus trichocarpa
atcacccacctggaaaatgccattttttcggtgcgcacgaaaaaccagctccgttaacaaaccacgtacaaaaaagaggccatccaccgtgaccacataaattcaaagtgggcttgccaccataatcatccactataatggttgttgagcagcctatcccattactgcagcaaaaatacaaagtagcagcccactgtccatcttcttcttcttaccaaactctcctcatctccacgtgttctaacataactcgcattgatcagcactccttgctcctgttcctgtcccttcccacagctgatcttgatcacaaccttctcccgtgtacctcctccatagacatcaacgatccacggatctagcatttattactacatcaacaacaaaactacttaattatacgtgatcacttcactctcccgtaactgatacgccgcatcaaaattaggagcgcagagagagagagagagagagaggagagagtgttagcaagaggaataaaatgaaggcaacgaagaggccagtccaggcagtggcgacatgggtaaggaggcaaccaccgaagatcaaggtgttcttagcggtggtttcagggttggcagcgttggtttttctcagaatggttgttcatgatcatgacaacctcttcgttgctgctgaggctgttcattctattggaatctctgttcttatttacaagctcatgaaggagaagacttgtgctggactttcactgaaatcacaggacctcacagctatatttttagctgctaggctctattgcagttttgtcatggagtatgacatacacactctacttgattctgctaccttgctgacaaccctttgggtaatctatatgatccgcttcaacttgaggtccagttacatggaagacaaagataactttgcaatttactatttggtgataccatgtgctttactagctttgattattcatccaacaacacatcataacatattcaacaggatttcctgggccttttgtgtttaccttgaatccatttcagtgttgcctcagctgcgagtgatgcagaacacaaagattgttgaaccattcacagcacattacgtatttgcacttggagttgccaggtttttgagctgtgcacactgggtcctccaggtattggacactcgaggacgcctattgacagcactgggctatggactgtggccttcgatggtcctgctttcagaaatcgtgcagactttcattcttgctgatttttgctattactatgtcaagagtgttcttggtggacaacttgttctacggctcccctcaggagtggtgtaagctagtgtgccccgcataatctgccaagcgcctccactgataactaccacgatacaaagcagctttggttgcgtttgggccatccagatagtgtgctcacgcatgttctcttttgcaggcattagagttattgtagtaagtgggactgtaaagttgggtcacgttgcatgttggtattttggtaacttaataattaaatagaaaaaatattattgaaaatgttagaattcatgacgtggataagagtttaccaaattaacccgagttagccagctggatttgagattagaatcttttttcatagttcatttaagcttctggtgcaaaaaa

SEQ ID NO: 2245 - DNA, 1205 bp, Glycine max
tgttcacacgtgtcctcctaacacgtattcattcatgtcccaacacacattacattacattagattatcacgggaagaaggacacaacacaagtcagaagacaagacaatcaattgattattttctgttcggaaatgaagggtagcaagaggcccatccacgccgtcacgacatgggttcggcgccaaccgcccaagataaaggcctttctcgcggtgctgtctgcccttgcggccttgctcttcctcagaatcgtcgttcacgaccacgacagcctcttcgtcgccgccgagtttgtccatgcattaggaatctccgtcctcatttacaaactcaccaaggaaaaaacctgtgccgggctttcgcttaaatcgcaggagctgacggctatgtttctgggtgttagactttattgcagttttgtgatggaatatgatatacacaccctactcgatatggcaaccttggccaccaccctctgggttatttatatgatacgtttcaaattgaaatctagttatatggatgataaggacaaccttgcaatatactatgtggtaataccttgtgctgtgctgtccttgttaattcatccaacaacccggcatcatccacttaataggattctctgggcattttgtgtttatcttgaagctgtttctgttctccctcagctgcgggtcatgcagaacactaagattgttgaaccattcacagcacactatgtttttgctcttggagttgcaaggttcttgagttgtgcacattgggtcctccaggtattagatactcgtggacgtctactgactgcattgggttatggattgtggccttctatggttcttctatcagaaattgtccaaactttcattctggcagatttttgctactactacgtcaagagtcttgttgggggacaacttgttcttcgacttccttcaggagtggtctaacttaaacattcaagtaggacgttcctttagcatgcagcactcggtaagtcagagtagctagttgatctttgacgtgttatgtatctatctgcggtcagagtgaacagagttgagaatgtactatacatgtaacatcgtgaaattttaatttatcttttgatcagttcaagtttgtgttggtagttaacagataacaaatatattaaatgatcctttggatacgagcaaataccagtcgcagggcttgatgga

SEQ ID NO: 2246 - DNA, 1383 bp, Fragaria vesca
gaacagccgatctagtagtttaactgctcgaactaaaaccctcccggactcgtttaagacataacaagtctccttctcttcttctttctttctttcgaatccaaacacacttcgagtaaaatccgaaacccatgaagggaggcaaaggagccacccacgcggttgcgacatgggtccggcgacagccgccgaagatcaaggcgtttttggcggtggtgtcgggtatgtccgccttggtgctcttacgtatgatcgtccacgaccacgacaacctcttcgtggcagccgaggctgtccactccctcggaatatccgtcctcatctacaagcttatgaaagagaagacctgtgccgggatttcactcaagtcgcaggaattgacggctctgtttctagctgttaggctgtactgtagtttggttatggaatatgacatacatacgatactggattcggctacattggtgaccacgctttgggttatttatatgattcggtttaagctcaggtctagctacatggatgacaaggacaacttcgctatctactatgtggtgattccttgtgctctgctttcattagctgtacatcccacgacccatcattttattgtaaaccgaattggatgggcattctgtgtttatcttgaagccgtatcagtactacctcagcttcgactcatgcaaaacactaagattgttgaaccatttacggcacattatgtttttgccctgggagtcgcacggttcttgagttgcgcacattgggtcctccaggtaatggatactcgaggacagttactgacaactttaggttatgggttctggccttgtatggttcttctctcagaaattgtccagactttcatacttgcagatttttgctactactacgtcaaaagtgctgttgatgggcaacttgttctacgcctaccctctggagttgtctaagtttaagctgtccagcatgcaagatcaaactgcatcgcaactcaaacctttgagaatgtaattgcctggttgcccaaatccgtttcttgggcagctattaagagaatggccgagtcatagagtgaactgtaaagctagggatgtttcctcactagtcaggtttacaatgtagtcattagcatatacactcaatgtttagaacattttcctagcagactttttgtgattctgcatttagttttgaagtgttatcagtggatgctattctctctatgttctttgctggttaaactgaaaagaatgtgcaactctctggaaacgggggtggaaatgtaatacgacattttagcatacttcgtgatcaagattttgtgttctaatactgcaaatgcaagttgaatggccaatggaaatggaatgttgtatgagaata

SEQ ID NO: 2247 - DNA, 1132 bp, Glycine max
gcaaccccacccgtcgcataactaataaacatgcacctctcaccagtgttcacacgtgtcctcctaacacgtattcattcatgtcccaacacacattacattacattagattatcacgggaagaaggacacaacacaagtcagaagacaagacaatcaattgattattttctgttcggaaatgaagggtagcaagaggcccatccacgccgtcacgacatgggttcggcgccaaccgcccaagataaaggcctttctcgcggtgctgtctgcccttgcggccttgctcttcctcagaatcgtcgttcacgaccacgacagcctcttcgtcgccgccgagtttgtccatgcattaggaatctccgtcctcatttacaaactcaccaaggaaaaaacctgtgccgggctttcgcttaaatcgcaggagctgacggctatgtttctgggtgttagactttattgcagttttgtgatggaatatgatatacacaccctactcgatatggcaaccttggccaccaccctctgggttatttatatgatacgtttcaaattgaaatctagttatatggatgataaggacaaccttgcaatatactatgtggtaataccttgtgctgtgctgtccttgttaattcatccaacaacccggcatcatccacttaataggattctctgggcattttgtgtttatcttgaagctgtttctgttctccctcagctgcgggtcatgcagaacactaagattgttgaaccattcacagcacactatgtttttgctcttggagttgcaaggttcttgagttgtgcacattgggtcctccaggtattagatactcgtggacgtctactgactgcattgggttatggattgtggccttctatggttcttctatcagaaattgtccaaactttcattctggcagatttttgctactactacgtcaagagtcttgttgggggacaacttgttcttcgacttccttcaggagtggtctaacttaaacattcaagtaggacgttcctttagcatgcagcactcggtaagtcagagtagctagttgatctttgacgtgttatgtatctatctgcggtcagagtgaacagagttgagaatgtactatacatgtaac

SEQ ID NO: 2248 - DNA, 1164 bp, Cucurbita pepo
agaacacaacgctattctcttctaccccacttcgccgcgcttacacagagagaacgcagtgaacctcgtaatgaaggcaaccaagaggcccattcaggccatcgccacatgggttcgccggcaaccccccaagatcaaggccttttggccgttgtctctggaatggctgctcttgttttcttgcgctttgttgttcatgatcacgacaatcttttcgtcgccgcagaggcagttcacgccatcggaatctccgtcctcatttacaaactcatgaaggagaggacctgcgcaggactttcactaaaatcgcaggagctaacagcaattttctggctgttagactctattgcagttttgtcatggaatatgatatacatactctactggattcagctactttggtaacgacgctctgggttatttatatgattcgatttaagcttagatccagctacatggacgacaaagataatttccctatttactatgtggtgataccttgtgctgttctatcttttgtgatccatccaactactgtgcataacataataaatagaatagcctgggcattttgtgtttatcttgaagctgtttcagtactacctcagctccgggtcatgcaaaatactaagattgttgagccatttaccgcacattatgtatttgccttgggagttgcgaggttcttgagttgtgcccattgggtcctacaggtcttggatactcgtggacgtttgttaacagcattgggttatggactatggccatccatggttctcctatcagagattgttcagactttcattcttgcagatttctgctattattatgtcaagagcctcgtcggtggacagctcgttctacgccttccttccggggtggtgtaacttcaacaaaactgcatatgccacaaagagaaatgagagaggttgtgttgcttgtcttgggctctatttgggaaggtaggaggagggtctcagttgttgaactaatgcttatacatgaaatgtgaatgatgcattaagttttaaagagacacatagtagatgtttttttcctttttaacatgatcttatttactctacatatctatccaccatcttctctcaaaagctctgatttgtccacgaaataatatctatcacgggcttttgtttgctgcct

SEQ ID NO: 2249 - DNA, 1101 bp, Carpinus betulus
atcattttccctcactttctcgcccacactttcccggaaaatcaaaacaaacacaaagaacaaaagacatatacacatctaggcgaaaccctcatgagggcacagagaaagtcgatccacgccgtgtcgtcatgggtgcggaaacaaccgccgaaggtgaaggccttcctggccgtggtctcgggcatggcggcgctggttctgctccgattcatcgtccacgatcacgacaacctcttcgtcgccgccgaggcggtccactccattggaatctccgtgctcatctacaagctcatgaaggagaggacttgcgctggactatcgctcaaatcccaggaattaacagctatgtttttagctgttaggctgtactgcagttttgttatggaatatgatatacacaccctacttgatttggcgacatttgtgacaaccctgtgggttatttatatgatccgctttaaattaagtctagttacatggaggacaaagacagttttgcgatatattatgtggtgctaccctgtgctgcgttggctatgtttattcacccatcaacttcacaccatttagtgaacaggatcttctgggcattctgtgtatatctggaagctgtttcagtactaccccagttgcgggtaatgcagaatacaaagattgttgaaccattcactgctcactacgtatttgctttgggtgtggcgaggttcttgagctgtgcccattgggttctccaggttttagatagtcgtggacacttgctggttgccctgggttatggattatggccttcaatggttcttatctcagaaattgtccagactttcatcttagcagatttctgttactattatgtgaaaagtgttttggtggccagcttgtcctccgccttccctctggagtggtgtgatagggatcctcttgttccacgtttgatgaatgcagtgccatccaaaattaacttaacctggcaatctggctggttgtcttaatttagatctgctttttgctctccctctgtcatgactattagtcaagtgggttgtttgtaaggatgggggatgcagaaagctttgatatttatatactaaacatgatttt

SEQ ID NO: 2250 - DNA, 1014 bp, Lippia dulcis
aaagcaccgaggagaccgatccaagcggcggcgacatggctgcgacgccggccgccgaaggtgaaggcgtttctggccgtcattagcggcatggcggcgcttgttctcctccgtgcaattgtccatgatcatgataatctgtttgtggcagcagaggctgttcattccatcggaattgctgttctgatttacaagttgatgagggagaagacctgtgctgggctttcgctgaagtctcaggagctaacagctatctttttggctgttaggttgtattgcagttttgtcatggagtacgacatacacactgtgcttgacttggctacactggctacgaccttgtgggttgtttatatgattcgatttaacttgagatcgagttatatggaggataaagacaacattgcactgtactatgtggttgtcccttgtgctgttatagccttagtagttcacccatctacatcacatcatgtcgtcaacaggatttcctgggcgttctgtgtttacttggaagctgtttctgtcctgcctcagctacgtgtcatgcagaacacaaagattgttgaaccttttactgctcattatgtatttgcattgggagttgctagatttttgagctgtgcccactgggttctccaggttttggacactcgtggccatcttctcgtcgcattgggttacggactccggccttcaatggttctaatatccgaaattgttcagaccttcatcctggccgacttttgtctattactatgtgaaaagtgttttcgggggacgagctcgtgttgcgccttccttctggagtggtgtaaatgtatggggctatttaagattattttcactgttttctttcttttttggtctatagatggctctggtttttggtcagcggttctggttggtcggaaacttggcagtaactataaagttggatgtttaaattagtctgaagttggcacaatcatatttggttcactgcaacactaccaatttgattttaattatgaa

SEQ ID NO: 2251 - DNA, 1351 bp, Amborella trichopoda
aatcttagtgccgctcattaatctattcgcccacgtttattgttgcagatatactacgccattctcttcttctcagaaaaactcgctctctatctcgctctctctctctcttttcaatccttaaagaataaagagtggtcgagaagggggctctctgagctgtggggtgatccaaaggagaccttgagagagagagagatgatgggttcaggtcgggcgatgaggaagaaccctgtgcatgtggtggcgacttgggtgaagaggcagcctccgaaggtgaaggcgttcctcgctgtggtggctggaatggggttactcgttttcctgaggctcgtagttcatgaccatgacaacctctttgttgcagctgaggcctcacacgccattggtatctctgtcttgatctacaaattgatcaaggagaagacttgtgctggactttcactgaagtcacaagaacttactgcattgtttttagctgttagactttactgtagttttgtcatggaatttgatctacacacattactggattcggctacacttatcacaacattgtgggtcatttatatgatacgttttaaactgcgatcaagttacatggaggacaaggacaatttcccaatatactatgtggtggtaccatgtgctttacttgcactctttattcgaccaacaacatcccacaatattgtcaacagaatcttgtgggctttctgtgtataccttgaagctgtttcagtattgcctcagttacgagtgatgcaaaacgtaaagattgttgaaccatttactgctcattacgtattcgcacttggagttgcgcggttcttgagttgtgcgcattgggttctccaggttttggacagtcgtggatatctattgactgctctgggacatggtttatggccttctatggttctcctttcagaaattgttcagacattcatcttggcagatttctgctactattatgtacagagtgtgctgggtgggcatcttgtattgaggcttccttctggcgtggtgtgagagaattgttatgttgaggagggatgttggggtaaagaagccaccgttctctctttgtagataagaactcttgagtcctgcactgtatttcattttttgttagttgcttcttggtctttgtggtttatttaatagacgattagaatggttccttaactgaagtcttttgaatctaactccaggttttggttttgtcctactaatctacctgcaactctgttttcctaatggaatgaatcagtatgaggaccatttgtgcttgctgttactgttcctgttgtgtctgctgattagaatctgagggatcccttatgatttg

SEQ ID NO: 2252 - DNA, 1808 bp, Conyza canadensis
tccaaccaaacctccaatataaacacatttactgacttccacagactaaaattctcccccaaatcacaaaaaccctaaaagaacaaaaaccaacctatacatacacaaatcgttacacaaaaacaaaacccaaattttaagtgaaaaaagaagaatgagaccaccaaagagaacgatccatataatatcatcatgggttcgccggcaaccaccaaaggtgaaagcttttttggcagtagtgagtggaatgctggctttggtgctgctgcgtgtgattgttcatgatcatgataatttatttgttgctgctgaagctgttcattccattggtatctccgtccttatttataaactcatgaaagaaaagacttgtgctgggttatcgctgaaaacgcaatacctaacagctatgtttttggctgttagattatattgcagctatgttatggagtatgatatacataccttgcttgacttggctacattgggtacaacattgtgggttatctttatgatccgttttaaactccaatcaagttacatggaggacaaagacaactttgcaatgtactatgtggcggtcccatgtgctgcactagctttgttaattcatccatcgacgtcccatcactttatcaacaggatattttgggcattctgcgtctatcttgaagcagtttcagttctcccacaactcagggttatgcagaacacaaagattgttgaaccattcacggctcattacgtatttgcccttggtgtcgcaaggtttttaagctgtgctcattgggttcttcaggttttggatagccgtggtcatctacttacagccctaggttacggattgtggccatcaatggttctgatctcggagattgttcaaacattcatactagctgacttctgttattactacgtgaaaagcgtatttggaggacaacttgtgttgcgtctaccttcaggggtggtgtaagtttgaggatgatgtacaaggaaatggtggcatcaaacgacgtttacagtacttgttcgtcttgttagtttaactttcctgcaatacaatcttgcaagatagtcggtcaaggtggatatttgtacatttgcgccctttcttatttacaacgataactcaaatcttaaaaaacttcaattaggatactcctcgggcctttaatgcattgttatcctttttcgtaatcaggtctgctaaatgaaaaattccaaagtaatttgaatctattattttgagtatggcttaatcttgtgaaatgggtctaacctctaaactgtatctaattcaatgtttagattgatctcatcaaggtttctggatatgttattatgttttgattgtgtccaatcttatgtggttcgagaggtcgaaaatatagtacactagaaaggtgtttagaaatgagttttgttatccgatataccaataattgtgacttgtgaatctatgttaataatttttcagaactttttacatttcaactggcttcacgaagaatgactatatgtaaagaccttttgccactttaaaatatttagcatgtatgtaacttctcaacatcatgtgttgtaaccatttgatctgaggccattgtgccgccttccacgccgaccatccaatcattggtaccaagaccttggcacaaaaacgccttcatgccaatactaaagatgcagttggagattggctaatgaaattaagtgaattatgtaaccattcattttattaacatataaatttctgatcaatgtcaaaggtttactttttatgtaacgatttaaaccttaatttataa

SEQ ID NO: 2253 - DNA, 1120 bp, Arabidopsis lyrata
gtcgtcactttaccgagaaagcaagagaagaagaagaaggaatcgaaaatgaagactccgatccacgcggtttcgacatgggtgagaaggcagccgccaaaggtgaaagctttcctcgccgtcgtatctggcatggcggcgcttgttctcctcagattcatcgttcacgatcacgacaatctcttcgttgccgccgaagctgttcattctattggaatctctgttcttatctataaactcatgaaggagaagacttgtgctggattgtcgttgaaatctcaggagcttacggcaatatttctagctgtgaggctttattgcagttttgtaatggaatatgatatacataccattctggacttggctactttgggaacaactctctgggttatatatatgatccgttttaagctcaaagctacttacatggaggaaaaagacaactttgctctctattatgtgcttgtgccctgtgtcgtgctagctgtattgattcatccatcaacgtcacacaatatattgaatagaatatcctggggattctgtgtttacctcgaagctgtttctgtactgccacagttgagagtgatgcagaacacaaagattgtcgaacccttcacggctcattatgtttttgcacttggagtagcaagattttttagctgtgcacactgggttttacagattatggacacccggggacgcctgcttgtagtgctgggttatggactatggccatcaatggttataatctcagaaatcgtccaaacattcatattggcagatttctgttactactacgttaaaagtgttttcggtggccagcttgttctacggcttccatctggggttgtgtaagttataaaggaaaaaaagataagacactttatgacatttgtaacacgaagataggtctcaagctttgtttaatctgagtagcctcaggttgctctcaagttactctctcaggccaaatcctaattctttcaactgtgttgtatatttttgtgggtcatcaatcatcatagagtcccttggatattattattgccaatgattttttcaccgcatttgtgcttaattctcctttgttctcacggtaaagttaatgcgaatttca

SEQ ID NO: 2254 - DNA, 1201 bp, Musa acuminata
ctgatgtaggtgaacgcaccgcatcgtatctttaagatgtcttccccgtctacattcccccgtccaactccgtcgagcaacgcctcttgtttgctttttgtgggatcggattgctcgacagggagagggagagggtgagagagtgagagatggagagcaagatgaggaagggacgggcgcggccgattagggcggtggtgggatgggtgaggcggcgatcgcccaaggtgaaggcctctctctccgtcatcgccggcatggcggcgctcgtcttccttcgcttcatcgtccacgaccacgacaagctcttcgtcatcgccgaggccgcacacgccctcggcatctccgtcctcatctataagctcatcaaggagcggacttgcgccggactttcgcttaagactcaatatttgacagctttgtttttagctgtcagactgtactgcagctttgtcatggaatatgacatacacacagtgctagattgcgctacgcttgcaactactctttgggttatctacatgattcggtttagattaaagtcaagttacatgaaagagaaggacaactttgcaatttattatgtggttttgccttgtgctatattggcctttacagttcatccttcaacaacacataatcttattgataggatttcttgggccttttgcgtttatctggaagctgtttctgtgttgccacaattacgtctgatgcaaaacacaaagattgttgagccattcaccgctcactatgtatttgcactgggggtttcaagatttctgagctgtgcacactgggtccttcaggtcttggatactcgtggacgtctattgactgctttgggccatgggttgtggccgcccctggtccttcttgctgaaattgttcaaacctttatcctggcagatttttgttattattatgtgaagagtgttgttggtggacaactggtgctaaggcttccttctggtgtagtgtgatcttctgcttaactttctgtcttataccaaaacaattgaaattctcttcatctttcttcagacctgtagctcttgtggctgatttgtgttacaagttcaagcagttatgtcaaaatttaccgagatttagagacactgaatttggcagaaataatttcttatctgactagctctaccacaaagtaaagcataatctgagttttatttaagactagaaa

SEQ ID NO: 2255 - DNA, 1144 bp, Daucus carota
aaaaaagaaaatacacacaatacacacagagagaacatgaggccaccgaagaggccgatccacgtgatatctacatgggtccggcgacaaccgccgaaggtgaaagcttttctggccgtcgtggccggaatgtctgcattggttgtactgagagccatcgttcacgatcatgataatctttttgttgcagccgaagctgttcattctattggtatctctcttcttatttataaaatcatgaaggagaaaacttgtgcagggctgtcactcaaatcgcaggaactaacagcattgtttttggctgttagactgtattgcagtttcgtcatggaatatgatatacacaccttgcttgatttagctacattaggtgctaccatgtgggtcatttatatgatgcgtcataaactgcgatcaagttatatggaggaaaaagataactttgaaatacattacgtggtggctccttgtgcggtattagctctgttgattcatccatctacatcgcatcatgttatcaatagaatcttctgggggttctgtgtgtatctagaatctgtttctgttttaccccagttgcgggtcatgcaaaatacaaagattgtagaacctttcacagctcattatgtgtttgctttgggtgttgcgaggttcttgagctgtgctcactgggttctccaggttttggacactcgtggccatctgcttactgccctaggatatggactctggccttccatggttcttatttcagaagttgttcaaacattcatattagcagacttttgttattactatgtattaagcgtctttgggggacaacttgtgttgcgccttccatctggagtcgtctaacgcaggatgtgattcgtcagaaagttagctcagaatggtggtttactctttacgagcaatatttatattttagcactccacagagtccatgttacctgagggtggttacaccgtatgttgactgaaaaatcaattacatggagggtatgtaaagatggtgtgggatgttaatggaaatctaatgtatctgatgtttatctgaattcgtataacttgaccttgttgtgccaatctagatgagctaattttacaatttatatgggatgtcgtttgatgcgaactgcacttg

SEQ ID NO: 2256 - DNA, 1280 bp, Catharanthus roseus
gatccatcgttacttcccatctcccaagcttaaggagttagacgcagcagcagcggtgccatctctgggttaattattcagaatgaggggcccagctaggaggccgatcgttgccgtcaagtcatggctccggcggcagccaacaaaggtgaaggctttcttggccgtcattgccggcatggctgctctcgttgttctccgtgcaattgtacacgatcatgataacctttttgtcgctgccgaggctgttcattctattggaatttctgtcctcatctacaagctcatgaaggagaaaacttgcgctgggctttcactcaaatcacaggatttaacagctttgtttttggctgttagactgtattgcagttttgtcatggaatatgatatacacactctgcttgacctagctaccttggcaacaaccttgtgggttatttatatgattcgttttaaacttagatcaagttacatggaagacaaggacactgttccactgtactatgtggtagttccttgtgccgttttagcttttctaattcacccatcaacatcacatcacatcgtcaacaggattgcctgggcgttttgtgtatacctggaagctgtttccgtgtttcctcaagtgcgagtcatgcaaaacacaaagattgttgagccattcacatctcactatgtatttgcactgggagttgcaaggttcttgagctgtgctcattgggttctccagatgattgacagtcgtggccatctgctgacggctttgggttatggattgtggcccgtgatggtgctggtttctgaaatcgttcaaaccttcatcttatctgacttctgttactactatgtgcaatgtgttcttggaggagagctggtgttacgactaccttctggagtagtatgaaggaggaaacacttgatgaacagagaggagcagtctcagaaaagaaaaaaaagataccattgctattggttttgtttgaagttgtagtgtgttatttaatggctctccacacagagcagtccatgttggttgcttttgtgttttggtttaaaaaaacaagtagatgaatggtctgtaagaaacaaacaaacattggcagggagagagggagagagtcacagtgacagtgaaagcagccagcttaatcaatggtattttcaggaaaaaccactatttatgttagtatctgtttaatcctccttaattgatgttttattaaactgaggtaggtaatattgaactgaaactcataatgatgcagaaacgggatgttggt

SEQ ID NO: 2257 - DNA, 1002 bp, Castanea mollissima
acaccactcgtagagagagaggcaatgaagggagcgaagacaccgatccacgcggtggcgatgtgggtacggaggcaaccgccgaaggtgaaggcgtttctggcggtggtttcgggcattgcggcgcttgtgttcctgcgactggtcgttcacgatcacgacaacctttttgttgccgccgaggctgttcacgctcttggaatctccgtcctcattttcaagcttaccaaggagaagacatgtgctgggctttcactcaaatcacaggaactaacagctatatttctggctgttagactctattgcagttttgtcatggaatttgatatacacacactacttgattctgcaacattggtgacaaccctctgggttatctatatgattcgttttacattgaagtctagttacatggatgataaagacaacttcaaatcttactatgtgttgctaccttgtgctgtgctatcattattaattcatcccacaacgcagcatcatatcatcaataggattttatgggcattctgtgtttatcttgaagctgtttcagtgctaccccaactgagggtaatgcagaacacaaagattgttgaaccattcacagcacattatgtatttgcactgggagttgcaaggttcttgagttgtgcgcattggattctccaggtattggatactcatggccgcttgctgactactttgggttatggtttgtggccttctatggttctcctctctgaaattgtccagacgttcattcttgcagatttttgttactactacgtcaaaagccttgttggcggacaacttgttctgcgcctcccctccggagtggtgtaagcttgaaatgctgcaatcttttttatataaatatatagttcagttgaatcattcaaccttggcaagttgatcatgtaatgtcattgatagtatttagcagttaggaggtttagatggtttcttcttgacatgatgtaagtttcgtgagctatcctctac

SEQ ID NO: 2258 - DNA, 1382 bp, Cirsium arvense
tgaggccaccaaagaggacgatccacgtgatatcgtcatgggtacggcggcaaccaccaaaggtgaaagcttttctcgccgtagtcactggcatggtggccttggtattactacgtgtcatcgtccacgatcatgacaatctcttcgttgctgccgaggctgttcactccattggaatctccgtccttatctataaactcatcaaggaaaaaacttgtgctggtctatcactgaaaacacaagaactaacagctatgttcttgggtgtgagactgtactgcagttttgttatggagtatgatatacacacgttgcttgatatggctacattggctacaacactatgggttatctttatgattcgttttaaactgaaatcaagctacatggaggacaaagacaactttgcaatgtactatgtggcggttccttgtggtgtactagctttgttagttcacccatcgacatcacatcatattataaacaggatattttgggcattttgtgtttatcttgaggcagtttcagtcctacctcaacttagggttatgcagaatacaaagattgttgaaccattcacggcgcattatgtatttgctttgggtgttgcaaggttcttgagttgtgctcattgggttcttcaggtattggatagtcgtgggcatctacttacggccctgggttatggattatggccatcgacggttcttatctcagagatcgttcaaacgttcatattagcagacttttgttactactacatgaaaagtgtttttggaggacaacttgttttgcgactaccttctggagtggtgtaagcaatttgaagtaatagatttctatatatagtaagtaagtagttgattagatccatgatttgtattgtacattttgtgacattgtttcctatattattaatttacaaacgctagtagtaatatttcaaaaaagaaaaaagtaagtaattcagatggtactttataaaagtatgaaagagcatcaagcatatcctacatacatttctagaggaaatgcgatttcggttcataagaaatattatctttctttatgctacttagcaagcagggtttgctaacaagctttaagcttggttttcttggttttgctggtagttgagaggcctcctatagagcatgatgtgtggctctggtttgtgaatcgcatagtgcacccacccacgactctgttggactcctatggcacgccattcactctcagaaagaagacgattcttgggaaggagtttcgcaacttcgggtggaagaaccacatgccgatactcgaaggtatcatcaaaatatttctcagagtactggatctggcccatgatccctttgatttctcagattcgaaaaattcct

SEQ ID NO: 2259 - DNA, 1134 bp, Euonymus alatus
cggccggggcagttgcacacggagagaaaggggaaggacaagtacaatgaaggcaacgaagaggccgatccacgcggtggcgaaatgggtccggcggcaaccaccgaagatcaaggcattcttggcggtgatgtcaggaattgctgttcttttgtctcttcgactgatcgttgaagatcacgacaacctctttgtagctgccgaggctgttcacgccattggaatctccgtcctcatctacaagctcatgaaggagaagacttgtgctggactttcactcaaaacacaggaactaacagctatgtttctagctgttagactctattgcagctttgtcatggaatatgatatacatacattacttgactcggctacactggcaacaactttgtgggttatatatatgattcgttttaagctgcggtccagttacatggacgacaaagacaactttgcaatttactatgtggtgataccttgtgctcttctgtctttagttattcatccaaccacccagcataacatagttaacaggatttgctggggtttctgtgtttatctggaagctgtttcagtactccctcagctacgggtgatgcagaatacaaagattgttgaaccattcacagcgcattatgtgtttgcacttggagttgctaggtttttgagctgtgcgcattgggtccttcaggtgttggatactcgaggacgcctactgacagccctgggttatggattatggccttccatggttctcctatctgaaattgtccagactttcattctcgcggatttttgttactattacgtcgagagccttgttggtggacaacttgttctgcgtcttccgtccggagttgtatgaattcaattcacagaggttggaagtagaagactggcaatgtagcattcacaacttccactgggaatttaagtgccttttcttctctgaccaaaatagtttgtacactcatttctcctttgttgcttatagagagagtcctgcttagtaggtggacctagaagttggcattcgttaaattttgactggagctattatgttaaaaaaaattgtgctgcattagtctggcttgaaagaattaagacagaatccaaccataaactctatcataa

SEQ ID NO: 2260 - DNA, 1118 bp, Panax ginseng
ggtatcaacgcagagtacatggggagagaaacaaggacaggacacagcatgagaccaccgaggaggccgatcaacgccgtattgacatgggccaagagacaaccgccgaaggtcaaggcttttatcgccgtcgtctccggcatgatctcactggtcttgcttcgaatcatcgttaatgatcacgataacctctttgttgccgctgaaattgttcacttcattggaatctctgtccttatatataagctcatgaaggaaaaaacttgtgctggactctcactcaagtcccaggagctaacagcattgtttttggctgttagactgtactgcagtttcgtcatggaatatgatattcacaccttgattgatttagctacattgggtacaaccttgtgggttatatatatgattcgctttaaactgaggtcaagttatatggaggacaaagacaactttgcaatatattatgtggtggttccttgtgcagtgttagctttgttaattcatccatctacatcacataatttaattaacagaattttctggggattttgtgtatatctagaatctgtttctgtgctacctcaactatgggtcatgcaaaatacgaagattgttgaaccattcacatctcattatgtatttgctttgggtgttgcaaggttcttgagctgtgctcattgggttctccaggttttggacactcgtggccatctgcttactgctctgggatatggactgtggccttctatggttcttatctcagaaattgttcaaacattcatattagcagacttctgttactactacgtaaaaagtgttattggaggacaacttgtattgcgccttccttccggagtagtttaatggaggatgcagccattgaaaagttgacttaaatatggtggtttatgttctttagttgttttctggtctccgcacagtccatgttgatcaatggttcttccatgtagtgatgaatgaaaattagttaagtggatgacttgtagagatgggaatgtggaattttaatggatatctaaattaaacttcttgttacccagaattaaaatatctttattctttgctgtctatgattcatactggatgtgttgggt

SEQ ID NO: 2261 - DNA, 1139 bp, Primula obconica
tctctctctctctctttctctctcatctctccggcgtgttccgccgtcgcgatccgataaacgatgagggcggcgcgcaagaacccgatccacggcgtgtggatgtgggtccggcgacaacctccgaaggtgaaggctttcctgggcgtggtcgccggcatgtcggcgctggttctgctacgtgtcatcgtacacgaccacgacaacctcttcgtcgccgccgaggctgttcactccatcggcatctgcgtccttatctacaagctcatcaaggaaacaacttgcgcagggctctcgcttaagactcaggagttgacagccatatttttagcggttaggttgtactgcagctatgtaatggaatatgacatacacaccttgcttgatttatccacgctggctgcaaccctatgggttatatatatgattcgtttcaaacttaagtcaagttacatggaggacaaagacaacttacctatatattatgtgttggcaccctgtgctgtgttggcttttctaatccatccatcaacatcacatcatttcgtcaacagaattttctggtctttctgtgtatatttggaagcagtgtctgtgctaccccagctgcgcgtcatgcaaaataccaagattgttgaaccatttacagctcattatgtattcgccttgggcgtcgccaggtttttgagctgtgctcactgggttttgcaggttttggacactcgtgggcgactgctcactgctatgggttatgggctatggccctcaatggttcttttctccgaaattgttcaaactttcatattagcagacttttgttactattatgtcaaaagtgtctttggaggtcagcttgtgcttcgtctcccttcgggagttgtctaactgaaaagtgaaaactatacaatggtgcatgcatcgaagctaagcaacttgggtgctcatatattcaattactcttgctctgcacacagtttgtcttcctcgaagctttattaatggttagttatcataattagttttgtatattttggggatgcaagaagccgtaacggcaattacttagattttaacctaaaagcaaaagaagacttggatgttcaattgagtttttttaaagagtttaaatgtttaattga

SEQ ID NO: 2262 - DNA, 864 bp, Euphorbia esula
ctcaaacacatcttcccctattttacctctctttccggagaaacgtccacagaattctccgatgagggcgcataacaggccgatctacgcgctcacaacatggctgcggcgacaaccgcccaaggttaaggcttttttggcggtggtcgccggaatggctgcgctcgttctcctccgattcatcgtacatgaccatgacaacctcttcgtcgcttccgaggctgtccactccataggcatcgttgtccttatttacaaactcatgaaggagaaaacttgtgctggactatcacttaaatcccaagaattaacagcaatgtttttagctgttaggctgtattgtagttttgtcatggaatacgatatacatactatactcgacttggctacattggggacgactttgtgggtcatatatatgatccgtttcaaattgaagtctagttacatggtggacaaagacaactttgctatatattatgtggtggtgccctgtgcagctctggcttttttaatccatccatcaacatctcataatttcataaataggatattttgggcattctgtgtgtaccttgaagctgtctctgtactacctcagttgagggtcatgcagaatacaaagatagttgaaccatttacagctcattatgtatttgcacttggtgttgcaaggttcttgagctgtgcccattgggttctccaggtattagatagtcgtggacacttgctggtagcattggggtatgggttatggccttctatggttcttatctctgaaattgtccagactttcatcttagctgacttctgttattattacatcaagagtgtatttggaggacaactagttcttcgtcttcc

SEQ ID NO: 2263 - DNA, 1138 bp, Valeriana officinalis
cagcctcccaaggtcaaggctttcctcgccgtcgtcgccggtatgtccgccttggtcttgctccgagtcatcgttcacgatcacgacaacctttttgttgccgccgaagctgttcactccattggaatcgccgttctcatttttaagctcatgaaggaaaaaacttgtgctgggatatccctgaagtcccaggaactaacggctttatttttggccgtcagactatactgtagttttgttatggagtatgatatacacacaatacttgatttagctactttagctgcaaccatgtgggttatatacatgattcgttttaaactgaagtcaagttacatggtcgacaaagacaatttcgcaatctattatgtcgtggggccatgtgcagctttagccctatttattcatccatctacttcgcattatttcgtcaacaggattttctgggcattctgcgtgtatctagaagccgtttctgtgcttcctcaattgcgtgttatgcaaaatacaaagattgtagaaccattcacggctcattatgtatttgcactgggtgttgcgaggttcttgagctgcgctcattgggttctccaggttttggatagtagaggtcatctacttacagccctaggttacggcttgtggccttcgatggttctcatctcagaaattgtgcaaactttcattttagctgacttctgttactactacgtcaaaagtgttttcggaggacagctggtgttacgtcttccttctggagtagtttaatgtcgtaagtaatatatttcgacggttttagttactattttcgtttgtccacatgcccatataaaatatttgctttgttcccaagaaattaaatttaaaaagaaagataatctgtagattttgggaatgtggaacttcactgaatacctgaaattagggctatgtcagttgagaattttctgtgtttttttggttgcgtcagcactgtttatttagttaatttatatgaagtgacgtattttagctctctaaactgtatatgaatgcgagtgtttctgtttccttaccagtgttgttgtaataactagttaatgcatttcatgttagactcggaaaaatgagtttttattaattgaattctaatctctag

SEQ ID NO: 2264 - DNA, 1260 bp, Citrullus lanatus
aaaaaacccctgactcagatacgttgacccgaaacccaattcagccaacgcccattcgcaatatttctctgaaatctcaaacaagtgtggacgcaccaaatttcatcgtccgctgttcacctgtttttcccttcgtcggttgctcgccgcagaacctcaacttcgccggaagatcaaccctccgccgcctccggttagctctgcaaccgaacagtagaagaagggattacactcatctcatttcatgaggccggcaagaaatccgatccacatcgtgtcggtatgggtccggcgacagccgccgaaggtgaaggcctttttggccgtcgtgcttggcatggtggctctggtggcacttcgattcatcgttcatgatcacgacaatttatttgtcgttgccgaggcagtgcactccatggggatatcggttctcatctataagttcatgaaggagagaacatgtgctggaatatcgcttaagtctcaggaattaactgctatcttcttggccgtgaggttgtattgtagttttgttatggagcatgatatacacaccctattagatttagcaacactggccacaaccctctgggtggtatatatgatccggttcaaacttaagtcgagctacatggaggataaagacaactttgcattatattatgtgatagcaccatgtgctgtattggctttacttattcatccatcaacttctcatcacttagttaacagagttttctgggcattttgtgtgtatctggaagctgtttcagtgttgccccagttgcgagtgatgcagaacactaagattgtcgaaccgtttactgctcactatgtatttgcattgggaattgcaagattccttagctgcgctcattgggttctccaggtcttggatagtcgtggacatcttctagtagctctcggttatgggttatggccatctatggttctaatctcagaaattgtgcagacttttatcctagccgacttctgttactattatgtgaagagcgttttggggggacagctcgtcctccgactcccttctggagtggtgtgacgaatagatgtcgtgtcatgtgctgttgtccatagccaggccaagttcttttcttgatctgtttgcgggtatctggttgatattgttattataacttgaaatcaccttggctgcatgtaaagttgattattcaagaagattgatgatttatcaaattccagttcttaatagtatttagtttcacacccttagaagtt

SEQ ID NO: 2265 - DNA, 1080 bp, Cucurbita pepo
ctctcttcgtcggttgctcgccgcaaactaaatttcgccggaagatcaatcctccgccgcctctgatcaggcctgcaacaaaacagaaaaagaaaggattggagttatctcatgaggccgtcaagaaatctgatccatatcgtctcctcatgggtccggcgacagccgccgaaggcgaaggcctttctggccgtcgtgcttggtatggtggctctggccgttcttcggtccgttgttcacgatcatgataatctatttgtcgctgccgaggcagtgcactccattggaatttcggttcttatttataagctgatgaaggagaggacttgtgctggaatatcactcaagtctcaagaattaaccgctatttcttggctgcgaggttgtattgtagttttgttatggagtatgatatacacaccatattagatttagcaacactggccacgaccctctgggtgatctatatgatccgtttcaaacttaagtcgagctacatggcggataaagacaactttgcattatattatgtgctagcaccctgtgctatcctggctttacttgttcatccatcaacttctcatcactttgttaacagagttttctgggcattttgtgtgtatctggaagccgtttcggtgctaccccagttgcgagtgatgcagaacactaagattgttgaaccatttactgcccattatgtatttgcattgggtattgcaagattccttagctgcgctcattgggttctccaggtcttggatagtcgtggacatcttctagtagctcttggatatggtttatggccatctatggttctgatctcagaagttgtacaaactttcatcctagctgacttctgttactattatgtgaagagcgttttgggcggacagcttgtcctccgactcccttctggagtggtgtgatgaaccattgttgtgtcatgtgcttttgtccatagccaggccaagttcttttcttgacatgtttgcgggtatgtggttgacattgttattataacctgaaatcaccttggctgcatgtaaatttaaacattcaagaagattgatgatttat

SEQ ID NO: 2266 - DNA, 1197 bp, Amsonia hubrichtii
acgctgaacaatttcaccgaggagtcagaacgataaggagaaaaggggagggaaggggcgatcatttactccattttcaactagattaggaggaaggtataaaggcggcagcagcagcttcaccgggataagaatgaggggcccagctaggaggccgatccttgccgtcaagtcatggctgcggcgccagccaccaaaggtgaaggctttcttggccgtaatttccggcatggctgctctcgtcgttctccgtgcaatagtccacgaccacgataatctctttgtcgccgccgaggccgttcattctattggaatttctgtgctcatctacaagctcatgaaggagaaaacttgcgccgggctttcactcaaatcacaggatttaacagctttatttttggctgttagactatattgtagttttgtcatggaatatgatatccacactctgcttgacttagctaccttggcaacaaccttgtgggttatttatatgattcgttttaaacttaggtcaagttacatggaagacaaagacagtgttccactatactatgtggtagttccttgcgctgttttagctttactaattcatccatccacatcacatcacatcataaaccggattgcctgggctttttgtgtatacctcgaagctgtttctgtgtttcctcaggtgcgagtcatgcagaacacaaagattgttgagccgttcacatctcactatgtatttgcattgggagttgcaaggttcttgagctgtgctcattgggttctccagcttattgacagtcgtggccacctgctgacggctttgggttatggattgtggcctgtgatggtgctggtttctgaagttgttcaaaccttcatcttatcagacttctgttattactatgtgcaatgcgttcttggaggagagctggtgttacgacttccttctggagtagtataaaggaacaatcttacgaacaaagcagtcacaaaaattaccattgctggtgcttttgtttgaagtagcagtctcttatttatggctctccacccggtccatgtcggtcccttatttgtttggtgtcaaaaacaagtcgattcagtggtctgtaacgttggcgagtcccactttgaaagctaaatcaatgatattttcagtgaacagatttatattttgagctctaatttatcaattgataattt

SEQ ID NO: 2267 - DNA, 1355 bp, Arabidopsis lyrata
gtaagaaaaaaggagtgaattttagctctatggttgcgttaccaatttctccagtttccccactccacctccaaaaagattaaaatttaaaagacagtgtaagcataataatcacctgatcaattcacacataaaagagacagatctgttttttttcttacaatcatcgtaccaagttcctaaaggtttcgactttactgtttctattttcggaaagaaagtgaatgattgaatcgaagatgaaggcggcgaagaggccgatccacgccgtgacgacatgggttcgtcggcaaccaccaaaggttaaagcttttctcggtgttgtatccgccatgactgctctcgttttgttgagaatgattgttcatgaccacgacaatctttttgtcgctgctgaggctgttcatgcccttggaatctccgtccttatctataaactcaccaaggagaagacttgtgctggattatctctcaagtctcaagagctaacggctctgtttttggcggtgagattgtattgtagttttgtgatggaatttgatattcacacgttgcttgattcggctacattggtgactacactttttgttatctatatgatccgttttaagctcaaagctagttacatggacgacaaagacaattttgctatctactacgtcgttattccatgtgttgttctatcagttctcattcacccatcaacacatcatcatataatcaataagatttcttgggccttctgcgtttaccttgaagctgtttcagtccttcctcaacttagagtcatgcaaaacactaagatcgtggagccattcacagcacattacgtattcgctttggggatcgctaggttcttgagttgtgcacactgggtccttcaggttttggacactcgagggcggttattgactgctttaggatatggtttctggcctataatggtcctcttctctgaaatcgtccaaaccttcattctcgcagacttctgctactactatgtgaagagtttaatgggtggtcagctcgttcttcgtctcccatcaggtgttgtgtaaaatttggtggaaacgagataagaagaagatatggagttgcttaagcttatgatgtggagtaatgatctatctcttgcaggctaatcgttttgagtcttctctaatctctttttttcttccctttatgttttttttctttcttggaggacttgtaaagaaaaaagaaaattgattatagattatgagttttgacattaatttgaaaattagtctcagcttttaatatattatgtagtttaatgttgtttccagaagcaattagatgaatgctttggtgtgagagggattatgaatcat

SEQ ID NO: 2268 - DNA, 1370 bp, Phaseolus vulgaris
gaagtgcgtaaaacgggttttgtccctggcagtttgggtggggaattgcagcgactcaaagtcgacgttgacgttgaaattgattgagttgtgccctaattcagaatttggggaaagaaacgcatgcaaccatttcaattaggaagaaacgcaattcaaatcaaataataaacaattgaacaaattaattgaatcggaggaaatagaaagcgaaagcgaaagagaaagaagggatcatgaggggtgggaaaaaatcgatccacgcaatcatcacatggatgcggcggcaaccaccaaaggcgaaggcttttatcgccgtcgtgtccagcatggcggctctcgtccttctccgcatcatcgttcacgaccacgacaatcttttcgtcgccgccgaggctgttcattctattggaatctctgttctcatctacaagctcatcaaagaaaaaacttgtgccggattatcactcaaatcccaggaattgacagctctgtttttagctgttaggctgtactgcagttttgtcatggaatatgatatacacaccctgcttgatttggctacttttgcaacaacattgtgggttatatacatgattcgttttaaattgagatccagttacatgcaggagaaagacaattttgctatatactatgtggcggtaccctgtgctgtgttagccttgtttattcatccatcaacttcacatcatttattgaacaggattttctgggcattctgtgtatatcttgaagctgtctcggtactgccccagctgcgagtcatgcagaacaccaaaattgttgagccattcacggcacattatgtatttgccctgggtgtggcaagattcttgagctgtgctcattgggttcttcaggtgttggatagtcgtggacatttgttggttgccttgggatatggtttatggccatcaatggtgcttatttcagaaattgtccagacctttatcttagcagatttctgttactattatgtccaaagtgttttcgggggacagcttgttctccgtctaccttctggagtggtgtgattcacgattcacttcattgcatacttgcatttacgtgaacttaatcaagcaatatttgtagtttggaagaatctggttcattgtaaagttagagattaaaggaaaaatagatatttatgctgaagggacattatttgtagttggaaatgctataatacacataatgtgtctatttgctcagctcttcaaattcagttgttgacagaacatttctgcgttaagctttgttaactgcttgagttgagacaatgagggtgggtggggatgtaacactccataatttacatataactattacaataaaagttctaccag

SEQ ID NO: 2269 - DNA, 1391 bp, Cephalotaxus harringtonia
agcgaaataagaggcagattatagccacgggcatcgtactttttccaaagcgaagcattgaaatgaagtgctgggaagttcggtgcggtgaataggactgcgtcgaatcggggatcgtctctgctgcattggatatcagaaatggtgacgatgaggaaatcgaggagaaatccaataaatgcgatatgggtatgggtcacaaggcagcctcccaaagtgaaagcatttttagcagtagtgagtggcatcctagcccttgtcattctgagattcgtcgttcacaaccatgataatctcttcattgctgccgaagcaatccatgctgttggtattgcagtcttgatctacaagctcatgaaggagaaaacttgcgcaggcttatcactaaaatctcaggagcttactgcaatgttcttagcagtacgggtgtactgtagttttgttatggaatatgatatacacacggtacttgatactgcaacattagcaactactttgtgggtgatttacatgatacggttcgagctgaaggcaacacatgtggaggatttggataattttccgatactctatgtggtgcttccttgtgcggtacttgcacttgctatccatccatccacgcaccataatatcgtaaacaggattctttgggccttttgtgtctatcttgaagctgtagcagtattgccccagcttcgtgtgatgcaaaatacaaagattattgaaccatttacagcccattatgtgtttgcactaggtgttgcaagatttttgagttgtgcgcattgggtactccaagttttggatagccgtgggtacttgttgacagctttgggtcatggcttatggccatccatggtgctcttgtcagaaattgttcagacttttattttggccgatttctgttactactatgttaaaagtgttgtaggtggtcaacttgtgctgcgacttccttctggagtggtgtaattggtattgccattgcgaaaaatgtgacgggatttgtgcaggcttcattccgagtcagatctgttgacaatgctttttgtgcttaagttaagtcatgaatctttggagaaatttattgacatcaagtcatagttgtaggcgtttttcatttggatggttaggaagattcaaggtttgagatagttactgcatgatgctgctgcttcccgtctaattttcgtgatttgtcttagatgaatatatggaacttttaagtactattggtacatcttcctgtgagtttgcatcagcaatgaatctgttttctaagctctgtttctgtaaagtttttgtagctttgtatatatttgctgtgttaattaataatctgcaatctaggcatttgctatggatttgaaatcctcagctggattgtatat

SEQ ID NO: 2270 - DNA, 1195 bp, Capsicum annuum
aaaatatccgaacgctccaatatattcaatttatcgccaatttgcacaatcaagaaagcagaatgaaggcgccgaggaggccgatccatgccgtgtcaacatgggtaaaacggcaaccaccaaaggtaaaggcttttctggcggtgatatccggcatggcgattctggtgctgctacgtgccattgtccatgatcacgacaacctttttgtcgccgctgaggctgttcatgccatcggaatctccgtccttatctataaactcatgaatgaaaaaacttgtgctggaatttcactaaaatcccaggagctcactgctctgtttttggctgtcagactgtattgtagttttgtcatggaatatgatatacataccttacttgatttagctacattggggactaccttgtgggttatttatatgatccattttaatcttaaatcaagttacatggaggacaaagacaattgtgcaatttattatgtggtgatcccttgtgccgtcttagccttactaattcatccatcaacatcacatcacattatcaatagaatcttctgggctttctgtgtttacttggaggcagtttctgtgcttcctcaacttcgtgtcatgcaaaatactaagatagttgaaccattcacagctcattatgtatttgcgttgggtgttgcgaggttcttaagctgcactcattgggttctccaggttttggacagtcatggccatttactagtagcattgggtcatggtctatggccttcaatggttcttttttctgaaattgttcagacattcatcttagcagacttctgttactactatgttaaaagtgtttttggtggacagctggttttgcgccttccttctggtgtcgtgtagctgaagtttgtgctaagtgatggataaatttagcgtaccactcttgccttgcatttgcttattttgtgtatcctacacaagtccaacttgatctaggttctccaagggcatgatcaaggtggctgttcttgtaaagctagcactaagctagcactatgtaaatgaggtagttgattctgtggcaatcatagttttaacttttttctttatgggcttaaattttaaggcttcagaaagggtagttacacttctagttctcatgaactaagttgaatgattaatctgacataagcatagtgcctgtttaatgacaa

SEQ ID NO: 2271 - DNA, 1873 bp, Cajanus cajan
aaaaatggtgtggcctttgaaggagaggagggggccagcatggaagcaagggtggacaataagcactctctcctcgctatctgcacctccgttgcagctggtggccatagtcggcatcgtcatgtttctgttgtttcttccgtcttacataaacttcaagtccaccctgcacacagccaccatagccttccacgtgttcctcttgtttctgccccttttcttgattttaattgcctacaccatctctaagcatgggccacgcctcctggttccgccgccgccgccgttctccggtggcatacgactgcgaacaccaccgggggggtttccttggggcgtagcggcgttggtggtcttgcttttggttctcgcctcctacctctccgatttccggtccatgtggtcgccactcatttcgagaccctactagaattcctaccatcatatcatatcatatatggccccaggtgaaaatgttttgcattaatgggccattacgaaattggtaagtgggccatgtaaatgcaattgaaggtgtagggaggagatgatgtgggaacaagagtcgttgagcaacccacgtcccacacccacccgtcgcataactaataagtaataaacacgcacctcaaaccacatgcacacgtgtcccctcaaactcatgttgaagtcggaacatagatgagaagagatgagattagacaaatttaccttgcgaaggaagaaggactatagagaagagaagaagataaaggatttaattgttaggaaatgaagggaagcaaaaggtcgatccacgccgtcacgacatgggttcggcggcaaccgcccaagatgaaggcctttctcgccgtcctattgggcctcgccgccttgctcttcctcagaatcgtcgtccacgaccacgacagcctcttcgtcgccgccgagtttgtccatgcattaggaatctccgtcctcatttacaagctcaccaaggaaaaaacctgcgccgggctttcgcttaaatcgcaggagctgacggctatgtttctaggtgttagactctactgcagttttgtgatggaatatgatatacacaccatacttgatatggctacattggtgaccaccctctgggttatttatatgatacgcttcaagctgaaagctagttatatggatgataaggacaaccttgcaatataccatgtggtgataccttgtgctttgctgtccttgcttattcatccgacaacccggcatcacacagttaataggattctctgggcattttgtgtttatcttgaagctgtttctgttcttcctcagttgcgggtcatgcagaacactaagattgttgaaccattcacggctcactatgtttttgccctcggagttgctaggttcttgagttgtgcacattgggttctccaggtattagatactcgtgggcgtctacttactgcattgggttatggattgtggccttctatggttcttctatcagaaattgtccaaactttcatcctggcagatttttgctactactacgtcaagagtcttgttgggggacaactggtacttcgacttccttcaggagtggtgtaactttattcatgatcagatccctcaagttggacgttcatatagcatgcagcacccaggaagtcagtatcgctagaggagcttgatatgttttgtatctgcggtccttgagtgaacagagttgagaatgtaacatacatgtaacttcgttgaaattttaatatttatctttgatcagttcaggttagtattggtggtaaacagatatcaatatatcaaatataatttgatacgagcaaaagttatttaaaggtgttttaaactcgaaatcaaaattttggagtcg

SEQ ID NO: 2272 - DNA, 1199 bp, Tabernaemontana elegans
ctagtatcttttgtcgtcccccaaacgcggagcaattccacggagaagtcagagcgattaggagaaagggaagagaaagggcagatagatcatttactccgtttccagctagattaggaggaggagggaaaaggcagcagcagcagcagcagcagcggaataagaatgaggggcccagctaggaggccgatccttgccgtcaagtcatggctgcggcgacagccaccaaaggtgaaggctttcttggccgtcatttccggcatggctgctctcgttgttctccgtgcaatagtccacgatcacgataacctttttgtcgccgccgaggccgttcactctattggaatttccgtcctcatctacaagcttatgaaggagaaaacttgcgccggactttcactcaaatcacaggatttaacagctttatttttggctgttagactatattgcagttttgtcatggaatatgatatacacactttgcttgacttagctacattggcaacaaccttgtgggttatttatatgattcgttttaaacttaggtcaagttacatggaagacaaagacagtattccaatatactatgtggtagttccatgtgctgttttagctgtcctaattcatccatctacatcgcatcacattgtcaacaggattgcctgggctttttgtgtatacctggaagctgtttctgtgcttcctcaagtgagagtcatgcaaaacacgaagattgttgagccattcacatctcactatgtatttgcactgggagttgcaaggttcttgagctgtgctcattgggttctacagcttattgacagtcgcggccatctgctgacggctttgggttatggattgtggcctgtgatggtgctggtttctgaagttgttcagaccttcatcttatcggacttctgttactactacgtacaatgtgttcttggaggagagctggtgttacgacttccttctggagtagtataaatgaacaatcttatgaacaaagcagtcgcaaaaaattaccaatgctgttgctttggtttgatgtagtagtttattttatttatggctctccacgcggtccacgttggtcgcttttttattcagtgtcaaaaacaagaagtcgattcaatggtctgtaatgtaggcgagtcacattttgagatcttaatgaatgatattttcagcgtacatat

SEQ ID NO: 2273 - DNA, 1268 bp, Eutrema parvulum
gttagtaaaaaacagagtaatttttagttatgcgttacccttttcaagttcccacttcataagaaataatatgtaataatcacccgatcgtcccaaaaataaatccgcagacaaaagaggcagatctggtttcttataatcaccgtaccaagttacgaaaggattctactttactgtttctatctttggaaaggaagtgatgaacgaatcgaggatgaaggcggcgaagaggccgatccacgccgtgacgacatgggttcgccggcaaccaccgaaggtcaaagcttttctcggtgttgtttcagccatgactgctctcgttttcctaagaatgattgttcatgatcacgacaaccttttcgtcgccgccgaggctgttcatgccctcggaatctctgttctcatctacaaactcaccaaggagaagacttgcgcaggattatctctgaagtcacaagagctaacggctctgtttttggccgtgagattgtattgtagttttgtgatggaatttgatattcacacattgcttgattcggctacattggtgactaccctttgggtcatctatatgatccgtttcaagctcaaagccagttacatggaagacaaagacaattttgcaatctactacgtcgttataccatgtgctgttctatcagtactaattcacccatcaacgcatcaccatataatcaataaaatctcttgggccttctgcgtttaccttgaagctgtttcagttcttcctcaacttagagtcatgcaaaacaccaagattgtggagccattcacagcacattacgtatttgcattggggatagccaggttcttaagttgtgcacactgggtccttcaggttttggacactcgagggcggttacttactgctttaggatatgggttttggcctataatggtcctcctctctgaagtcatacaaaccttcattctcgcagacttctgctactactatgtcaagagttttatgggtggccagctcgttcttcgtctcccgtcaggtgttgtgtaaaatttgttaaagaagatacggtttggctttaagcttatggtatctgtagtttggcactacgtttttttgcaggccatcgttttagtcttctttaaaactcctttttggtacttttatgtttctttcttggatcactgtaaagaaaaaaaggagttcattagagattttgacaattatcaattcaatattagccattcagcttttaatctcttacatcttgttttagagaggaaaa

SEQ ID NO: 2274 - DNA, 1192 bp, Nicotiana tabacum
aagcagcatgacgccgccccggaggccgatccacgccgtctccacatgggtccgccggcaaccgccaaaggtcaaggcttttctggcggtcgtccccggcatggcggcgctcgtcctcctacgcgccatcgtccacgatcacgacaacctcttcgtcgccgccgaggctgttcaccccatcggaatctccgtcctcatctataagctcatgaaagagaaaacttgtgccgggctttcactcaaatcccaggagctcaccgctatctttttggctgttagactgtattgcagtttcgtcatggaatatgatatacacaccttacttgatttagctacattggctaccaccttgtgggttatttatatgatccgttttaaccttaaatcaagttacatggaggacaaagacaattctccaatctattacgtggcgatcccttgtgctgccttagccttactaattcacccatcaacatcacatcacttcatcaacagaatcttctgggctttctgtgtttacttggaagcagtttccgtgctacctcaacttcgtgtcatgcaaaacactaagatagttgaaccattcacagctcattatgtatttgcattgggtattgcaaggttcttaagctgtgctcattgggttctccaggttttggacagtcgtggccatctgctcgtagcattgggtcacggtctatggccttctatggttcttatatccgaaattgttcaaacctttatcttagcagacttctgttactactatgttaaaagtgttttcggtggacagctggtcatgcgccttccttctggagtagtgtaactgatgattgtgctggtcatggacagaaatttcacatacgtttgttgccttccttttgcttatctttggtctctctacaaggtcaaaatctggtctagggctctccaggcgtaaaatcaagagtgcggtggtctgtgaagttagtattatctaaaatattttctggtcatcctagattatactttacttttttagcagttagcaatgtcttaaaatgaagcagttgattttctctcaatcctagattactttactttgttagcactaacatcatatggctttcagatatgtactcatttttgtacttatgtaccactgtgaatgattaatgattctgattccgacacaatttatccctgtttgttg

SEQ ID NO: 2275 - DNA, 1045 bp, Aristolochia fimbriata
ggggggggggtaccaaagatgggttcagctcgatcggggaagaatccgatccatgcagttgcaacatgggtgaagagccagcctccgaaggtgaaggcctttttggcggtaatcgccggaatggcctccctcgtctttcttcggcttgttgttcatgaccacgacaatctttttgtcgcggccgaggcttgtcatgccatgggtatatgcgttttgatctacaagctcatcaaggagcgaacttgtgctggtctctcacttaaatcccaggagttgactgcaatttttctggcagtccgtctctactgtagttttgtaatggaatatgacatacacacagtgctcgatgtagctacattggccacaactttgtgggtgatttatatgatccggtttaagttgcggtcaagctatatggaggacaaagataactttgccatatactatgtgctgataccatgtgctgtgctcgcccttcttattcatccttcaacatcacacaattttgtgaatcgaatttcttgggcattttgtgtttacttggaggcagtgtcagttttaccccagttgcgcgttatgcaaaatgcaaagattgttgaaacgtttacagctcattatgtctttgcattgagtgtttctcgcttcctcagctgtgcacattgggttctccaggtcatggacagtcgtggataccttttgactgcactaggtcatggtttatggccttcgatggttcttctttcagagatcgtccaaacgttcattttggctgacttctgctactactatgtcaagagtgttgtaggtggtgatcttgttctgaggcttccgtctggtgtagtctgaaacaattgccagctgaagttggctacggatgatttattaactctttcaactctctgtagatattataaacaattctggtgacaattcaaatgttaaatatttgcttaacataatcactctctgatctaggttgttcttttccaagtaatgaagataacgaattttatattgtgataacacatctttttccttcttgtca

SEQ ID NO: 2276 - DNA, 942 bp, Glycine max
atcaattaatctgctggaaaacaaaaaaatgaagggaagcaagaggcccatccacgccgtcaccacatgggttcggcgccaaccgcccaagatgaaggcctttctcgcggtgctgtccggcctggcagccctgctcttcctcagaatcttcgttcacgaccacgacagcctcttcgtcgccgccgagcttgtccatgcgttaggaatctccgtcctcatttacaaactcaccagggaaaaaacctgtgccgggctttcgcttaagtcgcaggagctgacggctatgtttctaggtgttagactttattgcagttttgtgatggagtatgatatacacaccctactcgatatggcaaccttggtcacaaccctttgggttatttatatgatacgcttcaaattgaaatccagttatatggatgataaggacaaccttgcaatgtactatgtggttataccttgtgccgtgctgtccttgcttattcatccaacaacccggcatcatccacttaataggattctctgggcattttgtgtttatcttgaagctgtttctgttctccctcagctgcgagtcatgcagaacgcgaagattgttgaaccattcacagcacactatgtttttgcccttggagttgcaaggttcttgagttgtgcacattgggtcctccaggtattagatactcgtggacatctactgactgcattgggttatggattgtggccttttatggttcttctatcagaaattgtgcaaactttcattctggcagatttttgctactactacgtcaagagtcttgttgggggacaacttgttcttcgacttccttcaggagtggtgtaacttaacattcaagtaggacgttcctttaacatgcagcactcaaggaagtcagagtagctagttaatcttttgatatgttatgtatctatctgcgg

SEQ ID NO: 2277 - DNA, 975 bp, Ambrosia trifida
cccccaactttactccccaaactacagccacccaaactactacccactaaaacctaaccaccgatctttataaaacatgaggccaccaaagaagacgatccacataatctcatcatgggtacaacgccaaccacccagggtaaaagcctttctagccgtagttaccggcatgttggccttggtgttgctacgtgcgattgtgcacgatcatgataacctctttgttgctgctgaggctgttcactctattggaatctccgtccttatttataaactcatcaaggagaaaacttgtgctgggctatcactgaaaacacaagaactaacagctatgttcttggctgttagattatactgcagttttgttatggaatatgatatacacaccttgcttgatttggctacattggctacaacattgtgggtcattttcatgatccgtttcaagctcaaatcaagctacatggaggacaaagacaacttcgccatgtactatgtggtggttccttgtgcggtactagctttgctaattcatccatcaacatcacatcatatgatcaacaggatattttgggcattttgcgtttatcttgaagcagtttccgtcctacctcaactcagggttatgcagaacacaaaaattgttgaaccattcacggctcattacgtatttgctctcggtgttgcaagattcttgagttgtgctcattgggttcttcaggttttggacagtcgtgggcatctacttacagccctcggttacggattatggccatcaatggttcttatatcagaggtcgttcaaacgttcatactagcagacttctgttactactacatgaaaagtgtttttggaggacagcttgttatgcgtctaccatctggagtggtgtaagtttgaagaaacccagtggcattcaattatacatttgcttcttgttaatttatctttcctccaatacagtaactcttgtg

SEQ ID NO: 2278 - DNA, 1070 bp, Artemisia annua
cagcagccataaatttaaaattatgagaccaccaaagagaacaatcaatattataacatcatgggttcgtcgtcaaccaccaaaagtgaaagcttttttagcagtagtgagtggaatgttagctttggttttacttcgtgccattgttcatgatcatgacaatctttttgttgctgctgaagctgtccattctcttggtatctctgtcttgatttataagctcatgaaggagaaaacttgtgctggcctatcgctcaaaacacaagaactaacagctatattcttagctgttagattatactgcagttttgttatggagtatgatatacacacattgcttgatttggctacattagcaacaactttgtgggttatctttatgatacgttttaaattaaaatcaagctacatggaggacaaagacaacttgccgatgtactatgtggcggttccttgtgttatactagctttggttattcatccatcgacgtcccatcatatcatcaataggatattttgggcatttgttgtttatcttgaagcagtttcagtcctacctcaacttagggttatgcagaacacaaagattgttgaaccttttacggctcattacgtatttgcccttggtgttgcaaggtttttgagttgtgctcattgggttcttcaggttttggatagtcgtggacatttgcttaccgccttaggatatggattatggccatcaatggttttgatctcagagattgttcaaacattcatattagctgacttctgttattactacattaaaagtgtttttggaggacaacttgttttacgtctaccttctggagtggtataagtttgaagcaaatgttgtaattgaagtcaatattgtcttgttactttttaccgtttctccaatacgatctttgcaagaatagtcaatcagtcaggtggatgatgatgttttgtacatttgtgcctttcttatttagaacactaattttactcaagttataacattatgatagtactcaggccggtctatatcttgtttatctatggttctttatattattgaatcactc

SEQ ID NO: 2279 - DNA, 1016 bp, Brassica oleracea
ctggttcgttaaaatctttagtttagtgctacgaaaggtctcgaaaagatgaaggcggcgaagaagccgatccacgccgtgacgacatgggttcgccggcaaccaccaaaggtcaaagcttttctcggtgttgtatccgccatgactgctctcgttctcttaagagtgattgttcacgaccacgacaaccttttcgtcgccgccgaagctgtccacgccctcggaatctccgttctcatctacaaactcaccaaggagaagacttgcgccggattgtctctaaagtctcaggagttaacagctctgtttctggctgtgagactttactgtagctttgtgatggagtttgatatccacacgttgcttgattcggctacattggtgactaccctttgggttatctacatgatccgtttcaagctcaaagctagttacatggaagacaaagacaattttgcgatctactacgtcgttgtaccatgtgctgttttgtctgttttgattcacccatcaacacatcatcatataatcaataagatctcttgggccttctgcgtttaccttgaagctgtttcagtccttcctcaacttagagtcatgcaaaacactaagatcgtggagccattcacagcacattatgtatttgcgttggggatagctaggttcttgagttgtgcacattgggtccttcaggttttggacactcgagggaggttactgactgctttaggatatgggttttggcctataatggttctcctctctgaagtcgtacaaactttcattcttgccgacttctgctactactatgtcaagagtttgatgggtggccagctagttcttcgtctgccgtcaggtgttgtgtaaaatctgttgaagaagagagaagaagacacggtatggcttttgagctcatggtatggagtttggttctacgttttttttgcaggccatcgttttagtcttctgtaaactccttttcttatacgtttttatgtttgtttcttggatgactg

SEQ ID NO: 2280 - DNA, 823 bp, Manihot esculenta
atgaaggcgacaaagaggccgatccacgcagtgactacatgggtccggaggcagccgcccaagatcaaggcttttttagctgcggtttctgggatggcagctttagtttttattcggatggtggttcacgatcacgataacctcttcgttgctgccgaggctgttcatgccattggaatctccgtcctaatttacaagctcatgaaggagaaaacttgtgctggactttcactgaaatcacaggagttgactgctatgtttttagccgttagactctattgcagtttggtgatggaatatgatatacacacgttacttgattcggctacattgataaccacactatgggtgatttatatgattcgcttcaaactgaggtccagttacatggatgacaaagataactttgcaatttactatgtgttgattccttgtgctgtgctatctttgattattcatccaacaacaacacatcatataataaacaggatttgctgggctttctgtgtttttcttgaagctgtttcagtattgcctcagctctgggtcatgcagaacacaaagattgttgaacctttcacagcacattacatatttgcacttggagttgcaaggttcttgagttgtgcgcattgggtgctccaggtatgggatactcgtggacgtcttctgacagcactggggtatggattgtggcctccagtcgtcctcctttcagaaattgtccagacattcattctcgccgatttttgctactactatgtgaagagtctgcttggaggacaacttgttctacgtcttccctcaggagtggtgtaaaggc

SEQ ID NO: 2281 - DNA, 1817 bp, Glycine max
taagaatggtgtggcctttgaaggagagaggaagcaagctagggtggacaagaagcactttgtagtccctatctgcaactcctggccatagttggcgtgcgtcgtcatgtttttgttatttgttccacgtcttcctcttggtcttgcccctcgtggttccattttttggaggcacaagagtaccaacagaagctgggagtagcgcagttggtggccttgctcttggttttggcctcttacctctccgatttcaggtccatgtggtcaccactcatttggagaccctactagttgctactactatcatatatggccattaccaaatgaaagatgcacggaggagatgacgtgggaagaaagtcgttgagcaagtattcacacgtgtcccccaaactacacacattatctccttcctttcttgggaaagtcaatcaattaatctgctggaaaacaaaaaaatgaagggaagcaagaggcccatccacgccgtcaccacatgggttcggcgccaaccgcccaagatgaaggcctttctcgcggtgctgtccggcctggcagccctgctcttcctcagaatcttcgttcacgaccacgacagcctcttcgtcgccgccgagcttgtccatgcgttaggaatctccgtcctcatttacaaactcaccagggaaaaaacctgtgccgggctttcgcttaagtcgcaggagctgacggctatgtttctaggtgttagactttattgcagttttgtgatggagtatgatatacacaccctactcgatatggcaaccttggtcacaaccctttgggttatttatatgatacgcttcaaattgaaatccagttatatggatgataaggacaaccttgcaatgtactatgtggttataccttgtgccgtgctgtccttgcttattcatccaacaacccggcatcatccacttaataggattctctgggcattttgtgtttatcttgaagctgtttctgttctccctcagctgcgagtcatgcagaacgcgaagattgttgaaccattcacagcacactatgtttttgcccttggagttgcaaggttcttgagttgtgcacattgggtcctccaggtattagatactcgtggacatctactgactgcattgggttatggattgtggccttttatggttcttctatcagaaattgtgcaaactttcattctggcagatttttgctactactacgtcaagagtcttgttgggggacaacttgttcttcgacttccttcaggagtggtgtaacttaacattcaagtaggacgttcctttaacatgcagcactcaaggaagtcagagtagctagttaatcttttgatatgttatgtatctatctgcggtcattgagtgaacagttctcaactgcggtctaacttcctaaaattttaatttatcttttgatcagttcgggttagtattggtagttagcagatatcaaaatatcaaatgatcctttggatacgagcaaatgccagttgacaattgatgttaaaagaaatcaattataacaattggagccttgtggtgatggatttgatgggggcaccgtacttgcatacaccagtctcgagccagaactctacttgatcacaccttgtcttacgtatctatcttgcccaagaaatcacaaggtgttttaaggccttgtgcgctttggaattggagcggtttctctgctttccaatttatcctttcacagtccaggaaaagcaataatttgataaattgatccctaaacgtttacaggagaagaaaataagaagaaaaataaacttatttagaagt

SEQ ID NO: 2282 - DNA, 1293 bp, Eutrema halophilum
atggttgcattaaccttttcaagttcccactccaaatccaaaaaaaaaaaacagtgtaataatcaaattgcacataaggcagatctgtttctataatcttcgaaccaagcagccgaaggattctactttactgtttctatctttggaaaggaagtgatgaacgaatcgaggatgaaggcggcgaagaggccgattcacgccgtgacgacatgggttcgccggcaaccaccgaaggtcaaagcttttctcggtgttgtttcagccatgactgctctcgttttcctaagaatgattgttcatgatcacgacaaccttttcgtcgccgccgaggctgttcatgccctcggaatctctgttctcatctacaaactcaccaaggagaagacttgcgcaggattatctctgaagtcacaagagctaacggctctgtttttggccgtgaggctgtattgtagttttgtgatggaatttgatattcacacattgcttgattcggctacattggtgactaccctttgggttatctatatgatccgttttaagctcaaagctagttacatggaagacaaagacaatttcgctatctactacgtcgttataccatgtgctgttctatcagtcctaattcacccatccacacatcaccatataatcaataagatttcttgggccttctgcgtttaccttgaagctgtttcagtccttcctcaacttagagtcatgcaaaacactaagattgtggagccattcacagcacattacgtatttgctttggggatagctaggttcttgagttgtgcacactgggtccttcaggttttggacactagggggcggttattgactgctttaggatatggtttctggcctataatggtcttgctctctgaaatcatccagaccttcattctcgcggacttctgctactattatatccagagtttaatgggcggtcagctcgttcttcgtctcccatcaggtgttgtgtaaaatttgctggagaagagagaagaagatactgtgtggctttgtgcttatggtatggagtttggctctatgtttttgcaggctatcgttttagtcttctctaaactcttcctctgacttttatgttcttttttttttggaggattgtaaagaaaaaaaaggagttgatagattttgacatattaatcttgaatattagcctctcagcttttgattttttactacatattttgttatacgtttagggatgtaaaatttagatggtacgtttactatcttaatttagttttaactttattttggggg

SEQ ID NO: 2283 - DNA, 1246 bp, Vinca minor
ataccaataataagttcacgaaatttccgccgctttaaactactgctcttttaatctttattaacaatttcaggagggtaaattcggaagaagaaagcgggcagctgagattaggagtaggagtagtacgaagggcagaagaagaagaagagaatgaggggcccagctaggaggccgatcgttgccgttaggtcatggctacggcggcagccaccaaaggttaaggctttcttggccgttatttccggcatggctgctctcgttcttcttcgtgtaattgtccacgatcacgacaacctttttgttgccgctgaggcccttcattctattggaatttccgttcttatctataagcttatcaaggagaaaacttgcgccgggctttcactcaaatcacaggagttaacagctttatttttggctgttagactgtattgtagttttgttatggaatatgatatacacaccctgcttgacttggctaccttagcaacaaccttttgggttatttatatgattcgttttaaacttagatcaagttacatggaagacaaagacagtgttccactgtactatgtggtggttccttgtgctgttctagcttttctaattcatccatctacttcgcatcacatcgtcaacaggattgcctgggcattttgtgtatacctggaagctgtttctgtgtttcctcaagtgcgagtcatgcaaaacacaaagattgttgagccattcacatctcactatgtatttgcattgggagttgcaaggttcttgagctgtgctcattgggttctccagcttattgacagtcgtggccatctgctgacggctttgggttatggattgtggcctgtgatggtgctggtttccgaaattgttcagaccttcatcttatcggacttctgttactattatgtgcaatgtgttcttggaggagagctggtgttacggcttccttctggagtagtgtaaggaacaatttatgaaaaaagaagtcacaaaaaataccactgctattgcttttgtttgaagtggtagtagtacttagtttgcgactctccactccgtccattttggttgttttgtttgtttgttcccaagaacaagtcgatccgtggtctgtatcgttcgcgagtcacactgatcaatggtattttctgggaacggataatattattgtttcaaccctaacttattagtatttttgatgtctaagtagctacatttaacggacacttataat

SEQ ID NO: 2284 - DNA, 1482 bp, Fagus grandifolia
ccatgaactataaatcaccatccaaaacatgataatttataatgggctggtggcactaccaagctaccacaccctgcaatgcatataagtggttgaaccgcccaatacccaaccccaagttccaactaaatcccgttccttcacacgtgtccaaaacacgaggactcaaagacttcgagatttgaacctaaagtctaaactaacgtacacaaggggagagagataaggtgcgtttgtttcctgaaacttcgttgtatcatacaactttcatctcctaaaaaacaaccacatcagagagagaagcaatgaagggaggaccgaagaggccgatccacgcagtggcgacgtgggtacggaggcaaccaccgaagatcaaggcgtttctggcggtggtgtcaggcattgcggcgttgttgttcttgcgaatggtcgttcacgatcacgacaacctttttgtttctgccgaggctgttcacgcccttggaatctccgttctcattttcaagcttaccaaggaaaaacatgtgctgggatttcactcaaatcacaggaactaacagctatatttctggccgttagactctattgcagttttgtcatggaatttgatatacacacactacttgattcagcaacattggtgacaaccctatgggttatctatatgattcgttttaaattgaagtctagttacatggatgataaagacaacttcaaatcttactacgtgttggtaccttgtgctgtgctatcattattaattcatcccacaacgcagcatcatatcttgaataggattttctgggcattctgtgtttatcttgaagctgtttcagtgctaccccagctgcgggtaatgcagaacacaaagattgttgaaccattcacggcacattatgtatttgcgctgggagttgcaaggttcttgagttgtgcgcattgggttctccaggtattggatactcatggccacttgctgacagctctgggttatggtttgtggccttctatggttctcctctcagaaattgtccagactttcattcttgcagatttttgttactactatgtcaaaagccttgtcggtggacaacttgttctgcgtctcccctcaggagtggtgtaagcttgaaatgcttcaatctttttacataaagttataaagttcaggagaatctttcaaccttggcaagttaaccatgtaatgtcatttgtagtatttagcagttgttaggagatttagatagtttcttcttgacacgatgcaaagtttcgtgagctatcttcactgttttcggttcaggttaattgttctgaacatgaacttgacataaaatatcagttcttaatgtcactcaaccttagtccgtgactgtgattagttaatttcattttacataacaaaaaagagagggagggggagctgattcattgttaattctaattggttgggggaggaggattcgaattcctagttctacg

SEQ ID NO: 2285 - DNA, 1053 bp, Cucurbita pepo
aagcgtcaaagttcatcgtccgcggttcacctgtagatcccttcgtcggttggacgacgcaaaaacctaaacttcaccggaagatcaacccgccgccgccttaggtcaatcatctcatgaggccggcaagaaatccgatccacatcgtgtcggtatgggtccagcgacagccgccgaaggtgaaggcctttttggccgtcgtgcttggcattgtggctctgatggcacttcgattcatcgttcatgatcacgacaatctatttgtcggtgccgaagcagtgcactccattgggatattggttctcatctttaagctcacgaaggagagaacatgtgctggaatatcgctcaagtctcaggaattaacagctatcttcttagccgtgaggttgtattgtagttttgttatggagtatgatatacacacgctattagatttagcaacactggccacgaccctctgggtgatatatatgatccgtttcaaacttaagtcgagctacatggaggataaggacaactttgcattatattttgtgatagcaccctgtgctgtattggctttactcattcatccatcaacttctcattactttgttaacagagttttctgggcattttgtgtgtatttggaagctgtttcagtgttgccccagttgcgagtgatgcagaacacgaagatcgtcgaaccgtttactgctcactatgtatttgcattgggtattgcaagattccttagctgcgctcattgggttctccaggtcttggatagtcgtggacatcttcttgtagctctcggtcatggtttatggccatctatggttctgatctcagaaattgtgcagactttcatcctagctgacttctgttactattatgtgaagagcgttttgggggacagctcgtcctccgactcccttctggagtggtgtgaccgaacagatgtcatgccatgtgccttttttgtccatagccaggtcaggttcttttcttgacatgtttgtgggtatgtggttgatatcgtttatgacctgaaatcaccttggccgaatt

SEQ ID NO: 2286 - DNA, 1185 bp, Solanum phureja
tcaattgacagtcgaattttttttagcacatcaagagagcagtatgaaggctccgaggaggccgatccacgctgtgtcaacatgggttaaacggcaaccgccaaaggtaaaggcttttctggcggtgtggtcgccggcatgacagttctggtgctgctacgtgccattgttcacgatcacgacaaccttttcgtcgccgccgaggctgttcacgccatcggaatctccgttcttatctataagctcaccaaagagaaaacttgtgctgggatttcactcaaatcccaggagctcactgctctgtttttggctgtcagactgtattgtagttttgtcatggaatatgatatacataccttacttgatttagctacattggggacaacgttgtgggttatttttatgatccgatttaaacttgaatcaagttacatggaggacaaagacaattgttcagtttattatgtggggatcccttgtgctgccttagccttactaattcatccatcaacatcacatcacttgatcaatagaatcttctgggctttctgtgtttacttggaggcggtttctgtgcttcctcaacttcgtgtcatgcaaaacactcagatagttgaaccattcacggctcactatgtatttgcgttgggtgttgcgaggttcttaagctgcgctcattggattctccaggttttggacagtaacggccatctactagtagcgttgggtcatggtctatggccttcaatggtgcttatatctgaaattgttcagacattcatcttagcagacttctgttactactacgttaaaagtgtttttggaggacagctagttttgcgccttccttcaggtgttgtgtaactgaagtttgtgctaagtgatggacaaatttcgcataccacgcttggctttgcttattttttttgtatcctacacaagtccaacttggtctagtttctccaggggaaaaaccaagagtggatgtttttgtaaagctagcacaatttaaattaagtagttgattttgtggctatcaatcatagttttaactttttcgttatgagctctaattttttcggcttcagaaaggtagtcacacttgtagttttcatgaactaagttgaatgattaatgatgctggttctcagataagctatagtgtctgtttgatgacaatataaa

SEQ ID NO: 2287 - DNA, 1316 bp, Arabidopsis thaliana
cgttaccaatttctccagtttcccactccacatccaaaaaaacagtgtaataataatcataatcacctgatcaatctcttacataaaagctacagatctggttttatacaatcatcaccgcaccaagttcctaaaggtttcgactttactgtttctattttcggaaagagagtgcaagattgaaatcgaagatgaaggcggcaacaaggccgatccacgccgtgacgacatgggttcgtcggcaaccaccaaaggttaaaggttttctcggtgttgtctccgccatgactgccctcgttttgttgagagtgattgttcatgaccacgacaatctttttgtcgctgctgaagctgttcattcccttggaatctccgtccttatctataaactcaccaaggagaggacttgtgctggattatctctcaagtcacaagagctaacagctctgtttttggcggtgagactgtattgtagttttgtgatggagtttgatattcacacgttacttgactcggctacattggtgactacactttttgttatctatatgatccgttttaagctcaaagctagttatatggacgacaaagacaattttgctatctactacgtcgttattccatgtgttgttctatcagtactcattcacccatcaacacatcatcatataatcaataagatttcttgggccttctgtgtttaccttgaagctgtttcagtccttcctcaacttagagtcatgcaaaacactaagatcgtggagccatttacagcacattacgtattcgctttggggatcgctaggttcttgagttgtgcacactgggtccttcaggttttggacactcgagggcggttattgactgctttaggatatggtttctggcctataatggttcttctctctgaaatcgtccaaaccttcattctagccgacttctgctactactatgtcaagagtttaatgggtggtcagcttgttcttcgtctcccgtcaggtgttgtgtgaaatttggtgtataagaagaagatacggtgttgctttgagcttatggtgtggtgtaatgatccatgtcttgcaggctaatcgttttgagtcttctctaatctcttttttttttttttttccctttatgttttttcttttcttagaggacttgtaaagaaaaaaagggaattaattagagattttgagttttaacatattaatttaaaacttgtttccagaagcaagtagatgaatgttttggtgtaaaatataaacatgagaagaatactatagtacagagagggactatgaatcattaatgttgac

SEQ ID NO: 2288 - DNA, 1227 bp, Brassica rapa
gagtaatctttagttagtgcagttatcacccaatcgtcccaacaatcaattcgcacacaaaagagacagatctggttcgttaaaatctttagtttagtgctacgaaaggtctcgaaaagatgaaggcggcgaagaagccgatccacgccgtgacgacatgggttcgccggcaaccaccaaaggtcaaagcttttctcggtgttgtatccgccatgactgctctcgttctcttaagagtgattgttcacgaccacgacaaccttttcgtcgccgccgaagctgtccacgccctcggaatctccgttctcatctacaaactcaccaaggagaagacttgcgccggattgtctctaaagtctcaggagttaacagctctgtttctggctgtgagactttactgtagctttgtgatggagtttgatatccacacgttgcttgattcggctactttggtgactaccctttgggttatctacatgatccgtttcaagctcaaagctagttacatggaagacaaagacaattttgctatctactatgttgttgtaccatgtgctgttttgtctgttttgattcacccatcaacacatcatcatataatcaataagatctcttgggccttctgcgtttaccttgaagctgtttcagtccttcctcaacttagagtcatgcaaaacactaagatcgtggagccattcacagcacattatgtatttgcgttggggatagctaggttcttgagttgtgcacattgggtccttcaggttttggacactagagggcggttactgactgctttaggatatgggttttggcctataatggttctcttctctgaagtagtacaaactttcattcttgctgacttctgctactactatgtcaagagtttgatgggtggccagctagttcttcgtctgccgtcaggtgttgtgtaaaatatgtcgaagaagagagaagaagacacggtatggcttttgagctcatggtatggagtttggttctacgttttttgcaggccatcgttttagtcttctgtaaactccttttcttatacgtttttatgtttgtttcttggatgactgtaaagaaaaaagggagttgatttagagatttttgacaacattacctctcagcttttaatctcttgctatatattttgttatttaacaaaactggttttggtgttgtttgagaggagaaacaaaaactttagtaaattactag

SEQ ID NO: 2289 - DNA, 1216 bp, Cichorium intybus
ttctcaacttcttcagacgttcacaaaatttcccccaaaatccccctactcgtcgccaccagatcaccaccgtagtcaaaccctagccactgcgccgtaattccaaacatctctaattccaccacatcaccagaaatacgcagagacaaagcatttgcaaaagcacgcagattcgaataacaaacatgaggccaccaaagaagacgatccacgtgatatcgtcatggatacatcggcaaccgccgaaggtgaaaggttttctggccgtagtcgcaggcatgctagccttggtcttgctacgcgcgattgtacacgatcatgacaatctctttattgcagccgaagctgttcactccattggaatcaccgtccttatatataaactctccaaggaaaaaacttgtgcaggcatatcacttaaatcacaagaactaacagctatgtttttggctgttagactttactgtagtttcgtgatggaatacgatatacacactctccttgacttgtcaacattggctgcaactttgtgggttatctttatgattcgttttagactcaaatcaagctacatggaggaaaaagacaattttgcaatgtactatgtggcggttccttgtgctatattagctttgttaattcatccatcaacatcacatcacatcatcaacagggtattttgggcattttgcgtttatcttgaggctgtttctgtgttacctcaacttagagtcatgcagaacacaaagattgttgaaccattcactgcccattatgtattcgctctcggtgttgccaggttcttgagttgtgctcattgggttcttcaggttttggatagccgtggccatctgcttactgctttaggttatggtttatggccttcaatggttttaatatcagaaattgtccaaactttcatattagcggacttctgttactactatgtgaaaagtgtttttggaggacaacttgttttgcgtctaccttctggagtcgtgtaggccaagacttgtattgttgatctagcttttaaaggatttatttttcccttttttcactttcattttatacatgttcaagtttggtggttaggttcttttttgtgtattggtggatggttgtaaatttggtgacgtgattgtggcaatggtttaaattataactctttttcttttaactaaatttgaatatctatattggagaaattgtgtct

SEQ ID NO: 2290 - DNA, 1254 bp, Echinacea purpurea
cggccgggggagagtggtccaagtatccaaacctccactaaaacatgtttcttttccgccccgtcattaattacccgatctgatttcctcacctacatcgcctccaaatcctcccaaaatcgccacccaatctccacctactcaaaccctaaccaccaccatcacccaccaaatcagaccacactcaagcaagaaactttgaaaaaaccaaacatgaggccaccaaagaagacgatccacataatttcgtcatggttaaaccggcaaccgccaaaggtgaaggcgtttcttgccgtcgtcaccggcatgctggtgctggtgttgcttcgtgcgattgttcacgatcatgataatctgttcgttgctgctgaggctgttcactccatcggaatctccgtccttatttataagctcataaaggaaaaaacttgtgctgggctatcactgaaaacacaagaacttacagctatattcttggctgttagactatactgcagttttgttatggaatatgatatacacacattgcttgatttggctacgttggctacaacattgtgggtcatcttcatgattcgtttcaagctcaaggcaagctacatggaggacaaagacaactttgccatgtactatgtggtggttccttgtgcggtactagctttgttaattcatccaacaacttcccatcatttcgtcaacaggatattttgggcattttgcgtatatcttgaagcagtttccgtcctacctcaactgagggttatgcagaatacaaagattgttgaaccattcacggctcattacgtatttgctctcggtgttgcaagattcttgagttgtgctcattgggttcttcaggttttggacagtcgtgggcatttacttacagccctcggttacggattatggccgtcgatggttctcatctcggaggttgttcagacgttcatcctagcagacttctgttactactacgtgaaaagtgttttcggaggacaacttgttatgcgtctaccttctggagtggtgtaagtttaaagaaacccagtggcattcaactatatatttgctcttgttaatttacctttcctccaatactgtagtcacttgtattgatggacaatttgtacatttttgcatgtttttatttattaaaaccctaattttactactcatcttcagttatggttattagtttcaggaatttcaatgctctattgtactccatcacataaatatacaagttaaatatat

SEQ ID NO: 2291 - DNA, 1212 bp, Lupinus angustifolius
actttcactttcactttcaactctactcctactttgcttttattcattcattccaatttccaacacacaacacattcatatccttaatcacaatacaacctcactggaaaaaatgaaaggaactaagaggccgatctacgccgtcacaacatgggttcgccggcaaccacccaaggtgaaggcttttctcgccttcctttctgggattacagcgttgttgttcatcagaatggtggttcacgaccacgacaacctcttcgttgctgctgaggctgttcatgcattaggaatctccgtcctcattttcaagctctccaaggataaaacttgttctggactttcacttaaatcacaggaactgacggcattgtttttagctgttagactttactgcagttttgtcatggaatatgatatacacaccatacttgatttggcaacattgggaacgaccctttgggttatttatatgatacgcttcaaactgaaagccaattatatggatgataaggacaaccttgccatatactacgtggtgctaccttgtgctctgctgtccttgcttattcatccaacaactcggcatcaaattgttaaccgggttctctgggccttttgcgtttatcttgaagctgtatctgttctccctcagctgcgtgtcatgcagaatgctaagtttgttgaaccatttacagcacactatgtttttgcccttggagttgcaaggttcttgagttgtgcacattgggtcctccaggtaatagatacccgtggacgcctactaacggctttgggttatggattgtggccttctatggtacttctatcggaaattgtccaaactttcatcctggcagatttttgctactactacgtcaagagcattgttggcggacaacttgttgttcggcttccttcaggagtggtgtaacttcagcaatcattttcaaatccctgaagttggacgttccccgaggaattacaactcgggatagctacagaagttttgatatgttttctcccagagactgggtatgtaaaacttatgtaacttaaaagataatttactttctatttcatcagttcaagttggtattggtaattggctgatatcaaatatcttataaatattcactatcttagaagtatcttctaacttgattatatctgttgaagctacagaatgaatagtacatgttttagcatgcctta

SEQ ID NO: 2292 - DNA, 1570 bp, Pinus taeda
atgttgtattgaggacgttgcgctggtctggtccgagttacttggtggagacttttatcaaaacaatcctctgtgttacgttggtctgaaattctgaattgggtactgtccttccgttcgcctgttatcagaaacaatggcgacaatgaggaaatccaggaggaatccagtgcatgtggtatcatcctgggtagcaaggcagcccccaaaggtgaaggcgtttctagcggtagtaagtggcatcgcagctcttgttgctctcagattcgtggttcacaaccatgataatctcttcgttgctgccgaagcaacacatgctgtgggcatctctgtcttgatctacaagctctttaaggaacgaaactgttcaggcttatcacttaaatctcaggagcttactgctatattcttagcagtgagggtgtactgcagttttgttatggaatatgatatacacacagtgcttgattgtgcaacattagtcaccactttgttggtgatttacatgatacgtttcaagttgaaggcaacacatgatgaagacttggataattttccgatatattatgtggtgattccatgtgcagtacttgccctttttatccatccatcaacatcccataatattgtaaacaggatactttgggccttttgtgtttaccttgaagctgttgcagttttaccccagcttcgcgtgatgcaaaatacaaagatagttgaaccattcacagcccattatgtgtttgcattgggtattgcaaggtttttcagctgtgcacattgggtactccaggttttggatagccgtggctacttgttgattgcattgggccatggcttgtggccgtccatggtacttttgtcagagattgttcagacttttattttggcagacttttgctactactatgttcaaagtgttgtaggagggcaacttgtgctgcggcttccttcaggagtggtgtgatttcaatctaatggctccgctgaagtttctatggaactggtgtatgctttggatctggtgccaagatctttcatgtttaattcttaattctctacaattaattctaggtagatttatctgatgcaaaacagacggctgtaagagttttacctccatatggatggatgagggaactggaggtggaattcacttctgcaaagttttgcttcaagtctagttgatccagtttgttcatatggatttttactagtgcatcctcacgtgggttctctacaatgctgaatccaattttaaggctttgaatttataaaacgcttgccagtgttgtgtatatttactgtcccgatgaataacctgcagtctaggcttttactgtggactttaaaaccatcatcttgaccatctgtatatactcaactctatcagatggctttttgtaaaggagaattcttgcaataaacagtccattggtttcaatattagctcgtttatgaactttattagctcatgctattggaaacaaggcaaatttgcatcaatggatactattttttaaaatgcatattataataacactttaaaatcataaaaaaaaaaaaaaaa

SEQ ID NO: 2293 - DNA, 1181 bp, Populus trichocarpa
cgtgactgatacatcgaaattagaagcgcagagtgagaagcagagggagagggagagggagagggagaagagtcttagctagaggaggagaggaatagaatgaaggcaacgaggaggccgatacaggcggtggcgagatgggtaaggaggcaaccaccaaagatgaaggcttttttagcggtggtttcagggttggcggctttggtttttcttagaatggttgttcgtgatcatgataacctctttgttgctgctgaggttgttcattctattggaatctctgttcttatttacaagctcatgaaggagaagacttgtgctggactttcactaaaatcacaggagctaatagctatatttttagctgttaggctctattgcagttttgtcatggagtatgacatacacactctacttgattcagctacgttgctgacaaccctttgggtaatctatacgatccgtttcaacttgaggtccagttacatggaaggcaaagataactttgcaatttactatttggtgataccatgtgctgtgctagctttgtatattcatccaagaacacatcaccacatagtcaacaggatttgctgggccttttgtgtttaccttgaatctatttcagtgttgcctcagctgcgagtaatgcaaaacacaaagattgttgaacccttcacggcacattatgtatttgcgcttggagttgccaggttcttgggttgtgcacattgggtcctccaggtactggacactcgaggacgcctattgacagcactgggctatggattgtggcctcttatggtcctactttcagaaattgtgcagactttcattcttgccgatttttgctactactacgtcaagagtgttcttggtggacagcttgttctaaggctcccctcaggagtggtgtaagctagtctgccttgcaaaatctgcgaagtgtgggaggatgctagctttggttgctcttggccatccagatagtgcgtgcaacgcttgttctatcttttgcaggcattagagctgtagtaggtggactgtaaaattggtcgcattttatgctggcattttgatagcttaataattaaatagaaatattttgatagcttttacgcggcatcatagtgtcttcaagtagtcaaaatgttatttgattaaaaaaaaaattaaaaaaa

SEQ ID NO: 2294 - DNA, 1156 bp, Chenopodium quinoa
ccgaaagtgaaggcgtttcttgcggtggtcgccggaatggcggcgttggtgttgctgagagcggtggttcgtgaccacgataatctctttgttgctgctgaagctgttcatgttattggaattgctgttcttatctataaactcacaaaggagaaaacttgcgctggactctcgcttaagtcacaggagcttacagctatatttttagcagttaggctgtattgcagttttgtcatggaatatgatatccacacgctgcttgattcagctaccttggttttcacattgtgggtcatctatatgattcgatttaacttgaggtcaacatatatggaggacaaggacaactttgctctatattatgtgctagtaccatgtgctgttttagcagttttggttcatccatcaacttcgcacaatatcttaaacagaatttcgtgggcattctgtgtatatttagaagcttcctcagtgcttcctcaacttcgggttatgcaaaatactaagatcgttgaaccatttacggcgcattatgtatttgcgcttggagtagcaaggttcttgagctgtgcccattgggttcttcaggttttggacagtcgtgggcaccttctaactgctttgggatatggactatggccatcatttgttcttatctcagagatagtgcaaactttcattttggcagacttctgttattactatgttcaaagcatctttggcgggcaacttgtcctacgccttccctccggtgttgtgtaaactacattttataggaggctgcaccaaagaaaatggttttgcaagctcaatggtggtttaattatgcttatttaaccgtctttgcactccagatgggctatcatgagcccaatccagttagggctgtgtaaaagttagagatgaaaggagaacattggattaatgttgaatcatacgttatttatctggaagattacatcaattttacagcatcagaaactcggaaacatagataactgatatctggagcaattaaaacactagtttctcgttcacttctagttttatgtgtcttgtgtcctgttatttcattgtatggaaatataggaatcatatagtctactaattttacgttcggggttgtgggagcgaaggcacacgagggctaggcccc

SEQ ID NO: 2295 - DNA, 1407 bp, Sciadopitys verticillata
gttgcgggtcggagaataaggcgactagagggaaatacactttttccaaagcgaccgattggaatacagtgtttgcgaacttcatttgatgtagtgagagcattgatatgctgaattgaattggggctgttcatatcagacatggtgacaatgaggaaatcgaggaatccaatatataaaatatcggcatgggtaacaaggcagcctcccaaggtgaaagcttttctagctgtagtgagtggcatcgtagcccttgtcattctcagattccttgttcacaaccatgacaatcttttcattgccgctgaagcaacccatgcagttggtatctcagtcttgatctacaagctcatgaaggaaaaaacttgtgcaggcttatcacttaaatctcaagagcttactgctatattcttaacagttcgcgtgtactgtagttttgttatggaatatgatatacacacagtgctagattctgcaacattagcaaccaccttgtgggtgatttacatgatacgattcaagctgaaggcaacacatgtggaggatttggataatttcccaatactttatgtggtgcttccatgtgctgtacttgcacttgctatacatccgtcaacacgccataatattgtaaacaggatcctttgggccttctgtgtctaccttgaagctgtagcagtgttgccccagcttcgtgtaatgcaaaatacaaagattattgaaccatttacagcccattatgtgtttgcattgggtattgcaagatttttgagttgtgcacattgggtactccaggttttggatagccgtggatacttgttgactgccttgggccatggcttatggccatccatggtgctattgtctgaaattgttcagacttttattttagcagacttttgttactactatgttaaaagtgttgtaggtggtcaacttgtgctgcgacttccttctggagttgtgtgattagtattccaactgccaaaaatatcatggaactggtgcatgcttctctcttgaacagatctggtgacaagaacgtttgttatttagttgtttagccaaatacctggagaagtttatagatatacaactctagttgtatgtattatgtatttggatggataaggaaattcaaggttgaaatagttactgtgaaatgctgcttccatctggctttgatgagcatacggaactttacgtaatattggtaggtctcattatggtttgcaacaacaatgtatccatttttcttagctctgactttgtaaaggcgtcacgagcttttgtgtatatttgctattttaattcacgacctgcagtctagcttttttacgaatttaaagatagttgtgtagtaaaaggggaatcttgcaataaacaatgtatgagtttcaagatatc

SEQ ID NO: 2296 - DNA, 1361 bp, Taxus baccata
tccaaagccaagtatttaaccaaagggggtgtcgggcattttggtatagcgaagtggattcgatatcagaaatggtgacgatgagaaaatcaaggagaaatccaatcagtgcgatgtgggcatgggtaacaaggcagcctcctaaggtgaaagcatttttagcagtggtgagtggcatcctggcccttgtcattctcagattcctggttcacaaccatgataatctcttcattgctgccgaagcaatccacgctgtcggtattgtagtcttgatctacaagctcatgaaggagaaaacttgtgcaggcttatctctcaaatctcaggagcttactgccatcttcttagcagttcgggtgtactgtagttttgttatggaatatgatatacacacagtgcttgacactgcaacattagcgactactttgtgggtgatttacatgatacggttcaagctgaaggcaacacatgtgggggatttggataatttcccaatacactatgtggtggttccatgtgcagtactttcacttgctattcatccatccacacgacataacattgtaaacaggattctttgggccttttgtgtctatcttgaagctgtagcagtgttgccccagcttcgcgtgatgcaaaatacaaagattattgaaccatttacagcacattatgtgtttgcattgggtgtcgcaagatttttgagttgtgcacattgggtactccaggttttggatagtcgtggatacttgttgactgctttgggccatggtttatggccgtccatggtgctcctgtcagaaattgttcagacttttattttagccgacttctgttactactatgttaaaagtgttgtaggtggtcaacctgtgctgcgacttccttctggagtggtgtgattagtattgccactgccaaaaattgtgatggaattcatgcaagtttcattattgagtcagatctgttgacgatgctatttgtgctgaatttagtcatgaatcatggagaaatttatagacacaactcatggttgtagctgtttttgatttggatggttagggagattcaaggtttgaatttgctaactgcaatgctgttgcttcctgtctatgttttgtcatttggctttgatgaccatacagaactttttaagtactattggcacgtctccccatgagttcgcatcaacaaagaatccatttctataagctctgtttttgtaaaggctttgtgagcgttgtacatatttgccgtttaaacaaacaatttgcaatctaggcatttgctatggatttgaaaccctcagctggactgtatatttttactaatttgaacaatatttatgtagtaaaggaagg

SEQ ID NO: 2297 - DNA, 1188 bp, Solanum lycopersicum
gatctccaattttcaattgacagtcgaatttattttagcacatcaagaaagcagtatgatggctccgaggaggccgatccacgctgtgtcaacatgggttaaacggcaaccgccaaaggtaaaggcttttctggcagtggtcaccggaatgacagttctggtgctgctacgtgccattgttcacgatcacgacaaccttttcgtcgccgccgaggctgttcacgccatcggaatatccgttcttatctataagctcaccaaagagaaaacttgtgctgggatttcactcaaatcccaggagctcactgctctgtttttggctgtcagactgtattgtagttttgtcatggaatatgatatacataccttacttgatttagctacattggcgacaacgttgtgggttatttttatgatccgatttaaacttgaatcaagttacatggaggacaaagacaattgttcagtttattacgtggtcatcccttgtgctgccttagccttgctaattcatccatcgacatcacatcacttaatcaatagaatcttctgggctttctgtgtttacttggaggcggtttctgtgcttcctcaacttcgtgtcatgcaaaacactcagatagttgaaccattcacggctcactatgtatttgcgttgggtgttgcgaggttcttaagctgcgctcattggattctccaggttttggacagtaacggccatctactagttgcgttgggtcatggtctatggccttcaatggtgcttatatctgaagttgttcagacattcatcttagcagacttctgttactactacgttaaaagtgttttcggaggacagctggttttgcgccttccttcaggggttgtgtaactgaagtttgatggacaaatttcgtgtaccacgcttgcctttgcttatttttttgtatcctacacaagtccaacttggtctagtttctccaggggcaaaaccaagagtggatgtttttgtaaagctagcactatttaaattaagtagttgattttgtggctatcaatatcatagttttaaatttttcgttatgagctctaattttttcggcttcagaaaggtagttcatacttgtagttttcatgaactaagttgaatgattgatgatgctggttctcagataaactatagtgtctgtttgatgacaatataaa

SEQ ID NO: 2298 - DNA, 1204 bp, Vinca minor
acaaacaatttcaaggtgaagtcagaacaacgataaaggagaaaaccggagatctcttactccgttccgttccgttctgttccggccagctcagattaggaggaggaggaagaggagtaggatccacccaaaggcagcagaatgaggggcccagcaagaaggccgatcgttgcagttaggtcatggctacggcggcagccgccaaaggttaaggctttcttggccgtgatttccggaatggctgctctcgttcttctccgtgctattgtccacgatcacgacaacctttttgttgccgctgaggctgttcattctattggaatctctgtcctcatctataagctcatcaaggagaaaacttgcgccgggctttcgctcaaatcacaggaattaacagctttatttttggctgttagactgtattgtagttttgtcatggaatatgatatacacacactgcttgactttgctaccttggcaacgacattgtgggttatttatatgattcgttttaaacttagatcaagttacatggaagacaaagacagcgttcctctgtactatgtggtggttccttgtgctgttctagcttttctaatccatccatctacttcacatcacaccgtcaacaggattgcctgggcattttgtgtatacctggaagctgtttctgtgtttcctcaagtgcgagtcatgcaaaacacaaagattgttgagccgttcacatctcactatgtatttgcactgggagttgcaaggttcttgagctgtgctcattgggttctccagcttgttgacagtcgtggccatctgctgacggctctgggttttggattgtggcctgtgatggtgctggtttccgaaattgttcagaccttcatcttatccgacttctgttactactacgtgcaatgtgttctcggaggagagctggttttacgacttccttctggagtagtgtgagggaacttttttatgaaaaaagcagtaaaaatgaaaaataccattgctagtgcttttcttttaagtagtagtaactttgtttatggctctccactcttgtccattttggttgtttttttgtttggttccataaacaagtcgatcggtagtctgtaacattggctgagtcacactgtccaatggtattttcaagaaacagataatatttttgttggttaattctgatatggagcatagtctt

SEQ ID NO: 2299 - DNA, 1125 bp, Sarracenia psittacina
aggggaaaatgaagggaccgaagaggccgatcgacgcggtggcgacgtgggttcgccggcaaccgccaaaggtgaaggcgtttctgtcggtgatctcggccgtggccgctctggttttcctctggttagtcgttgaagatcacgacaacctcttcgtcgccgccgaggctgttcacgctctcggcatctccgttcttatttacaaactcaccaaagagaagacttgcgccggactttcactgaagtcgcagatactaacagctctgttttggctgttagactctactgcagttttgttatggaatatgatatccacaccattcttgatttggctacgttggcgacaacaatgtgggttatctacatgattcgctttagtttgaagtccagttacatggacgacaaagacaacttggcaatttattatgtggttataccttgtgcgctattgtctatagttgttcatccatcaacaccacatcatattttcaacagaatctgctgggcattttgtgtttatgtggaagctgtttccgtgttacctcaactacgtgtcatgcagaatgcaaagattgttgaaccatttacagcacattatgtatttgcactaggaattgcaaggtttttgagttgtgcgcactgggtactgcaggttttggatactcgaggccgattattgacagccttgggctatggattgtggccttcgatggttcttatttctgaaatcatccaaacattcattttggctgatttctgctactattacgttaaaagtattctgggcggccaacttgtattacgcttaccttctggagtggtgtgaattcagtttcgaatcattctcaacacaaataacttataatcgggtgcgtggatcgacggtcatttccagttactttttctcttgttgtcagtaaaatcttgtttgatgctgccaatgggaaggagtggtagttatttgtgaaggtggagatggaactttggcggggtatttaacttttactcaattggtatctaatctaacttttgcgtgaccgtttttattaccaggaaaatgttagtatacaaatttggctcaaatgtcaaaaggcaagagattggttaagcccctttgtttggatg

SEQ ID NO: 2300 - DNA, 1045 bp, Ambrosia trifida
tccgatatactcatcacctactttccccaaaactctcccttcaaatagccaggcagccacccaatctccactgtaatcaaaccctaaccaccttacaacccaatcaaacaacatgagaccaccaaagaagacgatccaggttgtatccacatgggtacggcgtcaaccacccaaggtcaaagcctttctcgccgtcgtcaccggcatgctggccttagtactcctccgtgctattgttcacgaccatgataacctcttcgttgctgctgaagctgttcactccattgggatctccctccttatttataaactcatgaaagagaaaacttgtgctgggttgtcactgaaagcacaagaactaacagctattttcttggctgttagattatattgcagtcttgtaatggaatatgatatacacaccttgcttgatttggctacattggttgcgacgttatgggttatctttatgattcggtttaaacttaaatcaagctacatggaagacaaagacaactttgcaacatactatgtggcggttccatgtgccgtactagctttgataattcatccatcgacatcccatcatgttatcaacaggatattttgggcattttgcgtttatcttgaagcagtttcagtcctacctcaactcagggttatgcagaacacaaagattgttgaaccattcacagctcattatgtatttgctcttggtgttgcaaggttcttgagctgtgctcattgggttcttcaggttttggatagccgcgggcatttacttacagccctcggttatggattatggccgtctatggttcttatttcagagatcgttcaaaccttcattctagcggacttctgttactattatgtgaagtgtatttggagggcaactcgttttgcgcctgccttcaggagtggtgtagtaagttttgaggaaatgtggccaaagattaaattctacatttacttattgttagtcttaccttcagcagaggcggtctcaggtggatgggtgatttgtacatttgtgcctgtgtca

SEQ ID NO: 2301 - DNA, 1272 bp, Cycas rumphii
gtcaaattgcagggcatggtgggggtaggtagtgggattctcgtctgaatccactattcacatatttgttaaatgttttcgtcagcgcaattacagtcgttatccagtgtatggtatagagatcctacgggaggccggctgcaggaaattataggaatttggttgaattgaggaaaatgggaaggaaatcaaagaatccaatatacgtggtgtggggatgggtgaggcggcaacctcccacggtgaaggcatttctggcagtcataacaggaattgcagcgctcgtatttctgaggtccgtggtcgatgatcacgacaatcttttcattgcagcagaagctgctcatgcgcttggaatcgccgtcctaatttacaagcttaccagacagaagacatgcgccggtttgtcacttaaatctcaagaactcactgctatattcttaggtgtgaggctgtattgcagtgttgtcatggagtatgatatacatacattacttgactctgcaacattagcatcaaccttgtgggttatctatgtgatacgctacaaactgcagtcaacctacatgaaggatttagacaactttccaatatattacatggtgattccatgtgctttgctcgctcttgcaatccatccaacaacatcacacaatatcataaacaggcttctatgggccttttgtgtgtacctggaagctgtgtcagtgttgccccagcttcgagtgatgcagaacacagagatagttgagccatttacagctcattatgtgtttgcattgggtgttgcaagattcttgagctgtgcacattgggtacttcaggttttggatacccgtggttacctgttgactgctttggggcgtggtttatggccatctatggtgctcctgtccgaaattgttcagacatttatcttggcagacttctgttactattatgtgaaaagcgttgtaggtggtcaactggttatgcggcttcctcctggagttgtgtgaagcaaatctaaacctgcaaaccaaagactttatttccaatgacaatcttgccaataggatctgtactaatcatgttcagtactttgctgtgcaaatttctatgtgcaacacaaatggtcgtctttgtttgggtgggtgttttgcgacagtttatcggtcaccatcaatgaaaatctggagttctgattagcttctgcagtatagtctgtattgtgtctttgttttggagccttgtagagatttaaacttgcctctatccttttattgtttattg

SEQ ID NO: 2302 - DNA, 1280 bp, Rosmarinus officinalis
cggccggggggtttccctcaaatactaatagcttccaatgctcacaaatttcgccgcttaaaactactgtctttttcgtctcgtaccccaaagtggaacaatttcacggtgaagtcagaacgataaagagaaaagcggagatcgtttactccattcccagcttggagtaggaggagcaaggcaaaaggcagcagcgccatatctgggataagaatgagaggcccagctaggaaaccgatccttgccgtcaggtcatggttgcggcggcagccaccaaaggtgaaggctttcttggccgtcattgccggaatggcttccctcgttgttctccgtgcaatagtccacgatcacgataacctttttgtcgccgccgaggccgttcattctattgggatttccgtcctcatctacaagctcatgaaggagaaaacttgcgccgggctttcactcaaatcacaggatttgacagctttgttcttggctgttagactgtattgcagttttgtcatggaatatgatatacacactctgcttgacttatctaccttggcaacaaccttatgggttatttatatgattcgttttaaacttagatcaagttatatggaagacaaagacagtgttccactgtactatgtggtagttccttgtgctgttttagcttttctaattcatccatctacctcacatcacatcatcaacaggattgcctgggcattttgtgtatacctggaagctgtttctgtgtttcctcaagtgcgggtcatgcaaaacacaaagattgttgagccattcacatctcactatgtgtttgctttgggagttgcaaggttcttgagctgtgctcattgggttctccagcttattgacagtcgtgggcatctgctgacggctttgggttatggattgtggcctgtgatggtgctgatttctgaagttgttcagaccttcattttatccgacttctgttattactatgtccaatgtgttctcggaggagagctggtcttacgacttccttctggagtagtatgaagcagcagtttaatgaagaaaagcagtcacaaaaaatataccattgctattgcttttgtttgaagtggtaggattttatttgtggctctccacacagtccatgttggttgcttttctgtttggttacgaaaacaagtcgaagaatggtctgtaacattgggcgagcacgctgactgcaatcaatggtattttcaggaaacatataatattatcttgtcaaccctaatttatttagtgaagctggt

SEQ ID NO: 2303 - DNA, 1138 bp, Aquilegia formosa
gaagaagaagaagaaagaataaagaagatgagaggatcgaaaacaccaattcatacagtagcaacatgggtgaaaagacaaccattcaaaataaagatgtttcttgcgggtgtatcatgtttagcaacacttgtttttcttaagattattgttcatgatcatgataatttatttgttgctgctgaagctgttcatgctcttgggatctgtattcttatctataaacttatgaaagagaactcttgtgctggactttcactcaaatcgcaggaactaacagctctgtttttagctgttagactgtactgcagtgttgtaatggaatatgatatacacacactgcttgattcagctacgctggggacaaccttgtgggttatttatatgatgcgttttaaactgaagtctacctacatggaggataaagacaactttgcaatatactatgtggtggtaccctgtgcagtattagcccttgttgttcatccatcaacatcacattatattttgaatagagttttctgggccttctgtgtgtacctggaagctgtttcagtgttaccccagctccgtgctatgcagaatactaagatcgtagaaccctttacagctcattatgtattcgcattgggtgttgcgaggttcttaagctgtgctcattggatcctccaggttgtagatactaggggacgcttgttgacagctttgggatatgggttgtggccgtccatggttcttctttcagaagctgtgcaaaccttcatccttgcagacttctgttactactacgtgaaaagccttgttggcggacagcttgttcttagacttcctgctggagttgtgtgagcctgatgcgcctgatggcttgtagtgcagtttacaggctttatgtatgtcatgaataacttttattagcagagatgtgggtgtaaaccccctcccctccttgtttactttcctttcactgtaatgctgacaagtgattgtaaaagttggagtggtggagtatttaatattttggtatgtaaacatgtatatttagataaatacccttttgttatggttgtcacaatcatccctcttgaacaatgacatagatctttttgttattattattaatctggtagtttgatctttg

SEQ ID NO: 2304 - DNA, 1180 bp, Brassica juncea
acacaaaagagacagatctggtttgtttacttacaatcatcgtaccaagctacgaaaggtctcgactttactgtttcctatcctcagtaacaaagctaagagcgaaatcaaaaaagatgaaggcggcgcagaagccgatccacgccgtgacgacatgggttcgccggcaaccaccaaaggtcaaagcttttctcggtgttgtatccgccatgactgctctcgttctcttaagagtgattgttcacgaccacgacaaccttttcgtcgccgccgaagctgtccacgccctcggaatctccgttctcatctacaaactcaccaaggagaagacttgcgccggattgtctctaaagtctcaggagttaacagctctgtttctggctgtgagactttactgtagctttgtgatggagtttgatatccacacgctgcttgattcggctactttggtgactaccctttgggttatctacatgatccgtttcaagctcaaagctagttacatggaagataaagacaattttgctatctactatgtcgttgtgccatgtgctgttctgtcggttctgattcacccatcaacacatcaccatataatcaataagatctcttgggccttctgcgtttaccttgaagctgtttcagtccttcctcaacttagagtcatgcaaaacactaagatcgtggagccattcacagcacattatgtatttgcgttggggatagctaggttcttgagttgtgcacattgggtccttcaggttttggacactagagggcggttactgactgctttaggatatgggttttggcctataatggttctcttctctgaagtcatacaaactttcattctcgctgacttctgctactactatgtcaagagtttgatgggtggccagctagttcttcgtctgccatcgggtgttgtgtaaaatctgtcgaagaagagagaagaagacacggtatggcttttgagctcatggtatggagtttggttctacgttttttgcaggccatcgttttagtcttctgtaaactccttttcttatacgtttttatgtttgtttcttggatgactgtaaagaaaaaagggagttgatttagagatttttgacaacattacctctcagcttttaatctcttgctatatattttgttatttaacaaaactggtttt

SEQ ID NO: 2305 - DNA, 1294 bp, Brassica rapa
aaaatattgtcaaaccataggtgattagagtagtttagtggcctatggggtttttaattgggtgactcagcccatccaagcctgactatcattttcgtgtgtcactttgttaagacttcctgcgtcactttacccagaaagctacagaaagaagaaggaatcgactatcgagcatgaggacgaccaagtctccgatccacgccgtgtcgacatgggtgaggagacagcctccaaaggtaaaagttttccttgcagttgcgtcgggcataacggctcttgttctgctgaagttcatcgttcacgatcacgacaatcttttcgtcgcagccgaatctgttcattccattggaatctctcttcttatctataaactcaccaaggaaaagacttgtgctggattgtcattgaaatcacaggagctaacagctacatttctagctgtgaggctttactgcagcttggttatggaatacgacatacataccattcttgacttggctactttggctgcgacactatgggttatttttatgatccgttttaagttaaaagctagttacatggtggacaaagacacccttcctctttattatgtccttgtgccctgtgctgtgttagctgtgttgatccatccatcaacttcacataatatattgaatagaatatcctgggcattctgtgtctacctggaagctgtttcagtactgccacagctgagagtgatgcagaacaccaagattgtggaacccttcacggctcactatgtttttgcactaggagttgcgagattccttagctgtgcgcactgggtcttacagttagtggacacccggggacacctgctagtagcactgggatacggactatggccatcgatgttcttaatctcagaagtcgtgcaaacattcatcttggcagacttctgttactactacgttaaaagtgttttcggaggccagcttgttctccggctcccctctggagttgtgtaaaaaaaaaaacaataagatacctttgatgacacgtttgttactcagaaggcattggatctctcagctgagcaggctaagtttgcgcaatgagaaaatttggggttcatcatggacagtccctcttggatattactgacatggattttttttcacaagattggtgcttagtgttccacatacttattatacaatatatacatattttgtcaactatatatctgataagttaccgcagaattatctattctacatcattaagtttggaaaaatttaaattttgatcatacacatattttaaaagt

SEQ ID NO: 2306 - DNA, 1029 bp, Brassica napus
ggcggcgaagaagccgatccacgccgtgacgacatgggttcgccggcaaccaccaaaggtcaaagcttttctcggtgttgtatccgccatgactgctctcgttctcttaagagtgattgttcacgaccacgacaaccttttcgtcgccgccgaagctgtccacgccctcggaatctccgtcctcatctacaaactcaccaaggagaagacttgcgccggattgtctctaaagtctcaggagttaacagctctgtttctggctgtgagactttactgtagctttgtgatggagtttgatatccacacgttgcttgattcggctactttggtgactaccctttgggttatctacatgatccgtttcaagctcaaagctagttacatggaagataaagacaattttgcaatctactatgttgttgtaccatgtgctgttttgtctgttttgattcacccatcaacacatcatcatataatcaataagatctcttgggccttctgcgtttaccttgaagctgtttcagtccttcctcaacttagagtcatgcaaaacactaagatcgtggagccattcacagcacattatgtatttgcattggggatagctaggttcttgagttgtgcacattgggtccttcaggttttggacactagagggcggttactgactgctttaggatatgggttttggcctataatggttctcttctctgaagtagtacaaactttcattcttgctgacttctgctactactatgtcaagagtttgatgggtggccagctagttcttcgtctgccgtcaggtgttgtgtaaaatatgtcgaagaagagagaagaagacacggtatggcttttgagctcatggtatggagtttggttctacgttttttgcaggccatcgttttagtcttctgtaaactccttttcttatacgtttttatgtttgtttcttggatgactgtaaaggaaaaagggagttgattttagagattttttgacaatattaccttctcagcttttaatctcttg

SEQ ID NO: 2307 - DNA, 974 bp, Chrysanthemum coronarium
gaagcaaacaaacacacccatttacacgctcctccaacaaataacagatcttgtagttgatccccaaaatcctcccccaaatcagcacaacagccataaattaaaattatgagaccaccaaagagaacaatcaatattataacatcatgggttggtcgtcaaccaccaaaagtgaaaggttttttagcagttgtgagtggaatgttggctttggttttacttcgtgccattgttcatgatcatgataatctttttgttgctgctgaagctgttcattctcttggtatctctgttttaatttataagctcatgaaggagaaaacttgtgctggcctatcactcaaaacacaagaactaacagctatattcttagctgttagattatactgcagttttgttatggagtatgatatacacacattgcttgatttggctacattagcaacaactttgtgggttatctttatgattcgttttaaattaaaatcaagctacatggaggacaaagacaacttgccgatgtactatgtggcggttccttgtgttatactagctttggcaattcatccatcgacatcccatcatatcatcaataggatattttgggcatttgttgtttatcttgaagcagtttcagtcctacctcaacttagggttatgcagaacacaaagattgttgaaccttttacggctcattatgtatttgcccttggtgttgcaaggttcttgagctgtgctcattgggttcttcaggttttggatagtcgtggacatttgcttaccgccttaggatatggattatggccatcaatggttttgatctcagagattgttcaaacatttatattagctgacttctgttattactacattaaaagtgtttttggaggacaacttgttttacgtctaccttccggagtggtataagattgaagcaaatgttgtatttgaagtcaatattttctttctccaat

SEQ ID NO: 2308 - DNA, 1121 bp, Tropaeolum majus
ctgacccaactgatttattttatgaatcgcgtaatcggaactccactctttccttttccactacaataaaattaattttcttcctttttcctgtcactttcccgagaaaacagaaaggaatcagagctaatttacacactccatgaggccgcagaagaagtcgatccaggcagtaacgacatgggtcaagagacaaccgccgaaagtcaaggcctttttggcggtggtcgcaggtatgtcggcgctggttttgctccgatttattgttcatgaccacgacaacctcttcgttgcctccgaggctgttcactctattggaatctcagtgctaatctataagctcatgaaggagaagacttgcgctgggctatcactgaagtcacaggaactgacggctctatttttatcggttaggctgtactgcagctttgttatggaatacgatatacacacactactggatttatgtacctttgccacgactgtctgggttatgtatatgatccaattcagattgcggtctagttacatggaggacaaagacaatttcacaatatattatgtggttataccatgcgctttgttagctgtgtttgtccatccatcgacctcacaccacgtaataaacaggatattttgggccttctgtgtatacttggaagcagtttctgtactaccccagttgcgggtgatgcagaatactaagattgttgaaccatttacggcgcactatgtctttgcacttggagttgctagattcttgagttgcgctcactgggttttgcaggttctggatactcaaggacacttgctagtcgctctaggctatgggttatggccttctatggttctcatttcggaaatcgtccaaactttcatcctagccgacttctgttactactacgttaaaagtgtaatcggcgggcagctcgtccttcgtcttccctccggagtggtttaacgatagataacttaagtctgtgttttgatgagctcattgacattaaattggcgtaataacttatattttttcgtccaccacctgattctcggaactcggtgagtttgtaaattcggaaaaatgtttgaaattttatgatcgatatttatattagaaagaa

SEQ ID NO: 2309 - DNA, 1164 bp, Raphanus sativus
ggatcgatcatccgatcgtctcaacaatcaattttcgcacacaaaagagacagatctgtggtttgtttacttataatcatcgtaccaagaacctacgaaagtccccacctcccgcccctatcttcagtaaccaacgcgaggagagcgaaaatcaaaagatgaaggcggcgcagaagccgatccacgccgtgacgacatgggttcgccggcaaccaccaaaggtcaaagcttttctcgccgttgtatccgccatggctgctctcgtcctcttgagaatgatcgctcacgaccacgacaaccttttcgtcgccgccgaagctgtccacgccctcggaatctccgtcctcatctacaaactcaccaaggagaagacttgcgccggactgtctttgaagtctcaagagttaacagctctgtttctggctgtgagactctactgtagctttgtgatggagtttgatatccacacgttgcttgattcggctactttggtgactaccctttgggttatctacatgacccgtttcaagctcaacgctagttacatggaagacaaagacaattttgcaatctactacgttgttgtaccatgtgctgttttatcagttctgattcacccatcaacacatcaccatataatcaataagatctcttgggccttctgcgtttaccttgaagctgtttcggttcttcctcagcttagagtcatgcaaaacactaagatcgtggagccattcacagcacattacgtatttgcattggggatagctaggttcttgagctgtgcacattgggttcttcaggtcttggacactcgagggaggttactgactgctttaggatatgggttttggcctataatggtcctcatctctgaagtcatacaaaccttcattctcgctgacttctgctactactatgtcaagagtttgatgggtggccagcttgttcttcgtctgccgtcaggtgttgtgtaaaatctgttgaagaagagagaagaagacacggtatggcttttaagcttagtatggagtttggctctatgtttcttttttgcagaccatcgttttagtctactgtaaactccttttctcatacgttttatgttttgtttcttggatgtaaaggaaaagggagttgatttagagacttttgacaatacca

SEQ ID NO: 2310 - DNA, 1101 bp, Tripterygium wilfordii
acttcgactttcacagttgcacacgaagagagaggggaaggagaaggacaatgaaggcaacaaagagaccgatccacgcggtggcgacatgggtccggcggcaaccaccgaagatcaaggcattcttgggggtgatgttaggaattgctgttcttttgtctctaagactgatcgttgaagatcacgacaacctctttgtagctgccgaggctgtccatgccattggaatctccgttctaatctacaagcttatgaaggagaagacttgtgctggactttcactcaaaacacaggaactaacagctatgtttctagctgttagactctattgcagcttcgtcatggagtatgatatacatacattgcttgactcagctacactggcaacaaccttgtgggttatatatatgattcgttttaagctacggtctagttacatggatgacaaagacaattgtgcaatttattatgtggtgatgccttgtgctcttctgtctttagttattcatccaaccacccaacataacatagttaacaggatttgctggggtttctgtgtctatctggaagctgtttcagtactccctcagctacgagtcatgcagaatacaaagattgttgaaccattcacggcgcattatgtgtttgcccttggagttgctaggtttttgagctgtgcacactgggtccttcaggtgttggatactcggggacgcctattgacagccctgggttatggattgtggcctcccatggttctcttgtcagaaattgtccagactttcattcttgcagatttttgttactactatgtcgagagccttgttggtggacaacttatcctgcgtcttccctccggagttgtatgaattcagttcacagaggttatgagagtagaagattggcaatgtgcattcacaacttccaccaataaatggagatcttggaatgcaattgcctttccttcctctggtttttcatctcattttctcttattgtagcttatagagtgctgctcagtgattagtggaccttggagttggcaatggcatacgttaaattttgacatatgtaatttaattgagttattatgataaaaaa

SEQ ID NO: 2311 - DNA, 1357 bp, Gnetum gnemon
aaacaataaattatcaccaggagcccgtcacgtgtaaaagtccgaggcgtaaaaatttagaagctgaaaatactccacatttagtgggtttggttcgcggatcgaagaaaatcgcagttttattgcgggtttggtttcagcagcgcaggtcaggaaccctgccttgcctgctttggcgtggcgaatagacgagatagggggagagacacagagatcgctgtgctgtgaactcctatatcgtcaacaattcggtgatcggagttttttgcatggtgtttgaattttcagattgagaaatggggcctgggcgaagatcgaaaaatccagtgtacgtgctttacgcgtgggtgaggcggcagccgccgaaggtgaaagcgtttctcgccgttattgccggaatcgcgtcgctggtgtttctgcgtatggtcgtgcatgatcacgataacttgtttgtggcggccgaggctattcatgcatttggtatctccattctcatctacaagctcaccaaggagaagacctgtgcagggttgtcactaaaatctcaagaactcactgcccttttcttaggagtgaggctttattgcagttttgtaatggaatatgatattcacacaatattggattttgcaacatttgtcacaacgctttgggtgatatatatgatgcgttacaagctacgatctacatacatggaggacctggacaatctatcaagtttaattgtggttcttccatgtgcacttcttgctcttctcattcatccgacaacttcacataatattgtaaacagaatcctttgggcctttgttgtatacctggaagctgtctcagtcttacctcagcttcgtatgatgcaaaacacaaaggttgttgaaccattcacagcgcattatgtttttgcattgggcattgttaggttcttaagctgtgcacactgggtacttcaggtcttggatagtcgtggccatctgttaattgctttaggtcagggtttatggccacccatggtgcttctgtctgaaattgttcagacattcatattggcagatttctgttactattatgttaaaagtgttgtaggtgggcagcttgttgttcggcttccttctggggttgtttaaagaatgctgtagatacactcggtagccaagctcaatcgatacaaccccaaaatattttgtaatgcattgtttatcagaattgtctcaactgtcaactgaaatttgaaatgcgcttaccttgttcggatgcgagtatacggatatcctaaatgcttttcgatattcatggccctagtgagtgttagggctgggcatacagaatcgcttcctgttaaaagtttcagtcaaatatt

SEQ ID NO: 2312 - DNA, 1324 bp, Podocarpus macrophillus
ttatagagtaccactaaggatatactttccggggaggaaatactttctactttttcggtatttagtttgtagacctccagcaggagagctgcaaaggcaagggttcctgcaggatattgagaaatgggtctgctgcgaaggtcgaagaatcccgtacacatgttggccggatgggttagaaggcaacctccaaaggttaaggcctttttagcggtagtaacgggcattgcatccttagtttttctaagatttgtggttcacgatcacgacaatttgtttgtggcagcagaggcaattcacgccttggggatatctgtcttgatctataagttgaccaaggagaagacatgtgcaggcttatcacttaaatctcaggagcttacagctatattcttggcagtaaggttatattgcagttatgtcatggaatatgatattcatacgttgcttgatttagcaacattagtaacaaccttgtgggttatctatatgatccgctacaagttaagatcaacctacatggagaatttggataatctcccagtatactatgtggtgattccgtgtgctcttcttgcttttgcaatccatccatcaacatcgcacaatattgtaaacagaattctttgggcattttgtgtatatcttgaagctgtgtcagtcctgcctcaacttcgggttatgcaaaacacacaggtagtagaaccatttacagcccactatgtttttgcacttggtgttgtcaggttcttaagctgtgcacattggatactccaggttttggatagccgtggttacttacttactgctctgggccatgggttatggccatcaatggtgcttttatctgaaattgtccagacatttatcttggcagacttctgttactactatgtaaaaagtgttgtaggcgggcaactggtggtgcgactccctgctggtgttgtgtaggcaaatgttgcatgacttggttttatttggcaagcaagctcgaggcatttttcttgccaaaactgatttggaaacctgatagatgaagcatcccagcaattatatttttatctgtattgcttcccttttgtttgcaatgctgaacaagatggataatatagaccaaatcaagggagttttgttttggtttgatgttatgctttttcatcatctataataataacaaggtcaaatgtcaatcccttcagtttgtttgagctcttggcttctccagaatgcctgattactttcccttggtatggatgcaatggattgctaatagcaacttttcacaatgtggggaaaaccatattggattattttctaattcaac

SEQ ID NO: 2313 - DNA, 1196 bp, Flaveria ramosissima
cacctactttgccccaatactctcccctcagatcgcccgcccaatctccaccgtaatcaaaccctaaccaccaccgccaccaccaccaccaccaccaccaccgctaccaccaccgctaccaccaacaccaccaccgtccatcttcaaatcagcaatacatacacatacacagagcatacacaagcacaagctcttgaaaaaccaatatgaggccaccaaagaggacgatccacatcatatcgtcatgggtgcggcggcaaccaccaaaggtgaaagcttttctcgccgtagtcaccggcatgctggccttggtgctgctgcgtgtgatcgtgcacgatcatgacaacctcttcgttgctgccgaggctgttcactccatcggaatctccgtccttatctataagctcatgaaggagaaaacttgtgctgggttatcactgaaagcacaagaactaacagctatgttcttggctgttagattatactgcagtcttgtaatggaatatgatatacacaccttgcttgatttggctacattggttactacattatgggtgatctttatgattcgttttaaacttaagtcaagctacatggaagacaaagacaactttccaacttactatgtggtggttccttgtgcagtactggctttgttaattcatccatcgacttcacatcatattatcaacaggatcttctgggcattttgcgtttaccttgaagcagtttcagttctacctcaactcagggttatgcagaacacaaagattgttgaaccattcacggctcattatgtatttgctctcggagttgcaaggtttttgagctgtgctcattgggttcttcaggttttggatagtcgcgggcatctacttacagctctaggttatggattatggccatctatggttctcatctctgagatcgttcagactttcattctagcggacttctgttactattacgtgaaaagtgtttttggaggacaacttgtgttgcgtctaccttctggagtggtgtataagctcaggaaatgctggcattgaactctacatttacatcttgttagttttaccttactttcagtcagatggattgatggatggacggtgatttgtacattagtgcctttgttatttacaaccttaattttactcaagtttccaaaatcactttaatatgatctaattatg

SEQ ID NO: 2314 - DNA, 1304 bp, Pinus pinaster
aattcggcacgaggggaaatccaggaggaatccagtgcatgtggtatcatcctgggtagcaaggcaaccccaaaggtgaaggcgtttctagcggtagtaagtggcatcacagctcttgtcgctctcagattcgtggttcacaaccatgataatctcttcgttgctgccgaagcaacacatgctgtgggcatctctgtcttgatctacaagctcttcaaggaacggaactgtgcaggcttatcacttaaatctcaggagcttactgctatattcttagcagtgagggtgtactgcagttttgttatggaatatgatatacacacagtgcttgattgtgcaacattagtcaccactttgtgggtgatttacatgatacgtttcaagttgaaggcaacacatgatgaagatttggataattttccgatatattatgtggtgattccatgtgcagtacttgccctttttatccatccatcaacatcccataatattgtaaacaggatactttgggccttttgtgtttaccttgaagctgttgcagttttaccccagcttcgcgtgatgcaaaatacaaagatagttgaaccattcacagcccattatgtgtttgcattgggtattgcaaggtttttcagctgtgcacattgggtactccaggttttggatagccgtggctacttgttgattgcattgggccatggcttgtggccgtccatggtacttttgtcagagattgttcagacttttattttggcagatttttgctactactatgttcaaagtgttgtaggagggcaactggtgctgcggcttccttcaggagtggtgtgatttcaatctaatggctccgctgaagtttctatggaactggtgtatgctttggatctggtgccaagatctttcatgtttaattcttaattctctacaattaattctaggtagatttataggatgcaaaacagacggctgtaagagttttacctccatatggatggatgagggaactggaggtggaattcacttctgcaaagttttgcttcaagtctagttgttccagtttgttcatatggattttttacttgtgcatcctcgcgtgggttctctacaatgctgaatccaattttaaggctttgattttataaaacgcttgccagtgttgtgtatatttactgtcccgatgaataacttgcagtctaggcttttactgtggactttaaaaccatcatcttgaccatctgtacagtgtatatactcacaactctatcagatggcttttgtaaaggagattcgtgcaataaacagtc

SEQ ID NO: 2315 - DNA, 1090 bp, Arabidopsis thaliana
acttaaccgagaaagcaaaagagaagaagaagaaggaatcgaaaaatgaagactccgatccacgcggtttcgacatgggtgaggaggcagcctccaaaggtgaaagctttccttgccgtcgtatctggcatggcggctcttgttctcctcaaactcatcgttcacgatcacgacaatctcttcgttgccgccgaagctgttcattctattggaatctctgttcttatctataaactcatgaaggagaagacttgtgctggattgtcattgaaatctcaggagcttacggcgatatttctagctgtgaggctttattgcagttttgtaatggaatatgatatacataccattctggacttggctactttgggaacaactctctgggttatatatatgatccgttttaacctcaaaactacttacatggaggaaaaagacaacttcgctctctattatgtgctggcgccctgtgttgtgctagctgtatggattcatccatcaacgtcacacaatatattgaatagaatatcctggggattctgtgtttacctcgaagctgtttcagtactgccacagttgagagtgatgcagaacacaaagattgtcgaacccttcacggctcattatgtttttgcacttggagtagcaagattttttagctgtgcacactgggttttacagatgatggacacgcacggacgactgcttgtagtgctgggttatggactatggccatcgatggttataatctcagaaatagtccaaacattcatattggcagatttctgttactactacgttaaaagtgttttcggtggccagcttgttctaaggcttccatctggggttgtgtaagttataaaggaaaaaagataagacacattatgacgaaatttgttacacgaagatagatctcagcttggtgtaatctgagtagcctctggttactctcaagttactccctcaggccaagtcctaattctattaactgtgttgtatatttttgtgtgggtcatcatcatagacagtcccttggatattattgacatgattttttccactgcatttgtgctaaattatccttggttcc

SEQ ID NO: 2316 - DNA, 1630 bp, Brassica rapa
gttttgtaataaaatcgtcttaaagtgagttaagatttggttcgtacaaagttacccaaaagtctcgacttttattactgtttcgattcccggtggagtgtaatcggagatgaaggcggcgaagaagccaatccacgccgtgacgacatgggttcgccggcaaccaccgaaagtcaaagcctttctcggtgttgtttccgccatggctgctctcgttctcttaagaatgattgttcacgaccacgacaacttcttcgtcgccgccgaggctgtccacgcccttggaatctccgttctcatctacaaactcaccaaggagaagacttgcgctggattgtctcttaagacacaagagttaacggctctgtttctggcagtgagactgtactgtagctttgtgatggagtttgatattcacacgttgcttgattcggctacgttggtgactaccctttgggttatctacatgatccgtttcaagctcaaagccacttacatggaagacaaagacaattttcctatttactacgttgttataccgtgtgctgttctgtcagtcttgtttcacccatcaacacatcaccatataatcaacaaagtctcatgggccttctgcgtttaccttgaatctgtttcagttcttcctcagcttagagtcatgcaaaacactaagatcgtggagccattcacagcacattacgtatttgcattggggatagccaggttcttgagttgtgcacattgggtacttcaggttttggacactcgtgggaggttactgactgctttaggatatgggctttggcctataatggtcctcctctctgaagtcatacaaacttttattctcgctgacttctgctactactatgtcaagagtttaatgggtggccagctggttcttcgtctcccatcaggtgttgtgtaaattgtgttgaagagaagagagaaagaagatacagtttggcatcaagctttttattatggtattggagtgtttgcctctacgtttttgcaggccatccttggttgtttttatgtttttttgcttagtaaagaaaaaggttaaggattttgaacaatttttgtttttatattagcctctcagcttttaatattttactactatatgaaaaattagatggtaatatatttgagataaaacgtattttcaaatgcttaaaaatgatcattgcattcgttattcaatactatcataccatcatttaggttttatttgaacaacttattaaacaaactaaatctagagttaagtaaatacgaactggttatttggatatgcatctgttagtgcaaatgaccgtaaatagataatcaagacttattagtattatttatgttgtacgaattagttactatctaactttaaagagtgatgatgattgatgcatgcagctattgtttgtttgtttcacttgtttttaactttttatgctcaagtttgagctaatccaaacttatttttaattcgatttcgactcttttggcggcggctacagctggaaactctgtaatcatatcacctaatattccaccaattccttgatgtattataccgaatatgttcggataactcaggtacatatttaagattttatccgaaagtggg

SEQ ID NO: 2317 - DNA, 836 bp, Manihot esculenta
atgaaggcgacgaagaggccgatccacgcagtggctacatgggtccagaggcaaccgcccaagatcaaggcttttttagctattatttctgggatggcagctttggtttttcttcgtatggtggttcatgatcacgacaacctattcgttgctgctgaggctgttcatgccattggaatctctgtcctaatctacaagctcatgaaggagaggacttgtgctggactttcactgaaatcacaggagctgacagctatatttttagctgttagactatattgcagcttggtcatggaatatgacatacacacgttacttgattcagctacattgctgaccacactatgggtgatttatatgattcgcttcaaattgaggtccagttacatggatgacaaagacaactttgcaatttactatgtgttgataccttgtgttgtgctctctttgcttattcatccaacaacacagcatcatttaataaacaggatttgctggtctttctgtgtttttcttgaagctgtttcagtattgcctcagcttcgggttatgcagaacacaaagattgttgaacctttcacagcacattatgtatttgcacttggaattgcacggttcttgagttgtgcgcattgggtgctccaggtattggatactcgaggacgccttttgacggcactgggctatggattgtggcctcctatggtcctcctttcagaaattgtgcagactttcattctcgcggatttttgttactactatgtgaagagtctcgttggtggacagcttgttcttcgtctcccctcaggagtagtgtaaggcaattgaataggcaa

SEQ ID NO: 2318 - DNA, 1059 bp, Chrysanthemum coronarium
gtcacgactagtcaccaccgtagtcaaaccctaacaagaacaaccatgagaccaccaaagaacacattgaccgtgatctcatcatgggtacgtcgtcaaccgccaaaagtcaaaggctttcttgccgtagtggctggtatgacggcgttagtgttgctgcgtgctattgttcatgatcatgataatctttttaaagctgctgaagctgttcattccattggtttggctgttcttatttataagttttctaaagagaaaacttgtgctggcatatcactgaaatcccaagaattaacagctatgtttttggctgttagactgtactgtagttttgtcatggaatatgatatacacacactgttagacttgtgtacattggctgcaacgttgtgggttatctatatgattcgttttaaacttaagtcaagctacatggaggacaaagataattttgctacatactatgtggcggtcccttgtgccatattagctttgttcattcatccaacaacaccacattacctcatcaacaggatatcttgggcatttgcagtttaccttgaagcagtttctgttctacctcaacttagggtcatgcagaacacaaagattgttgagccattcacagctcattatgtatttgctctcggtgttgcaaggttcttgagctgtgctcattgggttcttcaagttttggatagtcatggccgactactaactgccctaggctacggtttatggccgtcaatggttttgatctcagaaatcgttcaaacttttattttagcggacttctgttactactatgtgaaaagtgtgtttggaggacaacttgttatgcgtctaccctctggagtcgtttaagccaagaacaatattgtcgatctagttttttcaggatgtttccgatacttttcaactatacatgttcaagtttaggtcatataccttccctcttgcaaagtagtggttggtttttcttttcgtaaattggtggattgttgtaaatttggtgacatggttatcgtttaaattataatccaatatcttttaactaaa

SEQ ID NO: 2319 - DNA, 1448 bp, Citrus clementina
agaaaactgagtggggtggccttggaactatcttcactcctgtgggtagctgaccaaaattatccgataagtgcaactgcccataagccattaatccaactcgcaccaacttttactggcctccacgtgtccggctatgacgaaattaaattccaatgtgatgtccgtcctcttgtttcttctcccctcgagtacttttgacgcgcatccaatctaagacgctaattatcaaattaaaaattgattaagagagcattaagattattttcttctcgtattatctttcccttaaaaacctccaacgaaactgtagtgtgtccactaggagtaacaaataataatcaaatgaagggttataagacgccgatccacgcggcggcgacgtgggttcgccggcagcctccgaagattaagatatttttggcggtaatcacggccttagcagctttagtttttctaagaatggtggtcgaagatcacgacagcctttttgttgttgccgaggccgctcacgctattggaatctccgttctcatttacaagctcactaaggagagaacttgtgctggattgtcacttaaatctcaggaactaacggccatctttttagctgttaggctctattgcagttttgtaatggaatatgatatacatacgctacttgattcagctacattggtgacaaccctttgggttatttatatgatgcgttttaaattgagggccagttacatggatgataaagacaactttgctatttactatgttttgataccttgtgctgttctatcttttctcattcatccatcaacccatcatcatttagttaatcggatttcttgggctttctgtgtctatcttgaagccgtttcagtcttaccccagctacgagtcatgcagaacacaaagattgttgaaccattcacggcacattatgtatttgcccttggagttgcaaggtttctcagttgtgcacattggatccttcaggttttggatacacgaggacgtttattgacagccttgggttatggattatggccatccatggttctcctctctgaaattgtccaaaccttcattcttgcagacttttgttactactatgtgaaaagccttattggtggacaacttgttctgcgacttccatctggagtggtatgaatttaatggttaagtttacaaaatgagtaaactgggatattgaataattggaagttgggtatgtgtttgccttgctcttctcaagtctcacttcattgattcatgatactttgtacacatttttcttgttggcagctgtagagttatgctagttggactttaaagttagggatgagttatattctggcgcgagagataatctaatattagttattttgttgtgatcaattggaactataggagtatccccttcttatttaaccaacgttgccgaatttaagatt

SEQ ID NO: 2320 - DNA, 1088 bp, Euonymus alatus
agttgcacacggagagaaaggggaaggacaagtacaatgaaggcaacgaagaggccgatccacgcggtggcgacatgggtccggcggcaaccaccgaagatcaaggcattcttggcggtgatgtcaggaattgctgttcttttgtctcttcgactgatcgttgaagatcacgacaacctctttgtagctgccgaggctgtccacgccattggaatctccgtcctcatctacaagctcatgaaggagaagacttgtgctggactttcgctcaaaacacaggaactaacagctatgtttctagctgttagactctattgcagctttgtcatggagtacgatatacatacattacttgatttaactacactggcaacaaccttgtgggttatatatatgattcgttttaagctgcagtctagttacatggaagacaaagacaactttgcaatttattatgtggtgataccttgtgctcttctttctctagttattcatccaaccacccagcataacatagttaacaggctttgctggggtttctgtgtctatctagaagctgtttcagtactccctcagctacgggtcatgcagaatacaaagattgttgagccattcacagcgcattatgtgtttgcactcggagtttctaggtttttgagctgtgcacactgggtccttcaggtgctggatactcgaggacgcctattgacagccctgggctacggattgtggcctctcatggttctcctgtcagaagttgtccagactttcattcttgcagatttctgttactattatgtcaagagccttgttggtggacaacttgttctgcgtcttccctccggagttgtatgagttcaattcacagaagatgaaagtagaacattggcaatgcgcattaacaacttccaccaatatatggaaatcttggaatgcaactgcctttcctcctctggcttttcaagactgaaataatttttacactgtttttctcttattgtagctatagagtgctgcttagtaattagtggaccttggaattggcaatggcgtgcgttaaattttgacatatataatttaatagagtt

SEQ ID NO: 2321 - DNA, 1236 bp, Lotus japonicus
atccaaaatagaagacaatgggagttgatggtggcagaacaagggtggttgagcaacccacccgtcacataactaataaaccagtcatcacacgtgtcccggaaactcacattcattcatagtactgttacctgaagaaggacacaacacaacacaacacaacccaacacaaagacaagtgaacaagtcttaggaggagaatgaaggcaaccaagagaccgatccacgccctgaccacatgggttcggcggcagccgcccaagatgaaggcctttctggcggtggttgccggcctcgcaaccttgctcttcctcagaatggtggttcacgaccacgacaacctcttcatcgcagctgagtttgttcacgcattaggaatttccctcctcattttcaaactcaccaaggaaaaaacttgtgctggactctcacttaaatcacaggaactgacggctatgtttctagctgttagactttactgcagttttgtcatggaatatgatatacacaccatactcgacacggcaacactggtgacgaccctctgggttatttatatgatgcgcttcaaactgaaatccagttatatggatgataaggacaaccttccaatatactatgtggtgatgccttgtgctgcactctccttgcttattcatccaaatacccgccataatccaattaacaggattctctggggcttttgtgtttaccttgaagctgtatcagttctccctcagctgagggtcatgcagaacgctaagattgttgaaccattcacaggacactacgtttttgcccttggagttgcaaggttcttgagttgtgcacattgggtcctccaggtattagatactcgcggccgtctactaactgctttgggttatggattgtggccttctatggtacttctatcagaaattgtccaaactttcatcctggctgatttttgctactactacgtcaagagcatctttggcggacaacttgttgtaaggcttccttcaggagtggtgtaacttaaacattcattttcagatgcctcagaattaacgttccttaagcaatgttgagaatgtaatatatatgtaacttagacaaattttgatcatcttgttccgtttcaagttagtattggtaaattgacaaatatcagaatatcaattttcttctctcgtgagtttggcgtgtagaagctaaaatgaacagtacttgctggcatgccttacaagttct

SEQ ID NO: 2322 - DNA, 1364 bp, Cycas rumphii
ttgagttacaacaaaatcgggtacccgaagtccttgtctggtgctctgaatcgtggtaggtgtttttgggaattgtctgtatcatatattgggtccatataattggtttcagaaaaatggttactgtgagaaaatccaggaatccaatacacgtagtatcaggatgggtggcaaagcagcccccgaaggtgaaggcttttctagctgtggtgagtggcatcacagccctggtttttctcagatttgtcgttcacaatcatgacaatttattcgttgctgcggaggcaactcacgctgttggtatctcagtcttgatctacaagctcacgaaggaaaagacatgtgcaggcttgtcattgaaatctcaggagcttactgctatattcttagtagtgagggtgtattgtagttttgtcatggaatatgatatacacacagtacttgattctgcaaccttagcaacaactttgtgggttatttacatgatacgtttcaaattgaaggccacacatgcagaggatttggataattttccaatatactatgtggtgattccctgtgctgtgattgcacttgctatccatccaacaacatcccataatattataaacaggattctttgggccttttgtgtctacctggaagctgtggctgtgttgcctcagcttcgtgtgatgcagaacacaaagataatcgagccgtttacagctcattatgtgtttgcattgggtattgcaagatttttgagttgtgctcattgggtactacaggttttggatagccgtggttacttgttgactgctctaggccatggcttatggccatccatggtgcttttgtcggaaattgttcaaacctttatcttggcagacttctgttactactatgttaaaagtgttgtaggtggtcaacttgtgctgagacttccttctggagtggtgtaacaaaaatgacagaattggcttataaaatggttgaagattgatttgaaggttattcagttgccaaatggcaaaagtattgtggaatacgtgtagacttgttttgtgagacggattcagtgacatgctctgttgtgctttagttcttccattactttggcattcagagatctcttaacagaggactcatggatataggagttttatccatgtttggatggttaacgaaaatggaggttgaattagttacggtaagaccttgcatcagctctggtggttgctttagtgttttggataactatagaaactttgaatattagtggtgtatcttcttctggggtggcaacaatgatgatgaatccctcagtgaacagccatcattttaagctttgtgattttgtaaaggcgtagtcaaatttgtgt

SEQ ID NO: 2323 - DNA, 958 bp, Brassica oleracea
caaaagtctcgacttttattactgtttcgattcccggtggagtgtaatcggagatgaaggcggcgaagaagccaatccacgccgtgacgacatgggttcgccggcaaccaccgaaagtcaaagcctttctcggtgttgtttccgccatggctgctctcgttctcttaagaatgattgttcacgaccacgacaacttcttcgtcgccgccgaggctgtccacgcccttggaatctccgttctcatctacaaactcaccaaggagaagacttgcgctggattgtctctcaagacacaagagttaacggctctgtttctggctgtgagactgtactgtagctttgtgatggagtttgatattcacacgttgcttgattcggctacgttggtgactaccctttgggttatctacatgatccgtttcaagctcaaagccacttacatggaagacaaagacaattttcctatccactacgttgttataccgtgtgctgttctttcagtcctgtttcacccatcaacgcatcatcatataatcaacaaagtctcatgggccttctgcgtttaccttgaatctgtttcagttcttcctcagcttagagtcatgcaaaacactaagatcgtggagccattcacagcacattacgtatttgcattggggatagccaggttcttgagttgtgcgcactgggtccttcaggttttggacactcgtgggaggttactgactgctttaggatatgggctttggcctataatggtcctactctctgaagtcatacaaacttttattctcgctgacttctgctactactatgtcaagagtttaatgggtggccagctagttcttcgtctcccatcaggtgttgtgtaaattgtgttgaagagaagagagaaagaagatacagtttggcatcaagctcttatcatggtattggagtttgcctctacgtttttgca

SEQ ID NO: 2324 - DNA, 1536 bp, Brassica napus
aaagtctcgacttttattactgtttcgattctcggtgtagtaaaatcggaggagatgaaggcggcgaagaagccaatccacgccgtgacgacatgggttcgccggcaaccaccgaaagtcaaagcctttcttggtgttgtttccgccatggctgctctcattctcttaagaatgattgttcacgaccacgacaacttcttcgtcgccgccgaggctgtccacgcccttggaatctccgttctcatctacaaactcaccaaggagaagacttgcgctggattatctctcaagacacaagagttaacggctctgtttctggccgtgagactgtattgtagctttgtgatggagtttgatattcacacgttgcttgattcggctacgttggtgactaccctttgggttatctacatgatccgtttcaagctcaaaaccacttacatggaagacaaagacaattttcctatccactacgttgttataccgtgtgctgttctttcagtcctgtttcacccatcaacacatcaccatataatcaacaaagtctcttgggccttctgcgtttaccttgaatctgtttcagttcttcctcagcttagagtcatgcaaaacactaagatcgtggagccgttcacagcacattacgtatttgcattgggggtagctaggttcttgagttgtgcgcactgggtccttcaggttttggacactcgtgggaggttactgactgctttaggatatgggctttggcctataatggtccttctttctgaagtcatacaaacttttattctcgctgacttctgttactactatgtcaagagtttaatgggtggccagctagttcttcgtctcccatcaggtgttgtgtaaattgtgttgaagaggagagaggagaagatactgtgtggcatctagctcttatcatggtattggagtttgcctctacgtttttgcaggccatccttaattgtttttatgtttcttgcttagatgactgtaaagaaaggttaggattttgaataatttttgttttaatattttactatatgaaaatttaaatggtaatattttagataaaacgtattttcaaatgctgaaaatgatcattgcattcgttattcaatactatcatcataggttttatttgaacaacttattatacaaattaaaactagagttaagtaaatacgaactagttatttggatatgcatctgttattgcaaatgaccgtaaatagatattgaagacttattatttttttctgctgtacgaattagctactatctaactttaaagagtgatgataattgatgcatgcagctattgtttgtttgtttcacttgttttaaactttttatgctcaagtttgagctaatccaaacttatttttaattcgacttcgactcttttggcggcggctacagctggaaactctgtaatcatatcacctaatattccaccaattccttgatgtattataccgaatatgttcggataactcaggaacagattaagatttatcccaagcggac

SEQ ID NO: 2325 - DNA, 1070 bp, Brassica napus
gaagaacaagaagaaggaatcgactatcgagcatgagggcgaccaagtctccgatccacgccgtgtcgacatgggtgaggagacagcctccaaaggtgaaagttttccttgcagttgcgtcgggcataacggctcttgttctgctgaagttcatcgttcacgatcacgacaatcttttcgtcgccgccgaatctgttcattccattggaatctctcttcttatctataaactcaccaaggaaaagacttgtgctggattgtcattgaaatcacaggagctaacagcaacatttctggctgtgaggctttactgcagcttggttatggaatacgacatacataccattcttgacttggctactttggctgcgacactatgggttatttttatgatccgttataagttaaaggctagttacatggaagacaaagacacccttcctctgtattatgtccttgtgccctgtgctgtgttagctgtgttgatccatccatcaacttcacataatatattgaatagaatatcctgggcattctgtgtctacctggaagctgtttcagtactgccacagctgagagtgatgcagaacaccaagattgtggaacccttcacggctcactatgtttttgcactaggagttgcgagattccttagctgtgcgcactgggtcttacagttagtggacacccggggacacctgctagtagcactgggatacggactatggccatcgatgttcttaatctcagaagtcgtgcaaacattcatcttggcagacttctgttactactacgttaaaagtgttttcggaggccatcttgttctccggctcccctctggagttgtgtaaataaaaaaacaataagatacctttgatgacgcgttgttactcagaacgcatggaatctctcagctgagcaggctaagtttgctccatcagaaaatttggggttcatcatggacagtccctcttggatattattgacatgagtttttcacaagacttgtgcttagtgttccacatactttttatacaatatatacatattttgtcaactatatatctgat

SEQ ID NO: 2326 - DNA, 2094 bp, Medicago truncatula
aatagaaatttgtcacctatcttacgcatctgggctcggccaattatgtgcaatttcacatacaataatcaaataactgttggttatgttatcatcatggttcctaattgtaattaggactgctaaaactctgcgaattttgttgatgtggatccaataaggattcatcatataaggatttttgacctaagtgtaaatttcttgaattgagatagaaaatgaaagaaaatttaagaaaattgaccaaataggaatagaaagaaaacatacaaatggaattagatgagaagtgggaagaacgatcgccacattcaagatgaacgataagatcgaatcgcggatccgccacaagaataagatgctcttgataaggatctagattcgattcatccaacaacctagaagagcaattctaactctctgttcaatcaaagattgaaatatcaaattgtattaacctcccaaaaaatgataacatgattgttatttatacctactcattggccatcacctataaggcccaataaagaactagaaaaaacaaggagcattatacaaatccaaattaaaaacaatctaagttttaaaactaaacaatttattattacaagcaatattcactgaagaaagattccttaaaaaaaaaaaaaagatggcatattggtcgtcgtcaccttagataaatttaccgtgtatttctaaagctgtaattaagttattttattagcgtaataatcgataatgtacttgaaaataatttggaatttcctccattttcagctgacgaaattagaatgggacaaaacaagtttgtagtaattgggacggtggcggaacagaggttagttgagcaacccacccgtcacgcaactaataaacattcagttctaactttaactcctatatgacgtgtcacgcgaacaaaacattataattgaaaccaacccagaagagaagagaatagattcacaaacaaacaaggaagaaaacaatgaaggctacgaaaagcccgatccacgccgtgaccaaatggcttcgccggcaaccgccgaagatgaagttgtttctggcgattctttcgggcattgcagctttggtttttcttagaatgatcgttcacgaccacgacaatctcttcgtagctgctgagtttgtgcatgcattaggagttgccctcctcatttacaagcttgctcaagaaaaaacatgtgccggactctcgcttaaatcacaggaactcacagctatatttctagcagttagactatactgcagttttgtcatggaatacgatatacacaccttactcgatactgcaacattggggacgaccctctgggttatttatatgatacgcttcaaactgaaatccagttatatggatgctaaggacaaccttgcaatatactatgtggtgataccttgtgctgtactgtctttgcttattcacccaacaacccggcatcattatgctaacaggattctctgggctttttgtgtttatcttgaagctgtgtcggttctacctcagttgcgggtcatgcagaacactaagattgttgaaccattcacagcacactatgtttttgcccttggagttgcaaggttcttgagttgtgcacattgggttctgcaggtattagatactcgtggacgtctattaactgctttgggttatggattgtggccttctatggtacttctatcagaaattgtccaaacttcaatcctggcagatttctgctactactacatcaagagccttgttgggggacaacttgttcttaggcttccttcgggagtggtgtgattttaactttcattttcagttccttcaagttggattctcttttgcattatagtgcagaaatcgggacacctttagaagttagatgtgttatctatcagggtcatcaatgttgacagaggggaacttgtgatattgcttcctttcaagttctgtcattgggtatcaacaaaattggaaccttcatattggaaagcccagagggggaattagacgcaatctaccgaccggttggatatctgcattttccaatccgttttttttccatttgttacctgctccactcc

SEQ ID NO: 2327 - DNA, 902 bp, Saccharum officinarum
tccacgaccacgacaacctcttcgtcgccgccgaggccgcgcacgcgctcggcataggcgtcctcatctacaagctcaccaaggagaagacctgcgccggactatccctcaagtctcaggatttaactgcgttatttctagctgttagactgtactgcagctttgtcatggagtatgacatccatacgattctggacactgctacacttgtagccacactgtttgttatttatatgatacggttcaaacagaggtcaacttatatggtggacaaggataactttgcattgtactatgtggtgctaccgtgtgctggactggctctacttattcatccttcaacatctcataacattgtgaaccgaatctcctgggcgttctgtgtttacttggaagctgtttcagtgttgccacaattacgcttgatgcaaaacaccaagattgttgaaccgtttacagctcactatgtatttgcattgggggttgcaaggtttcttagctgcgcccactgggttctacaggttttggacacgcgtggccgtctgttgacagctctcggctatggtttgtggccgtctatggtgctgttatcagaaatcgtgcagacattcatccttgcagatttctgctactactatgtgaagagtctggttggtgggcaactggtgctacggcttccctcaggggtggtgtaacaagtgcagcaggatacaaaacttagcgcttcaccgattgatatgtactctgaataacagttatgctctagtgctcaacctgggagccttttttagttgatgatgttacgagttatgactatgtatgacaaagttgctgcaagggtcctcttaaaaagataggttgtcattgagactgtttatagctgcgcgtttcttgatacccaa

SEQ ID NO: 2328 - DNA, 1500 bp, Abies balsamea
ttttttttttaatgggtggagaccaatccatgttttacaagaacaatcattcgtgtgttttattagactgaaattctgaattgggcagtgtatctccatccgtctgttatcagaaacaatggcgacagtgaggaagtccaagaggaacccagtacatgtgatatcgtcatgggtggcaaggcaacccccaaaggtgaaggcatttctcgcggtagtgagtggcatcacagcccttgtcgttctcagattcgtcgttcacaatcatgacaatctcttcgttgccgccgaagcgactcatgctgtgggcatctctgtcttgatctacaagctcttcaaggaacggaactgtgcaggcttatcacttaaatctcaggagcttactgctatattcttagcagtgagggtgtactgcagttttgttatggaatatgatatacacacagtgctcgattctgcaacattagtcaccactctgtgggtgatttacatgatacgtttcaagttgaaggcaacacatgcagaagatttggataattttccaatatattatgtggtgattccatgtgcagcacttgctctttttatccatccaacaacatcacataatattgtaaacagggtactttgggccttttgtgtttaccttgaagctgttgcagttttaccccagcttcgtgtgatgcaaaatacaaagatagttgaaccattcacagcccattatgtgtttgcattgggtattgcaaggtttttcagctgtgcacattgggtactccaggttttggatagccgtggctacttgttgactgctttgggccatggcttgtggccatccatggtacttttgtcagaaattgttcagactttcattttggcagacttttgctactactatgttaaaagtgttgtaggtggtcaacttgtcctgcggcttccttcaggagtggtgtgatttcaatctaatagtcctactgaagctgctatggtactggtatacgctttggatctggtgaaaagatctttcatgtttaatcctctacatttaattctggatagatttatagatatgcaaaacacatggatgtaggagtttttgcctctatatggatggataatgaaactggaggttgaattctctcccgcaaatgttgcttcaagtctagttgttccagtttactctggagtctggacaattatatgaatttttactaccggtgcatcctccagttggttctcgacaatgctgaatccaatttttaggcttagattttataaaatgctttgccggtgttgtgtatatctactgtcccaattaataatttgcagtctaggctcttactgtggacttcaaaagcaccatcttgacaatttgtatatatttataactgtaagagatggctttttgtaaaagaaaaatctcgcaataaacagtccattggtttcaagatagctcgtttatgaacttattagattatgctcttggaaacaaggcaaatttgcatt

SEQ ID NO: 2329 - DNA, 1076 bp, Musa acuminata
ctccctcgaccaacgtctctcgttttcttttagtgggatcggattgctcgagagggagagggagagggagagggagagagatggacagcaagacgaggaagggacgggcgcggccgattagggcggtggtgggatgggtgaggcggcggtcgcccaaggtgaaggcctctctctccgtcatcgccggcatggcggcgctcgtcttccttcgcttcatcgtccacgaccacgacaagctcttcgtcgtcgccgaggccgcgcacgccctcggcatctccgtcctcatctataagctcgtcaaggagcggacttgcgccggactttcgcttaagactcaatatttgacagctttgtttttagctgtcagactgtactgcagctttgtcatggaatatgacatacacacagtgctagattgcgctacgcttgcaactactctttgggttatctacatgattcggtttagattaaagtcaagttacatgaaagagaaggacaactttgcaatttattttgtggttttgccttgtgctatattggcctttgcagttcacccttcaacaacacataatgttattgataggatttcttgggccttttgcgtttatctggaagctgtttctgtgctgccacaattacgtctgatgcaaaacacaaagattgttgagccattcaccgctcactatgtatttgcattgggggtttcaagatttctgacctgtgcacactgggtccttcaggtcttggatactcgtggacgtttattgactgctttgggacgtgggttgtggccgccaatggtccttctggctgaaattgttcaaacttttatcctggcagatttttgttattattatgtgaagagtgttgttggtggacaactggtgctaaggcttccttctggtgcagtgtgatcttctgcttaaacttcccatcttataccaaaacaatcgaaattctatttttctttcttcagacctgcagctcttgtggccgacttgtgatacaagttcaagcagttatgtcaaaatttactgagatttagatttgtagacactgaattcagcagaaaacaa

SEQ ID NO: 2330 - DNA, 1632 bp, Cycas rumphii
tgggatgcaagggacgcaggtcacctgcgcttttgccccgtaagacgtcaattttagttcgtattcggcgaaattttggttcaatctgcaggttttggggactatataggctatttcctgtacaaaatagctgcaacgggcttgttaaactggttgtttccggaccagtggtgaagggtttgaggttcgttaagagtacagaggggaaaatgggtccattaagaagatcaaggaaccctcttcatgttctctcagggtgggtgaggaggcaacccccgaaggtaaaggcctttctgggtgtagtgactggtattgcgtcgctagtgttcttgagaatggtggttcatgatcacgacaatttattcgtggcagcagaagctattcatgctgtcggaatatccgtcttgatctacaaattgatgaaggagaagacatgtgcaggcttgtcacttgtctctcaagagcttactgctatattcttaggcgtgaggctgtattgcagttttgtcatggaatatgatatacacacattgcttgatttggctacattagcaactaccttatgggtcatctatatgatccgttacaagctgaagtcaacctatatggaggatttggataactttccaatatattatgtgctgattccatgtgctttgcttgcattcgcaatccatccaacaacatcgcataatattgtaaacagggttctttgggccttctgtgtgtatctggaagctgtgtcagtcttgccacaacttcgagtgatgcagaatacaaaggtagttgaaccgtttacagcccattatgtgtttgcattgggtgttgtaagattcttaagctgtgcacattgggtgcttcaggttttggatagccgtggttacttattgactgctctgggccatggcttatggccatccatggtgcttttgtctgaaattgttcaaacctttatcttggccgacttttgctactactatgtcaaaagtgttgtgggcggtcaactggtggtacgactaccttcgggagtggtgtaaagcaattctaagcattgaatttattcttcatgggttttgatctcaaggcctagctctttccaaaatgatgtcaagacttacgaccaaagacaaactctgcaacaatattgatgcacttgttgttctgccgtttgctctgtcatgcagaactttctggatgcaatgtggaaattggcaagcaattctgattgcttgggtttatgttctatcactgcctgtcagtttttaatccaagtaaatatagtgctgtatttattagccatatttagtcttggtattctagttaacttggttttcaatgttattggaaagctttgtttctccactagtgtattgactactgtgggtcactgattttcttagcaggaacttgatatccctgtagtggtttattattattgcttctgctttctttcatagcacctgggactgagtttgaagttgttaaaaatgttgtattgttttgttttccttttagattttctagctctgtcatggtgttttcccccttggaacgtttgtatttgcattcatcagatatttcctaaaggaaataagagcattcccagtttttaaagtaagaattgaagtgtgg

SEQ ID NO: 2331 - DNA, 1170 bp, Sciadopitys verticillata
gcgtagttactgcaaatgggtccgttacgaagatcgaaaaatcctgttcagatggttgcgagttgggttagaaggcagccccccaaggttaaggcttttctggctgtaattacaggcattgtttcgttaatttttctgagatttgtcgttcacgatcacgacaatttgttcgtggcagcagaagcgattcacgctcttggaatctccgtcttgatctacaaattgtccaaggagagaacatgtgcaggcttgtcacttaaatctcaggagcttacagctatattcttgggagtaaggctatattgcagttttgttatggagtatgatatccatacattgcttgatttggcaacattagcaacaaccatttgggttatctatatgatccgtttcaagctaagatcaacgtacatggaggatctggacaatcttccagtatattatgtggtgattccttgtgctgtgcttgctttggcaatccatccaacaacatcacataatattgtaaacagaattctttgggcattctgtgtatacctcgaagccgtgtcaatcttgcctcaactgcgagtgatgcagaacacacaggtagttgagccatttacagctcattatgtctttgcactgggtgttgtgaggttcttaagctgtgcacactggattcttcaggttttggacacccgtggtttcttattgactgctttgggccatggcctatggccgcccatggtgcttctgtctgagattgttcagacgttcatcttggcagatttttgttattactatgttaaaagtgttgtaggtggtcaactggtggtacgacttcctgctggtgtggtgtaagaaatcattgcgagaactctgttctctatgtcgagcaatttcaacaagatgacgaaattttgctgaaagacaaacttttcagcaattttatttgtattcgcactactactcatttatttgcagagcaaaccttactgaatagacattgcccaacatgccattctttgtagcagttttatgccccattttgtgggttaaaaaaatagcgatgatgtatgatattgaagggggcaattgaagattgtggatgcttatatatgcggctccaatgctgtcatatgacaaaggtgggcagcaatagctcctttgatgaagattgaaggcata

SEQ ID NO: 2332 - DNA, 1424 bp, Sequoia sempervirens
cccgttggctatggcggcgtaaaaaacattgttggtccgctttgcgagaatggtagcgaagaaataaaggaggattccgtagtgccacaggcaacttactttttttggattgaaaaatcaacaatttgggaggtttagtgcgttcatttcttgttgtgggtcgggttgaagtgaattgaattggggattgtgtgtacattggatatcagaaatggtgaccacgaggaaatcaaggagaaatcccattaatgcgatgtggggatggataacaaggcagcctcccaaggtgaaagcatttttagcagtagtgagtggcatcctcgctcttgtcattctcagattcctcgttcacaaccatgacaatctcttcattgctgccgaagcgattcacgctgttggtatcgctgtcttgatctacaagctcatgaaggagaaaacatgtgcaggcttatcactcaaatctcaggagcttactgctatgttcttagcagttcgagtgtattgtagttttgttatggaatatgatatacacacagtgcttgatactgcaacattagcaactactttgtgggtgatttacatgatacggttcaagctgaaggcaacacatgtggaggatttggataacttcccaatacattatgtggtgcttccgtgtgcagtgcttgcacttgctatccatccaaccacacaccataatattgtaaacaggattctttgggccttttgtgtgtatcttgaagctgtagcagtattgccccagcttcgtgtgatgcaaaatacaaagattattgaaccgtttacagcccattacgtgtttgcattgggcattgcaagatttttgagttgtgctcattgggtactccaggttttggatagccgtgggtacttgttgactgctttgggccatggcttatggccatccatggtgctcttgtcagaaattgttcagacttttattttggctgacttctgttactactatgttaaaagtgttgtaggtggtcaactggtgctgcgacttccttctggagtggtgtgatttgcattgccatttccaaacatgggatgggacttgtgcaggcttcattattgagtcagatctgttgacagtgcattttcttctaactttagtcatgaattgctgcagaaatttataatacaactcatggctgtagatgtttttaattttgatggctagggagattcaagtgtacaatcccgctgctctcagtctaatttttgtcagtttgcttagatgacctgtccatatggaacttttaagtacgattaatacatcttcctgtgaatttacaaccatggatccatttttataagctctgtttctgtaaaggttttgtgagctttgtatatatctgctgttcttaacaatctgcaatctagcctattgcatggattgaaac

SEQ ID NO: 2333 - DNA, 1604 bp, Picea glauca
atgggacacgaatttctatttaattatactagtattccatattccacagcttgagctggaagtttattggcgagatcaatccttcttttacaagaacaatcatctctgtgttacattggactgaaattctgaattgggcattgtatttccgtctctctgttatcatcagaaacaatggcgatagtgaggaaatccaggaggaacccagtacatgtggtatcatcatgggtggcaaggcaacccccaaaggtgaaggcatttctagcggtagtgagcggcatcacagcccttatcgttctcagattcgtcgttcacaaccatgacaatctctttgttgctgccgaagcaacacatgctgtgggcatctctgtcttgatctacaagctcttcaaggaaaggaactgtgcaggcttatcacttaaatctcaggagcttactgctatattcttagcagtgagggtgtactgcagttttgttatggaatatgatatacacacagtgcttgattctgcaacattagccaccactttgtgggtgatttacatgatacgtttcaagttgaatgcaacgcatgacgaagatttggataattttccaatatattatgtggtgattccatgtgctgcacttgcactttttgtccatccaacgacatcccataatattgtaaacaggatactttgggccttttgtgtttaccttgaagctgttgcagttttaccacagcttcgcgtgatgcaaaatacaaagattgttgaaccattcacagcccattatgtgtttgcattgggtattgcaaggtttttcagctgtgcacattgggtcctccaggttttggatagccgtggctacttattgactgctttgggccatggcttgtggccgtccatggtacttttgtcagaaattgttcagacttttattttggcagacttttgctactactatgttcaaagtgttgtaggtgggcaacttgtgctgcggcttccttcaggagtggtgtgatttcaatcgaattgtcctgctgaagctgccatggaactggtgtatgctttggatctggcgacaagatctttcatctttaattctctacaattaattctagatagatttatagataagcaaaacagatggatgtaggagttttacctctatatggatggataaggaaactggaggttgaattcacttctgcaaagtgttgcttcaagtctagttgttccagtttgttctggacaaccatatggaatttttactacttgtgcatcctcccatgggttctctacaatgctgaatccaatttttaggcttgattttataaaacgctttgccagtgttgtgtatatttactgtccggatgaataatctgcagtctaggcttttaccgtggactttaaaagcataatcttgaccatttgtatatacttataacagatggctttttgtaaaagagaattcttgcaataaacagtccattggtctcaagattagctcgtttatgaactttattagctcatgctctgggaaacaaggcaaattggcatcaatggatactattttgtaaaatgcatattatattagctttaaaatcacgagaatgagtt

SEQ ID NO: 2334 - DNA, 1149 bp, Cirsium arvense
cggggatgtttatgcggctttacgccattttctagagagagaaatagagaaaaaggttatttgattctagagagagaaagagaatgacgatgaagggttcgaaacggccgattcaggtggtccgaacatgggtacgaagacaacctcccaaggtcaaggtgtttctaggttttgtctgcgccatcgccgcccttattttcattcgtatggtcgtttacgatcatgataacctcttcattgccgccgaagccgttcacgctctcggaatatctgttcttatttataaactcgccaccgagaaaacttgtgccggtctttcattaaaatcgcaagaactgacggctattttcttaggatccagactgtattgcagttttgttatggaatatgatgtgcatactttactagatttggctacattggcagctaccgtttgggttgtttatatgatgcgttttaacctaaatgctagttacatgcacgagaaagataatgttgcaaattattatgtggtgattccttgtgctttattgtctctgttgattcatccctccacacagcattacatcataaacaggattctttgggccttttgtgtttatctggaagctgtttcggtactgccacaacttcgtgttatgcaaaataccaagattgttgaaccgttcacagcacatttacgtttttgctttaggggttgctaaggtttttgagttgtgcccattggattctccaggtgttggataccaggggacggttgttgacagctttaggttacggattatggccttcgatggttctcctttctgaaatcgttcaaacatttatacttgccgatttctgctattactatgttcaaagtgttatgggcggacaactagtgttacgccttccttctggcgtggtgtgagttgaaagatggcgtaaaaaagaaagaaagaagtggttttaataactcctgaaaacagagatagtaagcaacatcatgttttatggttttttcttgtttattttcatgcatcattatctcaagtagcttaccatggggatcatccctctgtttaagtttatgtaaagtttttttttgatttaatgtgtttttagagtatttgggtgttaaaaaagaaaaaagtaccgactgcgactctc

SEQ ID NO: 2335 - DNA, 1455 bp, Pseudotsuga menziesii
gccggtcggaatttattggtgcagaccaatccttgttttaatcataacaatcatctgcttgttacattgggccgaaattctgaattttgcggtgtatctccgtccctgtgttatcagaaacaatggcgacagtgaggaaattcaggaggaacccagtacatgtggtatcctcatgggtggcaaggcaacccccaaaggtcaaggcatttctagcggtagtgacgggcatcacagcccttgtcgttctcagattcgtcgttcacaaccatgacaatctattcgttgctgccgaagcaactcatgccgtgggcatctctgttttgatctacaagcttttcaaggaacgaaactgtgcaggcttatcacttaaatctcaggagcttactgctatattcttagcggcaagggtgtactgcagttttgttatggaatatgatatacacacagtgcttgattctgcaacattagtcactactttgtgggtgatttacatgatacgtttcaagttaagggcatcgcatgatgaagatttggacaattttccaatatattatgtggtgattccatgtgctgcacttgcactttttatccatccaacgacatcccacaatattgtaaacagaatactttgggccttttgtgtttaccttgaagctgttgcagttttaccccagcttcgtgtgatgcaaaatacaaagatagttgaaccattcacagcccattatgtgtttgcattgggtattgcaaggtttttcagctgtgcacattgggtacttcaggttttggatagccgtggctacttgttgactgctttgggccatggcttgtggccgtccatggtacttttgtcggaaattgttcagacttttattttggccgacttttgctactattacgttaacagtgttgtaggtgggcaacttgtgctgcggcttccttcaggagtagtgtgattaaaaatttcaatctatgagtcctgctgaagttgatatggaactggtttatagtttggatctggtgacaatatctttcatgtttaattctctacaattaattctagatagatttagagatatgaaaaacacacggatgtaggagttttgcctctatatggatggataaggaaaccggaggttgaattctctcccgcaaagtgttgctttaagtctagttgttccattttgttctggacaactgtatgaaatatttacgacttgtgcatcctcccgtgggttctctacaatgctgaacccaatttttaggctttgattttataaaacgctttgccagtgttttgtatatttactgtcccgattaataatctgcagtctaggcttttagtatggactttaagatcatcaccttgaccattttgtatatacttataactctatctctatgagatggctttttgtaaaagagagttcttgcaataaacagtccaatagtttcaag

SEQ ID NO: 2336 - DNA, 912 bp, Centaurea maculosa
agagagagagagaatgaagggttcgtcgaagcggccgatccaggtggtgaggacatgggtacggaggcaaccgccgaaggtgaaggtgtttctagggttcgtctgcgcaatcgccgccctaattttcatccgtatggtggtttacgatcacgataacctcttcattgccgccgaggccgttcacgctctcggaatttctgttcttatctataagatcgccaccgagaaaacttgcgcaggtctttcactgaaatcacaggaactgacggccatcttcttaggaactaggctctactgtagttttgtaatggaatatgatgtacacactttactagacttggctacattggcagctaccgtttgggttgtctatatgatgcgctttaacctaaatgccagttacatgcacgagaaagacaatgttccgaattattatgtggtgattccttgtgctttattgtctctgttgattcatccctccacacagcattacatcgtaaacaggattctttgggccttttgtgtttatctcgaagctgtttcagtactgccacaacttcgtgttatgcaaaataccaagattgtcgaaccgttcacagcacattacgttttcgctttaggggttgcaaggtttctaagttgcgcacattggatcctccaggtgttggatacaaggggacgtttattgacggctttaggttacggattatggccttcgatggttctcctttctgaaatcgttcagacatttatacttgccgatttctgctactactatgttcagagtgttatgggcgggcaactagtgttacgccttccttctggcgtggtgtgagtcaaaaaatggcgtaaaaacgaagtggttttaataactcctgaaaaacagaggtagtaagcaacatcttgtttatg

SEQ ID NO: 2337 - DNA, 1339 bp, Vigna unguiculata
gaagagtggttgagcaacccacccgtcgcatataaaactagtaaacaaaaacatccaaactaatgtcacacgtgtcgttctaaatcatcgtcaactgagaacacagattacattagattggattgtatttttagcttctttcggaacaagttagaaaacacaagaccagacaaagtgacaaacaaataatctgttgggaaaagaaaaaaagaagaagaatgaagggaagcaagaggccgatccacaccgtcacgacatggtttcggcggcaaccgcccaagatgaaggtctttcttgcggtgctaatcggcctggccgccttgctcttcctcagaatcgttgttcatgaccacgatagccttttcgttgccgcggagtttgtccatgcattaggaatctccgtcctcatttacaaactcaccaaggaaaaaacctgtgccgggctttcgctgaaatcgcaggagctgacggcaatattcctaggcgtaagactttactgcagttttgtgatggaatatgatatacacaccctactcgatatggcaacattgggaacgaccatctgggttatctatatgatacgcttcaaactcaaatctagttatatggatgataaggataaccttgcaatatactatgtggtgataccttgtgctgtgctgtccttgtttattcatccaacaacccggcatcatacagttaataggattctctgggcattttgtgtttatcttgaagctgtctctgttctccctcaactgcgggttatgcagaacactaagatcgttgaaccattcacagcacactatgtttttgccctgggagttgcaaggttcttgagttgtgcacattgggttctccaggtaatagatactcatggacgtctactaactgcattgggttacggattgtggccttcatttgttcttctatcagaaattgttcaaactttcatcctggcagatttttgctattactacgtcaaaagtcttgtcggaggacaacttgttgttcggcttcctgcaggagtggtgtaattttcacattccttctcagattcctcaagttgagaaatcctttggcttgtggcacttagaaagtcagaatagatatagcagctagaggagtttgataggttatgtatacgcgtcaccgagtgaatttgagttgagaatgtactacacatgtaactttctgaaattttagtttatcttttgttttcatcacagttcttcaacttagtattaagaaaaagaggagtttgacactcatccactaaaattacactcaccttgcaactgttttaataacataataatatatattagcattttaaatt

SEQ ID NO: 2338 - DNA, 1153 bp, Euphorbia peplus
aaaatgaaggcgacgaagaggccgatccacgccgtgtccacatgggtccgaaaacaaccaccaaagatcaaagcttttctggcggtggtcaccggaatggccgctctggtttttctcagaatggtggttcgcgatcacgataatctttttgtcgccgccgagtcggtccatgccattgggatttctgtccttatttataagctcacaaaggagaaaacttgtgctggactttcactgaaaacacaggagctgacagctatatttttagctgttagactgtattgcagttttgtcatggaatttgacatacacacaatacttgattccgcgaccttgataacaaccctatgggtgatttacatgattcggtttaacttgagaaccagttatatggaagacaaagacaactttccgaatcattttgttttgataccgtgtgcggtgctatcttttcttattcatccaacaacacaacattatctaattaacaggatctgttgggctttctgtgtttaccttgaagcagtgtcagtgctgcctcaacttcgggtcatgcagaataccaagattgttgaacccttcacagcacactatgtttttgcccttggagttgcaagattcttgagttgtgcacattgggtgctccaggtactggatagtgggggccgccttttgacagcactgggctacggattgtggcctccgatggtcttaatttcggaaattgtacaaacgttcatacttgctgatttttgctattactacgtcaagagtctgtttggcggacaacttgttctacgtctcccctcaggagtggtataaacaaacttgatatgcagaagcaagaaaagcgcattgacaaagagagtgttcttgctgctggcttctgaagcttggatgaggtagtttatatagtttacacttggttctcttctcctttgcagccgattccgattaggggttcatttggaataggtgaactgtaaagtttggtgtgcattgggattttgatgtttatggttacttaataatttactaggattttttaacctaagtagagtaacaatgtaatgaatgccaatggtaaaaatttctccatgatggatggattaagagttgttttttctcctctcatggagattgttttctgtgg

SEQ ID NO: 2339 - DNA, 1071 bp, Arachis hypogaea
agttcatcagcttctattgtctcaattattcagaaggaatgaagggaaacaacaagaggcctatatacgccgtgacaacatgggttcggcgccagcccccaaaaatgaaggcctttctcgcccttctttccgccattgccgcccttgtcttcctcaggatggtagtcaacgaccacgacaacctcttcgtcgccgccgaggctgttcatgctttgggaatctccctcctcatctacaagctcaccaaggataaaacttgtgctgggctgtcactgaagtctcaggaactgacggctttgtttctagctgttagactgtactgcagttttgtgatggaatatgatatacacacaattctggatctggcaacactggtaaccaccctttgggttatctatatgatccgcttcaaactcaaatccacttatatggatgataaggataatctcgctatatacttggtcgtggcaccttgtgctgtagtgtccttctttatccatccaacgacccggaattctatcgttaacaggattctctgggccttctgtgtttatcttgaagccgtctctgttctaccacagcttcgggttatgcagaatactaagattgttgaaccaatcacagcacattatgtttttgcacttggagtagcaaggttcttgagttgtgcacattgggtcctccaggtaatcgatacacgcggacgcctactagttgttttgggttatggattgtggccttcaatggtgcttatatctgaaattgtccaaactttcatcctagcagacttttgctactactatgtcaagagcattattgggggacaacttgtagttcggcttccatcaggagtagtttaaaactaaaacaaattatcattaagatccccaagagaagctttttatgtgggtctgtaaaacatgtaacctaaataaacttaatttagtacttatcagtaattgactcaaattgatgtgtgcatgcctcgctagctataatgacaagtcaatttgcctgggaatattattatataattaataaagagaaagcatgcatttaaaaaagtcgtta

SEQ ID NO: 2340 - DNA, 974 bp, Eutrema parvulum
aattgaaaacgaagacgaagttaattagttgtgtgataatcattaatcacacacatttgatcctcggacaaaactcaaaccaagagagagatctggtaatctttggaatcatcagaatttgtggacgatgaaggcggagaagagtccgattcagtccgtgatgtcgtggattcgccggcagccgcctaaggtaaaggcgtttctcgctgtggttacggcaatgacggtgctcgtcttcctcagggtcattgtccatgagcacgacaaccttttcatcgcttccgaggctgttcatgccgtcggaatctccgtccttatctacaagctcaccaaggagaagacttgtgctgggatctctctcaagacccaggagctaacggctttgtttctcgccgtgcgattgtattgtagctttgtgatggaatttgatcttcacacattacttgattcagctacgttagtcacgactctttgggtcatttatatgatccgtttcaagcttagacccacttatatggaagacaaagacaattttgcaatctactacgttgtaatcccatgtgctgttgtggctttcctcattcatccatcgacacgtcaccatatcataaacaggctcttttgggcattctgtgtttatcttgaagctgtttcagttcttcctcaattaagagtcatgcagaacactaagatcgtggaaccattcacagcacattacgtatttgctttgggaatagctaggttcttgagttgtgcacactggatccttcaggtgttggatacgagagggcggttactgactgcattagggtatggattatggcctttaatggtccttctctctgaaatcatccaaactttcattcttgcagatttctgctattactatgttcagagtttaatgggtggacagctcgttcttcgtctcccgtctggtgtggtgtaagaagcgtgtggaggtttcgaattgatta

SEQ ID NO: 2341 - DNA, 1892 bp, Oryza sativa
ccgccgccgccttcgtcttctccgtcgccgacttctcctcctctccgatccaccgccaccgccgccgccgccgccgcctcgcccctccgatccgtcgccgccttcatcccctcccacacctcgatccgcccccgcctccccgagccggagccgccgctgccacctcctcctcctcgatccgccgctgcctccccgagttcgtcgtccaccgctgatcggccaacccgaggaaccttcgacgtttcaaacatgtctcgccgaggattgatggagcaggacttaagcaagcttgacgtgacaaagctccacccgttatcgcctgaagttatctcacgccaggcgacgatcaatataggtaccattgggcatgtggcccatggaaagtccaccgttgtgaaagctatatctggagttcagactgttcgcttcaagaatgagctggagcgtaacatcactataaagcttggttatgctaatgcgaaaatctacaaatgtgaagacgagaaatgcccacgaccaatgtgctacaaggcttatggaagtggaaaagaagatagccctcactgtgatgtgcctgggtttgaaaacactaggatgaagctactgagacatgtttcttttgttgattgtccggggcatgacattctcatggctacaatgcttaatggagctgctatcatggatggagcattgcttttgatagcagccaatgaaagctgcccacaaccccaaacatctgagcatcttgctgcggttgaaatcatgcgtctccaacatatcattattcttcagaacaagattgatcttatccaggaaagtgcagcaatgaatcaacatgaagcgatccagaaattcatccagggtaccatagctgaaggtgctccggtggtgccaatatctgctcagcttaagtataacattgatgtgatatgtgaatacattgtgaagaaaatccccattcctgaaaggaacttcacttcccctccaaacatgattgtcattcgctcctttgatgtcaacaagcctggttcagaggttgatgaaattaggggtggtgtagctggtggcagcatcctcagaggagttttgagggtgaaccagaacattgaagtccgccctggcattgtaatgaaggatgaaagcggcaacatcaaatgcaccccaatctattcaaggattgtttcgctctatgctgagcagaatgagctccaatttgctgtgcctggaggtcttattggtgtgggaacaaccatggatccaaccttgacacgtgctgatagactggttggtcaggttctaggtgaagttggatcacttcctgatgtctatgtggagcttgagatcaacttcttccttcttcggaggctgttgggtgtgaggacaaaaggtactgagaaggctgggaaggtctccaagctcaccaagggtgaaatcctcatgcttaacatcggatccatgtcgactggtgctcgtgtggttgctgtcaagaacgatcttgccaaacttcagctcactgcccctgtctgcacaagcaaaggtgagaaggttgcccttagccgtcgtgttgagaagcattggcgactcatcggatggggccagatccaggctggcacgacgctcgaagttccaccgtgtccgctctgaagtgcagttgtttaggcagaagtctaccaacagtttgaggtaagagagaaggaaatgtggaagggcagagagctcctaggcactattttcgtgagatggaggagaaaacaaatgagtttggaagagatgtcattgcgtgaattcacctacggtcgatactgaagtttgcctacattactaagtttgtttacattctgaatgctgggaaaatcgttttccttgccatgttgaagtaggcgagaaaccta

SEQ ID NO: 2342 - DNA, 2527 bp, Oryza sativa
cctccccccacaacccgccgccgccttcgtcttctccgtcgccgacttctcctcctctccgatccaccgccaccgccgccgccgccgccgcctcgcccctccgatccgtcgccgccttcatcccctcccacacctcgatccgcccccgcctccccgagccggagccgccgctgccacctcctcctcctcgatccgccgctgcctccccgagttcgtcgtccaccgctgatcggccaacccgaggaaccttcgacgtttcaaacatgtctcgccgaggattgatggagcaggacttaagcaagcttgacgtgacaaagctccacccgttatcgcctgaagttatctcacgccaggcgacgatcaatataggtaccattgggcatgtggcccatggaaagtccaccgttgtgaaagctatatctggagttcagactgttcgcttcaagaatgagctggagcgtaacatcactataaagcttggttatgctaatgcgaaaatctacaaatgtgaagacgagaaatgcccacgaccaatgtgctacaaggcttatggaagtggaaaagaagatagccctcactgtgatgtgcctgggtttgaaaacactaggatgaagctactgagacatgtttcttttgttgattgtccggggcatgacattctcatggctacaatgcttaatggagctgctatcatggatggagcattgcttttgatagcagccaatgaaagctgcccacaaccccaaacatctgagcatcttgctgcggttgaaatcatgcgtctccaacatatcattattcttcagaacaagattgatcttatccaggaaagtgcagcaatgaatcaacatgaagcgatccagaaattcatccagggtaccatagctgaaggtgctccggtggtgccaatatctgctcagcttaagtataacattgatgtgatatgtgaatacattgtgaagaaaatccccattcctgaaaggaacttcacttcccctccaaacatgattgtcattcgctcctttgatgtcaacaagcctggttcagaggttgatgaaattaggggtggtgtagctggtggcagcatcctcagaggagttttgagggtgaaccagaacattgaagtccgccctggcattgtaatgaaggatgaaagcggcaacatcaaatgcaccccaatctattcaaggattgtttcgctctatgctgagcagaatgagctccaatttgctgtgcctggaggtcttattggtgtgggaacaaccatggatccaaccttgacacgtgctgatagactggttggtcaggttctaggtgaagttggatcacttcctgatgtctatgtggagcttgagatcaacttcttccttcttcggaggctgttgggtgtgaggacaaaaggtactgagaaggctgggaaggtctccaagctcaccaagggtgaaatcctcatgcttaacatcggatccatgtcgactggtgctcgtgtggttgctgtcaagaacgatcttgccaaacttcagctcactgcccctgtctgcacaagcaaaggtgagaaggttgcccttagccgtcgtgttgagaagcattggcgactcatcggatggggccagatccaggctggcacgacgctcgaagttccaccgtgtccgctctgaagtgcagttgtttaggcagaagtctaccaacagtttgaggtaagagagaaggaaatgtggaagggcagagagctcctaggcactattttcgtgagatggaggagaaaacaaatgagtttggaagagatgtcattgcgtgaattcacctacggtcgatactgaagtttgcctacattactaagtttgtttacattctgaatgctgggaaaatcgttttccttgccatgttgaagtaggcgagaaacctactaccctttggatcaggatcatctttacacatctcagcgagaatcagttatgcatggctgagaatcagttgtgcatggcattcacgtgttgcaaccgaaagtaacaaacatgaccaacacacttagtaataatatggatatcttgaaaatattgcaatacagatatttgctaaaggcagagtatacctcatttcttcataacttgagcttcaatccacgtctcatcccagtaatactagtccatgttgttaagggcatgttttgtggacggcctgagcagtgcctgagacctccctgaggttttgatggaataggaatgcctggtcaggcaagcctttggttggtgttgtgcctgagaacagatgaaaaaaaaaggttatgacttataccaggggcaaaaaaaaaaaaagatgagaagccaggggcaaaaatagtttaatcatctagtcatatcatcagtatcacaaccactcaaccagcacctgctgacctgcatggctgcatgctgcactaatcaatccacttgattatgcggtggcgcttgggctaatgatgcacggaagtaactcaggccaggcgtcactggaaatattcagggcaccaaccaaacaccactcagcc

SEQ ID NO: 2343 - DNA, 1921 bp, Setaria italica
atccagctcgctcgctagggttaccttaccgccgcgccgccctctctctcatttgcagtcgcctctgcttctccatctcgttcacgccggcggaggaccctctcccactcgtgctcatcgttcccctcgccgtcagttgctccaccgccgggctcctccgcagcttctggtgtttccaagatggctcgccgaggattgatggaacaggacttaagcaagcttgatgtgacaaagcttcacccattgtcacctgaagttatctcacgccaagcgaccattaacattggtaccatcggccatgtggctcatggaaagtccactgttgtgaaagctatttctggagttcagactgtccggttcaagaatgagctggagcgtaacattactataaagctgggttatgctaatgcaaaaatctacaaatgtgaggacgacagatgtccacgaccgatgtgctacaaggcctacggaagcggaaaagaagacagccctcactgtgatgtgcctgggtttgaaaacactaggatgaagctcctgagacatgtttcttttgttgattgcccggggcacgacattctcatggctacaatgcttaacggagctgctatcatggatggagcactgcttttgattgcagcgaatgaaagttgcccacagccccagacatctgagcatcttgcagctgttgagatcatgcgtctccagcatatcatcattctgcagaacaagattgaccttatccaggaaagtgcagcgatgaaccagcatgaagcaatccaaaaattcatccagggaacaatagctgaaggcgctcctgtggtgcctatatctgcccagctgaaatacaacattgatgtgatctgtgaatacattgtgaagaaaatccccatccctgaaaggaactttacctcacctcccaatatgattgttattcgctcgtttgatgttaacaagcctggttcagaggttgatgaaattaggggtggtgtagctggtggcagtatcctcaggggagttctgagggtaaaccagaaaattgaagttcgccctggcattgtcatgaaagatgaaagtggcaacatcaagtgcaccccaatctactcaaggattgtctcgctatatgctgagcagaatgagctccaatttgctgtgcctggagggcttattggtgtgggaacaaccatggacccaactctaacacgtgctgatagacttgttggtcaggttcttggtgaagttggctctctacctgatgtttacgtagagcttgagatcaatttcttccttctccggagacttctgggtgtgaggacaaaaggtacagagaaggcagggaaggtgtccaagctcaccaagggcgagatcctcatgcttaacataggatccatgtcgacaggcgcccgcgtgcttgccgttaagaatgatcttgccaagctacagctcaccgcgcccgtctgcacaagcaaaggagagaaggttgccctgagccgtcgtgttgagaagcattggcgccttatcggatggggccagatccaggccggttcaacactcgaagtgccaccctgcccgctctgaagcatcatcacaccagaatttgagctgaagctgtgagtgctgtgaggagaaaacatgagattgttggtagtcctgcctctgtgttacttagccactagtcgggttttgtttcttggaaattttgaagggcactttacattgtgttactataggacgagtcctgtgaacattagcaggttgaaaaccagctgcctgtggatcagtattgccttgtcgacatttatggtggtgtcatcctgggttcaatgttttcgcaccaaatatttgtacttttcactaatgttgggttggctacttgaagaagcctaccaaatagaaccacgtgtcgttgtgcatatgcgcaatt

SEQ ID NO: 2344 - DNA, 2229 bp, Sorghum bicolor
gttcacggttcagcttgctctccccagcagcgacgactgggcgacccccgccgccgcactaaaccctaccccaggtctgcgtcgggctcttgccggcggcgagcaccagccaggtatgcctacaccttctcttgcctccgtgctgcgcgaaaccgagcacccaaccctaccccaagctgttcggctatttgtgctcggatctgatctaattaccgggcccgtccctgattcttaaggaacccttacctgcttggacgcaatttgttcgtaccagctctgctgcgagatatcggatccgaatttccaagaacgggaaatagatttgatgttcagttgaacgcccatccaacgctaagttcgcacctggttgagtagcgattaggggttaggacttgatgcatctgtgtccttatatattatggaatccgtgttaatcgctggtcctgcctgcctgtgtgttgggcgatgctatgctagagaggaaaaatgcttaatgatgttgtttatgtggttggtattgagtcagtaagtgctgaacaagacactaggtttatctttccagttaccattgtgcagcttccaagatggctcgtcgtggattgatggaacaggacttaagcaaactggatgtgacgaagcttcacccactgtcacctgaagttatctcacgccaagcaacaatcaatattggtaccattggccatgtggctcatggaaagtctactgttgtgaaagctatatctggagttcagactgttcggttcaagaatgagctggaacgtaacattactataaagctgggttacgctaatgcaaaaatctacaaatgtgaggatgacagatgtccacgaccaatgtgctacaaggcatatggaagcggaaaagaagatagccctctatgtgatgtgcctggatttgaaaacactagaatgaagctcctgagacatgtttcttttgtcgattgcccgggacacgacattctcatggctacaatgcttaatggagcagctatcatggatggagctcttcttttgatcgcagcaaatgaaagttgtccacagccccagacgtctgaacatcttgctgctgttgaaatcatgcgtcttcaacatatcatcattctgcagaacaagattgatcttatccaggaaagtgccgcgatgaatcagcatgaagcaatccagaaattcatacaggggacaatagctgaaggtgcacctgtggtgcctatatctgcccagctgaaatacaacattgatgttatctgtgaatacattgtgaagaaaatccctatccctgaaaggaactttacctcgcctcccaacatgattgttattcgctcctttgatgttaacaagcctggttcagaggttgatgaaattaggggtggtgtagctggtggcagtatcctcaggggagttctgagggtgaaccagaagattgaagttcgccctggcattgtcatgaaagatgagagtggaaacattaagtgcactcctatctattcaaggattgtttcactctatgctgagcagaatgaactccaatttgctgtcccaggagggcttattggtgtaggaacaaccatggacccaactctaacgcgtgctgataggctggttggccaggttcttggtgaagttggttcactacctgatgtttatgtagagcttgagatcaatttcttcctactccggaggctgttgggtgtgaggacgaaaggtacagagaaggcagggaaggtgtcgaagctcaccaagggcgagatcctcatgcttaacataggatccatgtccacaggcgcccgcgtgctcgctgttaagaacgatctcgccaagctacagctcaccgcacctgtctgcacgagccgaggcgagaaggttgctctgagccgtcgtgttgagaagcattggcgcctcatcggatggggccagatccaagccggtacaacacttgacgtaccaccgtgcccgctttaaactgaagcgtcatactcagacgtgacctgaagttgtgagtgccaaagagaaaagatgagtttgttggtagtcctgcctttgtgttactgcagagccaaagtcttaggccactctagttttattttgttttgttcaattttggaggccacttccattatgattcctgtgaacattagcaggtcggaaaccagtattgtgaacattgtgagtacggcatatggatcagtattgccaacgtcttgctttcgca

SEQ ID NO: 2345 - DNA, 1797 bp, Zea mays
cggagctggggcctcagcttgatcccaggctgccgttcgcggaatctctcttcccactagcgacgactgggcgacctccgccgccacactaaaccctactccaggtgcccaggtctgcgtcgggcccttgccggcgacgagcacccgctagttacctctgtgcggtttccaagatggctcgccgtggattgatggaacaggacttaagcaaattggatgtgacaaagcttgacccactgtcacctgaagttatctcacgccaagcaacaatcaatattggtaccattggccatgtggctcatggaaagtctactgttgtgaaggctatatccggagttcagactgttcggttcaagaatgagctggaacgtaacattactataaagctgggctatgctaatgcaaaaatctacaaatgtgaggatgacagatgtccacgaccaatgtgctacaaggcctatggaagcggaaaagaagatagccctctatgtgatgtgcctggatttgaaaacactagaatgaagctcctgagacatgtttcttttgttgattgcccgggacacgacattctcatggctacaatgcttaatggagctgctatcatggatggagctcttcttttgatcgcagcaaatgaaagttgtccacagccccagacatctgagcatcttgctgctgttgaaatcatgcgccttcaacatatcatcattctgcagaacaagattgatcttatccaggaaagtgcagcaatgaatcaacatgaagcaatccaaaaattcatccagggaacaatagctgaaggtgcacctgtggtgcctatatctgcccagctgaaatacaacattgatgttatttgcgaatacattgtgaagaaaatccccatccccgaaaggaactttacctcgcctcccaacatgattgttattcgttcctttgatgttaacaagcctggttcagaggttgacgaaattagaggtggtgtagctggtggcagtatcctcaggggagttcttagggtgaaccagaagattgaagttcgccctggcattgttatgaaagatgagaatggaaacattaagtgcacgccaatctactcaaggattgtctcactctatgctgagcagaatgagctccaatttgctgtcccaggagggcttattggtgtgggaacaaccatggacccaactctaacgcgtgctgataggctggttggccaggttcttggtgaagttggttcactacctgatgtttatgtagagcttgagatcaatttcttcctactccggaggctgttgggtgtgaggacgaaaggtacagagaaggcagggaaggtgtcgaagctcaccaagggcgagatcctcatgcttaacataggatccatgtccacaggcgcccgtgtactcgccgttaagaacgatcttgccaagctacagctcaccgcgcctgtctgcacgagccgaggagagaaggttgctctgagccgtcgtgttgagaagcattggcgtctcatcggatggggccagatccaggccggtacaacacttgaagtaccaccctgcccgctctaaagcgtcatacacagacgtgagcttaatttgtgtgtgccaaagaaaaaaaatgagtttgttgttagtattgtctttgtgttactgcatatccaaagccttaggccattctagtttaattttgtttcgttcaattttggaggccacttccattatgattcctgtgaacattagcaggtcagaaaccagtactgtgaacattatgagtacgacgtgtggatcagtattgcca

SEQ ID NO: 2346 - DNA, 1904 bp, Avena sativa
cgacctcccagacttcgacgcctccctgctccgccgtctagactctcgcgcgaacctcaccaccaccggcgagcggctgccctccagccacctcgctcgccccctcggttcgcgtcagatctacgcgcgcggcgaccgtcttcgtctcggcacacccaacccgccggtcctccctagccaagtttcaatcatggcacgccgaggattgatggagcaggacctaagcaagctcgatgtcacaaagctccacccgttgtcacctgaagtcatctcgcgtcaagcaacaatcaacattggtacaattggtcatgtggcccatggcaagtctactgtcgtgaaagctatatctggagttcagactgttcgcttcaagaacgagcttgagcgtaacatcactatcaagctgggttatgctaatgcaaaaatctataaatgtgaggatgacaagtgtccacgaccagtctgctacaaggcttatggaagcggaaaagaagatactccttattgtgatgtgcctgggtttgaaaacactaggatgaagctcctgagacatgtttcctttgttgattgcccgggccacgatattctcatggctacaatgcttaatggagcagctatcatggatggagcgttgcttttgatagcagcaaatgaaagctgcccacaaccccagacatctgagcatcttgcagctgttgaaatcatgcgtctccaacatctgataattctgcagaataagattgaccttatccaggaaagtgcagcaatgaaccagcatgaagcaatccaaaaattcatccagggcacgatagctgaaggtgctcctgtggttccaatatctgcccagctgaagtacaacatcgatgtgatctgtgaatatattgtgaagaaaattcctattccggaaaggaacttcacttcacctcctaacatgattgttattcgctcctttgatgtcaacaagcctggttctgaggtcgatgaaattaggggtggggtagcaggtggcagcatcctcaggggagtcctcagggtgaaccagaacattgaagttcgccctggcattgtcatgaaggatgagagtggcaacatcaaatgcaccccaatctactcaaggattgtctcgctctatgctgagcagaatgagctccagtttgctgtaccaggagggcttattggtgtgggaacaaccatggatcctactttgactcgtgctgataggctggttggccaggttcttggagaaattgggtcgcttcctgatgtattcgtggagcttgagatcaacttcttccttctccgaaggctgttgggtgtgagaacaaagggcacagagaaggcagggaaggtctccaagctcaccaagggtgagatcctgatgcttaacattgggtccatgtccaccggtgcccgtgtggttgctgtcaagaacgatcttgccaagctccagctcaccgcgcctgtctgcacaagcaagggcgagaaggttgccctcagccgccgtgtcgagaagcattggcgtctcatcgggtggggccagatccaggccggcgcgacgctcgaggtcccaccctgcccgctgtgaagcacactcccctgcagtttgtgagagaagagagacgaaaatgtggaagggcagagagctcctaggtacagtttttgtgaggtggaggagaaaacatgagtctggaagtcttgtctttgtgggttattatcccagatttgtttacgctactagtttgctttctctttgtctgaaacttaggatttacctttgccatgttatcatggagtgtttagtaggcgaggaacctactactttggttcagatttacctaaatcgtcttgccgatcaactcattgacttcatcgtgtctttcgttgagcagacttcagaattttat

SEQ ID NO: 2347 - DNA, 1757 bp, Avena sativa
cgacctcccagacttcgtcgcctccctgctccgccgtctagactctcgcgcgaacctcaccaccaccggcgaccggctgctctccatccacctcgctcgccccctcggttcgcgtcagatctgcgcgcgcggcgaccgtcttcgtctcggcacacccaacccgccggtgctccctagccaagtttcaatcatggcacgccgaggattgatggagcaggacctaagcaagctcgatgtcacaaagctccacccgttgtcacctgaagtcatctcgcgtcaagcaacaatcaacattggtacaattggtcatgtggcccatggcaagtctactgtcgtgaaagctatatctggagttcagactgttcgcttcaagaacgagcttgagcgtaacatcactatcaagctgggttatgctaatgcaaaaatctataaatgtgaggatgacaagtgtccacggccagtgtgctacaaggcttatggaagcggaaaagaagatactccttattgtgatgtgcctgggtttgaaaacactaggatgaagctcctgagacatgtttcctttgttgattgcccgggccacgatattctcatggctacaatgcttaatggagcagctatcatggatggagcgttgcttttgatagcagcaaatgaaagctgcccacaaccccagacatctgagcatcttgcagctgttgaaatcatgcgtctccaacatctgataattctgcagaataagattgatcttatccaggaaagtgcagcaatgaaccagcatgaagcaatccaaaaattcatccagggcacgatagctgaaggtgctcctgtggttccaatatctgcccagctgaagtacaacatcgatgtgatctgtgaatatattgtgaagaaaattcctattccggaaaggaacttcacttcacctcctaacatgattgttattcgctcctttgatgtcaacaagcctggttctgaggtcgatgaaattaggggcggggtagcaggtggcagcatcctcaggggagtcctcagggtgaaccagaacattgaagttcgccctggcattgtcatgaaggatgagagtggcaacatcaaatgcaccccaatctactcaaggattgtctcgctctatgctgagcagaatgagctccaatttgctgtgccaggggggcttattggtgtgggaacaaccatggatcctactttgactcgtgctgataggctggttggccaggttcttggagaaattgggtcgcttcctgatgtatttgtggagcttgagatcaacttcttccttctccgaaggctgttgggtgtgagaacaaagggcacagagaaggcagggaaggtctccaagctcaccaagggtgagatcctgatgcttaacattgggtccatgtccaccggcgcccgtgtggttgctgtcaagaacgatcttgccaagctccagctcaccgcgcctgtctgcacaagcaagggcgagaaggtcgccctcagccgccgtgtcgagaagcattggcgtctcatcggatggggccagatccaggccggcgcgacgctcgaggtcccaccctgcccgctgtgaagcacactcccccgcagtttgtgagagaagagagacgaaaatgtggaagggcagagagctcctaggtacagtttttgtgaggtggaggagaaaacatgagtctggaagtcttgtctttgcgggttattatcccggatttgtttacgctactagtttgctttctctttgtctg

SEQ ID NO: 2348 - DNA, 1772 bp, Saccharum officinarum
ttcacggctcagcttgctctctttctcccgcagcgacgactgggcgacccccgccgccgcactaaaccctactcttcccccaggtctgcatcgggctcttgccagcgacgaccacccgccagtttccaagatggctcgtcgtggattgatggaacaggacttaagcaaactggatgtgacaaagcttcacccactgtcacctgaagttatctcacgccaagcaacaatcaatattggtaccattggccatgtggctcatggaaagtctactgttgtgaaagctatatctggagttcagactgttcggttcaagaatgagctggaacgtaacattactataaagctgggttacgctaatgcaaaaatctacaaatgtgaggatgacagatgtccgcggccaatgtgctacaaggcctatggaagcggaaaagaagatagccctccatgtgatgtgcctggatttgaaaacactagaatgaagctcctgagacatgtttcttttgttgattgcccgggacacgacattctcatggctacaatgcttaatggagcagctatcatggacggagctcttcttttgatcgcagcaaatgaaagttgtccacagccccagacgtctgaacatcttgctgctgttgaaatcatgcgtcttcaacatatcatcattctgcagaacaagattgatcttatccaggaaagtgcagcgatgaatcagcatgaagcaatccaaaaattcatccaggggacaatagctgaaggtgcacctgtggtgcctatatctgcccagctgaaatacaacattgatgttatttgtgaatacattgtgaagaaaatccccatccctgaaaggaactttacctcgcctcccaacatgattgttattcgctcctttgatgttaacaagcctggttcagaggttgatgaaattaggggtggtgtagctggtggcagtatcctcaggggagttctgagggtgaaccagaagattgaagttcgccctggcattgtcatgaaagatgagactggaaacattaagtgcaccccaatctactcaaggattgtttcactctatgctgagcagaatgaactccaatttgctgtcccaggagggcttattggtgtgggaacaaccatggacccaactctaacgcgtgctgataggctggttggccaggttcttggtgaagttggttcactacctgatgtttatgtagagcttgagatcaatttcttcctactccggaggctgttgggtgtgaggacgaaaggtacagagaaggcagggaaggtgtcgaagctcaccaagggcgagatcctcatgcttaacataggatccatgtccacaggcgcccgcgtgcttgctgttaagaatgatctcgccaagctacagctcactgcgcctgtctgcacgagccgaggagagaaggttgctctgagccgtcgcgttgagaagcattggcgcctcatcggatggggccagatccaggctggtacaacacttgacgtaccaccctgcccgctctaaagcgtcatactcagacgtgagctgaacttgtgattgccaaagagaaaagatgagtttgttggtagtcctgtctttgtgttactgcagatccaaagtcttaggccactctagttttattttgtttcgttcaattttggaggccacttccattatgattcctgtgaacattagcaggtcggaaatcagtattgtaaacattatgagtacggcatatggatcagtattgccaatgtcttgttttcgcacc

SEQ ID NO: 2349 - DNA, 1881 bp, Lolium multiflorum
cctaggacctctgccctctcccccagacgcctccctgctccgccgtctagctctcgcgcgaacctcgcccgcaccggcgaccaccccccgtctccggcgacccccatcctcctcgctcgtccactcggttcgcgtcagatctacgcgcgcgcgcgcggcgaccctcttcgcctcgccacacccaacccgccgccggtcctccctagccaagtttcaatcatggcacgccgagggttgatggagcaggacctgagcaagctcgacgtcacaaagctccacccgttgtctcctgaagtcatctcgcgccaagcgaccatcaacattggtacaatcggtcatgtggcccacggaaagtctactgtcgtgaaagctatatctggcgttcagactgttcgcttcaagaatgagcttgagcgtaacatcactatcaagctgggttatgctaatgcaaaaatctataaatgtgaggatgacagatgtccacggcccatgtgttacaaggcttatggaagcggaaaagaagatactcctgcctgtgatgtgcctgggtttgaaaacactaggatgaagctcctgagacatgtttcctttgttgattgcccgggccacgacattctcatggctacaatgcttaatggagcagctatcatggatggagccttgcttttgattgcagcgaatgaaagctgcccacagcctcagacgtctgagcatctcgcagctgttgaaatcatgcggctccaacatctcataattctgcagaataagattgaccttatccaggaaagtgcagcaatgaaccagcatgaagcaatccaaaaattcatccagggcacgatagctgaaggtgctcctgtggtgccaatatctgcccagctgaagtacaacattgatgtgatctgtgaatatattgtgaagaaaatccccattccggaaaggaacttcacttcacctcccaacatgattgttattcgctcctttgatgtcaacaagcctggttcagaggttgatgaaattaggggtggggtagcaggtggcagcatcctcaggggagtcctcagggtgaaccagaacattgaagttcgccctggaattgtcatgaaggatgagagtggcaacatcaaatgcaccccaatctactcaaggattgtctcgctctatgctgagcagaatgagctccagtttgctgtgccaggagggcttattggtgtgggaacaaccatggacccaactttgactcgtgctgataggctggttggccaggttctaggagaaattgggtcgcttcctgatgtatttgtggagctggagatcaatttcttccttctgcgaaggctgttgggtgtgagaacaaagggtacagagaaggcaggaaaggtctccaagctcactaagggtgagatcctgatgcttaacatcgggtccatgtccactggcgcccgtgtggttgctgttaagaacgatctcgccaagctccagctcaccgcgcctgtgtgcacaagcaagggtgagaaggtcgccctgagcctccgtgtcgagaagcattggcgtcttatcggatggggccagatccaggccggcgcgacgctcgaggtcccaccctgcccgctgtgaagcactcccccgcagtttgtgtgagaagagagacgaaatgtggaagggcagagagctcctaggtacagtttttgtcaaatggagaagaaaacatgagtctggaagtcttgtctttgcgggttattatcccggattatttgtctacgctactagtttgctttctctttgttggagtttaggaaatcattttacttgccatgttatcatggatgtgttagtaggcgaggaacctactactttggttcagattttacctaaatcgtcttg

SEQ ID NO: 2350 - DNA, 1938 bp, Secale cereale
tcgctcccgtcccctgttaggttttcccccaccccacccaagcgcgccgccggctgtctccgccgacctccgccacgcccctcgccgctcgaccccgacccctccgagtccctcgccgccgacgccgccgtcccccgactccgccccgccccgccctcaccgccagacgccgtttcaatcatggcacgccgaggattgatggagcaggacctaaccaagcttgatgtcaccaagctccacccgttgtcacccgaagtcatctcgcgccaagcgaccatcaacattggtacaattggtcatgtggcccatggaaagtctactgttgtgaaagctatatctggagttcagactgttcgcttcaagaatgagcttgaacgtaacatcactatcaagctgggctatgctaatgcaaaaatctataaatgcgaggatgacaaatgtccacgaccaatgtgttacaaggcttatggaagcggaaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgaaatcatgcgtctccagcatctcataattttgcagaataagatcgatcttatccaggaaagcgcagcaatgaaccagcatgaagcaatccaaaaatttatccagggcacgatagctgaaggtgctcctgtggtgccaatatctgcccagctgaagtacaacattgatgtgatctgtgaatacattattaagaaaatccccattccagaaaggaacttcacttcacctcccaacatgattgttattcgctcctttgatgtcaacaagcctggttcagaggttgatgaaattaggggtggggtagcaggtggcagcatcctcaggggagtcctcagggtgaaccagaatattgaagttcgccctggcattgtcatgaaggatgagagtggcaacatcaaatgcaccccaatctattcgaggatcgtctcgctctacgcagagcagaacgaactccaatttgctgtgccaggagggcttatcggtgtgggaaccaccatggatccaactttgactcgtgccgacaggctggttggccaggttctaggagaaatcgggtcacttcccgacgtattcgtggagcttgagattaacttcttccttctccgaaggctgctgggtgtgagaacgaagggtacagagaaggcagggaaggtctccaagctcaccaagggcgagatcctgatgcttaacatcggatccatgtccaccggcgcccgcgtggtcgccgtgaagaacgatctcgccaagctccagctcaccgcgcctgtgtgcaccagcaagggcgagaaggtggccctgagccgccgtgtcgagaagcattggcgcctcatcgggtggggccagatccaagccggcgcgaccctcgaagtcccaccttgcccgctctgaagtacacccccatctgagtgaaaagccgcagcttgtgaaacaagagaagtgaaatgtggaagggcagagagctcctaggtacaatttttgtgaggtggaggagaaaacacctcgagtctggaagtcttgtctttgctggatttgtctacactactagtttgcttctttctttttggcggaatttagggtttgttatcatggcggtcgtggttagtagggatggaacctgctacttcggttcagatttacccatcacattgactccattgtgtcttgcgttgagaagatttcacctaattttacttggtcctgtctttcttgtcaagaaaaaaaaaaaaaaacaaacgcacctgcacgacgacg

SEQ ID NO: 2351 - DNA, 2078 bp, Pennisetum glaucum
ctagcccagcaagcgaaccctcgtaatccccccatccagctccgctcgcttcgctagctagggttaccgaccgccgcgccgccctctctctcatttgcagtcgtctctgcttctccatctcgttcacgccggcggaggaccctgcctctcccattcgcgctcgtcgttcccctcgccgtgtctccgccgccgtcgtccgcaggttcagtttccaagatggctcgccgaggattgatggaacaggacttaagcaagcttgatgtgaccaagcttcacccattgtcacctgaagttatctcacgccaagcgaccattaacatcggtaccattggtcatgtggctcatggaaagtctactgttgtgaaagctatttctggagttcagactgttcggttcaagaatgagctagaacgtaacatcactataaagctgggttacgctaatgcaaaaatctacaaatgtgaggatgacagatgtccgcgaccaatgtgctacaaggcctatggaagcggaaaagaagatacccctccctgtgatgtgcctgggtttgaaaacaccaggatgaagctcctgagacatgtttcttttgttgattgcccgggtcacgacattctcatggctacaatgcttaatggagctgctatcatggatggagcactgctgttgatcgcagctaacgaaagttgcccacagccacagacatctgagcatcttgcagctgttgaaatcatgcgtctccagcatattatcattctgcagaacaagattgaccttatccaggaaagtgcagcgatgaaccagcatgaagcaatccaaaagttcatccaggggacaatagctgaaggtgctcctgtggtgcctatatctgcccagctgaaatacaacattgatgtgatctgtgaatacatcgtgaagaaaatccccatccctgaaaggaacttcacttcacctcccaatatgattgttattcgctcctttgatgttaacaagcctggctcagaggttgatgaaattaggggtggtgtagctggtggcagtatcctcaggggagttctgagggtgaaccagaagattgaagtccgccctggaattgtcatgaaggatgaaaatggcagcatcaaatgcaccccaatctactcgaggattgtgtcactatatgctgagcagaatgagctccaatttgctgtgcccggagggcttattggtgtgggaacaaccatggacccaactctaacacgtgctgatagactggttggtcaggttctcggtgaagtcggctcgctacctgatgtttatgtagagcttgagatcaatttcttccttcttcggagactactgggtgtgaggaccaaaggtacagagaaggctgggaaggtgtccaagctcgccaagggtgagatcctcatgctcaacataggatccatgtcgacaggcgcccgtgtgcttgccgttaagaacgatcttgccaagctacagctcactgcccccgtctgcacaagcaaaggggagaaggttgccctgagccgtcgtgttgagaagcattggcgtcttatcggatggggccagatccaggccggctcgacactcgaagtaccaccctgcccgctttgaagcgtcatcacatcacacttgagctgaaactgtgagtgccgtgaggagaaaacatgagattgttggtagtcctggctctgtgttacctagccactagctggaatttgtttcttggaaattttgaaaggcgatttgcatcatgttactataggatgagtcctgtgaacgttagcaggttgaaaaccagctgcctgtggatcagtattgccttgtcgacattgatggtagtgtcatctcgtgttgagtgttttcgcaccaaatatttgtactgttcgctactgttgggttggctgcttgttgaagaagcctaccaaatacaaccacgtgtcgttgtgcatatgcgcaattcgataactgcaatgttcattgatcataaatcaggctctcattttatttgttttcaagtagagttgccatacattttcagcctacgtacgcaaagagagcacgaggcagagaattagcat

SEQ ID NO: 2352 - DNA, 1843 bp, Pseudoroegneria spicata
cggcttcctagcgccctccccgctcgtcccctcggcccgcagcacatccaggcgcgcggcgacccccctcgtcgcggcaagtacacccagctcgacggtcccccaacccaagtttcaatcatggcgcgccgaggattgatggagcaggacctaaccaagcttgatgttaccaagctacacccgttgtcgcctgaagttatctcgcgccaagcgacgatcaacattggtacaattggtcacgtggcccatggaaagtctactgttgtgaaagctatatctggagttcagactgttcgcttcaagaatgagcttgaacgtaacatcactatcaagctgggctatgctaatgcaaaaatctataaatgcgaggatgacagatgtccacgaccaatgtgttacaaggcttatggaagcgggaaagaagatactcctgcctgtgatgttcctgggtttgaaaacactaggatgaagctcctcagacatgtttcctttgttgattgcccgggccacgacattctcatggctacaatgcttaatggagcagctatcatggatggagccttgcttttgatagcagcaaatgaaagctgcccacaaccccagacgtctgagcatcttgcagctgttgaaatcatgcgtctccagcatctcataattttgcagaataagattgatcttatccaggaaagtgcagcaatgaaccagcatgaagcaatccaaaaatttatccaggggacgatagctgaaggtgctcctgtggtgccaatatctgcccagctgaagtacaacattgatgtgatctgtgaatatattattaagaaaatccccattccggaaaggaacttcacttcacctcccaacatgattgttattcgctcctttgatgtcaacaagcctggttcagaggttgatgaaatcaggggtggggtagcaggtggcagcatcctcaggggagtcctcagggtcaatcagaatattgaagttcgccctggcattgtcatgaaggatgagagtggcaacatcaaatgcaccccaatctattcgaggattgtctcactgtatgctgagcagaatgaactccaatttgctgtgccaggagggcttattggtgtgggaacaaccatggatccaactttgactcgtgccgacaggttggtcggccaggttctaggagaaatcgggtcgcttcccgacgtattcgtggagcttgagatcaacttcttccttctccgaaggctgctgggcgtgagaacaaagggcacggagaaggctgggaaggtctccaagctcaccaagggcgagatcctgatgcttaacatcggatccatgtccaccggcgcccgcgtggtcgctgtgaagaacgatcttgccaagctccagctcaccgcgcccgtctgcaccagcaagggcgagaaggtggccctgagccgccgtgtcgagaagcattggcgcctcatcgggtggggccagatccaagccggcgcgaccctcgaagtcccaccctgcccgctctgaagcacacccccatctgagtgaaaaacccgcagcttgtgaaacgagaggcgaaatgtgggagggcagagagctcctaggtacaatttttgtgaggtggaggagaaaacaccatgagtctgcaagtcttgtcgttgccagatttgtctacactgctagtttgcttctttctttttgtcggaatttagggtttgttatcatggccgctgtggttagtaggcggcgaacctactacttcggttcagatttatttacctatcacattgactccattatgtcttgcgttgagaagatttcagttggtgtattacacctagttttaaaaaaaaaa

SEQ ID NO: 2353 - DNA, 1843 bp, Secale cereale
accggcttcccagcgccctccccgctcgcccccctcggcccgcagcacatccacgcgcgcggcgaccctcctcgtcgcggcaagcacactcagcttgacggtcctccaacccaagtttcaatcatggcgcgccgaggattgatggagcaggacctaaccaagcttgatgttaccaagctacacccgttgtcgcctgaagttatctcgcgccaagcgacgatcaacattggtacaattggtcatgtggcccatggaaagtctactgttgtgaaagctatatctggagttcagactgttcgcttcaagaatgagcttgaacgtaacatcactatcaagctgggctatgctaatgcaaagatctataagtgcgaggatgacagatgtccacgaccaatgtgttacaaggcttatggaagcgggaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagttgcccacaaccccagacatctgagcatctagcagctgttgaaatcatgcgtctccaacatctcataatcttgcagaataagatcgatcttatccaggaaagtgcagcaatgaaccagcatgaagcaatccaaaaatttatccagggcactatagctgaaggtgctcctgtggtgccaatatctgcccagctgaagtacaacattgatgtgatctgtgaatacattattaagaaaatccccattccggaaaggaacttcacttcacctcccaacatgattgttattcgttcctttgatgtcaacaagcctggttcagaggttgatgaaattaggggtggggtagcaggtggcagcatcctcaggggagtcctgagggtgaaccagaacattgaagttcgccctggcattgtcatgaaggatgagagtggcaacatcaagtgcaccccaatctattcgaggattgtctcgctctatgctgagcagaatgaactccaatttgctgtgccaggagggcttattggtgtgggaacaaccatggatccaactttgactcgtgccgacaggctggttggccaggttctaggagaaatcgggtcgctccctgacgtatttgtggagcttgagatcaacttcttccttctccgaaggctgctgggtgtgagaacaaagggtacagagaaggcagggaaggtctccaagctcaccaagggcgagatcctgatgcttaacattggatccatgtccactggcgcccgtgtggtcgccgtgaagaacgatctcgccaagctccagctcaccgctcccgtctgcacaagcaaaggcgagaaggtcgcactgagccgccgtgtcgagaagcattggcgcctcatcggatggggccagatccaagctggcgcgaccctcgaagttccaccgtgcccgctctgaagcacaccacccctctgaaacgaaaagccgcacagcttgtgaaacaagagaggtgaaatgtgggagggcagagagctcctaggtacagtttttgtgaggtggaggagaaaacatcatgagtctggaagtcttgtcgtcgcgggatttgtctacgctactagtttgcctttctcgttttctgaatttaggatttgttatacttgttgtgttatcatggccgtggtcagtaggcgagcaacctactactttggttcaggtttacctaatcatcttgcctatttttcattgacaacatttgtcagtattgctcctaattttactcagc

SEQ ID NO: 2354 - DNA, 1591 bp, Secale cereale
ggcttcccagcgccctccccgctcgccccctcggcccgcagcacatccacgcgcgcggcgaccctcctcgtcgcggcaagcacactcagcttgacggtcctccaacccaagtttcaatcatggcgcgccgaggattgatggagcaggacctaaccaagcttgatgttaccaagctacacccgttgtcgcctgaagttatctcgcgccaagcgacgatcaacattggtacaattggtcacgtggcccatggaaagtctactgttgtgaaagctatatctggagttcagactgttcgcttcaagaatgagcttgaacgtaacatcactatcaagctgggctatgctaatgcaaagatctataagtgcgaggatgacagatgtccacgaccaatgtgttacaaggcttatggaagcgggaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgaaatcatgcgtctccagcatctcataattttgcagaataagatcgatcttatccaggaaagcgcagcaatgaaccagcatgaagcaatccaaaaatttatccagggcacgatagctgaaggtgctcctgtggtgccaatatctgcccagctgaagtacaacatcgatgtgatctgtgaatacattattaagaaaatccccattccagaaaggaacttcacttcacctcccaacatgattgttattcgctcctttgatgtcaacaagcctggttcagaggttgacgaaattaggggtggggtagcaggtggcagcatcctcaggggagtcctcagggtgaaccagaatattgaagttcgccctggcattgtcatgaaggatgagagtggcaacatcaaatgcaccccaatctattcgaggatcgtctcgctctacgcagagcagaatgaactccaatttgctgtgccaggagggctgatcggtgtgggaaccaccatggatccaactttgactcgtgccgacaggctggttggccaggttctaggagaaatcgggtcacttcccgacgtattcgtggagcttgagattaacttcttccttctccgaaggctgctgggtgtgagaacgaagggtacagagaaggcagggaaggtctccaagctcaccaagggcgagatcctgatgcttaacatcggatccatgtccaccggcgcccgcgtggttgccgtgaagaacgatctcgccaagctccagctcaccgcgcccgtgtgcaccagcaagggcgagaaggtggccctgagccgccgtgtcgagaagcattggcgcctcatcgggtggggccagatccaagccggcgcgaccctcgaagtcccaccttgcccgctctgaagtacacccccgtctgagtgaaaaaccgcagcttgtgaaacaagagaagcgaaatgtggaagggcagagagcctcga

SEQ ID NO: 2355 - DNA, 1900 bp, Triticum aestivum
tgtctccctcctccaactccgccccacgcccctcgccgccggctgtctccgccgactccgccacgcccctagccgctcgagcccgacccctccaagtccctcgccgccgacgcccgactccgccccgccctcaccgccagacgccgtttcaatcatggcacgccgaggattgatggagcaggacctaaccaagcttgatgtcaccaagctccacccgttgtcacccgaagtcatctcgcgccaagcgaccatcaacattggtacaattggtcacgtggcccatggaaagtctactgttgtgaaagctatatctggagttcagactgttcgcttcaagaatgagcttgaacgtaacatcactatcaagctgggctatgctaatgcaaaaatctacaaatgtgaggatgacagatgtccacgaccaatgtgttacaaggcttatggaagcggaaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgagatcatgcgtctccaacatctcataattttgcagaataagattgatcttatccaggaaagtgcggcaatgaaccagcatgaagcaatccaaaaatttatccagggcacgatagctgaaggtgctcctgttgtgccaatatctgcccagctgaagtacaacattgatgtgatctgtgaatatattattaagaaaatccccattccggaaaggaacttcacttcacctcccaacatgattgttattcgctcctttgatgtcaacaagcctggttcagaggttgatgaaatcaggggtggggtagcaggtggcagcatcctcaggggagtcctcagggtgaaccagaatattgaagttcgccctggcattgtcatgaaggatgagagtggcaacatcaaatgcaccccaatctattcgaggatcgtctcgctctatgctgagcagaatgaactacaatttgctgtgccaggagggcttattggtgtgggaacaaccatggatccaactttgactcgtgccgacaggctggtcggccaggtcttaggagaaatcgggtcgcttcccgacgtattcgtggagcttgagatcaacttcttccttctccgaaggctgctgggtgtgagaacaaagggcacagagaaggctgggaaggtctccaagctcaccaagggtgagatcctgatgcttaacatcggatccatgtccaccggcgcccgcgtggttgccgtgaagaacgatcttgccaagctccagctcaccgcgcccgtctgcacgagcaaaggcgagaaagtggccctcagccgacgtgtcgagaagcattggcgtctcatcgggtggggccagatccaagccggcgcgacgctcgaagttccaccctgcccgctctgaagcacacccccatctgattgaaaagccgcagcttgtgaaacaagagaggcgaaatgtgggagggcagagagctcctaggtacaatttttgtgaggtggaggagaaaacgagtctgaaagttttatctttgctggatttatctacgctactagtttgctcctttcggtttgtcggaatctagggtttgttatactcgccatgttattgtggtggttagtaggcgaggaacctgctagtttggttcagatttacctaattgtctcgtctatcacattgactccattatgtcttgcgttgataagattaaagtcggtgtattacacctaattttactcgattttctttgtctgc

SEQ ID NO: 2356 - DNA, 1743 bp, Secale cereale
tcactgccagacgccgtttcaatcatggcacgccgaggattgatggagcaggacctaaccaagcttgatgtcaccaagctccacccgttgtcacccgaagttatctcgcgccaagcgaccatcaacattggtacaattggtcatgtggcccatggaaagtctactgttgtgaaagctatatctggagttcagactgttcgcttcaagaatgagcttgaacgtaacatcactatcaagctgggctatgctaatgcaaaaatctataaatgcgaggatgacaaatgtccacgaccaatgtgttacaaggcttatggaagcggaaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgaaatcatgcgtctccagcatctcataattttgcagaataagatcgatcttatccaggaaagtgcagcaatgaaccagcatgaagcaatccaaaaatttatccagggcacgatagctgaaggtgctcctgtggtgccaatatctgcccagctgaagtacaacattgatgtgatctgtgaatacattattaagaaaatccccattccagaaaggaacttcacttcacctcccaacatgattgttattcgctcctttgatgtcaacaagcctggttcagaggttgatgaaattaggggtgggtagcaggtggcagcatcctcaggggagtcctcagggtgaaccagaatattgaagttcgccctggcattgtcatgaaggatgagagtggcaacatcaaatgcaccccaatctattcgaggatcgtctcgctctacgcagagcagaatgaactccaatttgctgtgccaggagggcttatcggtgtgggaaccaccatggatccaactttgactcgtgccgacaggctggttggccaggttctaggagaaatcgggtcacttcccgacgtattcgtggagcttgagattaacttcttccttctccgaaggctgctgggtgtgagaacgaagggtacagagaaggcagggaaggtctccaagctcaccaagggcgagatcctgatgcttaacatcggatccatgtctaccggcgcccgcgtggtcgccgtgaagaacgatctcgccaagctccagctcaccgcgcccgtgtgcaccagcaagggcgagaaggtggccctgagccgccgtgtcgagaagcattggcgcctcatcgggtggggccagatccaagccggcgcgaccctcgaagtcccaccttgcccgctctgaagtacacccctatctgagtgaaaaaccgcagcttgtgaaacaagagaggcgaaatgtgggagggcagagagctcctaggtacaatttttgtgaggtggaggagaaaacaccatgaaccggaaagtctcgtctttgctggatttgtctacgctaccagtttgcttctttctttttgtcggaatttagggttttttatcatggcggtcgtggttagtagggatggaacctgctacttcggttcagatttacctatcacattgactccattgtcttgcgttgagaagatttcagtcggtgtattacacctaattttacttggccaaaa

SEQ ID NO: 2357 - DNA, 1775 bp, Triticum aestivum
gtcccccgactccgccccgccctcagcgccagacgccgtttcaatcatggcacgccgaggattgatggagcaggacctaaccaagcttgatgtcaccaagctccacccgctgtcacccgaagtcatctcgcgccaagcgaccatcaacattggtacaattggtcacgtggcccatggaaagtctactgttgtgaaagctatatctggagttcagactgttcgcttcaagaatgagcttgaacgtaacatcactatcaagctgggctatgctaatgcaaaaatatataaatgcgaggatgacagatgtccacgaccaatgtgttacaaggcttatggaagcggaaaagaagatactcctgcctgtgatgttcctgggtttgaaaacaccaggatgaagctcctgagacatgtttcctttgttgattgcccgggccatgacattctcatggctacaatgcttaatggagcagctatcatggatggagccttgcttttgatagcagcaaatgaaagctgcccacaaccccagacatccgagcatcttgcagctgttgaaatcatgcgtctccagcatctcataattttgcagaataagatcgatcttatccaggaaagcgcagcaatgaaccagcatgaagcaatccaaaaatttatccagggcactatagctgaaggtgctcctgtggtgccaatatctgcacagctgaagtacaacattgatgtgatctgtgaatatattattaacaaaatccccattccagaaaggaacttcacttcacctcccaacatgattgttattcgctcctttgatgtcaacaagcctggttcagaggttgatgaaattaggggtggggtagcaggtggcagcatcctcaggggagtcctcagggtgaaccagaatattgaagttcgccctggcattgtcatgaaggatgagagtggcaacatcaaatgcaccccaatctattcgaggatcgtctcgctctacgcagagcagaatgaactccaatttgctgtgccaggagggcttatcggtgtgggaaccaccatggatccaactttgactcgtgccgacaggctggttggccaggttctaggagaaatcgggtcacttcccgatgtattcgtggagcttgagatcaacttcttccttctccgaaggctgctgggtgtgagaacgaagggtacagagaaggcagggaaggtctccaagctcaccaagggcgagatcctgatgcttaacattggatccatgtctaccggcgcccgtgtggtggccgtgaagaacgatctcgccaagctccagctcaccgcgcccgtctgcactagcaaaggcgagaaggtggccctgagccgccgtgtcgagaagcactggcgcctcatcggatggggccagatccaagctggcgcgacgctcgaagtcccaccatgcccgctctgaagcacacccccatccgagtgaaaaaccgcagcttgtgaaacaagagaggcgaaatgtgggagggcagagagctcctaggtacaatttttgtgagatggaggagaaaacataacgagtctgaaagtctcatctttgctggatttatctacgctactagtttgcttctttctgtttgtcggaatttagggtatgttatacttgccatgtcgtggtggttagtaggcgaggaacctgctagtttggttcagatttacctaattatcttgtctatcacattgactccattatgccttgcgttgagaagattaaaccaaattttactcgctttcttttt

SEQ ID NO: 2358 - DNA, 1761 bp, Secale cereale
ggcaagcacactcagcttgacggtcctccaacccaagtttcaatcatggcgcgccgaggattgatggagcaggacctaaccaagcttgatgttaccaagctacacccgttgtcgcctgaagttatctcgcgccaagcgacgatcaacattggtacaattggtcatgtggcccatggaaagtctactgttgtgaaagctatatctggagttcagactgttcgcttcaagaatgaacttgaacgtaacatcactatcaagctgggctatgctaatgcaaagatctataagtgcgaggatgacagatgtccacgaccaatgtgttacaaggcttatggaagcgggaaagaagatactcctgcctgtgatgttcctgggtttgaaaacactaggatgaacgctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgaaatcatgcgtctccagcatctcataattttgcagaataagatcgatcttatccaggaaagcgcagcaatgaaccagcatgaagcaatccaaaaatttatccagggcacgatagctgaaggtgctcctgtggtgccaatatctgcccagctgaagtacaacattgatgtgatctgtgaatacattatcaagaaaatccccattccagaaaggaacttcacttcacctcccaacatgattgttattcgctcctttgatgtcaacaagcctggttcagaggttgatgaaattaggggtggggtagcaggtggcagcatcctcaggggagtcctcagggtgaaccagaatattgaagtacgccctggcattgtcatgaaggatgagagtggcaacatcaaatgcaccccaatctattcgaggatcgtctcgctctacgcagagcagaatgaactccaatttgctgtgccaggagggctgatcggtgtgggaaccaccatggatccaaccttgactcgtgccgacaggctggttggccaggttctaggagaaatcgggtcacttcccgacgtattcgtggagcttgagattaacttcttccttctccgaaggctgctgggtgtgagaacgaagggtacagagaaggcagggaaggtctccaagctcaccaagggcgagatcctgatgcttaacatcggatccatgtccaccggcgcccgcgtggttgccgtgaagaacgatctcgccaagctccagctcaccgcgcccgtgtgcaccagcaagggcgagaaggtggccctgagccgccgtgtcgagaagcattggcgcctcatcgggtggggccagatccaagccggcgcgaccctcgaagtcccaccttgcccgctctgaagtacacccccgtctgagtgaaaaaccgcagcttgtgaaacaagagaagcgaaatgtggaagggcagagagctcctaggtacaatttttgtgaggtggaggagaaaacacctcgagtctggaagtcttgcctttgctggatttgtctacgctactagtttgcttctttctttttgtcggaatttagggtttgttatcatggcggtcgtggttagtagggatggaacctgctacttcggttcagatttacctatcacattgactccattgtgtcttgcgttgagaagatttcagtcggtgtattacacctaattttacttg

SEQ ID NO: 2359 - DNA, 1995 bp, Triticum aestivum
gtcccctgttaggttttcccccaccccacccaagcgcgccgccggctgtctccctcctccaactccgcccacaccctcgccgccggctgcctccgccacgcccctagccgctcgaccccgacccctccacgtccctcgccgccgtcccccgactccgccccgccctcaccgccagacgccgtttcaatcatggcacgccgaggattgatggagcaggacctaaccaagcttgatgtcaccaagctccacccgttgtcacccgaagtcatctcgcgccaagcgaccatcaacattggtacaattggtcacgtggcccatggaaatctactgttgtgaaagctatatctggagttcagactgttcgcttcaagaatgagcttgaacgtaacatcactatcaagctgggctatgctaatgcaaaaatctacaaatgcgaggatgacagatgtccacgaccaatgtgttacaaggcttatggaagcggaaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagttgcccacaaccccagacatctgagcatctagcagctgttgaaatcatgcgtctccaacatctcataattttgcagaataagattgatcttatccaggaaagtgcagcaatgaaccagcatgaagcaatccaaaaatttatccagggcacgatagctgaaggtgctcctgttgtgccaatatctgcccagctgaagtacaacattgatgtgatctgtgaatacattatcaagaaaatccccattccggaaaggaacttcacttcacctcccaacatgattgttattcgctcctttgatgtcaacaagcctggttcagaggttgatgaaatcaggggtggggtagcaggtggcagcatcctcaggggagtcctcagggttaaccagaacattgaagttcgccctggcattgtcatgaaggatgagagtggcaacatcaaatgcaccccaatctattcaaggatcgtctcgctctacgcagagcagaatgaactccaatttgctgtgccaggagggcttattggtgtgggaacaaccatggatccaactttgactcgtgccgataggctggttggccaggttctaggagaaatcgggtcgcttcctgatgtattcgtggagcttgagatcaacttcttccttctccgaaggctgctgggtgtgagaacgaagggcacagagaaggcagggaaggtctccaagctcaccaagggcgagatcctgatgcttaacatcggatccatgtccactggcgcccgtgtggtcgccgtgaagaacgatctcgccaagctccagctcaccgcgcccgtgtgcaccagcaaaggcgagaaggtggccctgagccgccgtgtcgagaagcactggcgcctcattggatggggccagatccaagccggcgcgacgctcgaagtcccaccctgcccgctctgaagcacacacccatctgagtgaaaaaccgcagcttgcgaaacaagagaggcgaaatgtgggagggcagagagctcctgggtacaatttttgtgaggtggaggagaaaaacataacgagtctgaaagtcttatctttgctggatttgtctacgctactagtttgcttctttctgtttgtcggaatttagggtttgttatactcgccatgttatcgtggtggttagtaggcgaggaacctactagtttggttcagatttacctaattgtctcgtctatcacattgactccattatgtcttgcgttgagaagattaaagtcggtgtattacacctaattttactcgattttctttgtctgcattgctgttccttgccaacatgtagcatgcgattagcaacaacagttttttgttt

SEQ ID NO: 2360 - DNA, 1912 bp, Brachypodium distachyon
ccctccctgtctttcctcacgactccaccccgatccgccgccgcctcgacgccgccggcccgccgcaccgaatccccttttcctttttccttcctgagtagccgcagctgagcgccccaaccccctcgctcgtcttcctcgtcgcgcacgactgactccagcaacgcaagcgccgccgccggagcttgatctccccttcttttctccgaccgtttcttcaggttcaaacatggcgcgccgaggattaatggagcaggacctgaccaagctcgacgttgcaaagctgcacccgttgtcacccgaggttatctcgcgccaagcgaccatcaacatcggtacaattggtcacgtggcccatggaaagtccactgttgtgaaagctatttctggagttcagactgttcgcttcaagaatgagttggagcgtaacatcactataaagctgggttatgctaatgcaaaaatctttaaatgcgaggatgacagatgtccacgaccaatgtgctacaaggcttatggaagcggaaaagaagatactcctatctgtgacgtgcctgggtttgaaaacactaggatgaagctcctgagacacgtttcatttgttgattgcccgggccatgacattctcatggctacaatgcttaatggagcagctatcatggatggagccttgcttttgatagcagcaaatgaaagctgcccacaaccccagacatctgagcatcttgcagctgttgaaatcatgcgcctccaacatctcataattctgcagaacaagatcgatcttatccaggaaagtgcagcaatgaaccagcatgaagcaatccaaaagttcatccagggcacgatagctgaaggtgctcccgtggtgccaatatctgcccagctgaagtacaacattgatgtgatctgtgaatatattgtcaagaaaatccccattccggaaaggaacttcacttcacctcccaacatgattgttattcgctcctttgacgttaacaagcctggttcagaggtcgatgacattaggggtggggtagcaggtggcagcattctcaggggagtcctgagggtgaaccagaacattgaagttcgccctggcattgtcatgaaggatgagagtggcaacatcaaatgcactccaatctactcaaggatcgtctcgctctacgcggagcagaatgaactccagtttgctgtgcctggagggcttattggtgtgggaacaaccatggatccaactttgactcgtgctgataggctagttggccaggttctaggagaaatcgggtcgcttcctgatgtattcgtggagcttgagataaatttcttcctcctacgaaggctgttgggtgtgagaacaaagggtacggagaaagcagggaaggtctccaagctcaccaagggtgagatcctgatgctcaacatcggatccatgtcaacaggtgcccgtgtggttgccgtcaagaacgatctcgccaagcttcagctcaccgcccccgtctgcacgagcaaaggcgagaaggtggccctgagccgccgtgtcgagaagcattggcgcctcatcgggtggggccagatccaggccggcgcgacgctcgaagtccctccgtgcccgctttgaggcattgcgctcaagacagaaacaagagtctgtaagagaagagagagacgaaaatgtgggagggcagagagctcctgggtacagtttttgtgaggtggaggagaaaacatcgtgtttggaaattgtggtttttttcccctggatttgtttacgcgtctagtttgctttatccgaatttaggaagctattttaccatgataccaccatgtggttggttaagatattttacctgatcgtcttgcgtctttgactccatcgtgtcaagagtattacacctaattttgcctg

SEQ ID NO: 2361 - DNA, 1810 bp, Musa acuminata
ctctttctcgttctttttatcttccgcagcagctccgcctcggcgtccgttatcgccgtcccctccgcctctcttgctctcctcggctccgataccctcgcgatctttcaagatcttagggtttcttctcgaccgcgcgctgatccttacgccgatccagctttcaaggactcaactgaggtatatcgtctacataaaaaatgtctcgtaaaggattaatggagcaagacttgagtaaacttgatgtgacaaaacttcacccactgtcgccagaagttatctcacgtcaggctaccattaacattggtaccattggtcatgtggctcatggaaagtcaactgttgtaaaagcaatatccggtgtacagactgttcgcttcaagaatgagttggagcgcaatatcaccatcaagctgggatatgccaatgcaaaaatatataaatgtgaagatgatagatgcccacgacctatgtgttacaaggcttatggaagtggaaaagaagacagtcctccatgtgatgttccagggtttgagaacactaggatgaaacttctaagacatgtttcttttgtggattgcccgggccatgatattcttatggctactatgcttaacggtgctgcaattatggatggagccttacttcttatagctggaaatgagagttgcccacagcctcaaacgtctgaacatctggctgctgttgaaatcatgcgtctgcaacatattattattttacaaaataagatcgatctaatccaggaaagtgctgcaattaatcaacatgaagctatccagaagtttattcagggtactatcgctgatggagctcctgtggtgccaatatctgctcaattgaaatataatattgacgttgtctgcgagtatcttgttaagaaaatccctattccagagagaaactttatttcacctccaaacatgattgtcatccgttcttttgatgtgaacaagcccggctctgaggttgatgagataaaaggtggtgttgcaggtggaagcatccttaggggtgttttaaaggtgaaccagtttattgaagttcgtcctggtatcgttgttaaagatgagagtgggaatataaagtgcacccctatatactcgaggattgtttcactatatgctgaacaaaatgagcttcaatttgccgtgcccgggggactcattggtgtaggcactacaatggatcccacattaactcgtgctgataggctggtaggtcaggttcttggtgaagttggttcgctgcctgatgtctttgttgagctggaggtgaacttttttctcctccggaggcttttgggtgtcaggacaaaagggacagagaaacaagggaaggtgtcaaagctgacgaagggcgaaatcctgatgctcaacataggatctatgtccacgggggctcgagtcgtcgctgtgaagaatgatctggcgaagctgcagcttactgcaccggtgtgcacaagcaaaggggagaagattgccctgagccggcgtgttgagaagcattggcgtcttatcggctggggccagattcaggctggcggaaccctggaagtcccaccctgccccatctgagacaacgcagtgtgtggagaggccatgtgggaaggcagggaacttctggggactatttatctgagatggaggagaaaacgtgtatcttctagtgatgttaaaactcgagactttcttttttcagttcatctgcttggggctttttgaggtgaaggtatgatgttggaaaatatgtgacatttattctaataagaatattagttttacatctaaaa

SEQ ID NO: 2362 - DNA, 1688 bp, Triticum aestivum
agcttgatgtcaccaagctacacccgttgtcgcctgaagttatctcgcgccaagcgacgatcaacattggtacaattggtcatgtggcccatggaaagtctactgttgtgaaagctatatctggagttcagactgttcgcttcaagaatgagcttgaacgtaacatcactatcaagctgggctatgctaatgcaaaaatctataaatgcgaggatgacagatgtccacgaccaatgtgttacaaggcttatggaagtgggaaagaagatactcctgcctgtgatgttcctgggtttgaaaacactaggatgaagcttctgagacatgtttcctttgttgattgcccgggccacgacattctcatggctacaatgcttaatggagcagccatcatggatggagccttgcttctgatagcagcaaatgaaagttgcccacaaccccagacatctgagcatctagcagctgttgaaatcatgcgtctccaacatctcataattttgcagaataagattgatcttatccaggaaagtgcagcaatgaaccagcatgaagcaatccaaaaatttatccagggcacgatagctgaaggtgctcctgtggtgccaatatctgcccagctgaagtacaacattgatgtgatctgtgaatacattattaagaaaatccccattccggaaaggaacttcacttcacctcccaacatgattgttattcgttcctttgatgtcaacaagcctggttcagaggttgatgaaattaggggtggggtagcaggtggcagcattctcaggggagtcctcagggtgaaccagaacattgaagttcgccctggcattgtcatgaaggatgagagtggcaacatcaagtgcaccccaatctattcaaggattgtctcgctctacgctgagcagaatgaactccaatttgctgtgccaggagggcttattggtgtgggaacaaccatggatccaactttgactcgtgctgacaggctggttggccaggttctaggagaaatcgggtcgctccctgacgtattcgtggagcttgagatcaacttcttccttctccgaaggctgctgggtgtcagaacaaagggtacagagaaggcaggtaaggtctccaagctcaccaagggggagatcctgatgcttaacatcggatccatgtccaccggcgcccgtgtggtcgccgtgaagaacgatctcgccaagctccagctcaccgcgcccgtctgcacaagtaaaggcgagaaggtcgcgttgagccgccgtgtcgagaagcattggcgcctcattggatggggccagatccaagctggtgcgaccctcgaagttccaccgtgcccgctctgaagcacacccgccctctgaaacgaaaagccgcatagcttgcgaaacaagagaagcgaaatgtgggagggcagagagctcctaggtacagttcttgtgaggtggaggagaaaacattatgagtgtgaaagttcttctattgcgggatttgtctacgctttctcgttttctgaatttaggatttgttatacttgctgtgttatcatggccgtggttagtaggcgagcaacctactactttggttcaggtttactctaatcgtcttgcctatttttcattgactccatttgtcagtattgctcctaattttactcagtttgtgccttgtttgtt

SEQ ID NO: 2363 - DNA, 2043 bp, Cocos nucifera
gcgactgagcgtacgttttatctagcctctcaagaaccctcaattcttccctacccttcgcgacccctccacgaatctccgcatacgacgcctcgcctccccctcggcctccgatcgctcgttctcttcggtcgaaagatcgccgccgccctcctccactctcccctctcccctctccggaggatcccgcggcctccgatctcggctttagaggtacattatctgcagcaaaaatgtctcgtaaaggattaatggagcaggacctaagtaagcttgatgtgacaaaactgcatccactgtcgccagaagttatttcacgtcaagctacaattaatattggtaccattggtcatgtggcccatggaaagtcaactgttgtaaaagctatttctggtgttcagactgttcgctttaagaatgagttggagagaaatatcaccatcaagctaggatatgctaatgcaaaaatatataaatgtgaagatgatagatgcccacgaccaatgtgctacaaggcttatggaagcggaaaggaagacagccctctatgtgatgtgccaggatttgagaacaccaggatgaaactcctaaggcatgtctcatttgtagactgcccgggacatgatattcttatggctacaatgcttaatggggctgcaatcatggatggagcattgcttttgattgctggaaatgaaagctgcccccagcctcagacttctgagcatctggctgctgttgaaatcatgcgactccagcatattattattctacagaacaagattgatcttattcaggaaagcgtagcaattaatcagcatgaagcaatccagaaatttattcagggcacaattgctgatggggcacctgttgtaccaatctctgctcagttgaagtataacattgatgttgtttgcgagtatattgttaacaagatccctattccagagagaaactttacttcaccaccaaacatgatagtcattcgttcttttgatgtgaataagcctggttcggaggttgatgagataaaaggtggtgttgcaggtggaagtatccttaggggagttttgaaggtgaaccagtatattgaagtccgtcctggtattgttatcaaagatgagagtggcaacattaagtgcactccaatatattcaaggatagtttcactttatgctgagcaaaatgaactccaatttgccgtacctggggggctcattggagtaggaaccacaatggatccaacactaacacgtgctgacaggctggtgggtcaggttcttggggaagttggaactctgcctgatgtttttgtggagcttgaggtgaactttttccttctccggaggcttttgggggtaaggacaaagggcacagagaaacaagggaaggtatccaagcttgcaaagggtgagatcctgatgttgaacataggctctatgtcaactggggcacgagtgattgctgtgaagaatgatctagccaagctgcagctcactgcaccagtgtgcacaagcaaaggggagaaggtggccctcagccggcgggtcgagaagcattggcgtcttattggttggggccagatccaggctggtgtgacccttgacgtcccaccatgctctatttaaagcaaagaatcttgctggtgaagagaagcacaaaaagtacaggattaagaggtctgtgagaagttatgtgggagggtagacagcttctaggaacagtttttgtgagatggagaagaaaacagaacaatgttgaagttttggtgcttggtttgtgtttcaaaaatttatctgatgccaagagagtatttttcagtaatatatcactcaacaaccaagatatcttgaattaaaatgggtgtattttcccatggaaactgatactgcatctgtacgatatcttatattaaaatgggtgtattttcccatggaaaccgatgctgcatcagttcttttaatggcactcctcctgcaaaccgaagtcgaatggagatggaattgtggcagctttaattctaaaagtatccttgctcaaaac

SEQ ID NO: 2364 - DNA, 1897 bp, Panicum virgatum
acactgagtttccttcgttccagtttcaggccccggctgtactcttgacagaagcgaagatggcgcgccgagggttgatggagcaggatctgagcaagctcgacgtcaccaagctgcaccctctgtcgccagaggtgatttcgcgccaagcgacgatcaacatcggtaccattgggcatgtggcccatgggaagtctactgttgtcaaagcaatctcaggtgtacagactgttcgattcaagaatgaactggagcgcaatatcacgataaagcttggttatgctaatgcaaaaatctataaatgtgaagatgataagtgcccacgcccaatgtgctacaaggcttatggcagtggcaaagaagatagccctctctgtgatgttccagggtttgaaaattgtaggatgaagctcctgagacatgtttcatttgttgattgcccggggcatgacattctcatggctacaatgcttaatggagcagctatcatggacggagcactacttctgattgcagcaaatgagagctgtccacagccccagacatctgagcaccttgcagctgttgaaattatgcgtcttcaacatattatcattctgcaaaacaagatcgatcttatccaggaaagtgcagcaatgaaccagcatgaagcaatccagaaatttatacagggaacaatagctcaaggtgctcctgtggtgccaatatctgcgcagctgaagtacaatattgatgttatatgtgaatacattgtgaaaaagatccccatcccagagaggaatttcatctctccacccaacatgattgttattcgttcttttgatgtgaacaaacctggttcagaggttgatgaaatcaagggtggagtagcaggtggcagtatcctcaagggagtcctgagggtgaaccagaaaattgaagttcgcccaggcatcgtgatgaaggatgagcatggcaaacttaaatgcacgcccatctattcaaggattgtctccctgtatgccgagcagaatgaactccagtttgccgttcctggagggcttattggagttggaactaccatggacccgacactgactcgtgctgataggctggtcggtcaggttcttggtgaagttggatcactgcctgatgtttatatcgagttagaggtgaacttcttcctcctaaggaggctgctgggggtgaggacaagtggaacagaaagggcaagcagggtctcaaagcttgccaagggtgagatcctgatgcttaacattgggtcgatgtccaccggagcccgtgttctcgctgttaagaatgatcttgcaaagctgcagctgactgcaccggtgtgcaccagcaagggtgagaagttggcccttagccggcgcatcgagaagcactggcgtctcattggttggggcacaatccaggctggcactacacttgatgtcccaccctgcccgctctgaatcgtacaccacctgtttgacgctagagtttgaaaaaagagagtggacatgtggcaaggcaaagagctgttaggaactgtttttgtaaggtggaggagaaaacctgaaccaaaatgttacctgcttggggtttattcttccatctgcagttttgtattgttattatgtgatggatgagtcacatcatagtgtttacttgggcagcgtatttataagcttgaatattgaattgagcaatttctggtttcagagcagtgaaaattgctgatgctgtgcaggaagctgagcattaatgttagttcatctgttactgttagtgtctccttcacataacgtattctgcatcctttcataataaaatatatttttaaatatttatttgagagtataacatttaatgtgtagttaagatactttataatcttataaaactgttgctttta

SEQ ID NO: 2365 - DNA, 1667 bp, Echinochloa colona
ccccagccctcgccgcctcggcgtccgagtccaccggagcccctccgtcctcctcttcgtgctccgactcgcagcgccgccgtcacctagccttccagtccgcgcgaccgcttgagtttcaggccccagcgttactcaaacagaatcgaagatggcgcgccgaggattgatggagcaggatctgagcaagctcgacgtcaccaagctccaccctctgtctccagaggtgatttcacgccaggcgacgatcaacatcggtaccattggccacgtggcccatgggaagtctactgttgtcaaagcaatctcaggtgtacagactgttcgtttcaaaaatgaactggagcgcaatatcactataaagcttggttatgctaatgcaaaaatctacaaatgtgaagatgataggtgcccacgaccaatgtgctacaaggcttatggcagtggcaaagaggatagccctctatgtgatgtgccaggttttgaaaactgtaggatgaagctcctgagacatgtttcatttgttgattgcccggggcatgacattctcatggctacaatgcttaatggagctgctatcatggacggagcacttcttctgattgcagcgaacgagagctgcccgcaaccccagacatctgagcaccttgcagctgttgaaattatgcgtcttcaacatattatcattctgcagaacaagattgatcttatccaggaaagtgcagcaatgaaccagcatgaagcaatccagaaatttatacagggaacaattgctcaaggtgcccctgtggtaccaatatctgcacagctgaagtacaatattgatgttatctgtgaatacatcgtgaaaaagatccccatcccggagaggaatttcatctctcctcccaacatgattgttattcgttcttttgatgtgaacaaacctggttccgaggttaatgaaatcaagggtggagtagcaggtggcagtatcctgaagggagtcctgagggtgaaccagaaaattgaagttcgcccaggcatcgtgatgaaggatgaacatggcaaacttaaatgcacgcccatctattcgaggattgtctccctgtatgctgagcagaatgaactccagtttgctgttcctgggggacttattggagttggaaccaccatggacccgacactgacccgtgctgataggctggtcggccaggttcttggtgaagttggatcactgccagatgtttacatcgaattagaggtgaacttcttcctcctgaggaggctgctgggggtgaggacaagtggaacagaaagggcaagcagggtttcaaagcttgctaagggtgagatcttgatgcttaacatcgggtcgatgtccactggagcccgtgttgtcgccgtcaagaatgatcttgcgaagctgcagctgaccgcaccggtgtgcaccagcaagggcgagaagctggcccttagccggcgcatcgagaagcactggcgtctcattggttggggcaccatccaggctggcactacacttgacgtcccaccctgcccgctctgaatcacacaccacctgttcgacgcgaatagagtttgaaagagaagagtggagatgtggcaaggcagacagttgttaggaacggtttttgtgaggtggaggagaaaacctgaaccgagatatt

SEQ ID NO: 2366 - DNA, 1737 bp, Elaeis guineensis
cccactctgagctgacgaggcttcctgccgcctccgatccttcgccctgtgcactctccttcggccgagagatcgccgccgccgccaccctcctcccctctccccaggatcccccagtctccgatctcggctttggaggtacattacctgcagcaaaaatgtctcgtaaaggattaatggagcaggacctaagcaagcttgatgtgacaaaactgcatccactatcaccagaagttatttcacgtcaagctacaattaatattggtaccattggtcatgtggcccatggaaagtcaactgttgtaaaagctatttctggtgttcagactgttcgctttaagaatgagttggagagaaatatcaccatcaagctcggatatgctaatgcaaaaatatataaatgtgaagatgatagatgcccacgaccaatgtgctacaaggcttatggaagcggaaaggaagacagccccctttgtgatgtgccaggatttgagaacaccaggatgaaactcctaaggcatgtctcatttgtagactgcccgggacatgatattcttatggctacaatgcttaatggggctgcaatcatggatggagcattgcttttgattgctggaaatgaaagctgcccccagcctcagacttctgagcatctggctgctgttgaaatcatgcgactccagcatattattattctacagaacaagattgatcttattcaggaaagcgtagcaattaatcagcatgaagcaatccagaaatttattcagggcacaattgctgatggggcccctgttgtaccaatctctgctcagttgaagtataacattgatgttgtttgcgagtatattgttaacaaaatccctattccagagagagactttacttcaccaccaaacatgatagtcattcgttcttttgatgtgaataagcctggttcagaggtcgatgagataaaaggtggtgttgcaggtggaagcatccttaggggagttttgaaggtgaaccagtatattgaagtccgtcctggtattgttatcaaagatgagagtggcaacattaagtgcactccaatatattcaaggatagtttcactttatgctgagcaaaatgaactccaatttgcggtacctggggggctcattggagtaggcactacgatggatccaacactaacacgtgctgacaggctggtgggtcaggttcttggggaagttggaactctgcctgatgtttttgtggagcttgaggtgaactttttccttctccggaggcttttgggggtaaggacaaagggctcagagaaacaagggaaggtatctaagcttgcaaagggtgagatcctgatgttgaacataggatctatgtcaactggggcacgagtgattgctgtgaagaatgatctagctaagctgcagctcactgcaccagtgtgcacgagcaagggggagaaggttgccctcagtcggcgggttgagaagcattggcgtcttattgggtggggccaaatccaggctggtgtaacccttgatgtcccaccatgccctttctaaaccaaagaattccgcagcaaaaaatacagcattacttgagaggtctgtgagagatcatgtgggagggtaggcagctgctaggaacactttttgtgagatggagaagaaaacaagttctaaagttttgttgcttttgtgtttgaagaatttatctgaagcctggatagtttttttcggtaatatc

SEQ ID NO: 2367 - DNA, 1883 bp, Gossypium hirsutum
ggatctttgattcgattgacaaaagaaagcaccatcgttaaaaagctcagttttttaggcttaaatctcaccatccctagagactgaaaaaggctgcgttcttctttcttcaggcaaactaatcaaatcagtctcaagcaactctttcttttaatcagttcatattgaagcagaaagacaaagggagcagtgaaaatgtcgaaaaaaggtttgatggagcaagacttaagtaaactggatgtaactaagttgcatccactgtctcctgaagtcatatctcgccaggctactataaatattggcaccatagggcatgtcgcacatgggaagtcaacagttgtgaaagcaatatctggggttcagactgttcgtttcaagaatgagttggagagaaatattactatcaagcttggatatgcaaatgcaaagatatacaaatgtgaagatgaacgatgccctcgtcctatgtgctacaaggcatatggaagtggaaaggaggatagtcctctttgtgatgtgcccggctttgaaaactgtaggatgaagttgctgagacatgtatcttttgtagattgcccaggtcacgatattctcatggctactatgcttaatggagcagcaatcatggatggtgcattacttcttatagctgccaatgaaagctgtccgcaacctcaaacttctgagcatctggctgctgttgaaattatgcgactccagcatattataattcttcaaaacaaggttgatcttattcaagagaatgtagccatcaatcagcatgaagcaattcagaaatttattcagggtacagttgctgatggtgcaccagtggtgccaatctctgcacaactgaaatataatattgatgttgtgtgcgagtacattgtgaagaagatccctattcctgagagaaactttgtctcaccccctaacatgattgtaatccgatcatttgatgtcaataagccggggtttgaggttgatgagattaaaggtggtgttgctggtggaagtatactcaggggtgttttgaaggtgaaccaatttattgaagttcgtcctgggattgttgtcaaggatgaaagcggaaacatcaaatgcacacccatatattcgagaatagtctcattgtatgctgaacaaaatgagctacaatatgccgttccgggaggtctaattggtgttggaacaactatggacccgactttaactcgtgcagataggttggtgggtcaagttcttggagaggtcgggtcactcccagaagtttatgttgagctcgaggtaaatttcttccttctccgaaggcttcttggtgttaggacaaagggctcagagaggcaaggaaaagtgtcaaagttggccaagggagagatcctaatgttgaatattgggtctatgtcgaccggtgctcgagtcatagctgtaaagaatgatttggcaaagctgcaactcacgtcccctgtatgcaccagcaagggagagaaaattgctcttagtcggcgtgttgagaagcattggcgtctaatcggatggggccaaatccaagctggaacaacccttgaagtcccaccctgccctctataataactgataaacaggtaaacagaaagtaaaaacatcgataagaaaaaaaaaagccggaagagtctatttttgttttttgttgaaaatgtgggaaggtagacaatatcttggtactatttttgtgaggtggagaagaaaacattgtttgatagaaacttcattgttcctttcattacattgagtctcctaaactttgctgaaaacatggaacattttctaggctatttgatactgtattctttgtctttggataaaaatctttactccgaccttttatttttttgtcgatgaac

SEQ ID NO: 2368 - DNA, 1801 bp, Gossypium hirsutum
tactgtatctggattggattgggttgacaaaaaaaccaaccattgttaaaagctcagttttttaggcttaaatccaactatccctagcgactgaaaaaggctgcgttcttctttctgcaggcaaactaatcaaaccagtctcaagcaactcttttaatcagtttatattgaagcagaaagacaaagggagcagcgaaaatgtccaaaaaaggtttgatggagcaagacttaagtaaactggatgtgactaagttgcatccgctgtctcctgaagtcatatctcgccaggctaccataaatatcggcaccatagggcatgtcgcacatgggaagtcaacagtagtgaaagcaatatctggggttcagactgttcgttttaagaatgagttggagaggaatattactatcaagcttggatatgcaaatgcaaagatatacaaatgtgaagatgaacgatgccctcgtcctatgtgctacaaggcatatggaagcggaaaggaggatagtcctctttgtgatgtccctggctttgaaaactgtaggatgaagttgctgagacatgtatcttttgtggattgcccaggtcacgatattctcatggctactatgcttaatggagcagcaatcatggatggtgcattacttcttatagctgccaatgaaagctgtccacaaccacaaacttctgagcatctggctgctgttgaaatcatgcgactacagcatattattattcttcaaaacaaggttgatcttattcaagagaatgtagccatcaatcagcatgaagcaattcagaaatttattcagggtactgttgctgatggtgcaccagtggtaccaatctctgcacaactaaaatataatattgatgttgtgtgcgagtacattgtgaagaagatccctattcccgagaggaactttgtctcaccccctaacatgattgtaatccgatcatttgatgtcaataagccagggtttgaggttgatgagattaaaggtggtgttgctggtggaagtatactcaggggtgttttgaaggtgaaccaatttattgaagttcgtcctgggattgttgtcaaggatgaaagcggaaacatcaaatgcacacccatatattcgagaatagtctcattgtatgctgaacaaaatgagctacaatatgccgttccgggaggtctaattggtgttggaacaactatggacccgactttaactcgtgcagataggttggtgggtcaagttcttggagaggtcgggtcactcccagaagtttatgttgagctcgaggtaaatttcttccttctccgaaggcttcttggtgttaggacaaagggttcggagaggcaaggaaaagtgtcaaagttggccaagggagagatcctaatgttgaatattgggtctatgtcgaccggtgctcgagtcatagctgtaaagaatgatttggcaaagctgcaactcacatcccctgtatgcaccagcaagggagagaaaattgcacttagtcggcgtgttgagaagcattggcgtctaattggatggggccaaatccaagctggaacaacccttgaagtcccaccctgccctctgtaataaccgataaacaggtaaacagaaagtaaaaacatcgataagaaaaaaaagccggaagagtctatttttgttttttgttgaaaatgtgggaaggtagacaatatcttggtactatttttgtaaggtggagaagaaaacattgtttgatagaaacttcattgttccttgcattacattgagtctcctaaactttgctgaaaacatggaa

SEQ ID NO: 2369 - DNA, 1943 bp, Gossypium hirsutum
aatccaaaccaaagaatactggatctttgattcgattgacaaaagaacgcaccatcgttaaaaagctcagttttttaggcttaaatctcaccatccctatagactgaaaaaggctgcgttcttctttcttcaggcaaactaatcaaatcagtctcaagcaactctttcttttaattagttcatattgaagcagaaagacaaagggagcagtgaaaatgtcgaaaaaaggtttgatggagcaagacttaagtaaactggatgtaactaagttgcatccactgtctcctgaagtcatatctcgccaggctactataaatattggcaccatagggcatgtcgcacatgggaagtcaacagttgtgaaagcaatatctggggttcagactgttcgtttcaagaatgagttggagagaaatattactatcaagcttggatatgcaaatgcaaagatatacaaatgtgaagatgagcgatgccctcgtcctatgtgctacaaggcatatggaagtggaaaggaggatagtcctctttgtgatgtgcccggctttgaaaactgtaggatgaagttgctgagacatgtatcttttgtagattgcccaggtcacgatattctcatggctactatgcttaatggagcagcaatcatggatggtgcattacttcttatagctgccaatgaaagctgtccgcaacctcaaacttctgagcatctggctgctgttgaaattatgcgactccagcatattataattcttcaaaacaaggttgatcttattcaagagaatgtagccatcaatcagcatgaagcaattcagaaatttattcagggtacagttgctgatggtgcaccagtggtgccaatctctgcacaactaaaatataatattgatgttgtgtgcgagtacattgtgaagaagatccctattcctgagagaaactttgtctcaccccctaacatgattgtaatccgatcatttgatgtcaataagccagggtttgaggttgatgagattaaaggtggtgttgctggtggaagtatactcaggggtgttttgaaggtgaaccaatttattgaagttcgtcctgggattgttgttaaggatgaaagcggaaacatcaaatgcacacccatatattcgagaatagtctcattgtatgctgaacaaaatgagctacaatatgctgttccgggaggtctaattggtgttggaacaactatggacccgactttaactcgtgcagataggttggtgggtcaagttcttggagaggtcgggtcactcccagaagtttatgttgagctcgaggtaaatttcttccttctccgaaggcttcttggtgttaggacaaagggctcggagaggcaaggaaaagtgtcaaagttggccaagggagagatcctaatgttgaatattgggtctatgtcgaccggtgctcgagtcatagctgtaaagaatgatttggcaaagctgcaactcacatcccctgtatgcaccagcaagggagagaaaattgcacttagtcggcgtgttgagaagcattggcgtctaattggatggggccaaatccaagctggaacaacccttgaagtcccaccctgccctctgtaataaccgataaacaggtaaacagaaagtaaaaacatcgataagaaaaaaaagccggaagagtctatttttgttttttgttgaaaatgtgggaaggtagacaatatcttggtactatttttgtgaggtggagaagaaaacattgtttgatagaaacttcattgttccttgcattacattgagtctcctaaactatgctgaaaacatggaacattttctaggatatttgatactgtattctttgtctttgggtaaaaatcttttactccgaccttttatttttttgtcgatgaactcacattggggtgcatgaaattagataaaatattgattgaa

SEQ ID NO: 2370 - DNA, 2068 bp, Gossypium raimondii
ttcccaacccagaaaaaaagcccaaatccaacccaaagaatactggatctttgattcgattgacaaaagaaagcaccattgttaaaaagctcagttttttaggcttaaatctcaccatccctagagactgaaaaaggctgcgttcttctttcttcaggcaaactaatcaaatcagtctcaagcaactctttcttttattcagttcatattgaagcagaaagacaaagggagcagtgaaaatgtcgaaaaaaggtttgatggagcaagacttaagtaaactggatgtaactaagttgcatccactgtctcctgaagtcatatctcgccaggctactataaatattggcaccatagggcatgtcgcacatgggaagtcaacagttgtgaaagcaatatctggggttcagactgttcgtttcaagaatgagttggagagaaatattactatcaagcttggatatgcaaatgcaaagatatacaaatgtgaagatgagcgatgccctcgtcctatgtgctacaaggcatatggaagtggaaaggaggatagtcctctttgtgatgtgcccggctttgaaaactgtaggatgaagttgctgagacatgtatcttttgtagattgcccaggtcatgatattctcatggctactatgcttaatggagcagcaatcatggatggtgcattacttcttatagctgccaatgaaagctgtccgcaacctcaaacttctgagcatctggctgctgttgaaattatgcgactccagcatattataattcttcaaaacaaggttgatcttattcaagagaatgtagccatcaatcagcatgaagcaattcagaaatttattcagggtacagttgctgatggtgcaccagtggtgccaatctctgcacaactaaaatataatattgatgttgtgtgcgagtacattgtgaagaagatccctattcctgagagaaactttgtctcaccccctaacatgattgtaatccgatcatttgatgtcaataagccggggtttgaggttgatgagattaaaggtggtgttgctggtggaagtatactcaggggtgttttgaaggtgaaccaatttattgaagttcgtcctgggattgttgtcaaggatgaaagcggaaacatcaaatgcacacccatatattcgagaatagtctcattgtatgctgaacaaaatgagctacaatatgctgttccgggaggtctaattggtgttggaacaactatggacccgactttaactcgtgcagataggttggtgggtcaagttcttggagaggtcgggtcactcccagaagtttatgttgagctcgaggtaaatttcttccttctccgaaggcttcttggtgttaggacaaagggctcggagaggcaaggaaaagtgtcaaagttggccaagggagagatcctaatgttgaatattgggtctatgtcgaccggtgctcgagtcatagctgtaaagaatgatttggcaaagctgcaactcacatcccctgtatgcaccagcaagggagagaaaattgcacttagtcggcgtgttgagaagcattggcgtctaattggatggggccaaatccaagctggaacaacccttgaagtcccaccctgccctctataataactgataaacaggtaaacagaaagtaaaaacatcgataagaaaaaaaaagccggaagagtctatttttgtttttttgttgaaaatgtgggaaggtagacaatatcttggtactatttttgtgaggtggagaagaaaacattgtttgatagaaacttcattgttccttgcattacattgagtctcctaaactatgctgaaaacatggaacattttctaggatatttgatactgtattctttgtctttgggtaaaaatcttttactccgaccttttatttttttgtcgatgaactcacattggggtgcatgaaattagataaaatattgattgaattttgtcatttggggcttggaatattatcaaattacaaaacccaatgtatatattgagactatttgtgttgataataacctagaattgttgcctgctta

SEQ ID NO: 2371 - DNA, 1839 bp, Cocos nucifera
gttttatctagcctctcaagaaccctcaattcttccctacccttcgcgacccctccacgaatctccgcatacgacgcctcgcctccccctcggcctccgatcgctcgttctcttcggtcgaaagatcgccgccgccctcctccactctcccctctcccctctccggaggatcccgcggcctccgatctcggctttagaggtacattatctgcagcaaaaatgtctcgtaaaggattaatggagcaggacctaagtaagcttgatgtgacaaaactgcatccactgtcgccagaagttatttcacgtcaagctacaattaatattggtaccattggtcatgtggcccatggaaagtcaactgttgtaaaagctatttctggtgttcagactgttcgttttaagaatgagctggagagaaatatcactatcaagctgggatatgctaatgcaaaaatatataaatgtgaagatgatagatgtccacgaccaatgtgctacaaggcctatggaagcggaaaggaagatagccctttatgtgatgtgccagggtttgagaacaccaggatgaaactcctaaggcatgtctcgtttgttgactgcccgggccatgatattcttatggctacaatgctcaatggagctgcaatcatggatggagcattgcttttgattgctggaaatgaaagctgcccccagccacagacttccgagcatctggctgctgttgaaattatgcgacttcagcatattattattttacagaataagattgatcttattcaggaaagcgtggcaattaatcagcatgaagcaatccagaaatttattcagggtacaattgctgatggggcacctgttgtaccaatctctgctcagttgaagtataacattgacgtcgtttgtgagtatcttgtgaacaaaatccctatcccggagaggaacttcacttcaccaccaaacatgatagtcattcgttcttttgatgtgaataagcctggttctgaggttgatgagataaaaggtggtgttgcgggtggcagtatccttaggggagttttgaaggtaaacgagcctattgaagtccgtcccggtattgttatcaaagatgagaacggcaacattaagtgcactccaatatattccaggatagtatcactttatgctgagcaaaatgagctccagtttgcagttcctggcggtctcattggagtaggcaccacgatggaccctacactgacacgtgctgacaggctggtgggtcaggttcttgggcaagttgggagtctgcccgatgtttttgttgagctcgaggtgaattttttcctcctccggaggcttttgggggtgaggacaaagggaacagaaaaacaagggaaggtatctaagcttgcaaagggtgagatcctgatgttgaacataggatcgatgtcaacgggggcacgagtgattgctgtgaaaaatgatctagctaagctgcagctcactgcaccagtgtgcacaagcaaaggggagaaggtggccctcagccggcgggtcgagaagcattggcgtcttattggttggggccagatccaggctggtgtgacccttgacgtcccaccatgctctatttaaagcaaagaatcttgctggtgaagagaagcacaaaaagtacaggattaagaggtctgtgagaagttatgtgggagggtagacagcttctaggaacagtttttgtgagatggagaagaaaacagaacaatgttgaagttttggtgcttggtttgtgtttcaaaaatttatctgatgccaagagagtatttttcagtaatatatcactcaacaaccaagatatcttga

SEQ ID NO: 2372 - DNA, 1723 bp, Echinochloa colona
aagccaggtgccaccaccacatttccagttttccacgccgcccgccggccgccgccaccgcgacgcaacacccagctaaactcccagccctcaccgcctcggcgtccgagcccaccggagcacctccctcctagtcgtcgtgctccgactcgcagctcagccgtcacctagccttccagtccgggcgaccgctccagtttcaggccccagcgttactcaaacagaatcgaagatggcgcgccgaggattgatggagcaggatctgagcaagctcgacgtcaccaagctccaccctctgtctccagaggtgatttcacgccaggcgacgatcaacatcggtaccattgggcatgtggcccatgggaagtctactgttgtaaaagcaatctcaggtgtacagactgttcgtttcaagaacgaattggagcgcaatatcactataaagcttggatatgctaatgcaaaaatctatatatgtgaagatgataggtgcccacgaccaatgtgttacaaggcttatggcagtggcaaagaagatacccctccatgcgatgtgccaggttttgaaaactgtaggatgaagctcctgagacatgtttcatttgttgattgcccggggcatgacattctcatggctacaatgcttaatggagctgctatcatggacggagcacttcttctgattgcagcgaacgagagctgcccgcaaccccagacatctgagcaccttgcagctgttgaaattatgcgtcttcaacatattatcattctgcagaacaagattgatcttatccaggaaagtgcagcaatgaaccagcatgaagcaatccagaaatttatacagggaacaattgctcaaggtgcccctgtggtaccaatatctgcacagctgaagtacaatattgatgttatctgtgaatacatcgtgaaaaagatccccatcccagagaggaacttcatctctcctcccaacatgattgttattcgttcttttgatgtgaacaaacctggttcagaggttaatgaaatcaagggtggagtagcaggtggcagtatcctgaagggagtcctgagggtgaaccagaaaattgaagttcgcccaggcattgtgatgaaggatgagcacggcaaacttaaatgcacgcccatctattcgaggattgtctccctgtatgctgagcagaatgaactccagtttgctgttcctggggggcttattggagttggaaccaccatggacccgacactgacccgtgctgataggctggttggccaggttcttggtgaagttggatcactgccagatgtttacatcgaattagaggtgaacttcttcctcctgaggaggctgctgggggtgaggacaagtggaacagaaagggcaagcagggtttcaaagcttgctaagggtgagatcttgatgcttaacatcgggtcgatgtccactggagcccgtgttgtcgccgtcaagaatgatcttgcgaagctgcagctgaccgcaccggtgtgcaccagcaagggtgagaagctggcccttagccggcgcatcgagaagcactggcgtcttataggttggggtacaatccaggctggcactacactcgacgtcccaccctgccctctgtgaatcatacaccagccgtttgacacgaagagtttgaaagagaagagtggagatgtggcaggacacagagttgttaggaacgggttttgtgaggtggag

SEQ ID NO: 2373 - DNA, 1861 bp, Echinochloa colona
ccaccgccccagccgccgtcaccgcgacgcaactcccagctctaaaccccagccccgccgcctcgccgtccgagcccaccggagcgggcccttcctcctccgccgtcgccttccgctcgaccgccccaggccccagcgttactcaaacagagtcgaagatggcgcgccgaggattgatggagcaggatctgagcaagctcgacgtcaccaagctccaccctctgtctccagaggtgatttcacgccaggcgacgatcaacatcggtaccattgggcatgtggcccatgggaagtctactgttgtaaaagcaatctcaggtgtacagactgttcgtttcaagaatgaattggagcgcaatatcactataaagcttggatatgctaatgcaaaaatctatatatgtgaagatgataggtgcccacgaccaatgtgttacaaggcttatggcagtggcaaagaagatacccctctatgtgatgtaccaggttttgaaaactgtaggatgaagctcctgagacatgtttcatttgttgattgcccggggcatgacattctcatggctacaatgcttaatggagctgctatcatggacggagcacttcttctgattgcagcgaacgagagctgcccgcaaccccagacatctgagcaccttgcagctgttgaaattatgcgtcttcaacatattatcattctgcagaacaagattgatcttatccaggaaagtgcagcaatgaaccagcatgaagcaatccagaaatttatacagggaacaattgctcaaggtgcccctgtggtaccaatatctgcacagctgaagtacaatattgatgttatctgtgaatacatcgtgaaaaagatccccatcccggagaggaatttcatctctcctcccaacatgatcgttattcgttcttttgatgtgaacaaacctggttccgaggttaatgaaatcaagggtggagtagcaggtggcagtatcctgaagggagtcctgagggtgaaccagaaaattgaagttcgcccaggcatcgtgatgaaggatgagcatggcaaacttaaatgcacgcccatctattcgaggattgtctccctgtatgctgagcagaatgaactccagtttgctgttcctgggggccttattggagttggaacgaccatggacccaacactgacccgtgctgacaggctggtcggtcaggttcttggtgaagttggatcactccctgatgtttacattgagttagaggtgaatttcttccttctaaggaggctgctgggtgtgaggacaagtggaacagaaagggcaagcagggtttcaaagcttgctaagggtgagatcttgatgcttaacatcgggtcgatgtccactggagcccgtgttgtcgccgtcaagaatgatcttgcgaagctgcagctgaccgcaccggtgtgcaccagcaagggtgagaagctggcccttagccggcgcatcgagaagcactggcgtctcattggttggggcaccatccaggctggcactacacttgacgtcccaccctgcccgctctgaatcacacaccacctgttcgacgcgaatagagtttgaaagagaagagtggagatgtggcaggacacagagttgttaggaacgggttttgtgaggtggagaaaacctgaacccaaacattacctgcttggatttttcttcttactattgcacttttgtactgttattttgttatggatggctgacataagaattgagcactttctgggcttcagtgtgtcaaatttgcttatgctgtgcaagcaagcagagcatgtagtgttcgctcaactgttaacgtccttgttttacatacgctctctacaaccttt

SEQ ID NO: 2374 - DNA, 1850 bp, Panicum virgatum
tccactgcctccaaaccctctgctccatctccaaactgccaactccgacgcccgccgccgccgccgccgcgacgcaacgcgtagatccaaacccccagcccacgccacctccgccgccgctgaaccgcgtccacgcggccgccccaggccccggcgttgctcaagcagaaccgaagatggcgcgccgagggttgatggagcaggatctgagcacgctcgacgttttcaagctgagccctctgtcgccggaggtgatttcgcgccaggcgacgatcaacatcggtaccattgggcacgtggcccatgggaagtctacggttgtcaaagcaatctcaggtgtacagacagttcgtttcaagaatgaactggagcgcaatatcactataaagcttggttatgctaatgcaaaaatctataaatgtgaagatgatagatgcccacggccaatgtgctacaaggcttatggcagtggcaaagaagatagtcctctctgtgacgttccagggtttgaaaactgcaggatgaagctcttgagacatgtttcatttgttgattgcccggggcatgacattctcatggctacaatgcttaatggagcagctatcatggacggtgcactacttctgattgcagcaaacgagagctgtccccaaccccagacatctgaacaccttgcagctgttgaaattatgcgccttcaacatattatcattctgcagaacaaaattgatcttatccaggaaagtgcagcaatgaaccagcatgaagcaatccagaaatttatacagggaacaatagctcaaggtgctcctgtggtgccaatatctgcacagctgaagtacaatgttgatgttatctgtgaatatatcgtgaaaaagatccccatcccagagaggaacttcacctctccacccaatatgattgttattcgttcttttgatgtgaacaaacctggttcggaggttgatgaaatcaagggtggagtagcaggtggcagtatcctcaagggagtcctgagggtgaaccagaaaatcgaagttcgcccaggcatcgtgatgaaggatgagaatggcaaaattaaatgcacacccatctattcgaggattgtgtccctgtatgcagagcaaaatgaactccagtttgccgttcctggagggcttattggagttggaactaccatggacccgacactgactcgtgcggataggctggtcggtcaggttcttggtgaagttggatcactccctgatgtttacattgagttagaggtgaacttcttcctcctaaggaggctgctgggggtgaggacaagtggaacagaaagggcaagcagggtctcaaagctcgccaagggtgagatcctgatgcttaacattgggtcaatgtccactggagcccgtgttgttgctgtcaagaacgatcttgcaaagctgcagctgaccgcaccggtgtgcactagcaagggtgagaagctggcccttagccggcgcatcgagaagcactggcgtctcattggttggggcacaatccaggccggcactacacttgacgtccctccctgtctgctctgaatcgtacaccacctgtttgacgtaagtagagtttgaaagaagagagtggacatgtggcaaggcagagagcttttaggaaatgtttttgtaaggtggaggagaaaacctgaaccaaaatgtttaagtattgttacatttacttggggagtgtaatgataagcttgaatattgaattgtgtaatttctggcttcagagcagtgaattgcggatgctgtgcaggaagctgagcaatgagaatgaagtgcaagttagtctgttagtgtcttgtttcaaatatc

SEQ ID NO: 2375 - DNA, 1810 bp, Gossypium hirsutum
aaaaggctgcgttcttctttctgcaggcaactaatcaaacccgtctcaagcaactctctcttttaatcagtttatattgaagcagaaagacaaaaggagcagcgaaaatgtcgaaaaaaggtttgatggagcaagacttaagtaaactggatgtgactaagttgcatccgctgtctcctgaagtcatatctcgccaggctaccataaatatcggcaccatagggcatgtcgcacatgggaagtcaacagtagtgaaagcaatatctggggttcagactgttcgttttaagaatgagttggagaggaatattactatcaagcttggatatgcaaatgcaaagatatacaaatgtgaagatgaacgatgccctcgtcctatgtgctacaaggcatatggaagcggaaaggaggatagtcctctttgtgatgtccctggctttgaaaactgtaggatgaagttgctgagacatgtatcttttgtggattgcccaggtcacgatattctcatggctactatgcttaatggagcagcaatcatggatggtgcattacttcttatagctgccaacgaaagctgtccacaaccacaaacttctgagcatctggctgctgttgaaatcatgcgactacagcatattattattcttcaaaacaaggttgatcttattcaagagaatgtggccatcaatcagcatgaagcaattcagaaatttattcagggtactgttgctgatggtgcacccgtggtaccaatctctgcacaactaaaatataatattgatgttgtgtgcgagtacattgtgaagaagatccctattcccgagaggaactttgtctcaccccctaacatgattgtaatccgatcttttgatgtcaataagccagggtttgaggttgatgagattaaaggtggtgttgctggtggaagtatactcaggggtgttttgaaggtgaaccaatttattgaagttcgtcctgggattgttgtcaaggatgaaagtggaaacatcaaatgcacacccatatactcgagaatagtctcattgtatgctgaacaaaatgagctacaatatgccgttccaggaggtctaattggtgttggaacaactatggacccgactttaactcgtgcagataggttggtgggtcaagttcttggagaggttgggtcactcccagaagtgtatgtcgagctcgaggtaaatttcttccttctccgaaggcttcttggtgttaggacaaagggttcggagaggcaaggaaaagtgtcaaagttggccaagggagagatcctaatgttgaatattgggtctatgtcgaccggtgctcgagtcatagctgtaaagaatgatttggcaaagctgcaactcacgtcccctgtatgcaccagcaagggagagaaaattgcacttagtcggcgtgttgagaagcattggcgtctaatcggatggggccaaatccaagctggaacaaccattgaagtcccaccctgccctgtttaagaactgataaacaggtaaacagaaagcaaaaacatctataagaaaaaaaagagggcagaagaatcaaattttttgttgttgaaaatgtgggaaggtagacaatatcttggtactatttttgtgaggtggagaagaaaacattgtttgatagagaatttgattgttccttgctgaaaacatggagctttttctaggatatatgatactgtaattttttattgggataaaatctattactcggactttttatttttctcgaagaactcatatttgatgcatgaaataagataaaataatgatttaatttt

SEQ ID NO: 2376 - DNA, 1807 bp, Setaria italica
ctgagatcaatcttcgtcgctgattctctgctgtgtgctcacgctcccgattgatctcgccggtgagctaggggtagttacatttgtttgcttgcgcccgactcactataggcgcgccaccgtcgctgaaccgccctgtccgcgcgcccgccccagttttaggccccagtgttactcaaacagaaccgaagatggcacgccgaggattgatggagcaggatctgagcaggctcgatgtcgccacgctgcaccctctatcgccagaggtgatttcacgccaggcgacgatcaacatcggtaccattgggcacgtggcccatgggaagtctactgttgtcaaagcaatatcaggtgtacagactgttcgtttcaagaatgaactggagcgcaatatcactataaagcttggctatgctaatgcaaaaatctataaatgtgaagatgataggtgcccacgaccaatgtgctacaaggcgtatggcagtggcaaagaagatagccctctctgtgatgtgccaggttttgaaaactgtaggatgaagctcctgagacatgtttcatttgttgactgcccagggcatgacattctcatggctacaatgcttaatggagctgctatcatggatggagcacttcttctgattgcagcaaatgagagctgcccacaaccccagacatctgagcaccttgcagctgttgaaattatgcgtcttcaacatattatcattctgcagaacaagatcgatcttatccaggaaagtgcagcaatgaaccagcatgaagcaatccagaaatttatacagggaacaatagctcaaggtgctcctgtggtgccaatatctgcacagctaaagtacaacattgatgttatctgcgaatacatcgtgaaaaggatccccatccctgagaggaatttcacctctcctcccaacatgattgttattcgttcttttgatgtgaacaaacctggttcagaggttgacgaaatcaagggcggagtagctggtggcagtatcctcaagggagtcctgagggtgaaccagagaatcgaagttcgtccaggcatcgtgatgaaggatgagcatggcaaacttaaatgcacgcccatctactcaaggattgtctccctgtatgctgagcagaacgaactccagtttgctgttcctggaggccttattggagttggaactaccatggacccgacactgactcgtgctgataggctggtcgggcaggttcttggtgaagttggatcattgcctgatgtttacatcgagttagaggtgaatttcttcctcctaaggaggctgctgggggtgaggacaagtggaacagaaagggcaagcagggtctcaaagctcgccaagggtgagatcttgatgcttaacatcgggtcgatgtccacaggagcccgtgttgtcgccgtgaggaatgatcttgcgaagctgcagctgaccgcaccagtgtgcaccagcaagggtgagaagctggcccttagccgccgcatcgaaaagcactggcgtctcataggttggggcacaatccaggccggcaatacactcgaagtccccccctgcccgctctgagtcatacaccacctgtttgacgtgaaggatacaattgaaagagtggagatgtggcaaggcagagagctgttaggaatgatttttgtgaggtggagaaaacctgaacataaatattatcttcttggatttttattcttaattttggtagttttgcattgttattatgttagttagcgttttacctggtgagcgtaatgataagctttatattgaatcgacca

SEQ ID NO: 2377 - DNA, 1943 bp, Gossypium raimondii
caaacaaagcccaaagacaacccaaagaatactgtatctggattggattgggttgacaaaaaaaaccaccattgttaaaagctcagttttttaggcttaaatccaactatccctagcgactgaaaaaggctgcgttcttctttctgcaggcaaactaatcaaacccgtctcaagcaactctctcttttaatcagtttatattgaagcagaaagacaaaaggagcagcgaaaatgtcgaaaaaaggtttgatggagcaagacttaagtaaactggatgtgactaagttgcatccgctgtctcctgaagtcatatctcgccaggctaccataaatatcggcaccatagggcatgtcgcacatgggaagtcaacagtagtgaaagcaatatctggggttcagactgttcgttttaagaatgagttggagaggaatattactatcaagcttggatatgcaaatgcaaagatatacaaatgtgaagatgaacgatgccctcgtcctatgtgctacaaggcatatggaagcggaaaggaggatagtcctctttgtgatgtccctggctttgaaaactgtaggatgaagttgctgagacatgtatcttttgtggattgcccaggtcacgatattctcatggctactatgcttaatggagcagcaatcatggatggtgcattacttcttatagctgccaatgaaagctgtccacaaccacaaacttctgagcatctggctgctgttgaaatcatgcgactacagcatattattattcttcaaaacaaggttgatcttattcaagagaatgtagccatcaatcagcatgaagcaattcagaaatttattcagggtactgttgctgatggtgcaccagtggtaccaatctctgcacaactaaaatataatattgatgttgtgtgcgagtacattgtgaagaagatccctattcccgagaggaactttgtctcaccccctaacatgattgtaatccgatcgtttgatgtcaataagccagggtttgaggttgatgagattaaaggtggtgttgctggtggaagtatactcaggggtgttttgaaggtgaaccaatttattgaagttcgtcctgggattgttgtcaaggatgaaagcggaaacatcaaatgcacacccatatattcgagaatagtctcattgtatgctgaacaaaatgagctacaatatgccgttccgggaggtctaattggtgttggaacaactatggacccgactttaactcgtgcagataggttggtgggtcaagttcttggagaggttgggtcactcccagaagtgtatgtcgagctcgaggtaaatttcttccttctccgaaggcttcttggtgttaggacaaagggttcggagaggcaaggaaaagtgtcaaagttggccaagggagagatcctaatgttgaatattgggtctatgtcgaccggtgctcgagtcatagctgtaaagaatgatttggcaaagctgcaactcacgtcccctgtatgcaccagcaagggagagaaaattgcacttagtcggcgtgttgagaagcattggcgtctaatcggatggggccaaatccaagctggaacaaccattgaagtcccaccctgccctgtttaagaactgataaacaggtaaacagaaagcaaaaacatctataagaaaaaaaaagagggcagaagaatcaaattttttgttgttgaaaatgtgggaaggtagacaatatcttggtactatttttgtgaggtgtagaagaaaacattgtttgatagagaatttgattgttccttgctgaaaacatggagctttttctaggatatatgatactgtaattttttattgggataaaatctattactcggactttttatttttctcgaagaactcatatttgatgcatgaaataagataaaataatgattgaattttgtcatttg

SEQ ID NO: 2378 - DNA, 2073 bp, Amorphophallus konjac
gatcggtccgctcgctaggttgcaggggcaccgtcatcctcagcgaagatgtcgcggaaagggttgatggagcaggatttgagtaagctggatgtcacgaagttgcatccgctgtcgccagaggttatctcccggcaggcgacaattaatatcggcactattggtcacgtcgcccatggaaagtctactgttgtgaaagcaatatctggcgtgcagactgtgcgttttaagaatgaacttgagcgtaacattactatcaagcttggatatgcaaatgcaaagatatacaaatgtgaagatgagagatgtcctcgtccaatgtgctacaaggcctatgggagtggaaaagaagacagtcctttatgtgatgtaccaggttttgagaatactagaatgaaactattgaggcatgtttcttttgtggactgccctggacatgatattctcatggcaacaatgcttaatggagctgcaatcatggatggggcattgttgttaatagctggaaatgaaagttgcccacagccccaaacttccgagcatctagcagctgttgagatcatgcgtttgaaacatataatcattttgcaaaataagattgatcttattcaagaaagtgttgcaatcaaccagcatgaagcaattcaaaattttattcagggtaccatagctgatggagccccagttgtaccgatctctgcccagttgaagtacaatattgatgttgtttgtgagtatctagttaacaaaatccccattccagacaggaactttgttgcacctccaaacatgattgtcattcgttcgttcgatgtgaataaacctgggtttgaggttgatgaaataaagggtggcgtagctggaggaagcatcctcaggggtgttttgaaggtgaaccagttcatagaggtccgtcccggtattgttgttaaggatgagagtggtaacatcaagtgcactccgatatattcaagaatagtttcattatatgcagagcaaaatgagctccagtttgcagttccggggggtctcatcggagtgggtactacaatggaccccacactaacacgtgctgatagattggttggtcaggttctcggagaagttggttcattgcctgatgtttttgtcgagctcgaggtgaatttcttcctcctccggcggctgttaggagtgaggacaaaggggacggagaagcagggcaaagtctcaaagctggcaaagggggagattctgatgttgaacataggatccatgtccacaggtgcccgggtcgttgctgtgaggaatgatcttgcaaaactgcagcttacggcacccgtttgcacgagcaggggggagaaggtcgctctcagccggcgagtagagaaacattggcggcttattgggtgggggcagattcaggctggtgttactctggatgtgccaccctgccccatctaaattcccctatcagataaaacaccagtcagtcaccaggcagacaggtaccggcctttcttattgagactcgtgatagatcatcatgtgggagggaagacaactacttggaacaatttttgtcagatggagaagaaaacagtgtgacaatgtgtgtttttgcccttgcctgttcttttgcatcatgaagaggattgtcaaggttttgtctccgagtttttctcgaatggaatcctgccttcaattttgatcatcccgtctggctagcattcaaatccctcttgcgatgtggatctacatcctttttttttaaaggttttttcttgcaaaccaagtcccgtcaaatccttgcatgaacgaacaaaagtgatgaacaggtctgcaacacagctacgcacttcctccccgcattgtctgtgtgtattcaatggggcacgtcttattcttgattgatccatgcggcaagaaagacagtgatgctttaaatgctctgactgcttataaccccatgcatttcgatgtaactcggcatatttcgagccaaactattatatgttactccagtctttaatgtcattcttatggactatagttcgctcgtatgagttatattttatcgatgtacagtattct

SEQ ID NO: 2379 - DNA, 1661 bp, Fagus grandifolia
ctcttcaaatctgctactgcttctctctctctatctcagctcccaaacagagcctctatctcttccttgtcggcgcgcactcaaacccgacctaatccgacccgccgttccgcccaccaactgaaccaaccagtttcttgtgtgttttgagagagaatacattgattctttctcgttggatttcaccagtaaccaaattagaaagttattttatctggagggtctcttagtaacaaccaaaaatgtcgcggaagggtttgatggagcaggacctgactaaactggatgtaacaaagctacatccactctctcctgaagttatatctcggcaagctacaataaatattggcaccattggtcatgtggctcatgggaagtcaacagtggtaaaagcaatatctggtgttcagactgttcgttttaaaaatgagttggagcgcaacattactatcaagcttggttatgcaaatgcaaagatctacaaatgcgaagaggaacggtgccctcgacctatgtgctacaaggcttatggaagtgggaaggaagataatcctctctgtgatgtgccggggtttgaaaactgcaggatgaaattgctgagacatgtgtcttttgttgattgccctggtcatgatattctcatggctacaatgcttaatggagctgcaattatggatggagctctacttcttatagctgctaatgaaagctgcccccaaccacaaacttctgagcaccttgctgctgttgaaattatgcgccttcaacatataataatccttcaaaataaagtagatctcattcaggaaaacgtagccatcaaccagcatgaagcaatccagaagtttattcagggaactgttgctgatggagcacccgtggtaccaatatctgcacagctgaagtataatattgatgttgtgtgtgagtatattgtgaaaaagattcccatacccgaaaggaactttgtgtcaccccctaacatgattgtaatccggtcttttgatgtcaataagcctggttttgaggttgatgagataagaggtggtgtggctggtggaagtattctcaggggtgttttgaaggtaaatcaatttattgaggttcgtcctgggattgttgttaaagatgagagtgggaacatcagatgtacaccgatatattccagaatagtttctttatatgccgagcaaaatgagctgcaatttgctgtacctggaggtctcattggtgttggcacaaccatggaccccactttgacacgtgctgataggttggtgggtcaagttcttggtgaagttggatcactccctgaagtttttgtggagcttgaggtgaactttttcttgctgcggcggcttctaggtgtcaggactaagggtactgagaggcagggaaaggtctctaagctaaccaagcaagagatcttaatgttgaacataggatccatgtctacaggggctcgagttgttgctgtgaagaacgatttagcaaaattgcaactcacatctccagtgtgcaccagcagaggagagaagattgcccttagtcgacgagttgagaagcactggcgtcttattggttggggtcagattcaagctggaaccacccttgaggtcccaccctgcccaatttgagttaaatccctaaacagatagaca

SEQ ID NO: 2380 - DNA, 1756 bp, Gossypium hirsutum
ctcttttaatcagtttatattgaagcagaaagacaaagggagcagcggaaatgtccaaaaaaggtttgatggagcaagacttaagtaaactggatgtgactaagttgcatccgctgtctcctgaagtcatatctcgccaggctaccataaatatcggcaccatagggcatgtcgcacatgggaagtcaacagtagtgaaagcaatatctggggttcagactgttcgttttaagaatgagttggagaggaatattactatcaagcttggatatgcaaatgcaaagatatacaaatgtgaagatgaacgatgccctcgtcctatgtgctacaaggcatatggaagcgcaaaggaggatagtcctctttgtgatgtccctggctttgaaaactgtaggatgaagttgctgagacatgtctcttttgtggattgcccaggtcacgatattctcatggctactatgcttaatggagcagcaatcatggatggtgcattacttcttatagctgccaatgaaagctgtccacaaccacaaacttctgagcatctggctgctgttgaaatcatgcgactacagcatattattattcttcaaaacaaggttgatcttattcaagagaatgtagccatcaatcagcatgaagcaattcagaaatttattcagggtactgttgctgatggtgcaccagtggtaccaatctctgcacaactaaagtataatattgatgttgtgtgcgagtacattgtgaagaagatccctattcccgagaggaactttgtctcaccccctaacatgattgtaatccgatcatttgatgtcaataagccagggtttgaggttgatgagattaaaggtggtgttgctggtggaagtatactcaggggtgttttgaaggtgaaccaatttattgaagttcgtcctgggattgttgtcaaggatgaaagcggaaacatcaaatgcacacccatatattcgagaatagtctcattgtatgccgaacaaaatgagctacaatatgccgttccgggaggtctaattggtgttggaacaactatggacccgactttaactcgtgcagataggttggtgggtcaagttcttggagaggttgggtcacttccagaagtttatgttgagctcgaggtaaatttcttccttctccgaaggcttcttggtgttaggacaaagggttcggagaggcaaggaaaagtgtcaaagttggccaagggagagatcctaatgttgaatattgggtctatgtcgaccggtgctcgagtcatagctgtaaagaatgatttggcaaagctgcaactcacgtcccctgtatgcaccagcaagggagagaaaattgcacttagtcggcgtgttgagaagcattggcgtctaatcggatggggccaaatccaagctggaacaaccattgaagtcccaccctgccctgtttaagaacagataagcaggtaaacagaaagcaaaaacatctataagaaaaaaagggaggcagaagaatcaaattttttgttgttgaaaatgtgggaaggtagacaatttcttggtactatttttgtgaggtgtagaagaaaacattgtttgatagagaatttgattgttccttgctgaaaacatggagctttttctaggatatatgatactgtaattttttattgggataaaatctattactcggactttttatttttctcgaagaactaatatttgatgcatgaaataagataaaataatgattgaattttgtc

SEQ ID NO: 2381 - DNA, 1951 bp, Cucumis sativus
agggcagccctaacctttgtacaacgcaagcttcctctaatatctctatctccctctttctctctccctctctcgacggtgatctctttctctctcacattcatcactcgccgccgccggtagcttctctttctctgacgccaccgccgccggtaatctctctctcgctctctcaacacacagaaatttctgattgagcatcaccaggttggttactctctggtttaactttcacaaagaaccaagacacacatccgtaacttgtttgcataaagatatttagccaagatgtcgcggaagggtttaatggaacaagacttaaagaaattggatgtaacaaagctccatccgctttctccagaagttatatctcgtcaagctactatcaatattggtactattggtcatgtggcacatggtaagtctacagttgtaaaggcaatttcaggagtccagactgtacgttttaagaatgaactggagcgtaacattaccattaagttggggtatgctaatgcgaagatatacaaatgtgaagatgacaagtgccctcggcctgcatgctacaaggcatatggaagtggaaaggaagacagtcctttgtgtgatgtgcttgggtttgaaaattgcaggatgaaactactgcgacatgtatcctttgtcgactgcccgggtcacgatattcttatggctaccatgcttaatggagcagccattatggatggagcactacttctgatagctgccaatgaaagctgccctcaacctcaaacttctgagcaccttgctgctgttgaaattatgcgccttcagcatattataatcctccagaataaagttgatcttattcaggaaaatgttgcaatcaatcagcacgaagctattcaaaagttcattcagggaacagttgctgatggtgcaccagtggtaccaatttctgctcagctgaagtataacattgatgtcgtttgcgaatatatagtaaaaaagattccaattccagaaaggaatttcgtctcacctcctaatatgattgtgattcgttcatttgatgttaacaaacccggatttgaagttgatgagatcaaaggaggtgtagctggtggtagcatattacggggtgttttaaaggtgaatcaatttattgaagttcgtcctgggattgttgttaaggatgaaagtggtaacataaagtgcaccccaatatactcgaggattgtttctttgtatgctgagcaaaatgagctgcaatttgcagtccctggaggtcttattggggttggtacaaccatggaccccactttgactcgtgctgacagattggtaggtcaggttcttggggaagttggatcacttcctgatgtttatgtcgagctagaggtaaactttttccttttacggcggctcctaggtgtgaggacaaaaggatcagaaagacagggaaaagtatcaaaactagccaagggggagattctaatgttgaacataggatccatgtctacgggagctagagtagttgcagtgaagaacgatttagcaaagttgcagcttacatctcctgtttgcaccagcaagggggagaagatcgctctaagtcgtcgtgttgagaagcactggcgtcttattggctggggtcaaattcaagctggatctactctggatgtccctccctgccccatttgagtagtaaaggtaagaatcaagaagaaaaagaagtgcgaagagtaaggaaaatgtgcaaagttagacagtttgttggaaccatttttgttaggtggaggagaaaacaccatctggtttctcattgtttattaggttgtctttttcacaatttcatcccccgaagtctatttctgatttttattattttaagttccgaatcatggatacatgacatgtgagccattccatttggtttatgaactaaaaatgcgataatattatttcacct

SEQ ID NO: 2382 - DNA, 1908 bp, Gossypium raimondii
gcttctttgttttctctctgcaaaaaaaatctccaccgatcaggtttggattgtagttcatattgaagcataaagaccgttattaatatcagccgaaatgtcgagaaaaggtttgatggagcaagacttaagtaaactggacgtaactaagttgcatccgttatctccagaagttatatcgcgccaagctactataaatataggcaccatagggcatgtggcgcatgggaagtcgacagttgttaaagcaatatctggcgttcagactgttcgttttaagaatgagttggagcgtaatattactatcaagcttggatatgcaaatgcaaagatatacaaatgtgaagatgaacggtgccctcgtcctatgagcttcaaggcatacggaagtggaaaggaggatagtcctctttgtgacgtgcctggctttgaaaactgcaggatgaaattgttgagacatgtatcttttgtagattgcccgggtcacgacattctcatggctacaatgcttaatggagcagcgattatggatggtgcattacttctcatagctgccaacgaaagctgtcctcaacctcaaacttctgagcatctggcagctgttgaaatcatgcgactccagcatattataattcttcaaaacaaggttgatcttattcaagagaatgtagccatcaatcagcatgaagcaattcagaaatttattcagggcactgtagctgatggcgcaccagtggtaccgatttctgcacagctaaaatataacattgatgttgtgtgcgagtacattgttaagaagatccccattcctgagagaaacttcatctcaccccctaacatgattgtcatcagatcatttgatgtcaataagccagggtttgaggtggatgagattaaaggtggcgttgctggtggaagtatactccagggtgttttgaaggtgaaccaatttattgaagttcgtcctgggattgttgttaaggatgaaaatgggaacatcaaatgcacacctatctattccagaatagtctcactatatgcagaacaaaatgagctacaatttgctgttcccggaggcctgatcggtgttggaacaactatggacccaactttaacacgtgctgatcggttggtgggtcaagtcctaggagaggttgggtcactcccagacgtttttgttgagcttgaggtaaacttcttccttcttcgaaggcttcttggtgttaggacaaagggatcagaaaggcagggaaaagtgtcaaagctggccaagggagagatcctaatgttgaacatcgggtccatgtcgactggggctcgggtcatagccgtaaagaacgatttggcaaagctgcaactcacatctcctgtgtgcaccagcaagggagagaagattgcactaagtcgacgcgtggagaagcactggcgtctaataggatggggtcaaattcaagctggaacaaccctcgaggttccaccctgtccgctttgaacaaccaccgaactgataatcaggtaacagaaaactaaaacatcagttcaaggaaaaaaagagacgcttaagtaaggaattttttagggtgtttagatgtggggacagaaagataatatcatggtactgtttttgtcaagtggagaagaaaacattgttttgataatttttgtcattgtttgttgtattgtgggaaacatggaattttgtacgaggctattgtttgtcatgcaaacactgttgaaattgagagagatatctatttgactgaactgaaagtttaagcacagtttctcaatggctgaatgaagcaatctccaccacccattatattgcaatctaaataagttgaacctgtggtggttaggatgttcactgttccaggtgtggcttaggtaggttctagttatgttgtt

SEQ ID NO: 2383 - DNA, 1739 bp, Vitis vinifera
aggttgaacccaggttcccatctaattgaatcttgcaaatagaactattttttctggaggagtacaactttcctaaggagcaggtaaaatgtctcgaagagggttgatggagcaggatttgagcaagctggatgtgacaacactacatccgctctcacctgaagttatttctcgtcaggctactataaatatcggcacaattggtcatgtggctcatgggaagtccacagttgtaaaagctatatctggtgttcagactgttcgttttaaaaatgagctggagcgcaacattactatcaaacttggatatgcaaatgccaagatatacaaatgtgaagatgaacggtgccctcgacccatgtgctacaaggcctatggaagtggaaaggaagatagtcctctctgtgatgtgcctgggtttgaaaactgcaggatgaagttgctacgacatgtgtcctttgtagattgcccggggcatgatattctcatggctacaatgcttaatggagcggcaattatggatggggcattacttcttatagctgccaatgaaagctgtccacagccgcaaactgctgagcatctggctgctgttgaaataatgcgtcttcagcatattataatccttcaaaataaagttgatctcattcaggaaaatgtagccatcaaccagcatgaagcaattcagaaatttattcagggaactgttgcagatggtgcaccagtagtaccaatttctgcgcagctgaagtataatattgatgttgtgtgtgaatatattgtgaaaaagatccccattccagagagagactttacttcaccaccaaatatgattgtgattcggtcatttgatgtcaataagcctgggtttgaggttgatgagataagaggtggtgttgctggtggaagcattctcaggggtgttttgaaagtgaatcagtttattgaggttcgtcctgggattgttgttaaagatgagaatgggaacatcaaatgcacaccgatatattctaggatagtctcattgtatgctgaacaaaatgagctgcaatttgctgtgccaggaggcctcattggggttggcacaaccatggaccccactttaacacgagctgatcgcctggtggggcaagttcttggagaggttggatccctccctgatgtttttgttgaactagaggtaaacttcttcctgctgcgacggcttattggtgtaaggactaagggaacagaaaagcagggaaaggtttcaaagctgaccaagggagagatcctcatgttgaatattgggtccatgtctacaggtgctcgagtccttgctgttaggaatgatttggcaaagttgcaactcacatctcctgtgtgcaccagcagaggggagaagattgcacttagtcggagagttgagaagcattggcgtctgattggatggggccaaattcaagctggaaccactctcgatgtcccacccagccccatttgagtgagaactgaatcaacaggtaaaacagaagcggctgaaaagaggactaatacggcagaagaggattaaggaaaatgtgggagggcagacaactgttaggaacaatttttttaaggtggagaagaaaacatgttctggatgcttgtggttgtgatatttgtttgctttgtgataggaaagtaccccagactgattcttttttttgcttcagtatgtttccgactgaactgacatttatatcaatggttgatgttgg

SEQ ID NO: 2384 - DNA, 1722 bp, Tripterygium wilfordii
tctctgccctaacgctacctgcgtcctctactttttaagcgaaagagttgcttatatactttgcatataccagtacttgcatcagtcggtggatcttaagtcattaagcaaaatgtctcgaaagggattgatggagcaggacttgaaaaaactggatgtgacgaagttgcatccactttcgcctgaggttatatctcgtcaggccactataaatattggcaccattggtcatgtggcacatggcaagtcaactgttgtaaaagcgatatccggtgtccagactgttcgttttaaaaatgagctggagcgtaacattaccatcaagcttggatatgcaaatgcaaagatctataagtgtgaagatgaacgttgtcctcgacctatgtgctacaaggcttatggaagtggaaaggaagataatcctcagtgtgatgtgccagggtttgaaaactgcaggatgaaattgctgagacatgtgtcttttgtggactgtccgggtcatgatattctcatggctacaatgcttaacggagcggcaattatggatggagcattacttctaatagctgcgaatgaaagctgcccacaaccgcaaacttctgaacatctggctgctgttgaaatcatgcgccttcaacatattattatccttcaaaataaagttgatcttattcaggaaaatgtggcaataaaccagcacgaagcaattcaagctttcattcagggaactgttgctgatggtgcaccagtggttccaatttcggcacagctaaagtataatattgatgttgtgtgcgagtacattgtgaaaaagatccctattccggagaggaactttgtctctccaccgaatatgattgttatcaggtcctttgatgttaataagcctggatttgaggttgacgatataaaaggtggtgtagctggtggaagcatccttcggggtgttttgaaggttaatcaatttattgaggttcgtccgggaatagttcttaaagatgaaagtgggaacataaaatgcacaccaatatattctagaattgtttctttgtatgctgagcaaaatgagctacaatttgctgtgcctggaggtcttataggggttggcactaccatggacccaactttgacccgtgctgataggttggtaggtcaggttcttggggaagtgggttcactcccagaagtctatgttgagcttgaggtgaacttcttcttgttgcgacgtcttcttggtgtcaagacaaagggcacggaaaggcaagggaaggtctcgaagcttgcaaaaggagagatcctaatgttaaacattggatccatgtctaccggtgctcgagttcttgctgtgaagaatgatttggcgaagctgcaacttacgtcgccagtttgcaccagcaaaggagagaagattgcactcagtcgaagagtagagaagcactggcgtcttattgggtggggccagattcaagctggaaccacccttgaagttccaccatgcccattgtgatcactgagaagagagagagcagtcaagagtaagaaaggattagatagagatgtgggagggaagacaatttcttggtacaatttttgtgaggtggagaagaagacattttgattggatggttgttactgttcgccttgtttctttaatttcatagtatccggtcttcttgagtattggacttccatccaaggaaggttttatcggaattgatagat

SEQ ID NO: 2385 - DNA, 2039 bp, Citrullus lanatus
gctgcccatttctttgtgcccagccctagcctttgtaaaacgcaagcttcctgtaatctctctatctctctctttcacgacggtgatctctctctcacattcatcactcgccgccgccggcagcttctctctctctgacgccaccgccgccggtaatctctctccctttctctcactcatctctcaatcgctctctcaacgcagagaaattcagattgagcatcagcagattggttactctctgctttaactttacaaggaacgaagacagacatccgtaacttttttgcataaagacattcagacaagatgtctcggaagggtttgatggaacaagacttaaagaaattggatgtgacaaagctccatccgctctcgccagaggttatatctcgtcaagctaccattaatattggtactattggtcatgtggcacatgggaagtctaccgttgtaaaagcaatttcaggagtccagactgtacgtttcaagaatgagctggagcgtaacattactattaagctggggtatgctaatgcaaagatatacaaatgtgaagatgacaagtgccctcggcctatgtgctacaaggcatatggaagtggaaaggaagacagtcctttatgtgatgtgcttgggtttgaaaattgcaggatgaaactattgcgacatgtatcctttgtcgactgcccaggtcacgatattctcatggctaccatgcttaacggagcagccattatggatggagcattacttctgatagctgccaatgaaagctgccctcaacctcaaacttctgagcaccttgctgctgttgaaattatgcgccttcagcatattataatcctccagaataaagttgatcttattcaggaaaatgtagcaatcaatcagcacgaagctattcaaaagttcattcagggaactgttgccgatggtgcaccagtagtaccaatttctgctcagctgaagtataacattgatgttgtttgcgagtacatagttaaaaagattccaattccagaaaggaattttgtctcgcctcctaatatgatcgtgattcgttcttttgacgttaacaaacctggatttgaagttgatgagatcaaaggtggtgtggctggtggtagcatactacggggtgttttaaaggtgaatcaatttattgaagttcgcccgggtattgttgttaaggatgaaagtggtaacatcaagtgcaccccaatatactctaggattgtttctttgtatgcggagcaaaatgagctgcaatttgcagtccctggaggtctcattggggttggcacgaccatggatcccactttgactcgtgctgacagattggtcggtcaggttcttggggaagttggatcacttcctgatgtttttgttgagctagaggtaaactttttccttttgcggcggctcctaggtgtgaggacaaaaggatcagaaaggcagggaaaagtatcgaaactggccaagggggagattttaatgttgaacataggatccatgtctacgggagctagagtacttgcagtgaagaacgatttagcaaagttgcagcttacatctcctgtttgcaccagcaaaggggagaagattgctctaagtcgtcgagtcgagaagcactggcgtcttattggctggggtcaaattcaagctggaacgactctcgatgtccctccctgccccatttgagttggttgtggaaaaaaggtaagaatcaagaagaaaagcgagtgagaagagtgaattgcagaactaagaaaaatgtgcaaagttagacagtttggtggaaccatttttgttaggtggaggagaaaacaccatttggtttctcattgtttattacgttatctttttcacatttttatcccccgaagtctttctgatttttactatttttaagtttcgaatcatgaatgtgacatgtgagccattgggtcaatgaactaaaaatgcgatataataggatgaacattattgtttcacattcactgtgtttggttgagatttccaattaaagaaaaaaa

SEQ ID NO: 2386 - DNA, 1709 bp, Momordica charantia
cggccggggaacctaacagcgaattcttctcgcgtagtctgtgagaggaccttcacattttgttccaagcgctccgtcggaccgtcgctcgcgctctcttcgcgtcaatccccagaatcactcacttctctcaattttctttcttccattctctgttcgccgcaacttcttcccacctacgaacgctcattttcgactagttgctctctgttcttgacttcacaaggagccaactaagacatccataacttgtttgcacgagaacaatcagccaagatgtcgcggaaaggtttgatggaacaagatttaaagaaattggacgtgacaaagctccatccgctttctccagaagttatatctcgtcaagccaccattaatattggtactattggtcatgtggcacatggaaagtctacagttgtaaaagcaatttcaggagtccagactgtacgttttaagaatgagctggagcgtaacattaccattaagctgggatatgctaatgcaaagatatacaaatgtgaagatgacaagtgccctcgacctatgtgctacaaggcttatggaagtggaaaggaagacagtcccttatgtgacgtacctgggtttgaaaattgtaggatgaaactgttgcgacacgtttcttttgtagactgcccgggtcatgacattcttatggctaccatgctcaatggagcagccattatggatggagcgttgcttctgattgcagccaaatgaaagctgccctcaacctcaaacttctgagcaccttgctgctgttgaaattatgcgccttcaacatattataatcctccagaataaagttgatcttattcaggaaaatgtagcaatcaatcaacatgaagcgattcaaaagtttattcagggaactgttgctgatggtgcgccagtagtaccaatttctgctcagctgaaatataatattgatgttgtttgcgagtatatagtgaaaaagattccaatccctgaaaggaattttgtctcacctcctaatatgattgtcattcgttcttttgatgttaacaaacctggatttgaagttgatgagatcaaaggtggcgtggctggtggtagcatattacggggtgttttaaaggtgaatcaatttattgaagttcgtccagggattgttgttaaagatgaaagtggtaacatcaagtgcaccccgatatattccaggattgtttctttgtatgcggagcaaaatgagctgcaatttgcagtccctggaggtctaattggggttggcacaaccatggatcccactttgacccgtgctgacagattggttggtcaggttcttggtgaagttgggtcacttcctgatgtttttgttgagctagaggtaaacttcttcctttgcggcggcttctaggtgtgaggacgaaaggatcagaaaggcagggaaaagtatcaaaactggccaagggagagattctaatgttgaacataggatccatgtctacaggagctagagtacttgcagtaaagaatgatttggcaaagttgcagcttacttctcctgtttgcaccagcaaaggggagaagattgctctaagtcgccgagtcgagaagcattggcgtcttattggctggggtcaaattcaagccggaactactcttgacgtccccccctgccccatttgagttgtcgccgaaaaaaggtaaagagtcgagaagcgaag

SEQ ID NO: 2387 - DNA, 1790 bp, Manihot esculenta
gtatctgctctctctcgctctctgtctagctgctgagtcttgcccccacctgctgtctctgctggtctctctgttactatctcggtcgcaggcatctttacctgctccagcccgctctctcaggttgaagttaggacagtcaaaaaatgtcgcggaaagggttgatggagcaagacttgagtaaactggatgtaacgaagttacatccactttctcctgaagttatatctcgccaggcaactataaatattggcaccataggtcatgtggcacatggcaagtcaacagttgtgaaagcaatatccggtgttcagactgttcgttttaagaatgagttggagcgtaacattacaattaaacttggatatgcaaatgcaaagatatataagtgtgaagatgaaaagtgcccccggcctatgtgctacaaggcatacggaagtggaaaggaagatagtcctatgtgtgatgtacctgggtttgaaaactgtagaatgaaattgctgaggcatgtgtcttttgttgattgcccgggtcatgatattctcatggctacaatgcttaatggggcagcgattatggatggagcattacttctcatagctgcaaatgagagctgcccccaaccacaaacttctgagcatcttgctgctgttgaaattatgcgtctccagcatatcataatccttcaaaataaagttgatctgattcaagaaaatgtagccatcaaccaacatgaggccattcagaaatttatccagggaactgttgctgacggtgctccagtggtaccaatttctgcacagctgaagtacaatattgatgttgtgtgtgaatacattgtgaaaaagatcccaattccagagaggaactttatctcaccacctaatatgattgtaattcgctcttttgatgtcaataagcctgggtttgaggttgatgagataaaaggtggtgtggctggtggaagcatctttaggggtgttttgaaggtcaatcaattcattgaagttcgtccaggcattgttgttaaagatgagacagggaatatcaagtgcacaccaatatatactagaatagtttcactttatgctgagcagaatgagctacaatttgcagtgccaggaggtctcattggtgttggcacaactatggaccctactttgacgcgtgctgatcggttggtgggtcaagtccttggtgatgtaggttcactccctgaagtttttgttgagcttgaggtgaacttcttccttcttcgaagacttattggtgtgaggacaaagggcacagagaagcaaggaaaggtatcaaaactggctaaaggagagattctgatgctgaatataggatcaatgtcaactggtgctcgagttattgcagtgaagaatgatcttgccaagctgcagttaacatctcctgtatgcactagcaagggagagaagattgcactcagtcgaagagttgagaagcattggcgtcttatcgggtggggtatgattcaagctggaacaacccttgatgttcctccgtgccccctttgagtgatcataagcaggtgcaaaaagagctgtaaaagaagcacagagagggattttaattgagacgcgggaaggtcaagcatactggttggaatgacttgtatccagtggagaatacattttttgttatggctattattgtttgtggtgtttcttttttcgttgactctcccaagttttgaacatgggtcacttcaatggatggtatgtagtgggtccttgatgaaaggtactaaaaatggcgttttcatg

SEQ ID NO: 2388 - DNA, 1754 bp, Gossypium hirsutum
ttgttttctctctgcaaaaaaaatctccaccgatcaggtttggattgtagttcatattgaagcataaagaccgttattaatatcagccgaaatgtcgagaaaaggtttgatggagcaagacttaagtaaactggacgtaactaagttgcatccgttatctccagaagttatatcgcgccaagctactataaatataggcaccatagggcatgtggcgcatgggaagtcgacagttgttaaagcaatatctggcgttcagactgttcgttttaagaatgagttggagcgtaatattactatcaagcttggatatgcaaatgcaaagatatacaaatgtgaagatgaacggtgccctcgtcctatgagcttcaaggcatacggaagtggaaaggaggatagtcctctttgtgacgtgcctggctttgaaaactgcaggatgaaattgttgagacatgtatcttttgtagattgcccgggtcacgacattctcatggctacaatgcttaatggagcagcgattatggatggtgcattacttctcatagctgccaacgaaagctgtcctcaacctcaaacttctgagcatctggcagctgttgaaatcatgcgactccagtatattataattcttcaaaacaaggttgatcttattcaagagaatgtagccatcaatcagcatgaagcaattcagaaatttattcagggcactgtagctgatggcgcaccagtggtaccgatttctgcacagctaaaatataacattgatgttgtgtgcgagtacattgttaagaagatccccattcccgagagaaacttcatctcaccccctaacatgattgtcatcagatcatttgatgtcaataagccagggtttgaggtggatgagattaaaggtggtgttgctggtggaagtatactccagggtgttttgaaggtgaaccaatttattgaagttcgtcctgggattgttgttaaggatgaaaatgggaacatcaaatgcacacctatctattccagaatagtctcactatatgcagaacaaaatgagctacaatttgctgttcccggaggcctgatcggtgttggaacaactatggacccaactttaacacgtgctgatcggttggtgggtcaagtcctaggagaggttgggtcactcccagacgtttttgttgagcttgaggtaaacttcttccttcttcgaaggcttcttggtgttaggacaaagggatcagaaaggcagggaaaagtgtcaaagctggccaagggagagatcctaatgttgaacatcgggtccatgtcgactggggctcgggtcatagctgtaaagaacgatttggcaaagctgcaactcacatctcctgtgtgcaccagcaagggagagaagattgcactaagtcgacgcgtggagaagcactggcgtctaataggatggggtcaaattcaagctggaacaaccctcgaggttccaccctgtccgctttgaacgaccaccgaactgataatcaggtaacagaaaactaaaacatcagttcaaggaaaaaaaagagacgcttaagtaaggaattttttagggtgtttagatgtgggggcagaaagataatatcatggtactatttttgtcaagtggagaagaaaacattgttttgataatttttgtcattgtttgttgtattgtgggaaacatggaattttgtacgaggctattgtttgtcatgcaaacactgttgaaattgagagagatatctatttga

SEQ ID NO: 2389 - DNA, 1847 bp, Euonymus alatus
cattttcactctatccccaaaagaagcagcagccctattttctctcttcgatccttgcgcaaaaccctgctacatttctgtcttcctctctgccctaactctaccagagtcctttatttttgaagtggaagagatcaattggtcgcttgaatactttgcatataccagtacttcaatcagtgaatcttaagtcattaagcaaaatgtctcgaaagggtttaatggagcaggacttgagtaaactagatgcaacaaagttgcatccactctcaccggaggttatatctcgtcaggccactataaatattggcaccattggtcatgtggcacatggaaagtcaacagttgtaaaagcaatatccggtgttcagactgttcgttttaaaaatgagctggagcgtaacattaccattaagcttggatatgcaaatgcaaagatctataaatgtgaagatgaacgttgtcctcgacctatgtgctacaaggcatacggaagtggcaaagaagataatcctccgtgtgatgtgccagggtttgaaaactgcaggatgaaattgctgagacatgtgtcttttgtggactgtccgggtcatgatattctcatggctacaatgcttaatggagcagcaattatggatggggcattacttctaatagctgccaatgaaagctgcccacaaccacaaacttctgaacatctggctgctgttgaaatcatgcgccttcaacatatcattatccttcaaaataaagttgatcttattcaggaaaatgtggcaataaatcagaacgaagcaattcaagcattcattcagggaactgttgctgatggtgcaccagtggttccaatttcggcacagctaaagtataatattgatgttgtgtgcgagtacattgtgaaaaggatccctattccagagaggaactttatctctccaccgaatatgattgttatcaggtcctttgatgttaataagcctgggtatgaggttgacgagataaaaggtggtgtagctggtggaagcatccttcggggtgttttgaaggttaatcagtttattgaggttcgtccaggaatagtccttaaagatgaaagtgggaacataaaatgcacaccaatatattctagaattgtttctttgtatgcggagcaaaatgagctacaatttgcggtgcctggaggtcttattggggttggcacaaccatggacccaactttgacacgtgccgataggttggttggtcaggttcttggggaagtgggttcactcccagaagtctatgttgagcttgaggtgaacttcttcttgttgcgacgtcttcttggagtcaagacaaagggcacggaaaggcaaggaaaggtctcaaagcttgcgaagggagagatcctaatgttaaacattggatccatgtctaccggtgcccgagttcttgctgtgaagaatgatttagcgaagctgcaactcacatcgccagtgtgcacgagcaaaggagagaagattgcactcagtcggagagtagagaagcattggcgtcttattgggtggggccagattcaagctggaactacccttgaagttcctccctgccccctttgagtgatatctgaggagagagagagaagaagcagtcaagagtaagaaaggattagttagagatgtgggaggcaagacaatttcttggtacaatttttgtgaggtggaggagaaaacattttgattaaatggttgttactggtttgccttgtttctttaatttgattgtattcggtctgtctcgagttttggatttgagtccatataaggatttatatttggcggcaaatttaaggaacggcaagtttttag

SEQ ID NO: 2390 - DNA, 1942 bp, Euonymus alatus
ggatccccatagattcgccactttcactctatccctaaaaagaagaagctgcagttcattttctctctttggcacttgcgcaaaaccctgctacagagctgtcttcgtctctgcggctctgccctaacttgtcctctatttttgaagccaaagagatcaattactctattatatactttgcatatactggtacttacgtcagtcggtggatcttaagtcgttaagcaaaatgtctcgaaagggtttgatggagcaggacttgagtaaactggatgccacaaagttgcatccactttcacctgaggttatatctcgtcaggccactataaatattggcaccattggtcatgtggcacatggcaagtcaacagttgtaaaagccatatccggtgtccagactgttcgttttaaaaatgagctggagcgtaacattaccatcaagcttggatatgcaaatgcaaagatctataaatgtgaagatgaacggtgtcctcgaccgatgtcctacaaggcatatggaagtggaaaggaagatagtcctccatgtgatgtgccagggtttgaaaacagcaggatgaagttgctaagacatgtgtcttttgtggactgtccgggtcatgatattctcatggctacaatgcttaacggagcggcaattatggatggagcattacttctaatagctgccaatgaaagctgtccacaaccgcaaacttctgagcatctggctgccgttgaaattatgcgccttcaacacattattatcctccaaaataaagttgatcttattcaggaaaatgtggcaataaaccagcatgaagcaattcaagggttcattcagggaactgttgctgatggtgcaccagtggttccaatttcggcacaattaaagtataatattgatgttgtgtgcgagtacatcgtgaagaagatccctattccggagaggaactttgtgtctccaccgaatatgattgttatcaggtcatttgatgttaataagcctggttttgaggttgatgatataaaaggtggtgtagctggtggaagcatccttcggggtgttttgaaggttaatcaatttattgaggttcgtccgggaatagttcttaaagatgaaagtgggaacataaaatgcacaccaatatattctagaattgtttctttgtatgctgagcaaaatgagctacaatttgcagtgcctggaggtcttattggggttggcacgaccatggacccaactttgacacgtgctgataggttggtaggtcaggttcttggggaagtgggttcactcccagaaatctatgttgagcttgaggtgaactttttcttgttgcgacgccttcttggtgtcaagacaaaaggcacggaaaggcagggaaaggtctcaaagcttgcaaaaggagagatcctaatgttaaacattggatccatgtctaccggtgcccgagttcttgctgtgaagaatgatttagctaagctgcaactcacgtcgccagtgtgcaccagcaaaggagagaagattgcactcagtcgaagagtagagaaacactggcgtcttatcgggtggggccagattcaagctggaactacccttgaagttccgccctgccccctttgagtgatcaccgagaagagagagataaggcagtcaagagtaagaaacgattagatagagatgtgggagggaagacaatttcttggtacaatttttttcaggtggagaagaaaacattttgattggatggttgttactgttcgccttgtttagtatccggtctgtcttgagtattggacttttaaaagtccatccgaggatttatattaggtgtaaaatttaacgatcggcaggttttattagaaacagcaattgacagacctaattttattccgactagttgtcataatttgcgaaataaatcaatcaaccatttcctgc

SEQ ID NO: 2391 - DNA, 1793 bp, Elaeis guineensis
atccgacgcctctccgcgcaccccccactctgagctgacgaggcttcctgccgcctccgatccttcgccctgtgcactctccttcggccgagagatcgccgccaccgccaccctcctcccctctccccaggatcccccagtctccgatctcggctttggaggtacattacctgcagcaaaaatgtctcgtaaaggattaatggagcaggacctaagcaagcttgatgtgacaaaactgcatccactatcaccagaagttatttcacgtcaagctacaattaatattggtaccattggtcatgtggcccatggaaagtcaactgttgtaaaagctatttctggtgttcagactgttcgctttaagaatgagttggagagaaatatcaccatcaagctcggatatgctaatgcaaaaatatataaatgtgaagatgatagatgcccacgaccaatgtgctacaaggcttatggaagcggaaaggaagacagccccctttgtgatgtgccaggatttgagaacaccaggatgaaactcctaaggcatgtctcatttgtagactgcccgggacatgatattcttatggctacaatgcttaatggggctgcaatcatggatggagcattgcttttgattgctggaaatgaaagctgcccccagcctcagacttctgagcatctggctgctgttgaaatcatgcgacttcagcatattattattctgcagaataagattgatcttattcaggaaagcgtggcaattaatcagcatgaagcaattcagaaatttattcagggtacaattgctgatggggcacctgttgtacctgtctctgctcagttgaagtataatattgacgttgtttgtgagtatcttgttaacaaaatccctatcccggagagggactttacttcaccaccaaacatgatagtcattcgttcttttgatgtaaataagcctggttctgaggttgatgagataaaaggtggtgttgcgggtggcagtatccttaggggagttttgaaggtaaacgagcctattgaagtccgtcctggtattgttgtcaaagatgagaacggcaacatcaagtgcactccaatatattccaggatagtttcactttatgctgagcaaaatgagctccagtttgcagttcctgggggtctcattggagtaggcaccacgatggaccctacactgacgcgtgctgataggctggtgggtcaggttcttgggcaagttgggtctctgcctgatgtttttgttgagctcgaggtgaatttttttctcctccggaggcttttgggggtgaggacaaagggcacagaaaaacaagggaaggtatctaagcttgcaaagggtgagatcctgatgttgaacataggatcgatgtcaacaggggcgcgagtgattgctgtgaaaaatgatctagctaagcttcagctcactgcaccagtgtgcacaagcaaaaaggagaaggtggccctcagccggcgggtcgagaaacattggcgtctcattggttggggccagatccaggctggtgcgaccctagacgtcccaccgtgctctatttaaatcaaagaatcttgcaggtgaagagaagcacaaaagcagaaaaagtacagcattaagaggtttgtgagaagtcatgtgggagggtagacagcttctaggaacagtttttgtgagatggagaagaaaacagaacaatgttgaagttttgtgtttcaaaattttatctgatgcgaagagtatttatcattaatatcaatcaacaaccactatatactta

SEQ ID NO: 2392 - DNA, 1764 bp, Cucumis melo
acagacagacatccgtaacttgtttgcataaagacattcaaccaagatgtcgcggaagggtttaatggaacaagacttaaagaaattggatgtgacaaagctccatccactttctccagaagttatatctcgtcaagcaaccatcaatattggtactattggtcatgtggcacatggtaagtctactgttgtaaaggcaatttcaggagtccagactgtacgttttaagaatgagctggagcgtaacattaccattaagttggggtatgctaatgcgaagatatacaaatgtgaagatgacaagtgccctcggcctgcatgctacaaggcatatggaagtggaaaggaagacagtcctttgtgtgatgtgcttgggtttgaaaattgcaggatgaaactactgcgacatgtatcctttgtcgactgcccgggtcatgatattcttatggctaccatgcttaacggggcagccattatggatggagcattacttctgatagctgccaatgaaagctgccctcaacctcaaacttctgagcaccttgctgctgttgaaattatgcgccttcagcatattataatcctccagaataaagttgatcttattcaggaaaatgttgcaatcaatcaacatgaagctattcaaaagttcattcagggaacagttgctgatggtgcaccagtagtaccaatttctgctcagctgaagtataacattgatgtcgtttgcgaatatattgtaaaaaagattccaattccagaaaggaatttcgtctcacctcctaatatgattgtgattcgttcctttgatgttaacaaacctggttttgaagttgatgagatcaaaggaggtgtggctggtggtagcatattacggggtgttttaaaggtgaatcaatttattgaagttcgtcctgggattgttgttaaggatgaaagtggtaacataaagtgcaccccgatatactcgaggattgtttctttgtatgctgagcaaaatgagctgcaatttgcagtccctggaggtcttattggggttggcacaaccatggaccccactttgactcgtgctgacagattggtaggtcaggttcttggggaagttggatcacttcctgatgtttttgtcgagctagaggtaaactttttccttttacggcggctcctaggtgtgaggacaaaaggatcagaaagacagggaaaagtatcaaaactggccaagggggagattctaatgttgaacataggatccatgtctacaggagctagagtacttgcagtgaagaacgatttagcaaagttgcagcttacatctcctgtttgcaccagcaagggggagaagattgctctaagtcgtcgtgttgagaagcactggcgtcttattggctggggtcaaattcaagctggatctactctggatgtccctccctgccccatttgagtagtaaaggtaagaatcacgaagaaaagaagtgagaagagtaaggaaaatgtgcaaagttagacagtttgttggaaccatttttgttaggtggaggagaaaacaccatctggtttctcattgtttattaggttgtctttttcacaatttcatcccccgaagtctctttatgatttttactatttaagtttcgaatcatggatacatgacatgtgagccatttggtttatgaactaaaaatgcgataataggacgaacaatattattatttcacctttgcgagtttggttcagactttcaaatgaaacaacccataaagctca

SEQ ID NO: 2393 - DNA, 1727 bp, Tropaeolum majus
ttttaatcatatcaaaggggcattagaaactgcaaaaatgtcgaggaagggcttaatggagcaagacttaagtaagctggatgttacaaagttgcatcctctctctcctgaagttatatcacgtcaagctactataaacatcggcactattgggcacgtggcacatgggaagtcaacagttgttaaagcaatatctggtgttcagactgttcgttttaagaacgaattggagcgtaacatcactattaagcttggatatgctaatgcaaaaatttataaatgtgaggatgagcgatgccctcgaccaatgtgttacaaggcttatgggagtgggaaggaagatactcctttgtgtgatgttcctggatttgaaaatctcaggatgaagttgttgaggcatgtctcatttgttgattgcccgggtcacgatattctcatggctacaatgcttaatggggcagcaattatggacggtgccttgcttctcatagctgccaatgaaagctgtccccaacctcagacctccgagcatcttgctgctgttgaaatcatgcgacttcaacatatcataattctccaaaataaagttgatctcattcaggaaaatgtagctatcaaccaacacgaagctattcaaaagtttattcagggaactgttgctgatggtgcacctgtggttccaatttcagcacaattgaaatataatattgatgttgtgtgtgagtatattgtgaagaaaatccctattccagagagaaacttcatctcaccacctaatatgatcgtgatccggtcttttgatgtcaataaacctgggtatgaggttaatgagattaaaggtggtgtggccggtggaagcattcttcggggtgttttgaaagttaaccaaaaatagaagttcgtcctggaattgttgttaaggatgagaatggaaacattaaatgtacgccaatatactctagaattgttacactctatgctgaacaaaatgagctacaatttgctgtaccgggaggtctcattggggttggtacaaccatggatccaacactgacacgtgctgatcgtttggtgggccaggttttaggggaggttgggtcactccctgaagtatttgttgagcttgaagtaaactttttcttgctaagaagacttcttggtgtgagaacaaaggggtcagagagacaaggaaaggtttcaaagcttgcaaagggagagattcttatgttgaacatagggtctatgtcaaccggagctagagtcattgctgtaaagaacgatctggctaagttgcaactgacttcacctgtgtgtacgagcaggggagagaagattgcactgagcaggcgagttgagaaacattggcgtctgattggatggggtcaaattcaggctggaacaacccttgaagtgccaccctgtccactctgagtgaagatcgagctaattgagagagagacgcattaaaaaagattttgttttagatgtgggagtttgagtgggagtggcgacaagttgtaggaacaatttttgttagatggagaagaaaattgtctgaattgattatctttttccccttatgaatatgatgttaagagttacttttttatttggcttcataattgggttcatacttttctactaattatgtccgattccttaaaacatgttttgttgtttcgagttgtcaacaattgcatggttttattatgtttgtgattgtaatt

SEQ ID NO: 2394 - DNA, 1782 bp, Amaranthus tuberculatus
cggaagaaccctagaactcaaaactcaattatcgtacgcctctttcgcctcactcgttcacttcgccagcatctcaattcatagcgttttcttcatcctctcttttcctctcctcccgccgatctcactgcattttcaagagattaaagggaggagaacttagatataagcattgaatatggcgcggaaaggattgatggaccaagatttgagaaaattggatgtaactaaactacatcctctttctcctgaggttatttctcgtcaggctactattaacattggaactattggtcatgtggctcatggaaagtctactgttgtcaaagctatttccggtgttcagactgtccgatttaagaatgagttggagcgtaatatcactattaagctaggttatgctaatgccaagatatataaatgtgaagatgaacggtgcccaagaccgatgtgctataaggcatatggaagcggcaaggaagacagtcctatgtgtgacgtgcctggttttgaaaatgctagaatgaagcttctgcgacatgtgtcttttgttgactgcccggggcatgatattcttatggctacaatgcttaatggagctgcaattatggatggagctttacttctgattgctgctaatgaaagctgccctcagccacagacttctgagcatcttgctgcaattgaaattatgcgacttcaacatattattatcctccaaaacaaggttgatctcatccaagaaaatgtggctataaaccagcatgaagccataaagaaatttgttcagggaactgttgctgataatgcacctgttgttccaatttctgctcaattgaaatacaacatcgatgttgtttgtgagtacatcgtcaaaaagatcccaatccctgaaaggaatttcatttcacctccaaatatgattgtgattcgttcttttgatgttaacaagcctggttttgaggttgatgagatacgtggtggtgttgctggtggtagtattttaaagggtgtcttaaaggtgaatcagaatattgaggtccgccctggaattgttgtgaaagatgagagtggaaacgtaaaatgcacacccatatactccagaattgtttcattgtatgctgagcagaatgagttgcaatttgctgtccctggaggtcttatcggtgttggaacaaccatggatccaactttaacccgtgcggatagactggtaggtcaggtacttggggaagttggatctctcccagaagtttatgttgagctagaggtcaatttctttttgcttcgacgactgcttggtgtgaggacaaagggaaccgagaagcaaggaaaggtcacaaaattgaccaaaggagaaatattaatgttgaacatagggtccatgtcgactggtgcgcgtgtacttgctgtcaaaaatgatttggctaagttacaactaacctcgcctgtctgcaccagcaaaggagagaaaattgctctgagtcggcgtgtcgagaagcattggcgattgattgggtggggacaaattcaagccggtatcacacttgatattcccccttgccccctttgagcttgaagcaaagaagagtccagatagaaaactcaaaaaaagtttgtgaaaatgtgggtagggaggaagcttttgggaataatttttttgtggaggagaaaaccaattttgttgctcaattttggtttattttggtgtatgttccggagattatttgcaattgatgctattaatatttttcttttaatccatttaattttatttggcga

SEQ ID NO: 2395 - DNA, 1861 bp, Malus domestica
attccccttaaacctgctctctctccagctcaacagaaaacctcgctcactcctgtcgtcttgccctaatcgcatcgtccagtctttcacagttttgatttcgtcacttttgataccacccagttgctagctgtttactttcaagtaactgtcaaaatgtcgaggaaaggtttgatggagcaagacctgagtaaactggatgtaacaaagttgcatccactctcgcctgaagttatatctcgtcaggcgactatcaatattggtactattggtcatgtggctcatggaaagtcaacagttgtaaaagcaatttctggtgttcagactgttcgttttaaaaatgagctggagcgcaacattactatcaagcttggatatgccaatgcaaagatatatatatgtgaagacgagcgctgccctcgaccgatggcttacaaggcatatggaagtggaaaggaagatgctcctctctgtgatgttcctggatttgagaactgcaggatgaaattgttgagacatgtatcttttgtagattgcccgggtcacgatattcttatggctactatgcttaatggtgccgcaattatggacggagcattacttctcattgctgctaatgaaagctgtccccaaccacaaacttctgagcatctggctgctgttgaaattatgcgtcttcaacatattatcattcttcagaataaagttgatctcattcaggagaatgtggccattaaccaacatgaggcaatcaggaagtttattcagggaactgtagctgataatgcaccagtggtgccaatttctgctcagttgaagtataatattgacgtcgtgtgtgaatacattgtaaaaaagatccccattccagaaaggaactttatctcacctcccaatatgattgttatccgttcttttgacgtcaataaacctgggtacgaggttgatgagattagaggtggagtggctggtggaagtatcctcaggggtgttctgaaagtcaaccaatttattgaggttcgtcctgggattgttgttaaagacgagagtggaaatatcaagtgcacgccaatatattctagaattgtttcattgtatgctgagcaaaatgagttgcaatttgcggtgccaggaggtcttattggtgttggaacaaccatggatcccactttgacacgtgctgataggttagtgggtcaagttcttggtgaagttgggtcactccctgaagtatttgttgagcttgaggtcaacttcttcttgttgagaaggcttctgggggtcaggacaaaggggtctgagaagcagggaaaggtctcaaagctggtcaagggcgagatcctcatgttgaatataggatccatgtctacaggggctagggttcttgctgtaaggaacgatttggcaaagttgcaactcacgtctccagtttgcaccagcaaaggagagaaaattgccctcagtcgacgtgttgagaagcattggcgtcttattggctggggtcagattcaagctggaacaacccttgatgtcccaccatgcccaatttgagttgacactgaaaattggtaagacagaagaaagcaagaaaactagtaagacagctaaagaataggcaagatgtggaaagtcggaaaattattgggaaccatttttgtcagatggaagagaaaacatcgtttggtggatcgttgtcgtttttgttttgtttctttgatttttgatgcagttacactttcatctgcattcgtattcttcgacttttgggctcgagtcattccaacagatgaaggaatgatagacagttacgttggctcttccagaggatattgcgttcttaaatttataagcagtttgagtt

SEQ ID NO: 2396 - DNA, 2001 bp, Aristolochia fimbriata
agtctggattgaatctcatcgctcactcccaaaagccaaaagaaaaaccctcggctggcaccttcattttcgctgtatcgcatttcctgccactgagaagctcgggcgatctcgaaaccctagcccctatattcaagatataagagccctctagctgctttcaagatgtctcgtaaaggtttaatggaacaggacctaagtaagcttgacgtaacaaagttgcatccattgtctcctgaagttatatctcgtcaagccaccatcaatattggtaccattggtcatgtggcccatgggaaatctaccgttgtaaaagcaatttctggtgttcagactgttcgttttaagaatgagctggagcgaaatattaccatcaagctaggatatgctaatgcaaaaatatacaaatgtgaagatgaaagatgctctcgacctatgtgttacaaggcatatggaagtggtaaggaagatagtccactctgtgatgttcctgggttcgagaatgccagaatgaagctattgaggcacgtgtcgtttgttgattgcccgggtcatgatattcttatggcgactatgcttaatggtgctgccatcatggatggagcattgctactgatagctagcaacgaaagttgtcctcaacctcaaacttctgagcatcttgctgctattgagattatgcgtttacaacatattataatcgtgcaaaacaaaattgatcttattcaagaaagtgtggccatcaatcaacatgaatcaatccagaagtttattcagggcacaattgctgatggagcaccggtagtgccgatttcagcccaattgaaatacaacatcgatgttgtctgtgaatacattgtgaaaaaaatccctatccctgtgagggactttacatctgccccaaatatgatagttatccggtcgtttgatgtaaataagcctggatctgaggtggatgagataaagggtggtgttgccggtggaagcatccttaggggggtgctgaaggtgaatcagaatgttgaagtgcgtcctggtattgttgtcaaagatgagagtggcaatatcaagtgcaccccgatttattcgaggattgtttcattgtatgcggagcagaatgagctacagtttgctgttccagggggtctaattggagttgggactacaatggatcctactctaactcgtgctgataagctagtgggccaggttcttggggaggttggatctcttcctgatgtatttgtggagcttgaggtgaacttttttctgctgcggcgacttctaggagtaaggaccaagggtgctgagaagcaagggaaagtatcaaaattgactaaaggagagattctgatgcttaacatcggttccatgtccactggggctcgtgttattgctgtgaggaatgatcttgcgaagctgcaactaacctcaccagtatgcacaagacagggagagaaagtagccctcagcagaagggttgagaagcactggcggctcattgggtggggtcaaattcaagccggagtgacccttgatgtaccaccgtgtccactgtgagttgtttcttattgaaaaacgtcttagaaaagcgaaacttgtattagttgaaagcagagtggagattgaagaaaatagcagatgtgggaagggagaaaactcttaggaacagtttatgtgagatggagaagaaaacatgaaagaacactgaacctttaattttgttttgtatttttgactagatgaagttttgttgtcaactccgacattttctataagcagttttgatcatcattaagtttgatattgagctcgtgctctgttcttagcattcaatgtcgcctctctaggcctgccattgtttgttaagaaaactttataatatatataaaaaagtaaacagtcctattttaaactttttgcctattgagtatgtaaaaggatctgagtgctatattaatgtgaaaaaaatgcagtatatagtttttatttaaaaaaaaa

SEQ ID NO: 2397 - DNA, 1952 bp, Theobroma cacao
caaagctgcgttttcttcctgcaaactgagcaaacacctcaagcaatcgatcagttcttattgaagcggagagacctttattaggagcagtcaaaatgtcgagaaaaggtttgatggagcaagacttaagtaagctggatgtaacaaagttgcatccactctctcccgaagttatatctcggcaggctactataaatattggcactatagggcatgtggcacatgggaagtcaacagttgtgaaagctatatctggcgttcagactgttcgttttaaaaatgagttggagcgtaatattactattaagcttggatatgcaaatgcaaagatatacaaatgtgaagatgaacgttgccctcgtcctatgtgctacaaggcatatggtagtggaaaggaggatagtcctctttgtgatgtgccaggctttgaaaactgcaggatgaagttgctgagacatgtatcttttgtagattgcccgggtcacgatattctcatggctaccatgcttaatggagctgcaattatggatggtgcattacttctcatagctgccaatgaaagctgtccacaacctcaaacttctgagcatctggctgctgttgaaatcatgcgactccagcatattataattctccaaaacaaggttgatcttattcaagagaatgtagccatcaaccagcatgaagcaattcagaaatttattcagggtactgttgctgatggtgcaccagtggtaccaatttctgcacagttaaaatataatatcgatgttgtctgcgagtacattgttaagaagatccctattccagagagaaactttgtctcaccccctaacatgattatcatccgatcatttgatgtcaataagccagggtttgaggttgatgagattaaaggtggtgttgctggtggaagtatacttaggggtgttttgaaggtgaaccaatttattgaagttcgtcctgggatttttcataaggatgaaaatgggaacatcaaagctgcacccatatattccagaatagtctcactgtttgctgaacaaaatgagctacaatttgccgttccaggaggtctgattggtgtaggaacaactatggacccaactttgacacgtgcggataggttggtgggtcaagtcctaggagaggttgggtcactcccagaagtttttgttgagcttgaggtaaacttcttccttcttcgaaggcttcttggtgttaggacaaagggctcagagaggcaggggaaggtctcaaagctggccaagggagagatcctaatgttgaacattggttctatgtcaactggggctcgagtcatagctgtaaagaacgatttggcaaagctgcaactcacatctcctgtgtgcaccagcaagggagagaagattgcactaagtcggcgtgttgagaagcactggcgtctaattggatggggccaaattcaagctggaacaacccttgaggttccaccctgccccctttgagcatcgataaaacaggtagagacagaagcaaaaacatcagtagaaaaggcacaagaaacgattttttattgaaatgtgggaaggcagacgagatcttggtactatttttgtcagatggagaagaaaacatttgtttggataaatttcatcactgtgtatgttgttctttttcccctgttatctgctgttggggaacttgattgttccttacgaaccattttggagttttgtttcctgggagtcttttaaactaggcggaagcatggagtttttactgggctatatcgccggcagacaatgttggaaattagagttgagagaagttgttgcctgaaacctgtgttgctgtcttcatgaagccatatatgatatgcctaaggctgaggggttatatgttaatcacttgagccccaatcttgcactttttatagcttaatcgaggcccaatcatcttaattcaaa

SEQ ID NO: 2398 - DNA, 1894 bp, Chenopodium quinoa
ctccgcctctatcgcctatctccttcactctctctcactcatcattcgacggcgaagacaacgacgagctcgcagattcctaattcttcactgctacctgatcaatcctctttctctctccttcacacgatctctctgattttttcaaggaattttgagggaggggaacttagactactgtgatcaatatggcgcgcaaaggattgatggaacaggacttgagcaagttggatgtgacaaaactacatcctttgtcacccgaagttatttccagacaagctacaattaatattggaactattggtcatgtggcccatggaaagtcgacagttgtgaaggctatatctggtgttcagactgtacgttttaagaatgagctggagcgtaatatcactatcaagcttggttatgctaatgccaagatttataaatgtgatgatgatcggtgcccaagacctatgtgctataaggcatacggaagtggaaaggaagatacccctatgtgtgatgtacctggatttgagaatgctaggatgaagcttctgagacatgtgtcatttgtcgactgcccgggtcatgatattctcatggctactatgcttaatggagctgctattatggatggagctttacttcttattgctgccaatgagagctgtccccaaccccagacatctgagcatcttgctgcaattgagatcatgcgacttcagcatattatcatcctccaaaataaggttgatctcatccaagaaaatgttgctataaaccagcatgaagctattcagaaatttgttcagggaactgttgctgatggagcgcctgtagttccaatttctgctcagttgaagtacaacattgatgttgtttgtgaatacattgtcaaaaagattcctattcctgaaagaaactttgtctcaccaccaaatatgatcgtgatccggtcttttgatgttaacaaacccggatatgaggttgatgatattcgaggtggtgttgctggtggaagtattttaaagggtgttttaaggataaaccaaaatattgaagttcgacctggaattgttgttaaggatgatagtggcaacataaaatgcacacccatatactccagaattgtttcgttgtttgctgagcagaatgagttgcaatttgctgtgccaggaggtctgattggggttggaacaaccatggatcccacattaacccgagctgatagattggtaggtcaggtacttggtgaggttggatcgcttccagatgtatatgttgagctagaggtgaatttcttcttgcttcgacggctgcttggtgtgagaacgaagggaactgagaagcaaggaaaggtgacaaaattaactaaggcggagattcttatgttgaacattgggtccatgtctactggtgcccgtgtagtcgctgtcaaaaatgatttggcgaagttgcaacttacatctccagtttgcacaagcaaaggagagaagatcgctctgagtcggcgggttgaaaagcattggcgactgattgggtggggacagattcaagctggtatcacccttgagatcccaccctgccccctgtgagttgtgaggtataagaagtgagaaagagagactagataggactaagaagttccggggaaatgtgggttgggagagaactgttgggtacaatttttttgagatggaggagaaaaccatttctcatgctcgattttggtttatttagtacatgttttaagatattaattgctcctgattctatgaatgtttttgtttttatggttattagttattacatgagtttgttgtacaatatggaggcaattccagtgcaaaaaattctgtgcagctctcatgctctcaatccttactgtccttagttactagtttag

SEQ ID NO: 2399 - DNA, 1981 bp, Fragaria vesca
acactaggatttcacgcacaaagatcaaaaccactatccctagcgcacccaattctcttaaacctgactctgcttcttcgtcttctccagctcacaaaccgctctcgcctctctgcctcatcgtcgtgccttagcctctaaaacagtaggagctgctacttgattaattgtcacaatgtcgaggaagggattgatggagcaggatctcagtaagctggatgtcactactttacatccactctcacctgaagtgatatcccgccaagcgactatcaatattggtactattggtcacgtggctcacgggaagtcgacggttgtgaaggcaatttctggtgttcagactgtacgttttaaaaatgagctggagcgtaacattactatcaagcttggatacgcaaatgcaaaaatctacaaatgtgaagatgagaagtgcccgcgaccttcatgctacaaggcatatggaagtggaaaagaagatgctcccctatgtgatgttgctggatttgagaactgcaggatgaagttgctgcgacatgtatcatttgtagattgcccgggccacgatattctcatggctactatgcttaatggggctgcaattatggacggtgcattgcttctgatagctgcaaatgaaagctgtccccagccacaaacatctgaacatcttgctgctgtggaaattatgcgtcttcagcatatcattatccttcaaaataaggttgatctcattcaggagaatgtggccatcaaccaacatgaggcaatccggaagtttattgagggtactgtagctgatggtgcaccagttgtgccaatttctgctcagttgaaatacaatattgatgtagtgtgtgagtacatcgtgaaaaagatcccaattccagaaaggaacttcatctcgcctccaaatatgattgttattcggtctttcgatgtcaacaaacctggatttgaggttgatgagatacgaggtggtgtagctggtggaagtattctcaggggtgttttgaaagtgaatcagtttattgaggttcgccctggtattgttgtgaaagatgagtctggcaacataaagtgcacaccaatatattccagaatagtctcactgtatgctgagcagaatgagttgcaatttgccgttccaggtggactcataggggttggaacaactatggatcccactttgacgcgtgcggatagattagtggggcaagttctcggtgaagtaggctcacttcctgaagtgtttgttgagcttgaggtaaactttttccttttgagaaggcttctgggggtccggacaaagggttctgaaaagcaggggaaggtctccaagcttgccaaggccgagatactcatgttgaatattggatctatgtcaactggtgctagggtaattgccgtgagaaatgatttagctaagcttcagttgacttctcctgtgtgcacaagcaaaggagagaagattgcactgagtagaagggtcgagaagcactggcgtctgatcggttggggacagatccaggccggaaccacacttgaagtcccaccctgcccgatttgagttgacaccaaaagcaagataacttgaagacagctgaaaaatttagatgtgggaaggcagacacttgttgggaaccatttttgtcagatggaggagaaaacattgtttagatcactattatttttgtggtgcatcttttgtgtttgatatgttaatactttctgctacgttcttatttagtgtgcgagctttgaatcttaatcactccaacatatggatttgcgacagttttatgttaaacatgtactcctcgaatacattgggttcccatgatactagctcaaatcctttagatttattgtcagattttcagcatttcaaggtgctgtgtttctatataacttgaggcacaggcacgagactgataataacagggagttgtgttttgccttgtgctgttctcgtcttgat

SEQ ID NO: 2400 - DNA, 1711 bp, Amaranthus tuberculatus
gcagaagaaccctagaactctccaagccatactccgcctctattcttgatttcttactcattcattccaaggttttaaaagggcggggaattttaggcaattatggcgcgcaaaggtttgatggagcaggatttgagcaaattggatgttgcacagttacatcctctttctcctgaagttatttctcgtcaggctacaattaacattggaactattggtcatgtggcccatggaaagtctactgttgttaaagctatctctggtgttcagactgtccgttttaagaatgaattggagcgtaacattactatcaagctgggttatgctaatgccaagatatataaatgtgaagatgaacggtgcccacgacctatgtgctataaggcatatggaagtggtaaggaagatagtcctatgtgtgatgtgcctggatttgaaaatgctaggatgaagcttctacgacatgtctcttttgttgactgcccggggcatgatattcttatggctacaatgcttaatggagctgcaattatggatggagcattacttcttattgctgctaatgagagctgccctcagccccagacttctgagcatcttgctgctattgagattatgcgacttcagcatattatcatcctccaaaataaggttgatctcattcaagaaaatgtagcaattaatcagcatgaagctatacaaaaatttgttcagggaacagttgctgatagtgcacctgtagttcctatttctgctcagttgaagtacaacattgatgttgtgtgtgaatacatcgtcaaaaaatcccaatccctgaaagaaatttcacctcaccaccaaatatgattgtgattcgttctttcgatgttaacaaacctgggtttgaggttgatgagatatgtggtggtgttgctggtggaagtattctaaagggtgtcttgaaggtaaaccaaaatattgaggtccgaccgggaattgttgtgaaagatgagagtggcaacataaagtgcacacccatatactccagaattgtttcattgtatgctgagcaaaatgaattacaatttgctgtccctggaggtcttattggagttggaacaaccatggatccaactttaacccgtgctgatagactggtaggtcaggtacttggtgaggttggatctcttccagaagtgtatgtggagttagaggtgaatttctttttgctccgacggctgcttggtgtgaggacaaaggggactgagaagcaaggaaaggtcacaaaattgacgaaaggagagattttaatgttgaacattggatcgatgtcaactggtgcccgtgtacttgctgtgaagaatgatttggctaagctacaacttacctctcctgtgtgcacaagcaaaggagagaaaatcgctttgagtaggcgtgttgagaagcattggcgattgattgggtggggacaaattcaagctggtattacacttgatatcccaccttgccccctttgagcttgaagcaaagaagtgtccaaaatccagatagaacgcacaaaaaagtttgtgaaaatgtgggtaggaaggaagtttttgggaattaattttttgaggtggaggagaaaaccaattttgttgctcaattttggtttattttggtgtatgttccggagattatttgcaattgatgctattaatatttttcttttaatacatttaattttatttgg

SEQ ID NO: 2401 - DNA, 1827 bp, Chenopodium quinoa
gaaaaaataagaaagagttgggaagaaccctagaattaccaaaccctcaattctaatcctccgcctctatcgcctatctcccttcactctttctcactcatcattcgacgccgaagactacgacgaactcttgcgcagattcccaattcttcattgctacctcattaatccgctttctctctcctccactcgatctctctgattttttaaagggaggggagcttagactactgtgatcaatatggcgcgcaaaggattgatggaacaggacttgagcaagttggatgtgacaaaactacatcctttatcacctgaagttattctagacaagctaccattaacattggaactattggtcatgtggcccatggaaagtcgacagttgtgaaggctatatctggtgttcagactgtacgttttaagaatgagctggagcgtaatatcactatcaagcttggttatgctaatgccaagatttataaatgtgatgatgatcggtgcccaagacctatgtgctataaggcatacggaagtggaaaggaagatacccctatgtgtgatgtacctggatttgagaatgctaggatgaagcttctgagacatgtgtcatttgttgactgcccgggtcatgatattctcatggctactatgcttaatggagctgctattatggatggagctttacttcttattgctgccaatgagagctgtccccaaccccagacatctgagcatcttgctgcaattgagatcatgcgacttcagcatattatcatcctccaaaataaggttgatctcatccaagaaaatgttgctataaaccagcatgaagctattcagaagtttgttcagggaactgttgctgatggagcacctgtagttccaatttctgctcagttgaagtacaacatcgatgttgtttgtgaatacattgtcaaaaaaattcctatccctgaaagaaattttatctcaccaccaaatatgatcgtgatccggtcttttgacgttaacaaacctggatatgaggttgatgatattcgaggtggtgttgctggtggaagtattttaaagggtgttttaaggataaaccaaaatattgaagttcgacctggaattgttgtgaaggatgatagtggcaacataaaatgcacacccatatactccagaattgtttcgttgtttgctgagcagaatgagttgcaatttgctgtgccagggggtctgattggggttggaacaaccatggatcccactctaacccgagctgatagattggtaggtcaggtacttggtgaggttggatcacttccagatgtatacgttgagctagaggtgaatttcttcttgcttcgacggctgcttggtgtgagaacaaagggaactgagaagcaaggaaaggtgacaaaattaaccaaggcagagattcttatgttgaacattgggtccatgtctactggtgcccgtgtagtcgctgtcaaaaatgatttggcgaagttgcaacttacatctccagtttgcacaagcaaaggagagaagatcgctctgagtcggcgggttgaaaagcattggcgactgattgggtggggacagattcaagctggtatcacccttgagatcccaccctgccccctgtgagtgtgaggtacaagaagtgagaaagagagactagataggactaagaaatttcggggaaatgtgggttgggagagaactgttgggtactatttttttgagatggaggagaaaaccatttctcatgctcgattttggtttatttagtagtacatgtttccagatattaattgctcctgattctatgaatgtttt

SEQ ID NO: 2402 - DNA, 1716 bp, Malus domestica
cagaaaacctcgctcactctcgtcgtcttgccctaatcccatcgtccagtctttcacagttttgatttcgtcactcttgataccacccagttgttagctgattacttcaagtaactgtcaaaatgtcgaggaaaggtttgatggagcaagacctgagtaaactggatgtaacaaagttgcatccactctcgcctgaagttatatctcgtcaggcgactatcaatatcggtactattggtcatgtggcacatggaaagtcaacagttgtaaaagcaatttctggtgtacagactgttcgttttaaaaatgagctggagcgcaacattactatcaagcttggatatgccaatgcaaagatatacacatgtgaagatgagcggtgccctcgacctatggcctacaaggcatatggaagtggaaaggaagatgctcctctctgtgatgttcctggatttgagaactgcaggatgaaattgttgagacatgtatcttttgtagattgcccgggtcacgatattcttatggctactatgcttaacggtgccgcgattatggatggagcattgcttctcattgctgctaacgaaagctgtccgcaaccacaaacttctgagcatctggctgctgttgaaattatgcgtcttcaacatattattatccttcagaataaagttgatctcattcaggagaatgtggccatcaaccaacatgaggcaatcaggaagtttattcagggaactgtagctgataatgcaccagtggtgccaatttctgcacagttgaagtataatattgatgtggtgtgtgaatacattgtaaaaaagatccccattccagaaaggaactttatctcacctcccaatatgattgttatacgttcttttgacgtcaataaacctgggtacgaggttgatgagattagaggtggtgtagctggtggaagtatcctcaggggtgttctgaaagtgaaccaatttatcgaggttcgtcctgggattgttgttaaagacgagagtggaaacatcaagtgcacaccaatatattctagaattgtctcattgtatgctgagcaaaatgagttgcaatttgcggtgccaggaggtcttattggtgttgggacaaccatggatcccactttgacacgtgctgatagattagttggtcaagttcttggtgaagtcgggtcactccctgaagtatttgttgagcttgaggtcaacttcttcttgttgagaaggcttctgggggtcaggacaaagggatccgagaagcagggaaaggtttcaaagctggtcaagggggagatcctcatgttgaatataggatccatgtctacaggggctagggttcttgctgtaaggaacgatttggcaaagttgcaactcacgtctccagtttgcaccagcaaaggagagaaaattgcgctcagtcgacgagttgagaagcactggcgtcttattggctggggtcagattcaagctggaactacccttgatatcccaccgtgcccaatttgagttgaacttggcaagacaggagaaagcaagaaaactagtaagacagctaaagagtagacaagatgtggaaagtcagcaaattattgggaaccatttttgccaaatggaaggaaaaacattgtttgacggatcattgtcgtttttgtttcgtttctttgatttttgataaaattatactttcatctgcatcattatcttc

SEQ ID NO: 2403 - DNA, 2171 bp, Ricinus communis
aaagaaaaattgaagaaaaatagagagaataaaatataattaagagccatttttttcttttaaaatttaataagagaaaatgtggctcttaagttaattttaaaaaatgatgataaattagaaagtttcttcaagtcctaattttttaatattctcgctaagataaagaaggagcaaagattgaagagctatttattagttcttagattaccttagcttatcatcatttttgccaaatggagtttagtgaataggacccgtttatatagaattctaaaggttaatgaagtacttaattgcaattcaaatgggaaatgaggccttaattgacaattatgtaaaaggtaaggagtttttcttttttttaccattttgccttaaaaataagaaaaaccccagccaactaatcgataaaactacacaacacaagaagcgaaaaagagcatcagctgcttatttggttagggtttttgtgcacacagcctcaaacagcttctctctctattcttctccaattttgctttctttcttcattctacagagtattctctgctccctctcataaggaaagaaaatgtcgaagaaaggtttaatggaacaagacttgagtaaattggatgtgacgaagttgcatccactttctcctgaagttatctctcgtcaggccactatcaatataggcactattggtcatgtggctcatggaaagtctactgttgtcaaagcaatttctggtgtccagactgttcgttttaagaacgagttggagcgtaacattacaattaagcttggttatgcaaatgctaagatatacaagtgtgaagatgatcgatgcccccgccctatgtgctataaggcttatggaagtggaaaggaagatagtcccatgtgtgatgtacccggatttgaaaacgttaggatgaaattgttgagacatgtctcttttgttgattgcccgggtcatgatattctcatggctacaatgcttaatggagcagcaattatggatggagcattgcttctcatagctgcaaatgaaagctgcccccaaccacagacttctgagcatcttgctgctgttgaaattatgcgtctccagcatatcattattcttcaaaataaagttgatttaattcaagaaaatgtagcaatcaaccaacatgaggctattcagaaatttattcagggaactgttgctgatggtgcaccagtggtgccaatatctgcacagctgaagtacaatattgatgttgtgtgtgaatacatcgtgaaaaagatcccaattccagaaaggaactttatttcaccgcctaatatgattgtaattcgctcttttgacgtcaataagcctgggtttgaggttgatgagataaaaggtggcgtggctggtggaagcatcttcaggggtgttctgaaggtcaatcaatttattgaagttcgtcctggaattgttgttaaagatgagacagggaatatcaagtgcacacccatatacactagaatagtttcattatatgctgagcagaatgagctacaatttgcagtgccaggaggactcattggtgttggcacaaccatggatcccactttgacccgtgctgatcgattggtcggtcaagttcttggagatgttggatcactccctgaagtttttgttgagcttgaggtgaatttctttcttcttcgacgacttattggtgttaggacaaagggctcagagaagcaaggaaaggtgtcaaagctggcgaagggagagattctcatgctgaacataggctccatgtcaactggcgctcgagttattgctgtaaagaatgatttggcgaagctgcagttgacttctcctgtgtgcacgagcaagggagagaagattgcactcagccgacgagttgagaagcattggcgacttattgggtgggggatgattcaagctggaacgacccttgatgttccaccatgccccctctgagaatctaaagcagagtttccagatgcacattattattgtttgtggtgtttcaatttttgttcatagtccaagttttgaacaagggtcacttcaactaacggtatgtaacaggttattggtggaaaaggccatatatggcattttcatggagtcgttctcagagatatttcttctttattttattaattttcatggtcttttg

SEQ ID NO: 2404 - DNA, 2262 bp, Vitis vinifera
cattcattttcctccaaacgctgcgtttcgatcgtctctgaattcaaggtactgctccaatctccattcccagttcaatcaatcgacttctaggttaaatacaattgtttggattgtgagaaaatacttccaggagtgcaaaatcccccaagagcaggcaaaatgtctcgaagagggttgatggagcaggatttgagcaagctggatgtgacaacactacatccgctctcgcccgaagttatttctcgtcaggctactataaatattggcacagttgggcatgtggcacatgggaagtccacagttgtaaaagccatatctggtgttcagactgttcgttttaaaaatgagctggagcgaaatattactatcaaacttggatatgcaaatgcaaagatatacaaatgtgaagatgaacggtgccctcgtcccatgtgctacaaggcctatggaagtggaaaggaagatagtccactctgtgatgtgcctggttttgaaaactgcaggatgaagttgctgcgacatgtatcttttgtagattgcccgggtcatgatattctcatggctacaatgcttaatggagcagcaattatggatggggcattacttcttatagctgccaacgaaagctgtccacagccgcaaactgctgagcatctggctgctgttgaaataatgcgtcttcagcatattataatccttcaaaataaagttgatctcattcaagaaaatgtagccatcaaccagcatgaagcaattcagaaatttattcagggaactgttgcagatggtgcacctgtagtaccaatttctgcgcagctgaagtataatattgatgttgtgtgtgagtatatcgtgaaaaagatccccattccagagagggactttacttcaccaccaaatatgattgttattcggtcatttgatgtcaacaagcctgggtttgaggttgatgagataagaggtggtgttgctggtggaagcattctcaggggtgttttgaaagtaaatcagtttattgaggttcgtcctggaattgttgttaaagatgagaacgggaacatcaaatgcacaccaatatattctaggatagtctcattgtatgctgaacaaaatgagctgcaatttgctgttccaggaggtctcattggagttggtacaaccatggaccccactttaacacgtgctgatcgactggtggggcaagttcttggggaggttgggtcactccctgatgtttttgttgaactagaggtaaatttcttccttctgagacggcttattggtgtaagggctaagggcacagaaaagcagggaaaggtttcaaaactaactaaaggggagatcctcatgttgaatattgggtccatgtccactggtgctcgtgtccttgctgttaggaatgatttggcaaagttgcaactgacatctcctgtgtgcaccagcagaggggagaagattgcactcagtcggagagttgagaagcattggcgtctgattggatggggccaaattcaagctggaaccactcttgatatcccagccaaccccatttgagtgaactcaaccaacaagtaaaacagaagcagcagaaaagacaagcaatacagccctttcatcaccttttttcctttttaaaggtctgtaccggggtgtttgttttccttcccgtggtatattaaaggtctagtaagaagaaatgtggtcttttacaatcgaatgattcaagagttttcttgaaattttgactatatgcaagttttgttggtttgtcaatgcacttggctacctgttctctttttaacaatggaaaattatgattttcggaggaacttcgtatatatgttgtacttgagagaattggaattcagaggccagtgtgactaattttatcctactagttggaatagctgtggcatgaaaggacgcctcggcttgaatctcatctacatggtgcatcgcttgattgcatgacaagtttggtgtttttcaggtatctgttgtacatgacaaagtgacaaagataatacttgaaaaaacagaaatctcaggattggatttaggtaattgcttccaaggatggctcaaagcttgcaaattgtgatacatccaacattcctgataatgagcgcagggatgaagacagaacatctatctactatggtggaatcttctcaggttattgcttttcgctatggctgcttttgttcttcatggaacttgacttgtttgaattttatgttcaggtaattttaaggtttt

SEQ ID NO: 2405 - DNA, 2032 bp, Papaver somniferum
atgcgagtatatcgtaaaaaggattcccatcagcaagggtttttctggaatcagttcgtttagtaatcttcttttcatatctcctccgcctctcacgacagcttcagcagaaatctccaatcgtttgccctagaaatctatttcaggatttgaagtactcgttgaaggaattgaatatggcgcggaaaggtttgatggagcaggatctgagtaaattggatgtgactttgttgcatccattgtcgcctgaagtaatctcacggcaagcaacaattaatattggtacgattggccatgtcgcccatggaaaatcaacagttgtaaaagcaatatctggtgtgcagacagtgagattcaagaatgaattggagcgtaacatcacaattaagcttggttacgccaatgcaaaaatatacaagtgtgaagatgaacggtgccctcggcctatgtgctacaaggcctatggcagtggtaaagaagatacccctgcatgcgatgtgcctgggtttgaaactgccaaaatgaaattattgagacacgtttctttcgtcgactgcccgggtcacgatattcttatggcaaccatgcttaatggagcggcaatcatggacggggcactgcttctgatagctgccaatgaaagctgtccccaaccccagacttcagagcatctggctgctgtggaaatcatgcgtctccaacacataatcatccttcagaacaaagttgatcttatccaagaaaatgtagccattaatcaacatgaagctatccagaagtttattcagaaaacagttgctgatggtgctcctgttataccaatctctgctcaattaaagtacaacattgatgttgtatgcgagtatatcgtaaaaaggattcccattccggagcgaaatttcatttcgccgcctaacatgatcgtcatccgatcgtttgatgttaataagcccgggtccgaggttgatgaaatcaagggtggtgttgctggtggaagtattctcaggggtgttttgagggtgaaccaattcattgaggtgcgacctggtatcgttttgaaagacgaaagtggtgccatcaagtgcacacccatctactccagaatagtttctttatttgccgaacaaaatgagctacaatttgctgttcctggtggtctgattggggtcgggaccacgatggatcccactttgactcgtgctgataggctggtgggtcaggttcttggggaggttgggtcactcccagacgtgtttgtggaacttgaggtgaactttttccttctcaggcgattactgggagtgagaacaaagggtacagagaggcaagggaaggtgtcaaagctggctaagggagagattcttatgttgaacattgggtctatgtctacaggggcacgagttcttgcagtgaagaatgatctggcaaaacttcaactaacgtcacctgtgtgcactagcaaaggagagaaggttgccctcagtcgacgtgttgagaagcattggcgtcttattgggtggggacagatccaggcaggtagcactcttgaagtcccaccgtgtcccatctgaaaaaaagctgagtggtaaactaaaagcaagtacccagcttgagtaaaaactagtgatactgaaaacaaaaagggagggactgaggaaactcatatttttgtgtgagaatgtggttaggaagagaactacttggcacaatttttgttagatggagaagaaaacctactgttattttgttaaattttctcgttttttctcatcaaattgaatgattgatagtttgaagatctataatgctttcttagtttttatagtttatggcattttcccaatattagtagtgtgtaagttcaatcttacatccacatttcaagcttaatttcgacattatttagtattttgtttagcgagatgtggatttttgctttctttgttttagttcattggctatttgtttatgtcctgcaaacttggtcgattaacttggataaacatggaaggctttatttcagtccaaaaaa

SEQ ID NO: 2406 - DNA, 1754 bp, Papaver somniferum
tttgtaatcttcttctcatatctcctccgcctctcacaacagcttcagcagaaatctcaaatcatctgccctagaaatctgatttgaagtattcgttgaaggaattcaatatggcgcggaaaggtttgatggagcaggatctgagtaaattggatgtgactctgttgcatccattgtcacctgaagtaatctcacggcaagcaacaattaatattggtacgattggccatgtcgcccatggaaaatcaacagttgtaaaagcaatatctggtgtgcagacagtgagattcaaaaatgaattggagcgtaacatcacaattaagcttggttatgccaatgcaaaaatatacaagtgtgaagatgaacggtgccctcggcctatgtgctacaaggcctatggcagtggtaaagaagatacccctgcatgcgatgtgcctgggtttgaaactgcaaaaatgaaattattgagacatgtttctttcgtcgactgcccgggtcacgatattcttatggctaccatgcttaatggagcggcaatcatggacggggcactacttctgatagctgccaatgaaagctgtccccaaccccagacttcagagcatctggctgctgtagaaatcatgcgtctccaacacataatcatccttcagaataaagttgatcttattcaagaaaatgtagccattaatcaacatgaagctatccagaagtttattcagaaaacagttgctgatggtgctcctgttataccaatctctgctcaattaaagtacaacattgatgttgtatgcgagtatatcgtaaaaaggattcccattccggagagaaatttcatctcgccgccaaacatgattgtcatccgatcgtttgatgtcaataagcctgggtcggaggttgatgaaatcaagggtggtgttgctggtggaagtattctcaggggtgttttgagggtgaaccagttcattgaggtgcgacctggtatcgtgttgaaagacgagagtggtaccatcaagtgcacacccatctactccagaatagtttctttatttgctgaacaaaatgagctacaattcgctgttcccggtggtctgattggggtcgggaccaccatggatcccactttgacccgtgctgataggctggtgggtcaggttcttggggaggttgggtcactcccagacgtgtttgttgaacttgaggtgaactttttccttctcaggcgattactgggagtgagaacaaagggtacagagaggcaagggaaggtgtcgaagctggctaagggagagattcttatgttaaacattgggtctatgtctacaggggcacgagttcttgcagtgaagaacgatctcgcaaaacttcaacttacgtcacctgtgtgcactagcaaaggagagaaggtcgccctcagccgacgtgttgagaagcattggcgtctcattgggtggggacagatccaggcaggtagcactcttgaagtcccaccgtgtcccatctgaatagaaaccgagtggtaaacaaaaagcaagtacccagcttgagtaaaaactagtgatactcaaaacaaaaagggagggactgaggaaactcatatttttctgtgagaatgtggttaggaagagaactacttggcacaatttttgttagatggagaagaaaacctactattatttgtttaattttcttcgtttttctcatcaaattgaatgattgatagtttgaagatctataatgcattctagttttat

SEQ ID NO: 2407 - DNA, 1838 bp, Tripterygium wilfordii
tagtgaaagagatcaagtagtcgctcatatactctgcatacaccagtacttcagtcggtgtatcttaagtcattaggcaaaatgtctcggaagggtttgatggagcaggacttgagtaaactggatgtaacaaagttgcatccactttcacctgaggttatatctcgtcaggccactataaatattggcaccattggtcatgtggcacatggcaagtcaacagttgtaaaagcaatatccggtgttcagactgttcgttttaaaaatgagctggagcgtaacattaccattaagcttggatatgcaaatgcaaagatctataaatctgaagatgaacggtgtcctcgacctatgtgctacaaggcatatggaagtggtaaagaagataatcctccatgtgatgtgccagggtttgaaaactgcaggatgaaattgctgagacatgtgtcttttgtggactgtccgggtcatgatattctcatggctacaatgcttaacggagcagcaattatggacggagcattacttctaatagctgccaatgaaagctgcccacaaccacaaacttctgaacatctggctgctgttgaaattatgcgccttcaacatattattatccttcaaaataaagttgatcttattcaggaaaatgtggcaataaaccagaacgaagcaattcaattgttcattcagggaactgttgctgatggtgcaccagtggttccaatttcggcacagctaaagtataatattgatgtagtgtgcgagtacattgtgaaaaagatccctattccagagaggaactttatctctccaccaaatatgattgttatcaggtcctttgatgttaataagcctgggtttgaggttgacgagataaaaggtggtgtagctggtggaagcattcttcggggtgttttgaaggttaatcaatttattgaggttcgtccaggaatagttcttaaagatgaaaatgggaacataaaatgcacaccaatatattctagaattgtttctttgtatactgagcaaaatgagctgcaatttgcggtgcctggaggccttattggggttggcactaccatggaccctactttgacacgtggtgataggttggtaggtcaggttcttggggaagtgggttcactcccagaagtctatgttgagcttgaggtgaacttctttttgttgcgacgtcttcttggtgtcaagacaaagggcacagaaaggcagggaaaggtcgcaaagcttgcaaagggagagatcctaatgttaaacattggatccatgtctactggtgcccgagttcttgccgtaaagaatgatttggcaaagctgcaactcacgtcgccagtgtgcaccagcaaaggagagaagattgcactcagtcggagagtagagaagcactggcgtcttattggttggggccagattcaagctggaactacccttgaagttccaccctgtcccctttgagcaaacaccgagaagaggaagaaaaaaaagcagtcgatagcgagaaagagttagttagagatgtgggagggaagacaatttcttggtacaatttttgtgaggtggaggagaaaacattttgctttaatggttgttactgttttccttgtttctttaatttgatagtatctggcctgtcctgagtgttggacttaattccatccaaggatttacatttggcggcggcaaacttaatgaacggcagctttttatccgaatggattgatggtgatgtagggtagcagttcatgaatctgttatgataatcaccgtcattttctaatggagttctgggccttctttgtgcactatattatgaattc

SEQ ID NO: 2408 - DNA, 1901 bp, Aquilegia formosa
aaaaaaaaaagataaaagaaagaaaacccaaactctctctctctctaaaacgcacacatctctctctctctctctctctctctcagatgttcagtgttattattattattgaaagagaaaactgaaaagatggcgtcaagaaaaggtttaatggaacaagatctgagtaagttggatgtaactcagttacatccattatcacctgaggttatttcacgacaagcaactattaatattggtactattggacatgtggctcatgggaagtcaactgtcgtgaaagctatctcgggtgtccagactgtgagattcaagaatgagctggaacgtaacattaccatcaagctaggatatgcaaatgcgaaaatatacaagtgtgaggatgaaaaatgcccgcgacctatgtgctacaaggcttatggaagtgggaaagaagatagtccttactgtgatgttccaggatttgagaatgcaaggatgaagcttctgagacatgtctcttttgttgattgtccgggtcacgatattcttatggctaccatgcttaatggagcagcaatcatggatggagcattacttctgatagctgccaatgagagttgtccccaacctcagacctctgagcatttggctgctgttgaaattatgcgtctccagcacataataatccttcaaaataaagttgatctcgttcaagagaatgctgcaatcaatcagcatgaagctattcagaagtttattcagaaaactgttgctgatggtgctccagtggtaccaatttctgcccagttgaaatacaatattgatgttgtttgcgagtacatcgtgaaaaggattcccattcctgaaagaaactttatttcaccccccaacatgatagtcatcagatcatttgatgtgaataagcccgggtatgaagtagatgatataaagggtggtgttgctggaggaagcatcctcaggggagttctaaaagttaatcaatatattgaagtccgtcctgggattgtcgtaaaggacgagagtagtaacatcaagtgcaccccaatatattcaagaatagtttcactattcacagagcagaatgagcttcagtttgctgtgcctggcggtctcattggagttggtaccactatggatcccactttgacacgtgctgataggcttgtgggtcaggtgcttggggaggtgggatcactacctgatgtttttgtggagcttgaggtgaacttttttcttcttcgtcggctcttgggagtcaggacaaaaggtacagagaggcaagggaaagttgcaaagttgacaaagggagagatacttatgctgaacattggctcaatgtctactggtgccaaagtgattgcagtgaagaacgaccttgctaaactgcaactcacctctcccgtctgcacaagcaaaggggagaaggttgccctcagtcggagagttgagaagcactggcgtcttattggatgggggcagattcaagctggaagcactctggaggtcccaccctgccccatctgaataaacaccacttgagaagaggacaacaaagagaagagaaacagtacttggtaacacaaccgaaaaaacttggtaaaaatgtgggaaggtaggcaattattaggtaccatttttgtaagatggcgaagaagacatacatacattggttattgttgtgactattttctttttagaatctttttaatgcatttgaattggattgcaaaatgtcttgagcatgttggctttttgtttttatcttgtaatgacacatctttaggtgtgctgagtttgtatttccaattggccaacctgtgccaaactttgtcttcattatatgttactcagcttagctatgttatagcaacagtaatatagtatgatatttttgtttg

SEQ ID NO: 2409 - DNA, 1564 bp, Cirsium arvense
gccgctgtccttgcttccttttacgactgttatcaagcttgctgcacttgttcatcatcaattatccaggttgaggtttttgtgttcatttagggtttgtgagattggaagtccttgaagaagaacaaaaatgtctcgaaaaggtctaatggagcaggatttgagcaagctggatgtgacacaactacatccactctcccctgaggtcatttctcgtcaagctacaattaatattggtactattggtcacgtggctcatggcaagtcaaccgttgtaaaagcaatttctggtgttcagactgttcggtttaaaaacgagttggagcgtaacatcactattaagcttggatacgcaaatgcaaagatctacaaatgcgaagatgagcgttgccctcgacctatgtgttacaaggcctatggatctggcaaagaggatagtcctctttgcgatgtgcctggatttgagaacgccaagatgactttgatgaggcatgtatcatttgttgactgcccggggcatgatattctgatggctactatgcttaatggagctgcgattatggatggagcgttgcttttgatagctgcaaatgaaagttgtccgcaacctcagacttctgagcacttggctgccgttgaaattatgcgtctccagcatattatcattcttcagaataaggttgatttaattcaggagaatgttgcaatcaaccaacatgaggcaattcagaagttcatccagggaacggtagctgatggtgcaccagtgatcccggtgtctgctcagcttaagtataatattgatgttgtatgcgaatacataataaagcggattcccattccagagaggaacttcatttcacctcctaatatgattgtaattcgctcatttgatgttaacaagcctggatccgaggttgatgagattagaggtggtgttgctggtggaagtatcctcaagggagtgttgaaggtgaaccaaaatattgaggtgcgtccggggattgttgtgaaagacgagagtggcaacatcaagtgcaccccaatttattctagaatagtttcgttatatgccgagcagaacgagcttcagtttgccgtacccggagggcttattggagttggaacaacaatggaccctatgttgacacgggctgaccgccttgtaggacaggttcttggggaggtcggatctcttccggatgtttatgttgaactagaggtgaacttctttcttttgcgtcggctgttgggtgtaaagacaaaaggaacagagaggcaagggaaggtatcgaagttggcaaagggagagattctgatgctcaacataggatccatgtccacaggggctcgtgtgttggccgttaagaacgatttagcaaaactccagctcacatcgcccgtctgtacaagcaaaggtgagaagattgcactaagccgacgagtggagaagcactggcgtctcattggttggggacaaattcaagccggtctcacacttgaaattccaccttgccctatttagatccagttttgcatgcttgcttatattctgttagatttg

SEQ ID NO: 2410 - DNA, 1966 bp, Panax ginseng
ttttttcttcgtctctcttcttcactaaggtgttggactgctcgcgacggctaccctagatttcttaaaaactgaatttagttctgttgaagagcaaagtctacaagaagagccaaaatgtcgcgaaaaggtttgatggagcaggatttgagcaagctggatgtgacaaaactacatcctctctcgcctgaagttatatctcggcaggctacaataaatattggcactattggccacgtggcacatggcaaatcgacagttgtaaaagctatatctggtgtgcagactgttcgtttcaaaaatgagctggaacgcaacatcactattaagcttgggtatgcaaatgcaaaaatatacaaatgtgaagatgaacgttgccctcgacctatgtcttacaaggcatatggaagtgggaaagaagatgctcctctttgtgatgtgccggggtttgagaacgccaggatgaatttactgagacatgtgtcgtttgttgattgcccaggtcatgatattctcatggctacaatgcttaatggagcagcaattatggatggggcattacttctcattgctgccaatgaaagttgtccccaacctcagacttcagagcacttggctgctgttgaaattatgcgtcttcagcatataataattcttcaaaataaggtcgatctaattcaggaaaatgtggccatcaaccagcatgaagctatccagaaatttatccagggaaccgttgcagatggtgcgccagtgataccagtttctgcacagctgaagtataacattgatgtcgtgtgtgaatatattgtgaaaaggattcccattccagagaggaatttcatctcaccgccaaatatgattgtgatccggtcttttgacgttaacaagcctggctttgaagttgatgaaattagaggtggtgttgctggtggaagcatcctcaagggggttttgaaggtcaatcaatacatagaggttcgtcctgggattgtagttaaagatgaaagtggcaacattaagtgcaccccaatatactctagaatagtttcattatatgcagagcaaaatgaattacaatttgctgtgccaggaggcctgattggtgttggcacaaccatggaccccaccttaactcgtgctgatcgtttggtgggacaggtccttggggaggtcggatcacttcctgaggtgtatgttgaactagaggtgaactttttcttgcttcgacgtcttctgggtgtaaggacaaagggaacagagaggcagggaaaggtctcaaagcttgcaaagggagagatacttatgctgaatattggatctatgtcaacaggtgctcgagttcttgctgtaaggaatgatttagcaaaattacaacttacatctccggtatgcaccagcaaaggggagaaaattgcactgagccggcgggttgaaaaacattggcgtcttattggttggggccagattcaagcgggtacaacccttgatgttcctcccagtccaatctgaggaaacctgaatcaatttttactcctttttccctcaccccccgtcgtcggggagtgttttgtattttgctgattctttggttgtgtccggaagcttatacattagtcggtgagtatgtgtggcatggttcgtaataaccaaaatacttgacattgcacacaatttttatgccagagcattttgttggtcaaaaaatgtgcagttctatagactaaacttgtgttacagttttgagtcatcaactccttccttttatgttggtattcattaagcctatttattttgagacttgctttttttataattgtaaaatgattgaaatgctcaaaggagtgcttctagaaaaaccccaaaaaaaaaaaaaaaaaaacaaaaaaaaaaaaaaaacaaaaaaaaaaaaaacaaaaaaaaaaaataaaaagtaaacgtaaggaagaacgaagaacaacaacgg

SEQ ID NO: 2411 - DNA, 1882 bp, Panax ginseng
ctcaaataaacacaaaatgggggtgtttatgtaaaaattgataaattcccaaaattgggatggtgtaacgtgcagcaaaacctctcttttttctcgtctctcttcttcactaaggtgttggactgctcgcgacggctaccctagatttcttaaaaactgaatttagttctgttgaagagcaaagtctacaagaagagccaaaatgtcgcgaaaaggtttgatggagcaggatttgagcaagctggatgtgacaaaactacatcctctctcgcctgaagttatatctcggcaggctacaataaatattggcactattggccacgtggcacatggcaaatcgacagttgtaaaagctatatctggtgtgcagactgttcgtttcaaaaatgagctggaacgaaacatcactattaagcttgggtatgcaaatgcaaaaatatacaaatgtgaagatgaacgttgccctcgacctatgtcttacaaggcatatggaagtgggaaagaagatgctcctctttgtgatgtgcctgggtttgagaacgccaggatgaatttactgagacatgtgtcgtttgttgattgcccaggtcatgatattctcatggctacaatgcttaatggagcagcaattatggatggggcattacttctcattgctgccaatgaaagttgtccccaacctcagacttcagagcacttggctgctgttgaaattatgcgccttcagcatataataattcttcaaaataaggtcgatctaattcaggaaaatgtggccatcaaccagcatgaagctatccagaaatttatccagggaaccgttgcagatggtgcgccagtgataccagtttctgcacagctgaagtataacattgatgtcgtgtgtgaatatattgtgaaaaggattcccattccagagaggaatttcatctcaccgccaaatatgattgtgatccggtcttttgacgttaacaagcctggctttgaagttgatgaaattagaggtggtgttgctggtggaagcatcctcaagggggttttgaaggttaatcaatacatagaggttcgtcctgggattgtagttaaagatgaaagtggcaacattaagtgcaccccaatatactctagaatagtttcattatatgcagagcaaaatgaattacaatttgctgtgccaggaggcctgattggtgttggcacaaccatggaccccaccttaactcgtgctgatcgtttggtgggacaggtccttggggaggtcggatcacttcctgaggtgtatgttgaactagaggtgaactttttcttgcttcgacgtcttctgggtgtaaggacgaagggcacagagaggcagggaaaggtctcaaagcttgcaaagggagagatacttatgctgaatattggatctatgtcaacaggtgctcgagttcttgctgtaaggaacgatttagcaaaattacaacttacatctccggtatgcaccagcaaaggggagaaaattgcactgagccggcgggttgaaaaacattggcgtcttattggttggggccaaattcaagcgggtacaacccttgatgttcctcccagtccgatctgaggaaacctgaaacaatttttactccttttctccctcacccccctcgttggggagtgttttgtattttgctgattctttggttgtgtccggaagcttatacattagtcggtgagtatgtgtggcatggttcgtaataaccaaaatacttgacattgcacacaatttttatgccagagcattctgttggtcaaaaaatgtgcagttctatagactaaacttgtgttgcagttttgagtcatcaactcctttcttttatgttggtattcattaagcctatttattttg

SEQ ID NO: 2412 - DNA, 1719 bp, Tragopogon dubius
gctatagaaccctgaaaccctagcaacgttactgctcaatattatcgccttagccaccgcaccatcaccagtcgtctaacgatcggagaatctctataacgtctcagcgattcggtgcttcctcactcagaggttgggtgttcatttagggtttctacaaattgcgaggttgaattagtgcaaagttcttgaagaacagtgaaaatgtctcgaaaaggtttaatggagcaggatttgagcaagctggatgtgacaaaactacatccgctctcaccggaggtcatatctcgccaggctacaattaatatcggtactattggtcatgtggctcatggcaagtcaacagtcgtgaaagcaatatctggtgtgcagactgttcgttttaaaaacgagttggagcgtaacattaccattaaacttgggtatgcaaatgcaaagatttataaatgtgaagatgagcggtgccctcgacccatgtgttacaaggcctatggaagtgggaaagaagatagccctctttgtgatgtacctggatttgaaaacagcaagatgacattgatgaggcacgtgtcttttgttgattgccctggacacgatattctcatggctactatgcttaatggagctgcaatcatggatggagcattacttctcatagctgcaaacgaaagctgtcctcaacctcagacttctgaacatttggctgctgttgaaatcatgaggctgcagcatattataattcttcaaaataaggttgatttgattcaggaaaatgtagctattaatcaacacgaagcaatccagaagtttatccagggaactgttgctgatggtgcaccagttatcccagtgtctgctcagcttaagtataacattgacgttgtgtgtgaatacataataaagcggatccctattccagaaaggaacttcatttcacctccaaatatgattgtaattcgttcttttgatgttaataagcctggatctgaagttgatgagattagaggcggtgttgctggtggaagtattctgaagggtgtgttgaaggtaaaccagttcattgaggttcgtccagggattgttgtgaaggatgagagtggaaacataaagtgcactcccatatattctagaatagtttcgttatatgctgagcagaatgaacttcaatttgctgtacctggtgggcttattggagtggggaccacaatggaccccatgttgacccgtgctgaccggctcgtgggtcaggttcttggggaagttgggtctcttcctgatgtttatgtcgaactagaggtgaacttttttctgttgaggcgtttgttgggagtgaagacaaaaggaacagagaggcaaggaaaagtgtcaaagctgacaaagtcggaaatactgatgctcaacatcgggtccatgtcaaccggggcccgtgttttagcagttaagaatgatctggcaaaactgcagctgacatcacctgtgtgtactagcaaaggtgagaagattgcacttagcaggagagttgagaaacattggcgtttgatcggttggggacagattcaagctggtcttactctcgagatcccaccctgcccgatttaaaacatacatttggagtttgattccagttttgcttgattcttgttatcatttagtttttggtagaaattgtgatttcgtatcattcacttgtttttaacgcataactttgcatggtgtttg

SEQ ID NO: 2413 - DNA, 1821 bp, Glycine max
gggatcgtcttctgcagaaatttgcgccatcgtcgagagaagcgtgagagacttctcgtttatgatgagagctaagatagtttagttgtcaagtcataaatcagtatcatcactttaaatttcattagaagctgtcaaaatgtcacggaagggtttgatggagcaagacctgagtaagttggatgtaacaaagttgcatccactttctccagaagtcatatctcggcaggctactattaatatcggcactataggtcacgtggcccatggcaagtcaacagttgtgaaagcaatatcaggtgtccagactgtgcgtttcaaaaatgagttggagcgtaacattacaatcaagcttggctatgcaaatgcaaaaatatacaagtgtgaagatgaacgatgtccaaggcctatgtgctacaaggcttatggaagtggaaaggaagatagtcctatgtgtgacgtgccagggtttgaaaacagcaagatgaaattgctaaggcatgtttcatttgtggattgtccgggacatgatattcttatggctacaatgcttaatggagcagcaatcatggatggagcgttgctactcatagctgctaatgaaagctgcccacaaccacaaacatctgagcatttagctgctgtagaaatcatgcgtctacagcacataataatccttcagaacaaggtagacttgattcaagaaaatgtcgcaatcaatcagcatgaggcaatttcaaagtttatacaaggaactgttgctgatggtgcaccagtagtacctatttcagcacagttgaagtataatattgatgttgtgtgcgaatatattgtgaagaagatcccaatccctgaaaggaactttgtttctccacctaacatgattgttattcggtcatttgatgtcaataaacctggttatgaggttgatgaaattaaaggaggtgtagctggtggaagcattctgaggggtgttttgaaggtcaatcaattcattgaagttcgtcctggcattgttgttaaagacgagagtggaaatatcagatgcacacccatatactcaagaatagtttcattgtacgctgaacaaaatgagcttcaatttgctgtgcctggaggcctaattggtgttgggacaacaatggatcccactttgacacgcgctgataggttggtaggtcaagttttaggagaggttggatcactacctgaggtttttgttgaactggaggtaaactttttcctgcttcgacgacttcttggtgtccgaacaaaagggtctgagagacaggggaaggtatccaagctggccaaaggagagatgctaatgttgaacattggatcaatgtcgacgggggctagagtagttgctgtgaagaatgacttggcgaagttgcaacttacttcccctgtgtgcactagcaagggtgagaagattgcacttagtcgacgtgttgagaagcattggcgtcttatcgggtggggacaaatccaagctggaatcactcttgatgtccctcccgccccccatctgagttgaacactgatcacaagaaacaccagcagctataaaaaactgagatgaatttagatatgtgggaagggaggcaattgttgggaaccatttttgtgaggtggagaagaaaacgttttttgattgttgtcttctattttgttttcacatcgttattggtttattttcccaactgtacctcttattgaagttgtatcctatgctgtgattgaattcaggctgggagtgagaatctcagcaagcacttgtttcaatctatggtatcttatcaatatgcaattatgcac

SEQ ID NO: 2414 - DNA, 1964 bp, Glycine max
gtagacgcagcgaatcacgttttgttcgagcttcctccattctcaattttcagaatcgatttcgaagagctgcttcgtctttgctccaccaaaattcttcaccgttgtagttgtactcagccactcggagacaccgctaatcgatagtttagttggcaagtcataaattagtttcatctcttaagatttcattggaagcagtcaaaatgtcacggaagggtttgatggaacaagacctgagtaagttggatgtgacaaagttgcatccactttctccagaagtcatatctcggcaggctactattaatattggcactataggtcatgtggcacatggcaagtcgacagttgtgaaagcaatatcaggagtccagactgtgcgtttcaaaaatgagttggagcgtaacattacaatcaagcttggctatgctaatgcaaaaatatacaagtgtgaagatgaacggtgtccaaggcctatgtgctacaaggcttatggaagtggaaaggaagatagtcctatgtgtgatgtgccaggatttgaaaacagcaagatgaaattgctgagacatgtttcatttgtggattgtccgggacatgatattcttatggctacaatgcttaatggagcagcaatcatggatggagctttgctactcattgctgccaatgaaagctgcccacaaccacaaacctctgagcatttagctgctgtggaaattatgcgtctacagcacataataattcttcagaacaaggtagacttgattcaagaaaatgtggctatcaatcagcatgaggcaatttcaaagtttatacaaggaactgttgctgatggtgcaccagtagtacctatttcagcacagttgaagtataatattgatgttgtgtgtgagtatattgtgaagaagatcccaatccctgaaaggaactttgtttctcctcctaatatgatcgttattcggtcatttgatgtcaataaacctggttatgaggttgatgaaataaaaggaggtgtagctggtgggagcattttgaggggtgttttgaaggtcaatcaattcattgaagttcgtcctgggattgttgttaaagatgagagtggaaatatcagatgcacgcccatatactcaagaatagtttcattgtatgctgaacaaaatgagcttcaatttgctgttcctggaggcctaattggtgttgggacaacaatggatcccactttgacacgtgctgataggttggtaggtcaagttttgggagaggttggatcactacctgaggtttttgttgaacttgaggtaaactttttcctgcttcggcggctccttggtgtccgaacaaaagggtctgagagacagggaaaggtatccaagctggctaaaggagagatgttaatgttgaacattggatcaatgtcgacgggggctagagtagttgctgtgaagaatgacttggcgaagttgcaactcacttcccctgtgtgcactagcaagggcgagaagattgcacttagtcgtcgtgttgagaagcattggcgtcttattgggtggggacaaatccaagctggaatcactcttgatgtccctcccgccccccaactgagttgaacactgataagagacagatcacaagaaacaccagcagctataaaaacctgagacgaatttagatgtgggaagggagacaagtgttgggaaccatttttgtgaggtggagaagaaaacgttttgattgtcgtctatttttgttttcacatcgttattggtttattttccccactgtacctattattgaagctgtatcctatactctgattgagttcaggctgggagcgagaatctcagccagtacttgtttcattccatggcatctttaccgatattcaaaaattggttcgccatttgataccgtgaagcatttcattatgaaactacataatatccaagcaatggttgaaaatacta

SEQ ID NO: 2415 - DNA, 2004 bp, Amsonia hubrichtii
cgacttcattaccatagtccccacgagaatactcacccggtcggtgttgagtcggcccctagggcactattcttgggagggttcgggccatcaagctgttttgtccctcgtataaaatagaatagtatttctggagcagttgcagcacagcagcagcttttgttaacattgattttgtgcagaagaaaaagtttcgaaattcagattatagggctcattgggacttcggacttcgaatcattcattcaagaagctcaagaacttcattccgaaggaaagtcgcagcattcattcggaaaatcggattacgcagaagctctgctctcagctcttccaaggtacaatcaagaagctttgctctcagaattcattcgagaagctcttctctcagtctcagctctttgaagatctgtttagcatagccacctctctttgctgaattttgtaaactttaagactttatttgaagccaaaagaaactaaggagcagccaaaatgtctcgaaaagggttgatggagcaggatctaagcaagctggatgtaacacagctgcatccactttcacctgaagttatttctcgtcaggccacaattaacattggcacaattggtcatgtggcacatggcaagtccactgttgtgaaagccatctccggtgtccagactgttcgtttcaagaatgagctggaacgtaatattaccataaagcttggttatgccaatgcaaagatatacaaatgcgaggatgaacgttgcccccgacccatgtgctataaggcgtatggaagtggaaaagaagatagcccaatgtgtgatgtacctggtttcgagaattgccggatgaaattgttgcggcatgtttcttttgttgattgtcccggtcatgatattcttatggctacaatgcttaatggagctgcaattatggatggagctttacttcttatagctgccaatgaaagttgtccacaacctcagacgtctgaacatttagctgctgttgagattatgcgtctccaacatattataattcttcaaaacaaggttgatctagttcaggagaatgtggccatcaatcaacatgaagccattcagaaatttatacagggaactgttgcagatggtgcaccagtcgtaccaatttctgcacagctgaagtataacattgatgttgtttgtgaatacattgtgaaaaagattcctattccagagaggaacttcgtttcaccaccaaatatgattgttatcagatcttttgatgtcaataagccaggatttgaggtggatgagattaaaggcggtgttgctggtggaagcatactgaagggcgttcttaaggtaaatcagtacattgaggttcgccctggtattgttgtcaaggatgagaatggcaacatcaaatgtactccaatatattctagaatagtttctttgtatgcggagcaaaatgaactgcaatttgcagtcccaggaggtcttattggagttggcaccactatggacccaacactaactcgtgctgatcgattggttggacaagttcttggggaggttgggtcattgcctgaagtttttgttgaactggaggtgaacttctttctattaaggcgacttcttggtgttaggacaaaagacactgaaaggcagggtaaagtctcaaagctagcaaagggtgagatccttatgttgaacataggatctatgtcaacaggggctcgtgttatagcagtcaagaatgtgtttgcaaaactgcaactaacatctcctgtatgcacgagcaaaggggagaaaatcgcactcagcagaagaattgagaagcactggcgtcttattggctgggggcaaatccaagctggtactactcttgatgtcccaccctgccccatctaattgcagagcaaaaattcgcctaaaaaggaaacaacagagaagaaagtgctgaaacaagtaaaaattagatattagatggtgggaaggcagaaactgctggaaaattttgtacgg

SEQ ID NO: 2416 - DNA, 1775 bp, Daucus carota
cggaaaaattgaggtttgcgggggttgtgcgaagtgcaaagaacagcatctcagcggcgcagtcattacccaatatcttcttctggaagagtaatcaaagattaaaggagcccttttcacaactatacaagctcacccaggttgtaagcttctgtgtagttgtgtagagctctctttccatcctctttaagattctctgctttcagttttttgaggaagagcaaacatgtcgcggaaaggtttgatggagcaggatttgagcaagctggatgtgacaacattacatcctctctcacctgaagttatatctcgacaggctacaataaatattggcactattggccatgtggcacatggaaaatcaactgttgtaaaagccatatctggtgtgcagactgtacgtttcaaaaatgagttggaacgtaacatcacaatcaagcttgggtatgcaaatgcaaaaatatataaatgtgaagatgaccgctgtcctcgaccaatgtgttacaaggcatatggaagtggaaaagaagatgctcctatgtgtgatgtaccgggctttgagaatgccaggatgaaactactgagacatgtctcctttgttgactgcccagggcatgatatcctcatggctacaatgcttaatggtgcggcaattatggacggagcgttgcttctcatagccgctaatgaaagttgtccccagcctcagacttctgagcatttggctgctatcgaaattatgcgccttcaacatataataattcttcaaaataaggttgatttgatacaggaaaatgttgccattaatcagcatgaggccattcagaaatttattcagggaaccgttgcagataatgctcccgtgataccagtatctgcacagctgaaatataacatagatgcagtttgtgagtatattgtaaaaaagatacctattccagagagaaacttcatctcgccaccaaatatgatagtgatccgttcatttgatgttaacaagcctggctctgaagttgatgatattagaggtggtgttgctggtgggagtattctcaagggggttttaagggtgaaccaaaacatagaggttcgtcctgggattgttgtcaaagatgaaagtggcaatatcaagtgcaccccaatctactctagaatagtttcattatatgctgaacaaaatgaactacaatttgccgtgccaggaggcctcatcggtgttggtacaaccatggatccaactttaactcgagctgatcgattggttggacaggttcttggggaagttggatcacttcctgaggtgtatgttgaactagaggtaaacttcttcttgctacggcgtcttctgggtgtaaggacaaagggcactgagaggcagggcaaggttgctaaactgacgaaggctgagatacttatgttaaatattggatccatgtcaactggtgctcgagttgttgctgtgaagaacgacttggcgaaattgcaactaacttctccagtgtgcaccagcaaaggtgaaaaaattgcattgagtcgaagggttgagaagcactggcgtcttattggctgggggcaaattcaagctggcacaactcttgacatccctcccttccccacattttgagtaaacctgtgaaacagtttcctttccatttccctcttagtgggagtattttgtacacactgctaattctttggttgtgtcgagctttaacaatttggcaatgagtttctggttgttatctcatatccaactccatttcctcacatttttt

SEQ ID NO: 2417 - DNA, 1601 bp, Chelidonium majus
ctctctctcaggcgaccaaaaatctccaatcggttgccctagaaatcggagtaaagagacccttttaagagattgaaaatggctcgaaaagggttgatggagcaggatctggctaagctggatgtggctaagttgcatccactctcacctgaagtgatatctcgtcaagcgacgataaatattggtaccattggtcatgtggctcatggaaagtctactgttgttaaagccatatctggtgttcagactgtccggtttaaaaatgagctggagcgaaatattaccatcaagcttggatatgccaatgcaaagatatacaagtgtgaagatgataggtgcccccggcctagctgctacaaggcctatggcagtggaaaagaagatgctcctttatgtgatgtcccaggttttgaaaatgcaagaatgaagctattgagacatgtctcattcgtggattgcccgggtcatgatattcttatggctactatgctcaatggagcagcgatcatggatggagcactacttctgatagctgccaatgagagctgtccccaaccacagacttctgagcatctggctgcagttgaaatcatgcgcctccaacacataatcatccttcaaaataaagttgatcttattcaagaaaatgtagcaatcaatcagcatgaatctattcagaagtttattcagaaaactgttgctgatggtgcaccagtgataccaatttctgcacagttgaaatacaatattgatgttgtgtgtgaatatcttgtgaaaaagatcccaatcccagagagaaactttatctcacctccaaatatgattgtcatccgatcttttgatgtgaataagcctggatcagaagttgatgaaataaagggtggtgttgctggtggaagtattctcaggggtgttttgaaggtgaatcaattcattgaggtccggcctgggattgttgtaaaagatgaaactggtaacatcaagtgcaccccaatctactcaaggatagtttccctatatgctgagcaaaatgagctgcaatttgctgtacccgggggtctcattggggttgggaccaccatggacccaactttgacacgtgctgataggctggttggtcaggttcttggggaggttggctcacttcctgatgtttttgttgaacttgaggttaacttcttccttctccgacggcttctaggagtcagaacaaagggtactgagaggcaagggaaagtttcgaagctggcgaagggtgaaatactgatgttgaacattgggtccatgtccactggggctcgagtaattgcagttaagaatgatttggctaagttgcaactcacatcacctgtgtgcactagcaaaggtgagaaggttgcccttagcaggcgtgttgagaagcattggcgtctgattggatggggacagattcaagcaggggcaacccttgaagtaccaccctgtcccatttgagtaaaacctctacacgggtggcggaaaacagagaaaaaaaatagaaaatcactacttgtatctggctttgagaacttggaaagatgtgggtagggaaagaattgctaggaacaatttttgttagatgg

SEQ ID NO: 2418 - DNA, 1749 bp, Vigna unguiculata
aatcgcgatagtttagttgtcaagtcacaaaacagtttcacaacttaagatcccatcgaaagctgccaaaatgtcgcggaagggtttgatggaacaagacctgagtaagttggatgtgacaaagttgcatccactttcaccagaagtcatatctcggcaagctactattaatattggcactattggtcatgtggcacatggcaagtcaacagttgtgaaagcaatatcaggtgtccagactgtgcgtttcaaaaatgagttggagcgtaacatcacaatcaagcttggctatgcaaatgcaaaaatatacaagtgtgaagatgaacggtgtccaaggcctatgtgctacaaggcttatggaagtgggaaagaagatagtcctatgtgtgatgtgccagggtttgaaaacagcaagatgaaattgctgagacatgtttcttttgtggattgtccgggacatgatattctcatggctactatgcttaatggagcagcaatcatggatggagctttattactcatagctgctaatgaaagctgtccacaaccacaaacctctgagcacttagctgctgtggaaattatgcgtctacagcatataattatccttcagaataaggttgacttgattcaagaaaatgtggcaatcaatcagcatgaagcaatttcaaagtttatacagggaactgttgccgatggtgcaccagtagtacccatttcagcacaattaaagtataatattgatgttgtgtgtgagtatattgtgaagaagatcccaatccctgagaggaactttgtttctccacctaacatgatcgtgatccggtcatttgatgtcaataaacctggttttgaggttgatgaaataaaaggaggtgtagctggtggaagcattttgaggggtgttttgaaggtgaatcaattcattgaagttcgacctgggattgttgttaaagatgagagtggaaatatccgatgcacaccaatatattcaagaatagtttcattgtatgctgaacaaaatgagcttcaatttgctgtacctgggggcctgattggtgttgggacaacgatggatcccacactgacacgagctgataggttggtaggtcaagttctaggagaggttggatccctacctgaggtttttgttgaacttgaggtaaactttttccttcttagacggcttcttggcgtccgaacaaaagggtctgagagacaggggaaggtatcgaagctgacgaaaggagagatgctaatgttgaacataggatcaatgtcaacgggggctagagtaattgctgtgaagaatgacttggcaaagttgcaacttacatcccctgtgtgtactagcaagggtgagaagatagcacttagtcgacgtgttgagaagcattggcgtcttattggatggggccaaatccaagcaggaatcacccttgacgtccctcctgccccccatctcagttgaacgcaggcaagacacaccacaggaaacacctgcagcagccataaaaaccctaaaacaatttagatattctgaagggagacaattgttgcgaaccatttttgtgaggtggcgagaaaaacgttttgattgttgtctattttttgttttctctttctcatcgttattgttatattttgcccatgtaactattattgaagttcaatgagttgtgggtcctgtcgattagtgacatcgtgttgggttaaaaagaaaacctttatagacttgtcaatgagttc

SEQ ID NO: 2419 - DNA, 1865 bp, Euphorbia peplus
gtgctcccagaaagttgcagattagggtttttcacaaagccaccatcaggaaggaatcttctgaattgaaagagctgattgaagcaggttcaaacttgggagattttaaaatgtcgaggaaaggattgatggagcaggatttgagtaaattggatgtaactaagttacatccgctctcgcctgaagtaatatctcgccaggccaccattaatattggtacgataggtcatgtggctcatggaaagtccactgttgtaaaagctatatctggtgtccagactgttcgttttaagaatgagttggaaaggaacattacgattaagcttggttatgcaaacgcgaagatatacaagtgcgaagatgaacggtgctcccggcctatgtgttacaaggcctatggaagtgggaaagaagatagtcccatgtgcgatgttcctgggtttgaaaatgcaaaaatgaaattgctgagacatgtttcctttgttgattgcccgggtcacgatattctcatggctactatgcttaatggagcagctattatggatggtgcattgcttctcatagctgcaaatgaaagctgcccccagccacagacttctgagcatcttgctgctgttgaaatcatgcgccttcagcatatcataattcttcaaaataaagtcgatttaattcaagaaaatgttgctgtcaaccagcacgacactattcaaaaatttattcagggaactgttgctgatggtgcaccagtggtaccaatttctgcacagctgaagtataatattgatgttgtgtgcgaatacattgtaaaaaagattcctattcctgagaggaactttatctccccaccaaacatgattgtgattcgttcttttgatgtcaataagcctgggtttgaggttgatgagataaaaggtggcgtagctggtggaagtattttcaggggtgttttgaaggtcaatcaaaatattgaagttcgccctggaattgtagttaaagatgagtcgggtaatatcaagtgcaccccgatatacacgagaatagtttcgctctatgctgagcagaacgagctacagtttgcagttccgggaggtttgattggtgttggcactacaatggaccctacattgacccgtgctgataggttggtgggacaggttcttggagatgtcgggtctctccctgaggtttttgttgagcttgaggtgaatttctttcttcttcgacgactcattggtgtccggacaaagggatccgaaaagcaagggaaagttgcaaagcttgccaagacagaaattcttatgcttaatatcggatccatgtctaccggtgctagggtcatcgccgtgaagaatgacttggcaaagttacagttgacttctcccgtgtgtactagcaaaggagagaagattgcactaagccggagagtggagaagcattggcgtcttatcgggtggggtatgattcaagcgggaactacacttgaagttcctccatgccccctttgaaaataccaacatagaaataggctggaagggttggtttatatccactagacaaagtacattttgctggatttatcctattattgcctgtgttcatttctttttggcaattataatcgaagttttgaacaggagtcgttttaatcgaatcagatgctttgtaggggaagaaaaaaatggcatttttgtgatattattatcagatttttgcttattttgttaaggacctgggctatttttctttttctttgctcatgatgtttggaaatcttctccagcttcagtttttagctttatttcatgtactgatgtttcataaatagttgtgaactcgtgcaaattgagaacatttagattactcat

SEQ ID NO: 2420 - DNA, 2161 bp, Quercus alba
ctgtgctttctctctctcagctttactacacaaccctacctctctctctctcactcactcgctcttgtcggctcgccctcaaaaccgacccaacccgacccggttttgcgtacgagctgaaccaaccagttttcttgtgtttgttgagagaaacattcgttgattctttcttagttggatttttgcggaataaccaaaacagaaagttctttcatttagagggtcactaagaaacaaccaaaaatgtcgcggaagggtttgatggagcaagacctgagtaaactggatgtaacaacattacatccactctcccctgaagttatatctcggcaggctacaataaatattggcaccattggtcatgtggcacatggaaagtcaacagtcgtaaaagcaatatctggtgttcagactgttcgttttaaaaatgagttggagcgcaacatcactatcaagcttggttatgctaatgcaaagatctacaaatgtgaagaggaacggtgccctagacctatgtgctacaaggcttatggaagtgggaaggaagataatcctctgtgtgatgtgctgggatatgaaaactgcaggatgaaattgctgagacatgtctcttttgtggattgcccgggtcacgatattctcatggctacaatgcttaatggagctgcaattatggatggagctctacttctaatagctgcaaatgaaagctgcccccaaccacaaacttctgagcatcttgctgctgttgagattatgcgcctccaacatataataatccttcaaaataaagtagatctcattcaggaaaatgtagccatcaaccagcatgaagcaatccagaagtttattcagggaactgttgctgatggagcacctgtggtaccaatttctgctcagctgaagtataatattgatgttgtgtgtgagtatattgtgaagaaaatccccattccagaaagagactttgtgtcacctcctaatatgattgtaatccggtcttttgatgtcaataagcctggttatgaggttgatgaaataagaggaggtgtggctggtggaagtattctcaggggtgttttgaaggtaaatcaatttattgaggttcgtcctgggattgttgttaaagatgagagtgggggcatcaaatgcacgccgatatattccagaattgtttctttatatgctgagcaaaatgagctgcaatttgctgtgcctggaggtctcattggtgttggcacaaccatggaccccactttgacacgtgctgataggttggtgggtcaagttcttggtgaagttggatcactccccgaagtttttgttgagcttgaggttaattttttcttgctgcggaggcttctaggtgtcaggactaagggcacagaaaggcagggaaaggtcactaagctgaccaagtccgagattttaatgttgaacataggttctatgtctacaggggcaagagttatggctgtgaagaacgatctggcaaagttgcaactcacatctccagtgtgcactagcaaaggtgagaagattgcccttagtcggcgagttgagaagcactggcggcttattggttggggtcagattcaagctggaaccactcttgagatcccaccccgccctatttgagttaaatccctaaacaggtagaaagaacaaccagtcaaatctttaaaagagaattaaggaagatgtgggaagatggacatttgttgggaaccatttttgttaggtggagaagaaaacagtgcttgcattgctgttccctgttttgtttcttttttcctatgggattgtgttactttgtgctgatatcttattttgagttttggactagagtattttttatgaggctgtttcttatggacctcctcacagtcagacatcgcattcttgtgaaattctcttatacaatattggaggatggtttctttgcgaatctgtaatttctagaaatggacattggtcatctacttaggcaggtagataattatactccgatggacaatacttgatttttttacccccaagctgttgttgacagccttagcagtaataataacggcttaacacccaatagactgaaaaaaaaaaacccccaatagaccgaaaaaagtgattaatacggttcattgtagatactcatttacta

SEQ ID NO: 2421 - DNA, 2910 bp, Petroselinum crispum
aaagtaggattgatgcaataattgagcttatttcttgctcccttcatttgaagtagattatcgcagaagaaattgtaacttgttgcttagtgattgaccatgtgaatttctagtgtaatgacactttacttaaaatggagaaacatgcgttttgtaatcattttactacaattatgcatgtataaagaaattgatgtgaaaatttcaaaagaattaagatttgtctctacttaggaaacttgaaggtgcaaacaatgatatttatgtggactatgagtgtgtacagtattattttgttataagctgaagctcaagaggagaaactaatcttaagatgtttatatttataacataagggcgttttttagatggtagtgtataactagtagaatcttgaaaagatgatgtgttatattatatatgtataaatgtatcttatttgttaccaagttcgagactcttaatttattttactggcctctcaggctctcacagttcgttatatctttttgtttcttacaactttttacatgtcgcatttttatgtacaaataagttgtgctgttgagtgtcatatataacaactgccctgacatttacaacatatctttatcctcaaacaatcacgtattcaagctgaaattcatgaacacttgaagtctttgtcttatatctttctatatattccattcaaaatctctatctagcattacttctactaattagtttaataaaccaaaattttaccactctccattctagtaagggacgtgtatttgaaattaaaattctctctaattttggaactaagaggaatttttaagcttgctttgtatgtacttattttcaaattgtgtagtaggtatcttcttctctttttgctgtagttgaattgcttgctgcaaataaaagttggcacatatactgaacatttaaggtctaatgcaggtgtaagtttctgtagccgtgtagagctttcttcccatcctcgttgagattccctgatttcagtctttaaaggaagagcaaacatgtctcggaaaggtttaatggagcaggatttgagcaagctggatgtgacaacactacatcctctctcacctgaagttatatctcgacaggctacaataaatattggcactattggccatgtggctcatggaaaatcgacagttgtaaaagccatatctggcgtgcagactgtgcgtttcaaaaatgagttggaacgtaacatcacaattaagcttgggtatgcaaatgcaaaaatatataaatgtgaagatgagcgctgtcctcgaccaatgtgttacaaggcatatggaagtggaaaagaagatgctcctatgtgtgatgtacctgactttgagaatgccaggatgaaactacttagacatgtctcctttgtcgattgccctggccatgatattctcatggctacaatgcttaatggtgcggcaatcatggatggggcattgcttcttatagccgccaatgaaagttgtccgcagcctcagacttctgagcacttggctgctattgaaattatgcgtctccaacatataataattcttcaaaataaggttgatttgatccaggagaatgttgccattaatcagcatgatgccattcagaaatttattcagggaactgttgcagatggtgctccggtgataccagtatctgcacagctgaaatataacatagatgctgtttgtgagtacattgtaaaaaagatacccattccggagagaaacttcatctcaccaccaaatatgatcgtgattcgttcgtttgatgttaacaagcctggctctgaggtcgatgatattagaggtggtgttgctggtgggagtattctcaagggggttttaagggtcaaccaaaacatagaggttcgtcctgggattgttgttaaagatgaaagtggcaatatcaagtgtaccccaatttactctagaatagtatcgttatatgctgaacaaaatgaactacaatatgccgttccaggaggcctgatcggtgttggtacaaccatggacccaactttaactcgagctgatcggctggttggacaggttcttggggaagttggatcacttcctgaggtgtatgttgaactagaggtaaacttcttcttgctacgacgtcttctgggtgtgaggacaaagggcactgagaggcaaggcaaggttgcaaaattggcgaaggctgagatacttatgttaaatatcggatccatgtcaaccggtgctcgagttgttgctgtaaagaacgacttggcaaaattgcaactaacttctccggtgtgcaccagcaaaggtgaaaaaattgcattgagtcgaagggtggagaagcactggcgtcttattggttgggggcaaattcaagctggctcaacgcttgatgtccctccctgtcccatttaagtaaaacgagaaacagtttctttttccattccccccttagtgggagaattttgtgtactctgctaattctttgattgtgtcaagctttaacattttggcaacaagtttcgggttgtaatttttatattcgacttcatttcttcacaattcttttgcctagagcttcctgtttacatcaactcttctcattagttttgggtaagcaatgtttttgtctgtgttcgttgataaagttcagcaatctttatctcataaccgagtgacagtacggggctttccttaaaatgaacttgaaattctatttgtctattgctatgttttaataattatacttgtttattatgttctcataattaatagatgtaattaatgttttatggaactgattttggctttggttactccaattaattatacattaatgtactgttagtgctaccctgtcttgaaataaataatacatcagactaattagttgtcacgt

SEQ ID NO: 2422 - DNA, 1891 bp, Glycine max
acagttcacattaagggatcgtcttctgcagaaatttgcgccatcgtcgagagaagcgtgagagacttctcgtttatgatgagagctaagatagtttagttgtcaagtcataaatcagtatcatcactttaaatttcattagaagctgtcaaaatgtcacggaagggtttgatggagcaagacctgagtaagttggatgtaacaaagttgcatccactttctccagaagtcatatctcggcaggctactattaatatcggcactataggtcacgtggcccatggcaagtcaacagttgtgaaagcaatatcaggtgtccagactgtgcgtttcaaaaatgagttggagcgtaacattacaatcaagcttggctatgcaaatgcaaaaatatacaagtgtgaagatgaacgatgtccaaggcctatgtgctacaaggcttatggaagtggaaaggaagatagtcctatgtgtgacgtgccagggtttgaaaacagcaagatgaaattgctaaggcatgtttcatttgtggattgtccgggacatgatattcttatggctacaatgcttaatggagcagcaatcatggatggagcgttgctactcatagctgctaatgaaagctgcccacaaccacaaacatctgagcatttagctgctgtagaaatcatgcgtctacagcacataataatccttcagaacaaggtagacttgattcaagaaaatgtcgcaatcaatcagcatgaggcaatttcaaagtttatacaaggaactgttgctgatggtgcaccagtagtacctatttcagcacagttgaagtataatattgatgttgtgtgcgaatatattgtgaagaagatcccaatccctgaaaggaactttgtttctccacctaacatgattgttattcggtcatttgatgtcaataaacctggttatgaggttgatgaaattaaaggaggtgtagctggtggaagcattctgaggggtgttttgaaggtcaatcaattcattgaagttcgtcctggcattgttgttaaagacgagagtggaaatatcagatgcacacccatatactcaagaatagtttcattgtacgctgaacaaaatgagcttcaatttgctgtgcctggaggcctaattggtgttgggacaacaatggatcccactttgacacgcgctgataggttggtaggtcaagttttaggagaggttggatcactacctgaggtttttgttgaactggaggtaaactttttcctgcttcgacgacttcttggtgtccgaacaaaagggtctgagagacaggggaaggtatccaagctggccaaaggagagatgctaatgttgaacattggatcaatgtcgacgggggctagagtagttgctgtgaagaatgacttggcgaagttgcaacttacttcccctgtgtgcactagcaagggtgagaagattgcacttagtcgacgtgttgagaagcattggcgtcttatcgggtggggacaaatccaagctggaatcactcttgatgtccctcccgccccccatctgagttgaacactgatcacaagaaacaccagcagctataaaaaactgagatgaatttagatatgtgggaagggaggcaattgttgggaaccatttttgtgaggtggagaagaaaacgttttttgattgttgtcttctattttgttttcacatcgttattggtttattttcccaactgtacctcttattgaagttgtatcctatgctgtgattgaattcaggctgggagtgagaatctcagcaagcacttgtttcaatctatggtatcttatcaatatgcaattatgcactattggttctacatgttatatacgtgaagcattttattttgaaacaagcaatggat

SEQ ID NO: 2423 - DNA, 2194 bp, Glycine max
actctcaaaccataaattccaagtagacgcagcgaatcacgttttgttcgagcttcctccattctcaattttcagaatcgatttcgaagagctgcttcgtctttgctccaccaaaattcttcaccgttgtagttgtactcagccactcggagacaccgctaatcgatagtttagttggcaagtcataaattagtttcatctcttaagatttcattggaagcagtcaaaatgtcacggaagggtttgatggaacaagacctgagtaagttggatgtgacaaagttgcatccactttctccagaagtcatatctcggcaggctactattaatattggcactataggtcatgtggcacatggcaagtcgacagttgtgaaagcaatatcaggagtccagactgtgcgtttcaaaaatgagttggagcgtaacattacaatcaagcttggctatgctaatgcaaaaatatacaagtgtgaagatgaacggtgtccaaggcctatgtgctacaaggcttatggaagtggaaaggaagatagtcctatgtgtgatgtgccaggatttgaaaacagcaagatgaaattgctgagacatgtttcatttgtggattgtccgggacatgatattcttatggctacaatgcttaatggagcagcaatcatggatggagctttgctactcattgctgccaatgaaagctgcccacaaccacaaacctctgagcatttagctgctgtggaaattatgcgtctacagcacataataattcttcagaacaaggtagacttgattcaagaaaatgtggctatcaatcagcatgaggcaatttcaaagtttatacaaggaactgttgctgatggtgcaccagtagtacctatttcagcacagttgaagtataatattgatgttgtgtgtgagtatattgtgaagaagatcccaatccctgaaaggaactttgtttctcctcctaatatgatcgttattcggtcatttgatgtcaataaacctggttatgaggttgatgaaataaaaggaggtgtagctggtgggagcattttgaggggtgttttgaaggtcaatcaattcattgaagttcgtcctgggattgttgttaaagatgagagtggaaatatcagatgcacgcccatatactcaagaatagtttcattgtatgctgaacaaaatgagcttcaatttgctgttcctggaggcctaattggtgttgggacaacaatggatcccactttgacacgtgctgataggttggtaggtcaagttttgggagaggttggatcactacctgaggtttttgttgaacttgaggtaaactttttcctgcttcggcggctccttggtgtccgaacaaaagggtctgagagacagggaaaggtatccaagctggctaaaggagagatgttaatgttgaacattggatcaatgtcgacgggggctagagtagttgctgtgaagaatgacttggcgaagttgcaactcacttcccctgtgtgcactagcaagggcgagaagattgcacttagtcgtcgtgttgagaagcattggcgtcttattgggtggggacaaatccaagctggaatcactcttgatgtccctcccgccccccaactgagttgaacactgataagagacagatcacaagaaacaccagcagctataaaaacctgagacgaatttagatgtgggaagggagacaagtgttgggaaccatttttgtgaggtggagaagaaaacgttttgattgtcgtctatttttgttttcacatcgttattggtttattttccccactgtacctattattgaagctgtatcctatactctgattgagttcaggctgggagcgagaatctcagccagtacttgtttcattccatggcatctttaccgatattcaaaaattggttcgccatttgataccgtgaagcatttcattatgaaactacataatatccaagcaatggttgaaaatactagactctggtaagcacatttcctgtaattgattgtacttattatgtggggtatggagttctgaaggtaatttctgggcaccttaattagaaggcaaaattgtaaaattggttcctcactttatcttcaattacgtatttggtcctcttataatttaatttacaaatttggttcctcagttttataaattcctgtaaaattggtcctgga

SEQ ID NO: 2424 - DNA, 2065 bp, Trigonella foenum-graecum
cttgttgtatctgcaattttaaacaacaaagctattttctttgctctttacaccaaatttaactcactgtagctgctctacccatccactctcaaatcccactaattgcagtcaaaatggctcggagggggttgatggaacaagacctaagtacgttggatgtgacaaaattgcatccgctttctcccgaagtcatatcccgtcaggctactatcaatattggcaccataggtcatgtggcacatggaaagtcaacggtcgtgaaagcaatatcaggtgttcagactgtgcgttttaaaaatgagttggaacgtaacattacaatcaagcttggttatgcgaatgcaaaaatatacaagtgtgaagatgaacggtgtccaaggcctatgtcctacaaggcttatggaagtggaaaggaagatagtcctatgtgtgatgttccagggtttgaaaattccaagatgaaattgctgcgacatgtttcttttgttgattgcccgggacatgatattctcatggctactatgcttaacggagcagcaatcatggatggagctttgctactcattgctgctaatgaaagttgccctcaaccacaaacctctgagcatttagctgctgtggaaattatgcgtctacagcatataataatccttcagaacaaggtagacttgattcaagaaaatgtggctatcaaccagcatgaagcaattcagaagtttatacaaggaactgttgctgatagtgcaccagtagtacctatttcagcacaattgaagtataatattgatgttgtgtgtgagtacattgtgaaaaagatcccaatccctgaacggaacttcatttccccacctaatatgatagtaattcggtcatttgatgtcaataaacctggctatgaggttgatgaaataaaaggaggcgtagctggtggaagtattctgaggggtgttttaagggtcaaccaattcatcgaagttcgacctggaatagttgttaaagacgagagtggaaatatccgatgcacaccgatctattccagaatagtttcactatttgctgaacaaaatgaacttcaatttgcagttcctggaggcctaattggtgttggaacaacaatggatcccactttgacacgggctgacaggttggtagggcaagttctcggagaggttggatcactgcctgatgtttttgtggaacttgaggtaaactttttcttgcttcgacggcttcttggtgtccggacaaaaggttctgagagacaaggaaaggtctcaaagctggcaaaagcagaaatgctaatgttgaacataggatcaatgtcaacaggtgccagagtggttgctgtgaagaatgacttggcaaagttgcaacttacgtcccctgtgtgcaccagcaagggtgagaagattgctctaagtagacgtgttgagaagcattggcgtctcatcggttggggacaaatccaagctggtatcacccttgaagtccctcctgccccccttctgagttgaaggaaatacagatcaagagaaagactacaagaaacagcttttataaaaacctgagattaatttagtaggtatgtcggaagggaaaaactgttgggaaccatttttgtgagatgtagaagattgtcaattttttttgttttcacattgttgttgttggttacctattgttgaaattgtattttatgctgattgagtttagaatgcgagcaaatgtctcagccatcacttgttttcattcattggtcaccttaccaataatttgtccagcaatcttgctatacagtactgtaaacaacttatccaaacaattgttgaaaatttgaagactggtacactttgtctgtcccttgttattcctatcctcttgcagtaatggagaatgtgttcacaaggctgtacgaacctctagaggtataatttttggcacgtttactagacacaacgtttcagtagggaaaacatgtttactatgaatacatggttatatgaatgtctattcaggccacccaaacgaatttagaattataaatgatgtttcttatggcaaa

SEQ ID NO: 2425 - DNA, 1806 bp, Phalaenopsis aphrodite
cctcctctctctgccccaaaccctcgtatctccctccccttctctgcgtttcgtccaaaaccatattcttcgtgaccgaaccctagcgatacagtcgcaataggagctagctgggaactcaacgacgggatcgtggcttacagcaacccgaaactcccatttttctccttcttccgctcctctcctacccgaaaccattgaggaaggtgttaggtttaaactataattgcaatcatgtctcgcaaaggactaatggagcaagacttgagtaagctggatgtggcaaaattgcatccattatcaccagaagtcatttccagacaagctactataaatataggtaccattggtcacgtggcccatgggaagtcaactgttgtaaaggccatatctggtgttcagaccgttcgttttaaaaatgaactggaacgcaacattacgatcaaactcggatatgcaaatgcgaagatctataaatgtgaagacgaaaaatgtccaaggcccatgtgctacaaagcgtatgggagcgggaaagaggacggccctctatgtgatgttcctggttttgaaaatgccaggatgaagcttttaagacacgtctcttttgttgattgcccgggtcatgatattcttatggcaacaatgcttaatggagctgcaatcatggatggggcattgcttctaattgcgggcaatgaaagctgccctcagcctcagacttccgaacatcttgccgcagtcgaaattatgcggttacagcacattattatcctacagaataagattgatctaattcaagaaagtgtggcgcttaatcaacatgaggccatacagaaatttatccagggcacaattgctgatggcgcgcctgttgtgccaatctctgcgcagttacggtataacatagacgttgtttgcgagtatcttgtcaacaaaatccccattccagtgagaaactttacgtcaccgccaaacatgattgtcattcgttcttttgatgtgaataagcctggttcagaagttgatgagattaaaggtggcgttgctggtggaagcattctttggggagtgctaaaggtgaatcagttcattgaggttcgtcccggcattgtcatgaaagatgaaaatggaaatataaaatgcactccaatttattctaggattgtatctctctttgccgagcaaaacgagctccaatttgcagtacccggcggacttattggcgtcggcaccacaatggatcctacactaacccgcgcagataggcttgttggtcaggttcttggtgaggtgaattccctccctgatgtctttgtggagctcgaggtcaacttcttcctgctgcgaagactgctgggcgtgaggacgaagggcgccgagaagcaaggtaaagtcgccaaattgacgaaaggggagatcctcatgcttaacattggatccatgtcgaccggagctcgagtcatcgccgtcaagaacgatctcgccaagctgcagctgacggctccggtgtgcacgagcaaaggcgagaaggttgcgctcagccggcgcgtcgagaagcactggcggctcatcggatggggccagatccaagccggggctaccctgcaagttcctgaggcccctaagaatctgtttggttgagtgaagagaggggaataatacaccaaatctttgtcataaggagaaaccatgtgggagggaagggagcttcttggaactatttttgtgaggtggagaagaaaacattttaaatttatttaattttttgtcgtagtttgttgtagtatttagtattactagtgtatg

SEQ ID NO: 2426 - DNA, 1613 bp, Amborella trichopoda
agcacagagagagcgctttgcatttgattttccagagggagagctttctattttccattgtagcaggcagagagaaagattctgggattagcagagagaggtggggcttttatcgctcaaagaaggcaacatcgaggaccagccgagtgagttgaatttcggtttttattaagttattcttgggtttagtggctgctgtcaagatgtcgagaaaagggttaatggaacaggacctaagtaagcttgatgtgacaaaattacatcctctctcgcctgaagtcatatcccgtcaagctacgattaatattggcacaattggtcatgtggcacatgggaaatcaactgtcgttaaagcaatatctggtgttcagactgttcgtttcaaaaatgaactggagcgtaatatcaccattaaactgggttatgccaatgctaagatatacaagtgtgaggatgaacgttgccctagaccaatgtgctacaaagcatatggaagtggaaaggaagatagccccttgtgtgatgttcctggatttgaaaatgctaggatgaaactcttaaggcatgtctcctttgtggactgtccgggtcatgatattcttatggccaccatgctgaatggagcagccatcatggatggcgcgttgcttttgattgctgccaatgaaagctgcccccagcctcagacttctgagcatcttgcggcagttgaaattatgcgactccaacatattatcattctacaaaataaaattgatttaatccaagagagtgttgccatcaaccagcatgaagcaatccagaagtttatccagaaaacaattgctgatggagctccagttgttccaatttctgcacaattgaagtataatgttgacgtagtgtgcgaatacctcataaataaaattccagttcccgaaagaaactttgttgacccacccaacatgatagtgatccgatcttttgatgttaataagcctggttctgaggttgaggagattaagggtggtgttgcaggtggaagtattttgaggggtgtgcttaaggtaaatcagaagattgaagttcggcctgggattgttgtgaaagatgagaacggaaacatgaaatgtactccgatttattcaaggatagtttctttatatgccgagcaaaacgagcttcaatttgcagttccaggtggtcttattggagttggtaccactatggatcccacgctgacccgagctgatcggcttgtgggtcaggtattgggagacattggttcactccccgatgtctttgttgagctcgaggtgaacttcttcctcctccgtcgtctcctcggtgtgaggaccaagggtacagagaagcaagggaaggtgtcaaaactgaccaaggctgagatactcatgctgaatataggttctatgtcgactggtgcaaaagtggtcgccgtgaaaaatgatttagctaagcttcagctgacctcacctgtttgcacaagtaaaggagagaaggtggccttgagtaggcgaatcgagaagcattggcgccttattggttggggtcagatccaggctggactcacactagacgttcctccttgcctcatctaagatagaaagaaagca

SEQ ID NO: 2427 - DNA, 1918 bp, Amborella trichopoda
taggaaggattggaattcaagtaagccctaacccatctgttgccgcactgaagctcaacccaatctaccattgccgctcggcccaccgaagctcaaccctgcaacttctatcctcctcgcccaaagttcgttctctccttgtcgctctagccatccaggaaccctaatctcttgttctgggcagaggataccggttttttgttggtgtttattatctgctgtcaagatgtcgcgtaaagggttgatggagcaggaccttagtaagcttgatgtgacaaaattgcatcctctctctccagaagtcatatctcgtcaagctacaattaatattggtacaattggtcatgtggcacatgggaaatcaactgttgttaaagcaatatctggagttcagactgttcgtttcaaaaatgaattggagcgtaatatcactattaagctgggctatgcaaatgccaagatatacaagtgtgaggatgaacgatgccctagaccaatgtgctacaaagcatatggaagtggaaaggaagatacccccttgtgtgacgttcctggatttgaaaatgctaggatgaaactcttaaggcatgtttcctttgtggactgcccgggtcatgatattcttatggccaccatgctcaatggagcagccatcatggatggtgcattgcttttgattgctgccaatgaaagctgcccccagcctcagacctctgagcatcttgcagccgttgaaattatgcgactccaacatattatcattctacaaaataaaattgatttaatccaagagagtgttgccatcaaccagcatgatgcaatccagaagtttatccagcaaacaattgctgatggagctccggttgttccaatttctgcacaattgaagtataatattgacgtagtgtgcgaataccttgtacataaaataccagttccagaaagaaacttcgttgcaccacccaacatgatagtgatccgctcttttgacgtgaataaacctggttctgaggtagaggagataaagggtggtgttgcaggtggaagtattttgagcggtgtgctgagggtaaatcagaagattgaagttcggcctgggatcgttgtgaaagatgagaatggaaacatgaaatgtaccccaatttattcaaggatagtctccttatttgccgagcaaaacgagcttcagtttgcagttccaggaggtcttattggagtaggtactacaatggatcccaccctgacccgtgctgatcgtctcgtgggtcaggtgctgggagaggttgggtcactccctgatgtctttgttgagctcgaggtcaacttcttcctcctccgccgccttcttggtgtgaggacaaagggcacagagaagcaagggaaggtgtcaaagttggccaaggcagagatactcatgctaaatataggttccatgtcgactggtgcaaaggtgttggctgtgaagaatgatttagcaaagcttcagctgacatcacctgtttgcacgagtaaaggagagaaggtggctttgagtaggcgaatcgagaagcattggcgccttattggatggggtcagattcaggctggagccacactagatgttcccccttgccccatatagagacagaaaacaaggtaaagaagaccgcaacttagagaagccgggagagttcagtgtgagatagagagcaatgtgggttgggagagaacttttagggactgtttttgtcagatggagaagaaaacctaagaactagcttaagttattgattttggttttgaggatttttgactgatttgagatttgattttaacatgggaatgccctacttgttttcacatatttttcttacaattcattgtacttctgtgtttatgtgattttttttcatgtgtgattttttttcatgtgataagg

SEQ ID NO: 2428 - DNA, 1725 bp, Centaurea maculosa
acctattgttgatgctgtagagatcattttcttcataatcaattgaagcataaaccctgatttcagaaaccctaaccgattcacgaggttgggtgttcacttagggtttttacaatttgttagattgaatagtgcaaagtctttaattgaacagcgaaaatgtctcgaaaaggtttaatggagcaggatttgagtaagctggatgtagcacagctacatccgctttctccggaggtcatatctcgccaggctacgattaatattggtactattggtcatgtggctcatggcaagtcaacagttgtaaaagcaatttctggtgtgcagactgtccgttttaaaaatgagttggagcgtaacattactattaagcttgggtatgcaaatgcgaagatctacaaatgtgaagatgagcggtgccctcgacctatgtgttacaaggcctatgggagtggcaaagaagatgctcctctctgcgatgtacctggatttgagaacagcaagatgacattgatgaggcatgtatcttttgttgactgcccgggacacgatattctcatggctactatgcttaatggagctgcaattatggatggagcgttgcttctcatagctgcaaatgaaagttgtccccaacctcagacttctgagcacttggctgctgttgaaattatgcgtctccagcatattatcattcttcagaataaggttgatctcattcaggagaatgtagcaattaaccaacacgaggcaattcagaaattcatccagggaactgttgctgatggtgcaccagtcatcccagtgtctgctcagcttaagtataatattgatgttgtatgcgaatacattataaagcggattcccattccagagaggaacttcatttcacctcctaatatgatagtaattcgatcatttgatgttaacaaacccggatctgaggttgatgagattagaggtggtgttgctggtggaagtatcctcaagggagtgttgaaggtaaaccaaaatattgaggtccgtccagggattgttgttaaagatgagagtggtaacatcaagtgcaccccaatatattctagaatagtttcattgtatgcggagcagaatgaacttcagtttgctgtacctggaggacttattggagttggaactacaatggaccctatgttgacacgtgctgatcggctggtaggacaggttcttggggaggtcggatctcttcctgatgtctatgttgaactagaggtgaacttctttcttttgcgtcggctgctgggtgtaaagacaaaaggaacggagaggcaagggaaggtgtcgaagctggcaaagggagaaattctgatgttgaacattggatccatgtctacaggggctcgtgttttggcagttaagaacgatctagcgaaactgcagctgacgtcaccagtgtgtacaagcaaaggtgagaagattgccctaagcaggagagtggagaagcactggcgtctgattggttggggacagattcaagcaggtctgactcttgaaatcccaccctgcccaatttagatttaagacctaccacccacacatttggattccagttttgcctgctgctgctgctgctctgcttgattcttatattctgatagatttggtagcatttgtgattttactactatcaaaacttgttttgaataggagctttgcatgtgctataaaccaatcaaaaggatacat

SEQ ID NO: 2429 - DNA, 2019 bp, Cicer arietinum
aagaagctaaaaagcatacaaaaataaaaatagagcagcatattgaatattacccgagtcgcagcaaccttaattggacactctaatcctgtcatcatcactaatcactatcaccttctctccggcaccacctgcttacacctctctccgtctttcaggtagtttagcagcaaacagtgttagatcataaattcaatccatcacgcaattgaagtttttattggaagcagccaaaatgtcgcggaagggtttgatggaacaagatctgagtaaattggacgtgacaaaattgcatccgctttctcctgaagtcatatctcggcaggctactattaatattggcaccataggtcatgtggcacatggcaaatcaacagttgtgaaagctatatcaggtgttcagactgtgcgttttaaaaatgagttggagcgtaacattacaatcaagcttggctatgcaaacgcaaaaatatacaagtgtgaagatgatcgatgtccaaggcctatgtgctacaaggcttatggaagtggaaaagaagataatcctttgtgtgatgtgccagggtttgaaaactgcaagatgaaattgctgagacacgtttcttttgttgattgcccaggtcatgatattctcatggctacaatgcttaatggagcagcaatcatggatggagctttgctactcatagctgctaatgaaagctgtccacaaccacaaacctctgagcatttagctgctgtggaaattatgcgtcttcagcacatgataatccttcagaacaaggtagacctaattcaagagaatgtggctatcaatcagcatgaagcaattcagaagtttatacaaggaacggttgctgatggtgcaccagtggtacctatttcagcccaattgaaatataatatcgatgttgtgtgtgagtatatcgtgaagaagatcccaatccctgaaaggaactttatctctccacctaatatgatagtaattcggtcctttgatgtcaataaacctggttttgaggttgatgaaataaaaggaggcgtagctggtggaagcattctgaggggtgttttgagggtcaaccaattcattgaagttcgacctgggatagttgttaaagacgaaagcggaaatattaaatgcacacccatatactctagaatagtttcattgtatgctgaacaaaatgagcttcaatttgctgtgccaggaggcctaattggtgttgggacaacaatggatcccactttaacgcgtgctgacaggttggtagggcaagttcttggagaggttggatcactgccagatgtttttgttgatcttgaggtgaactttttcttgcttcgacggcttcttggtgtccgaacaaaagggtctgagagacaaggaaaggtatcaaagctggccaaaggagaaatgctgatgttgaacataggatcaatgtcaacaggtgccagagtaattgctgtgaagaatgacttggcaaaattgcaacttacatctcctgtgtgcactagcaagggtgagaagattgcactgagtcgacgtgtcgaaaagcattggcgtcttattgggtggggtcaaatccaagctggaattactctctacgtccctcctgcacccatcttgagttgaagacagacaagaacgagaagagaaaagaaaagaagagacagactataagaaaacgccttttttttttataaaatcacgagatgaatttagatatgtgggaagggagacaatttttgggaaccatttttgtaaggtggagaagaaaacatttggattatcaagttttgttttcgcagtgtgatttacttgttattttccctactgttaacctatttttgaagttgtatttaatgatgattgcgtttagatggagagcatgtgttcactgttcaaaaattataattttcactgtgattcatcaaagctacaaacagtagcttcaatttgttgcacctttaatatattttatagtgaagcattccatgccctactggctactgatg

SEQ ID NO: 2430 - DNA, 1864 bp, Cichorium intybus
tggacaaataaaacggggttgccaagtcccagtatgtcatgtgcgacgtcaatactgcttttctagtttgctatagaaccctgaaaccctagcaacgttactgctcaatattatcgccttagccaccgcaccaccaccagtcgtctaacgatcaaagaatctctacgccgtctcggcgattcggtacttcctcactcaaaggttgcgtgttgagttagggttttacaattttgtgaggtcgaatagtgcaaagtttttgaagaacagcgaaaatgtctcgaaaaggtttaatggagcaggatttgagcaagctggatgtgacgaaactacatccgctctcaccggaggttatttctcgccaggctacaatcaatatcggtactattggtcatgtggctcatggcaagtcaacagttgtgaaagcaatatctggtgttcagactgttcgttttaaaaacgagttggagcgtaacattactatcaagctcgggtatgccaatgcaaagatctacaaatgtgaagatgacaggtgtcctcgacctatgtgttacaaggcctatggaagtgggaaagaagacagccctctttgtgatgtccctggatttgaaaacagcaagatgacattgatgagacatgtatcatttgttgattgcccaggacatgacattctcatggctaccatgcttaatggagctgcaatcatggatggagcattacttctcatagctgcaaatgaaagctgtccacaacctcaaacttctgaacacttggctgctgttgaaatcatgaggctgcaacatattataattcttcaaaataaggttgatttgattcaagaaaatgtagctatcaatcaacacgaggcaattcagaagtttatccagggaactgttgctgatggtgcaccagtcattccagtgtctgctcagcttaagtataacattgatgtggtgtgtgaatacataataaagcggattccaattccagaaagaaacttcatttcacctccaaatatgattgtgattcggtcttttgatgttaataaacctggttctgaagttgatgaaattagaggtggtgttgctggtggaagtatcctcaagggtgtgttgaaggtaaaccaattcattgaagtccgtcccggaatcgttgtgaaagacgaaagtggcaacataaaatgcaccccaatatattccagaattgtttctttatacgcagaacaaaacgagcttcaattcgctgtacctggtggccttattggagtggggaccacaatggaccccatgttgacccgtgctgaccggttggtcgggcaggttcttggtgaagtcgggtcacttcccgatgtctatgtcgaactagaggtgaacttttttctgttgaggcggttgttgggagtgaagacgaaaggaacagagaggcaagggaaggtgtctaaattgtcaaaggcggaaatactgatgttgaatatcgggtcgatgtcgactggggcccgcgtgttggcggttaagaatgacctggcgaaactgcagctgacgtcaccggtgtgtacgagtaaaggtgagaagattgcgctgagtaggagagtggagaagcattggcgtttgattggttggggacagattcaagcggggctgactcttgagatcccgccttgcccgatttaaatcgtataatttgggattgttcttcagttttgctgcggtggtactagttgattcttgttatctggtttggtttagtttttggttagaaatttgtgatttgtgactgtgtgtcattgacttgtgttgacgtacaactttggatggtgtttcaagagaggatcataagacatgtttgtgccttttgttcgtctttatgt

SEQ ID NO: 2431 - DNA, 1741 bp, Cichorium intybus
gccaccgcaccaccaccagtcgtctaacgatcaaagaatctctacgccgtctcggcgattcggtacttcctcactcaaaggttgcgtgttgagttagggttttacaattttgtgaggtcgaatagtgcaaagtttttgaagaacagcgaaaatgtctcgaaaaggtttaatggagcaggatttgagcaagctggatgtgacgaaactacatccgctctcaccggaggttatttctcgccaggctacaatcaatatcggtactattggtcatgtggctcatggcaagtcaacagttgtgaaagcaatatctggtgttcagactgttcggtttaaaaacgagttggagcgtaacattactatcaagctcgggtatgccaatgcaaagatctacaaatgtgaagatgacaggtgtcctcgacctatgtgttacaaggcctatggaagtgggaaagaagacagtcctctttgtgatgtccctggatttgagaatgcaaagatgacattgatgagacatgtgtcatttgttgattgccctggacacgatattctcatggctactatgcttaatggagctgcaatcatggatggagcattacttctgatagctgcaaatgaaagctgtccacaacctcaaacttctgaacacttggctgctgttgaaatcatgaggctgcaacatattataattcttcaaaataaggttgatttgattcaagaaaatgtagctatcaatcaacacgaggcaattcagaagtttatccagggaactgttgctgatggtgcaccagtcattccagtgtctgctcagcttaagtataacattgatgtggtgtgtgaatacataataaagaggattccaattccagaaagaaacttcatttcacctccaaatatgattgtgattcggtcttttgatgttaataagcctggttctgaagttgatgaaattagaggtggtgttgctggtggaagtatcctcaagggtgtgttgaaagtaaaccagttcatagaagtccgtccaggaattgttgtgaaagatgaaagtggcaacataaaatgcaccccaatatattccagaattgtttctttatacgcagaacaaaacgagcttcaatttgcggtacccggtggccttattggagtggggaccacaatggaccctatgttgacccgtgctgaccgtttggtcgggcaggttcttggtgaagtcgggtcacttcctgatgtttatgtcgaactagaggtgaacttttttctgttgaggcggttgttgggagtgaagacgaaaggaacagagagacaagggaaggtgtcgaaattgtcaaaggcggagatactgatgttgaatatcgggtcgatgtcgactggggcccgcgtgttggcggttaagaatgacctggcgaaactgcagctgacgtcaccggtgtgtacgagtaaaggtgagaagattgcgctgagtaggcgagtggagaagcattggcgtttgattggttggggacagattcaagcggggctgactcttgaaatcccgccttgcccgatttaaatcgtataatttgggattgttatccagttttggttcggtggtactacttgattcttgttatctggtttggtttagtttttggttagaatttgtgatttgtgactgtgtgtcattgacttgtgttgacgtacaactttggatggtgtttcaagagaggatcataagacatgtttgtgccttttgttctctttatgt

SEQ ID NO: 2432 - DNA, 1816 bp, Cichorium intybus
catgtgcgacgtcaatacttctttttctagtttgctatagaaccctgaaaccctagcaacgttactgctcaatattatcgccttagccaccgcaccaccaccagtcgtgtaacgatcaaagaatctctacgccgtctcggcgattcggtacttcctcactcaaaggttgcgtgttgagttagggttttacaattttgtgaggtcgaatagtgcaaagtttttgaagaacagcgaaaatgtctcgaaaaggtttaatggagcaggatttgagcaagctggatgtgacgaaactacatccgctctcaccggaggttatttctcgccaggctacaatcaatatcggtactattggtcatgtggctcatggcaagtcaacagttgtgaaagcaatatctggtgtgcagactgttcgttttaaaaacgagttggagcgtaacattactatcaagctcgggtatgccaatgcaaagatctacaaatgtgaagatgacaggtgtcctcgacctatgtgttacaaggcctatggaagtgggaaagaagacagccctctttgtgatgtccctggatttgaaaacagcaagatgacattgatgagacatgtatcatttgttgattgcccaggacacgatattctcatggctaccatgcttaatggagctgcaatcatggatggagcattacttctcatagctgcaaatgaaagctgtccacaacctcaaacttctgaacacttggctgctgttgaaatcatgaggcttcaacatattataattcttcaaaataaggttgatttgattcaagaaaatgtagccattaatcaacacgaggcaattcagaagtttatccagggaactgttgctgatggtgcaccagtcattccagtgtctgctcagcttaagtataacattgatgtggtgtgtgaatacataataaagcggattccaattccagaaagaaacttcatttcacctccaaatatgattgtgattcggtcttttgatgttaataaacctggttctgaagttgatgaaattagaggtggtgttgctggtggaagtatcctcaagggtgtgttgaaggtaaaccagtttatcgaagtccgtcccggaatcgttgtgaaagacgaaagtgggaacataaaatgcaccccaatatattccagaattgtttctttatacgcagaacaaaacgagcttcaattcgctgtacccggtggtcttatcggagtggggaccacaatggaccccatgttgacccgtgctgaccgattggtcgggcaggttcttggtgaagtcgggtcacttcccgatgtttatgtcgaactagaggtgaacttttttctgttgaggcggttgttgggagtgaagacgaaaggaacagagagacaagggaaggtgtcgaaattgtcaaaggcggaaatactgatgttgaatatcgggtcgatgtcgactggggcccgcgtgttggcggttaagaatgacctggcgaaactgcagctgacgtcaccggtgtgtacgagtaaaggtgagaagattgcgctgagtaggcgagtggagaagcattggcgtttgattggttggggacagattcaagcggggctgactcttgaaatcccgccttgcccgatttaaatcgtataatttggaattgttatccagttttgctgcggtggtactacttgattcttgttatcttgtttggtttagtttttggttagaatttgtgatttgtgactgtgtgtcattgacttgtgttgacgtacaactttggatggtgtttcaagagaggatcataagacatgtttgtgccttttgtt

SEQ ID NO: 2433 - DNA, 3582 bp, Cirsium arvense
cttcccttttcacttacatccagttcagctgcttcagccgcatcttcttccctctattcagcccgaactgaatcaacacagccgacctattgttgatgctgtagagatcattttcttcataatcaattgaagcataaaccctgatttcagaaaccctaacccattcacgaggtttgggtgttcacttagggtttttacaatttgttagattgaatagtgcaaagtctttaattgaacagcgaaaatgtctcgaaaaggtttaatggagcaggatttgagtaagctggatgtggcacagctacatccgctttctccggaggtcatatctcgccaggctacgattaatattggtactattggtcatgtggctcatggcaagtcaacagttgtaaaagcaatttctggtgtgcagactgttcgttttaaaaatgagttggagcgtaacattactattaagcttgggtatgcaaatgcaaagatctacaaatgtgaagatgagcggtgccctcgacctatgtgttacaaggcctatgggagtggcaaagaagatgctcctctctgcgatgtacctggatttgagaacagcaagatgacattgatgaggcatgtatcttttgttgactgtccgggacacgatattctcatggctactatgcttaatggagctgcaattatggatggagcgttgcttctcatagctgcaaatgaaagttgtccccaacctcagacttctgagcatttggctgctgttgaaattatgcgtctccagcatattatcattcttcagaataaggttgatctcattcaggagaatgtagcaattaaccaacatgaggcaattcagaaatttatccagggaactgttgctgatggtgcaccagtcatcccagtgtctgctcagcttaagtataatattgatgttgtatgcgaatacattataaaacggattcccattccagagaggaacttcatttcacctcctaatatgatagtaattcgatcatttgatgttaacaaacctggatctgaggttgatgagattagaggtggtgttgctggtggaagtatcctcaagggagtgttgaaggtaaaccaaaatattgaggtccgccccgggattgttgtgaaagatgagagtggcaacatcaagtgcaccccgatatattctagaatagtttcgttatacgcggagcagaatgaacttcagtttgctgtacctggtgggcttattggagttggaacaacaatggaccctatgttgacacgtgctgatcggctggtaggacaggttcttggggaggtcggatctcttcctgatgtctatgttgaactagaggtgaacttctttcttttgcgtcggctgctgggtgtaaagacaaaaggaacggagaggcaagggaaggtgtcgaagctggcaaagggagaaattctgatgttgaacattggatccatgtctacaggggctcgtgttttggcagttaagaacgatctagcgaaactgcagctgacgtcaccagtgtgtacaagcaaaggtgagaagattgccctaagcaggagagtggagaagcactggcgtctgattggttggggacagattcaagcaggtctgactcttgaaatcccaccttgcccaatttagatttaagacctaccacccacacatttggattccagttttgcctgctgctgctgcttctgcttctgcttgattcttatattctgatagatttggtagcatttgtgatttttactactatcaaaatttgttttgaagaggagctttgcatgtgctataaaccaatcgaaaggatacatgtacctttccccttcccctttctttcttgtggaaaattgagattgtgctacctactgtgtactcgtcccacaaccatcataagagagaattgcggtgtgactttggtgtggaaactccattgctttacaccgagacctttgcttttcttctttgacgttattgtccttgattgttgaagaagacatgaaattgaaaaaagaaaaaaataccgaagtgaactattatttaggacggacttaatacttacataaaccacaacatcatcaacaacttgtcaatccttgtgcctccttaccatcatgaatcacttacagaaagatacaacactgctagcaccaccttcaacaaaacatacacttcaagtcgaaccaacatggatgattttcgaggtttttacacgtgtgctagctttctcttcgattcccaaccatttccgtaagtatagaaatactgtttcatctcttagtagtgctcggtgagcaccaggaattcccgctctttctatagcagcaaatccatccgccattgcagactcagcggggactgttccatctccatccacatatgagtattcgggcaatgtatggcatatctcagatgggtctttgattggatcggtttctgaaccataacaaacgtcaaatggggtctcgattgatgttccatagatgttgtaaaaaggaatcccttcgggaagcttcacgctgttgagcatcttgcgtgtagtagaagcccattcgtatatagaagaattgaatggtaaaggtatactcttcttgttatactctagctcattgtctttcaatgcttctacaaacaggtccacactcccagatggatcataagattccagtttgaccgaatcttctccattttctgaatagtttctccaaaccacaatttcaggttgctttttccatttgaattcggggttaggtagcatctcgtaaatcgaagggcattcaaccaacagttgatgcatagaccatctcgacacaaagaagtagctttcaagtccttccacaaactgtaatccggttaacaaagaatcattgatgcatccgggtgcaccttggaaaggggttgcgatagttatccactttttcacatacttggagaacacatcagaatggagtgatatgaaacacgacactagcaatccacccatcgagtgtgatataaggttgacctttctaccccccgcagctttatatgcagtctccaacttttccttgaggccatccatcgcttggtcaattctattgctttgtcggaaatcatatccaaatccaaacaatgtggttcctttcttgtatccacacttaacaagcatatcgatcatgtcatgaaaatggtacacatccgtcacgtgtaaacattttatccaaaatgaaggatccaaaatatcaatcgcataaagtccataatcatcttgtgggaccacgatatcagaactatcatccaatgcttctgtatagccagtgtcgggattgtaaagtgataagactttatttcgaaactccaaatcagcaagaagaatgcggacccaaacccgggtggtgagtccgaaccaactctttggctttgagttaagaatagtcccgccaattccactcacaagaactatcgggtcaagatcagccgcatcgtcaccggagctccggcagccgccgaagcaccaccatttcccacccaccatttcttacttaattggtttttcttttggtagaaatgtagcacgttgtttggttggtaggtagttggag

SEQ ID NO: 2434 - DNA, 2253 bp, Prunus mume
tggagtctacttctcatcgggcttggataacctatataatattgggcccgatccacccaaagaaaggacccgtgacccgattgagtaagaaattaaagaaaagcgctctcatccttttgcctggacggacagaactatcaaccagcgaatttctcttaaacctgtgcggctgcgttctctctatcgctcaacaaaaccctcgctcactctcatcatcttgcccagtttgtcactcttgataccatccagttgttagctgattacttatttgagccggaggatccagtaaaagctgtcaaaatgtcgaggaagggtttgatggagcaagacctgagtaaactggatgtaacaaagttacatccactgtcgcctgaagttatatctcgccaggcgactatcaatattggtactataggtcatgtggctcatggaaagtcaacagttgtaaaagcaatatctggtgttcagactgttcgttttaaaaatgagctggagcgcaacattactatcaagcttggatatgccaatgcaaaaatatacatgtgtgaagatgagcggtgccctcgacctatgagctacaaggcatatggaagtggaaaggaagacactcctctctgtgatgttcctggatttgagaactgcaggatgaaactgttgagacacgtatcttttgtagattgcccgggtcacgatattcttatggctactatgcttaatggtgccgccattatggatggagccttacttctcatagctgctaacgaaagctgtccccaaccacaaacttctgagcatctggctgctgttgaaattatgcgtctgcaacatattattatccttcaaaataaagttgacctcattcaggagaatgtggccatcaatcagcatgaggcaatccgaaagtttattcagggaactgtagctgataatgcaccagtggtcccaatttctgctcagttgaagtataatattgatgttgtttgcgagtacattgtcaaaaagatccccattccagaaaggaattttatctcacctcccaatatgattgttatccgttcttttgatgtcaataaacctgggtttgaggtcgatgagataagaggtggagtggctggtggaagcatcctcaggggtgtcttgaaagtgaaccaatatattgaggttcgtcctgggattgttgttaaggacgagagtggaaacataaaatgcacgccaatatattctagaatagtttcattgtatgctgagcaaaatgagttgcaatttgcggttccaggaggtctcattggcgttggaacgaccatggatcctactttgacacgtgctgataggctagtgggtcaagttcttggtgaagttggatctctccctgaagtatttgttgagcttgaggtgaacttcttcctgttgagaaggcttctaggggtcaggacaaagggatcggagaagcaaggaaaggtctcaaagctggccaagggtgagatcctgatgttgaatataggatccatgtctacaggggctaaggttattgctgtaaggaatgatttggcaaagctgcaactcacctctccagtgtgcaccagcagaggagagaaaattgcactcagtcggcgagttgagaagcattggcgtcttattgggtggggcacgattcaagctggaacaacccttgatgtcccaccctccccaatttgattagaccccgcaaattggtaagacagaaagcaagaaaaccactaagacagctaaagagtagggaagatgtgggaaggcaggcaattactgggaaccatttttgtcagatggaggagaaaacattgtttggataattgtgttttctgttttgtttctttgacttttgataaaatcatactttcatctgcattcgtattcttcgagttttggacccgactcattccaacaggtgagggaatgattgatggttatgttgtctcttccagaaaatattgtgttcttaattcgatgaagttttgagtttgatttggaccttattagaaattagtgatcgccagcatctttaggagggtaattaggcattactgttcatgctggttgatttgatttgagtgccgttcaacattaggcttctgcctagactgttttagctcttttaatatctcagattcagaaattttctcttttgaccaacatgaagctggactcgatccggtgaagttacatcaaatagtctctaggcagaaatctcgactgaataaaaatattaaatctaaa

SEQ ID NO: 2435 - DNA, 1760 bp, Prunus persica
gacagacagaactatcaaccagcgaatttctcttaaacctgtgcggctgcgttctctctatcgttcgacaaaaccctcgctcactctcatcatcttgcgcagtttgtcactcttgataccatccagttgttagctgattacttatttgagccggaggatccagtaaaagcagtcaaaatgtcgaggaagggtttgatggagcaagacctgagtaaactggatgtaacaaagttacatccactgtcgcctgaagttatatctcgccaggcgactatcaatattggtactataggtcatgtggctcatggaaagtcaacagttgtaaaagcaatatctggtgttcagactgttcgttttaaaaatgagctggagcgcaacattactatcaagcttggatatgccaatgcaaaaatatacatgtgtgaagatgagcggtgccctcgacctatgagctacaaggcatatggaagtggaaaggaagacactcctctctgtgatgttcctggatttgagaactgcaggatgaaactgttgagacacgtatcttttgtagattgcccgggtcacgatattcttatggctactatgcttaatggtgccgccattatggatggagccttacttctcatagctgctaacgaaagctgtccccaaccacaaacttctgagcatctggctgctgttgaaattatgcgtctgcaacatattattatccttcaaaataaagttgacctgattcaggagaatgtggccatcaatcaacatgaggcaatccggaagtttattcagggaactgtagctgataatgcaccagtggtcccaatttctgctcagttgaagtataatattgatgttgtttgtgagtacatcgtcaaaaagatccccattccagaaaggaactttatctcacctcccaatatgattgttatccgttcttttgatgtcaataaacctgggtttgaggtcgatgagataagaggtggagtggctggtggaagcatcctcaggggtgtcttgaaagtgaaccaatacatcgaggttcgtcctgggattgttgttaaggacgagagtggaaacataaaatgcacaccaatatattctagaatagtttcattgtatgctgagcaaaatgagttgcaatttgcggttccaggaggtctcattggcgttggaacgaccatggatcctactttgacacgtgctgataggctagtgggtcaagtacttggtgaagttggatctctccctgaagtatttgttgagcttgaggtgaacttcttcctgttgagaaggcttctaggggtcaggacaaagggatcggagaagcaaggaaaggtctcaaagctggccaagggtgagatcctgatgttgaatataggatccatgtctacaggggctaaggttattgctgtaaggaatgatttagcaaagctgcaactcacctctccagtgtgcaccagcagaggagagaaaattgcactcagtcggcgagttgagaagcattggcgtcttattgggtggggcacgattcaagctggaacaacccttgatgtcccaccctccccaatttgattagaccccacaaattggtaagacagaaagcaagaaaaccactaagacagctaaagagtagggaagatgtgggaaggcaggcaattattgggaaccatttttgtcagatggaggagaaaacattgtttggataattgagttttctgttttgtttctttgacttttgataaaatcatactttcatctgc

SEQ ID NO: 2436 - DNA, 1595 bp, Helianthus annuus
tctaacgatcaccgaatctctataacatcttagcggttcggtgattcctcacttcaggttgtgtgttattgtgttaatctaaggtttttttaacaagttttggttccgaatagtgcgaaattgttgaagaagagtgataatatggcgcgaaaaggtttaatggagcaggatttgagcaagctggatgtagcgacgctgcatccgctttctccggaggttatatctcgccaggctacgataaatattggtactattggtcatgtggctcatggaaaatcaacagttgtaaaagccatatctggtgtgcagactgttcgatttaaaaatgaattggaacgtaacattaccattaagcttgggtatgccaatgcaaagatatacaaatgtgaagatgaaaagtgtcctcgacccatgtgttacaaagcctatggaagtgggaaagaagatagccctccttgtgacgtgcctggatttgagaacagcaagatgaagttggtgaggcatgtttcttttgttgactgtccgggacatgatattctcatggctactatgcttaatggagctgcaatcatggatggagcattacttctcatagccgcaaacgaaagctgtccccaacctcaaacttctgaacacttggctgctgtggaaattatgaggctccaacatatcataatccttcaaaataaggttgatctaattcaagaaaatgtagccattaatcagcacgaggcaattcagaaattcattcagggaacggttgctgatggtgcaccagtcatcccagtgtctgctcagcttaggtataatattgatgttgtttgcgaatacataatcaagcggattcccattccagagagaaacttcatatcacctccaaacatgatagtaatccgttcatttgacgttaacaaacctggatctgaggttgacgagatcagaggtggtgttgctggtggaagtattctcaagggtgtgttgaaggtaaatcagaatatcgaggtccgtccagggattgttgttaaagacgagagtggcaacatcaagtgcaccccgatttactctagaatagtgtcgctatatgcagagcagaatgagcttcaatatgctgtacctggaggtcttattggagttggaacaacaatggaccctatgttgacccgtgctgatcggttggtgggtcaggttcttggtgaagtcgggtctcttcccgatgtttatgtcgaactagaggtgaacttttttcttttgcgtcggctgctgggtgtgaagacaaaaggaacagaaaagcagggtaaggtatcaaagctgtcgaaggcagaaatactgatgcttaacataggatctatgtctacgggggcgcgtgttttggcggtcaagaatgatttagcaaaactgcagctgacatcgcccgtgtgtactagcaaaggcgagaagatcgctctgagcaggagagttgagaagcattggcgactgatcggttggggacagattcaagcgggtctaactcttgaaatcccaccttgccctatttaaacacacatttggattccagttttgcctttactttattcttaatttttatttcttggttt

SEQ ID NO: 2437 - DNA, 1808 bp, Tabernaemontana elegans
cgagctccctctccttgtctcgcctacctccaagaaaaaacctttctcctctctcaagctccgcaagaaccctagtgaaatctaatttattaacatcaagagtgagaaaggaacaaccaaaatgtctcgaaaagggttgatggagcaggatctaagtaagctggatgtaacacaattgcatccactctcacctgaagttatttctcgtcaggccacaattaatattggcacgattggtcatgtggcacatggcaaatctactgttgtgaaagccatctctggtgtgcagactgttcgtttcaagaatgagctggaacgtaatattaccataaagcttggttatgccaatgcaaagatatacaagtgtgacgatgaacgttgccctcggcccatgtgctataaggcttatggaagtggaaaagaagatagcccaatgtgtgatgtacctggttttgagaattgccggatgaaattgttgagacacgtttcttttgttgattgtccaggtcatgatattctcatggctacaatgctcaatggagctgcaattatggatggagctttactacttatagctgccaatgaaagttgtccacaacctcagacatctgaacatttagctgctgttgagattatgcgtctccaacatattataattctccaaaataaggttgatcttgttcaggaaaatgtagccatcaatcagcatgaagccattcagaagtttatacagggaactgttgcagatggtgcaccagttataccaatttctgcacaactgaagtataacattgatgttgtttgtgaatacattgtgaaaaagattcctattccagagaggaacttcatttcaccaccaaacatgattgttatccgatcttttgatgtcaacaagccaggatttgaggtagatgagattagaggtggtgttgctggtggaagcatacttaagggggtcttgaaagtaaatcagtacattgaggttcgtcctggcattgttgtcaaggatgagaatggcaacataaaatgtactccaatatattctagaatagtttcattgtatgccgagcaaaatgaactacaatttgcagtcccaggaggccttattggagttggtacgactatggacccaacactgactcgtgctgatcgattggttggacaagttcttggggaggttgggtcattgcccgaagtttttgttgaactggaggtgaacttcttcctactgaggcgacttcttggtgttaggacaaaagacaccgaaaggcagggtaaagtctcaaagctagcaaagggtgagatccttatgttgaacataggatccatgtcaacaggggctcgcgttgttgctgtcaagaatgtgtttgcaaaactgcaattgacatctccagtatgcaccagcaagggggagaaaatagcactcagcagaaggattgagaagcactggcgacttattggttgggggcaaatccaagctggtattactcttgatgtcccaccctgccccatctgagtgaagtgaacaaatttgattacaaaggaaacagagaagaaaagtactgaaacaagaaaaagaaaagctaggcattagatgtggaagggcagacaactgttgggaacaatttttgtacgctggaggagaaaacatgtttcaaaattttggagacttttgttgcttgtgatgcatttgaccatccttcttttccatttgcaagagtttgtatcttatgctaattctttattagttggtccaacggtgattggatgttactctactattttagagcaaaaaccttattgggcga

SEQ ID NO: 2438 - DNA, 1694 bp, Eschscholzia californica
aagacattttcaatatggcgcggaaaggattaatggagcaggatctagctaaactggatgttacgaaattgcatccgctctcaccggaagttatttctcgtcaagccacaataaatattggtactattggtcacgtcgctcatggaaaatctactgttgttaaagcaatatcaggtgtccagactgtgcggttcaaaaatgagttggagcgtaacatcaccatcaagcttggatatgcaaatgcaaaaatatacaagtgtgaagaagagcgatgccctcggccttcgtgctacaaggcctatggcagtggaaaagaagacagtcctctctgtgatgtccccggatttgaaaatgcaagaatgaagctattgagacacgtgtctttcgttgattgtccaggacatgatattcttatggctactatgcttaatggagcagcaatcatggatggggcgttacttttgatagctgcgaacgagacttgtccacagcctcagacttctgagcatctagctgcagttgaaattatgcggctccaacatataatcattcttcagaataaagttgatcttattcaagaaaatgtagctatcaaccagcacgaagctattcaggagtttattaagaaaacagttgctgataatgcaccaatagtacccatttctgcacagttgaaatacaatattgatgtggtatgtgaatatattgtgaaaagataccaatcccagagaggaacttcatttcaccaccaaatatgattgtaatccgatctttcgacgttaataagcctggttcagaggttgatgaaataaagggtggtgttgctggtggaagtatactcaggggtgttctgaaagttaatcaattcattgaggtcaggcctggaattgttgtaaaagatgaaactggaaacatcaagtgtactccaatatactcaaggatcgtgtcactatacgctgagcaaaatgagctgcaatttgctgtacctgggggtcttattggtgttggtaccaccatggatcccactttgacaagggcggatagacttgtaggccaagttcttggggaggttggctcacttcctgatgtttttgttgaacttgaggtgaactttttccttcttcgacgacttctaggagtccgaacaaagggtacagaaaggcaaggaaaagtgtcaaagctgacaaaggctgagatcttgatgttgaatatcggttctatgtccacaggagctcgagttattgctgttaagaacgatcttgctaaacttcaactcacttcacctgtttgcactagcaaaggagagaagattgcccttagccggcgagttgaaaagcattggcgtctcattgggtggggacagattcaagcaggtaccaccctcgaagttccaccttgccctatttgagtagaacttgcataaagcaaaaaccagaaagagaaaaagaaaaacagtacttgtatcagaaacagaagttgagaagatgtggaaagggagggaattggtaggaacaatttttgttagatggagaagaaaacatggatgcatgattcgtatttcgttgtttgcttctttattaaatctcatcagattgaaatcattgaatgatgttttgggttcctgagttcgagaatttcgatatttgacattcttatgcttgttaatcgacttattctatacatgtggtacgtgg

SEQ ID NO: 2439 - DNA, 2194 bp, Cycas rumphii
tggggctttacgcttctcttctcttcttccattcggtctcattttgccgatatctctaagttgagcaccacatttcaccaaaacagcagcacagcagtagagaaagaagaggaagcggtaaaggaggtggtagtggtggttacatcccatcttgatctgtaacgctaactgtgagttgaagaattgtgacagatctgtgcagttttggctatatcggtcttcagcttgaagcctacagagtttgtgagtcaatttcaacaaacaatcaagatgtcgagaagagggttaatggagcaggatctaagtaagctggatgtgacaaagctgcatccgctttctccagaggtcatatctcgtcaggctaccataaacattggtaccattggccatgtggcacatgggaaatcaacagtggttaaagcaatatctggcgtacagacagttcgtttcaagaatgaattagagcgtaacatcacaatcaagttgggatatgcaaatgctaagatatacaaatgtgaggatgatcgttgcccccgaccaatgtgttacaaggcatatggaagtggaaaggaggacagccctttgtgtgatgttcctggatttgagaacactcggatgaagcttttaagacacgtgtcatttgttgattgcccaggtcatgatattctcatggccaccatgctcaatggtgcggctattatggatggagcacagcttctgattgcaagcaatgagagctgtcctcagccacaaacttcagaacatcttgctgctgttgagattatgcgtcttcagcatataatcattttacaaaataaaattgatttgatccaggagagtgtagctatcaaccagcatgaggcaattcagaagtttattcagggcaccattgctgatggagcacctgtagtgccaatatctgcacaattaaaatacaacattgatgtagtctgtgaatacataacaaacaagattcctatcccagagcggaattttgttgcacccccgaacatgattgtgatcaggtcttttgatgtgaataagcctggtgctgaagttgatgaaataaaggggggagtagctggtggaagtatactcaggggtgtgttgagagtgaatcaaaaaattgaagtccgtcctggaattgttgtcaaagatgagagtggcaatatcaagtgtacacccatcttttcaaggataatttcactttatgctgagcaaaatgagttgcagtttgctgttcctggaggccttattggtgtgggtaccacaattgatcctacactcacacgggctgacaggcttgttggacaagtccttggagaagttggagaacttccggatgtatttgttgagcttgaggttaactttttccttcttcgacgcctccttggggtcaggacaaagggtacagaaaaacaggggaaggtttcaaaattgtccaagggagaagttttgatgcttaatattggttcaatgtcaactggagctcgggtacttgctgtgaaaaatgaccttgctaaactccagcttacctctcctgtctgcacaagtaaaggtgaaaagatggctcttagcagacgagtagaaaagcattggcgtttgatagggtggggtcaaattcaagctggagttatgctggacatcccccaagggtccatataaactagtaaatagaatatatttgatcaaaaagaagcagaggagaattttagtaagggagaatgtggattggaagagagttactaggaactatttttgtaagatggagaagaaaacctactcggtttttgttatttcagttgttgctgtaaaatcattattaaattgagcagctagctcctgtgtctgttcttgttatctgcttaaattgtcatttgagggttaaatttgtctgttaactatgcttttaggacagaggggggggggggggggggggggggggggggggggggggggggggggggggggggggggggggggggggggggggggggggggggggggggcctactaggtggttatcaggtacctatttttaaaagcagcttagattttaatattcttgcacacctgcataggaagtggataaggaatttcatattctgacacccagtgacagaaacatatgtgtccattcagcaaggtctaaagcgaagaaacaattggacagatgtttacataatcaagacca

SEQ ID NO: 2440 - DNA, 1797 bp, Amsonia hubrichtii
acacaccaccaaagccactgtgtctgtctctccgtcttccactccttctaggttcaaagacagccaccgccgctcgccggttcgttcctctcttcacggcgctttctgtcccaggtctgttcgtcatagagccagtctctcttcactgaattttgtaaatcttaggttttttttttgtcgaagccaaaagaaactaaggagcagccaaaatgtctcgaaaagggttgatggagcaggatctaagcaagctagatgtaacacaactgcatccactttcaccagaagttatttctcgtcaggcaacaattaatattggcacgattggtcatgtggcacatggcaagtccactgttgtgaaagccatctctggtgttcagactgttcgtttcaagaatgagttggaacgtaatattaccataaagcttggttatgccaatgcaaagatatacaaatgtgaggatgaacgttgccctcgacccatgtgttataaggcttatggaagtggaaaagaagatagcccaatgtgtgatgtacctgggttcgagaattgccggatgaaattgttgagacatgtttcttttgttgattgtcccggtcatgatattcttatggctacaatgcttaatggagctgcaattatggatggagctttacttcttatagctgccaatgaaagttgtccacaacctcagacgtctgaacatttagctgctgttgagattatgcgtctccaacatattataattcttcaaaacaaagttgatctagttcaggaaaatgtggccatcaatcaacatgaagccattcagaagtttatacagggaactgttgcagatgctgcaccagtcgtaccaatttctgcacagctgaagtataacattgatgttgtttgtgaatacattgtgaaaaagattcctgttccagagaggaacttcatttcaccgccaaatatgattgttatccgatcttttgatgtcaataagccaggattcgaggtggatgagattaaaggtggcgttgctggtggaagcatacttaagggggttctcaaggtaaatcaaaaaattgaagttcgccctggcattgttgtcaaggatgagaatggcaacatcaaatgtactccaatatattctagaatagtttctttgtatgccgagcaaaatgaactgcaatttgcagtcccaggaggtcttattggagttggcacaactatggacccaacactgactcgtgctgatcgattggttggacaagttcttggggaggttgggtcattgcctgaagtttttgttgaactggaggtgaacttctttctattaaggcgactccttggtgtgaggacaaaggacactgaaaggcagggtaaagtctcaaagctagcaaagggtgagatccttatgttgaacataggatctatgtcaacgggggctcgtgttatagccgtcaagaatgtttttgcaaaactgcaactaacatcgcctgtatgcacgagcaaaggggagaaaattgcactcagcagaagaatcgagaagcactggcgtcttatcggctggggacaaatccaagctggtactactcttgatgtcccaccctgccccatctaattgaagagcaaaaattcgcttagaaagggaaacaacagagaagaaagtgctgaaacaagtaaaaaatttaggtattagatgtgggagggcagacaactgctgggaacaatttttgacggtggaagagaaaacatagtttcaaaaatttggatacttgttctattattgtttctgattctgatatgacttttga

SEQ ID NO: 2441 - DNA, 2036 bp, Phaseolus vulgaris
tggcccaagacccagtggctacatgtttctctgaatgcgaaggaaaacatgttgtcggagcttccattttcggagagaaaatcaatttcgaaggagaatgcgatttggactcttttttcgaggccaaatttagtcactctccactcacctactcctacactccactaatcgataatttagttgtcaagtcataaatcagtttcaccacttaagatcccattgaaagctgccaaaatgtcacggaagggtttgatggagcaagacttgagtaagttggatgtgacaaagttgcatccactttctccagaagtcatatctcggcaagctactattaatattggcactattggtcatgtggcacatggcaagtcaacagttgtgaaagcaatatcaggtgtccagactgtgcgtttcaaaaatgagttggagcgtaacattacaatcaagcttgggtatgcaaatgcaaaaatatacaagtgtgaagatgaacggtgttcaaggcctatgtgctacaaggcttatggaagtgggaaagaagatagtcctatgtgtgacgtgccagggtttgaaaacagcaagatgaaattgctgagacatgtttcatttgtggattgtccgggacatgatattctcatggctactatgcttaatggagctgcaatcatggatggagctttactactcatagctgctaatgaaagctgcccacaaccacaaacctctgagcacttagctgctgtggaaattatgcgtctacagcatataataatccttcaaaacaaggttgacttgattcaagaaaatgtggcaatcaatcagcatgaagcaatttcaaagtttatacagggaactgttgctgatggtgcaccagtagtacccatttcagcacagttaaagtataatattgatgttgtgtgcgagtatattgtgaagaagatcccaatccctgagaggaacttcgtttctcctcctaacatgatcgtaatccggtcatttgatgtcaataaacctggttttgaagttgatgaaataaaaggaggtgtagctggtggaagcattctgaggggtgttttgaaggtgaatcaattcattgaagttcgacctgggattgttgttaaagatgagagtggaaatatccggtgcacaccaatatactcaagaatagtttcattgtatgctgaacaaaatgagcttcaatttgctgttcctggaggcctaattggtgttgggacaacaatggatcccacattgacacgtgctgataggttggtaggtcaagttctaggagaggttggatcattacccgaggtttttgttgaactcgaggtaaactttttcttgcttagacggcttcttggggtcagaacaaaagggtctgagagacaggggaaggtatcgaagctggcgaaaggagagatgctaatgttgaacataggatcaatgtcaacgggggctagagtaattgctgtgaagaatgacttggcaaagttgcaacttacatcccctgtgtgcactagcaagggtgagaagatagcacttagtcgacgtgtggagaagcattggcgtcttattggatggggccaaatccaagcaggagtcacccttgacgtccctcctgccccccatttcagttgaacgcggacaagacacacctgcaccggctattaaaaccctagaacaatttagatatgtgggaaaggagacaattgttgggaaccatttttgtgaggtggcgaagaaaacgttttgattattgtctatttttgttttcacattggtattgttttattttgaccatgtacctattattgaagttcaatgtgttggtcctccagcacgttatatggaagcaatggctgaaaaatactggactctgctactcatcatcagataatagaatgtgcttagtatggtgaataggtttctgaaggtgtacggatgcaattccgtacctttagacctgggtcttaacctttagttacagttatacttgagacatcaacatgctaatcaatagcataatggctaagctgcag

SEQ ID NO: 2442 - DNA, 1795 bp, Castanea mollissima
caaacacaagcctctctctctcgctcgctcttgtcggctcgcccttaaaaccgacccaacccgacccggttttgcgtacgagctgaaccaaccagttttcttgtgtttgttgagagaaacattcgttgattctttcttagttggatttttgcggaataaccaaaacagaaagttctttcatttagagggtcactaagaaacaaccaaaaatgtcgcggaagggtttgatggagcaagacctgagtaaactggatgtaacaacgttacatccactctcccctgaagttatatctcggcaggctacaataaatattggcaccattggtcatgtggcacatggaaagtcaacagtcgtaaaagcaatatccggtgttcagactgttcgttttaaaaatgagttggagcgcaacatcactatcaagcttggttatgctaatgcaaagatctacaaatgtgaagaggaacggtgccctagacctatgtgctacaaggcttatggaagtgggaaggaagataatcctctgtgtgatgtgctgggatatgaaaactgcaggatgaaattgctgagacatgtctcttttgtggattgcccgggtcacgatattctcatggctacaatgcttaatggagctgcaattatggatggagctctacttctaatagctgcaaatgaaagctgcccccaaccacaaacttctgagcatcttgctgctgttgaaattatgcgccttcaacatataataatcctgcaaaataaagtagatctcattcaggaaaatgtagccatcaaccagcatgaagcaatccagaagtttattcagggaactgttgctgatggagcacctgtggtaccaatttctgctcagctgaagtataatattgatgttgtgtgtgagtacattgtgaagaaaatccccattccagaaagggactttgtgtcacctcctaatatgattgtaatccggtcttttgatgtcaataagcctggttatgaggttgatgaaataagaggtggtgtggctggtggaagtattctcaggggtgttttgaaggtaaatcaatttattgaggttcgtcctgggattgttgttaaagatgagagtgggggcatcaaatgcacgccgatatattccagaattgtttctttatacgctgagcaaaatgagctgcaatttgctgtgcctggaggtctcattggtgttggcacaaccatggaccccactttgacacgtgctgataggttggtgggtcaagttcttggtgaagttggatcactccccgaagtttttgttgagcttgaggttaattttttcttgctgcggaggcttctaggtgtcaggactaggggcacagaaaggcagggaaaggtcactaagctgaccaagtccgagattttaatgttgaacataggttctatgtctacaggggcaagagttatggctgtgaagaacgatctggcaaagttgcaactcacatctccagtgtgcactagcaaaggtgagaagattgcccttagtcggcgagttgagaagcactggcggcttattggttggggtcagattcaagctggaaccactcttgacatcccacctcgccctatttgagttaaatccctaaacaggtagaaagaacaaccagtcaaatctttaaaagtgaattaaggaagatgtgggaagatagacatttgttgggaaccatttttgttaggtggagaagaaaacggagcttgcattgccgttacctgttttgtttcttttttcctatgggattgtgttactttgtgcacgagtggtgt

SEQ ID NO: 2443 - DNA, 1794 bp, Chrysanthemum coronarium
catgtgacactccccaaacgcaactttctacaatagaatagaaccctttagaaaaccctaataatagctaaaaatattatcttcatccccttttagccaccaaaccatcaaaccctaactcaccacaatcaaatcatttcatcgtaacaggttgttgtgtgttaatcgttagggttttgattgtttaattagtgttgtttgaatagagtgaggttgagttaacaagtgtgaaaatatggcgaaaaagggattgatggaacaggatttgagtaagttagatgtggccaagctccatccgctttcgcccgaagttatatcgcgtcaagcgactattaatatcggtactattggtcatgtggctcatgggaagtcgactgttgtgaaagctatttcgggtgtgcagactgttcgttttaaaaatgagttggagcgtaacattactatcaagcttgggtatgccaacgcgaagatctataagtgtgaagatgaaaagtgcccgcgacccatgtgttacaaggcctatggaagtggaaaagaagacagccctgcttgtgatgtgcctggatttgagaacagcaagatgaaattgatgaggcatgtatcctttgttgattgcccgggacacgatattctcatggctactatgcttaatggagctgctatcatggatggagcattacttctcatagctgcaaatgaaagttgtcctcaacctcaaacatcagagcacttggctgctgttgaaattatgcgactccagcatatcataattcttcaaaacaaggttgatctcattcaggaaaatgtagccataaatcaacacgaggccattcagaaattcatccagggaactgtggctgatggtgcaccagtcatcccagtgtctgctcagctgaagtataatattgatgttgtatgcgaatacatcataaaacgtattcccattccagaaaggaacttcatttcaccaccaaacatgattgtcatccgatcatttgatgttaataaacctggtgcggaggttgaggagattagaggtggtgttgctggaggaagtattctcaagggtgtgttgaaggtaaaccagaacatcgaggttcgtccaggaattgttgttaaagatgagagtggcaacatcaagtgcaccccaatttactctagaatagtttcactgtttgcggagcagaacgaactccagtttgctgtacctggaggtcttattggagttggaactacaatggaccctatgttgactcgtgctgatcggttggtgggtcaggttcttggggaggtcggatcacttcctgatgtttatgttgaactggaggtgaacttctttttgttgcgtcggttgttgggtgtgaagacgaaaggaacggaaagacaaggaaaagtgtctaaactttcaaaagcagaaattctgatgctcaacataggatcaatgtctactggagctcgtgttttggcagttaagaacgatttagcaaaactgcagctaacatctcccgtgtgtacaagcaaaggagagaagattgcactgagcaggagagtggagaagcattggaggttgattggttggggacagattcaagcaggattgacccttgagatcccaccgtgcccaatttagaccaagacatttgaattccagttttgcctgctgttgctttttaatacttgattctaaattgttatatctgttttagctttttggtagccattgtgattttacacttatcaacttgtacttgcattgagcacaactccgcatggtgtttgaaaaaaggatcataa

SEQ ID NO: 2444 - DNA, 1815 bp, Cichorium intybus
gttactgctcaatattatcgccttagccaccgcaccaccaccagtcgtctaacgatcaaagaatctctacgccgtctcggcgattcgatacttcctcactcaaaggttgcctgttgagttagggttttacaattttgtgaggtcgaatagtgcaaagtttttgaagaacagcgaaaatgtctcgaaaaggtttaatggagcaggatttgagcaagctggatgtgacgaaactacatccgctctcaccggaggttatttctcgccaggctacaatcaatatcggtactatcggtcatgtggctcatggcaagtcaacagttgtgaaagcaatatctggtgttcagactgttcgttttaaaaacgagttggagcgtaacattactatcaagctcgggtatgccaatgcaaagatctacaaatgtgaagatgacaggtgtcctcgacctatgtgttacaaggcctatggaagtgggaaagaagacagccctctttgtgatgtccctggatttgaaaacagcaagatgacattgatgagacatgtatcatttgttgattgcccaggacatgacattctcatggctaccatgcttaatggagctgcaatcatggatggagcattacttctgatagctgcaaatgaaagctgtccacaacctcaaacttctgaacatttggctgctgttgaaatcatgaggctgcaacatattataattcttcaaaacaaggttgatttgattcaagaaaatgtagctatcaatcaacacgaggcaattcagaagtttatccagggaactgttgctgatggtgcaccagtaattccagtgtctgctcagcttaagtataacattgatgtggtgtgtgaatacataataaagcggattccaattccagaaagaaacttcatttcacctccaaatatgattgtgattcgatcttttgatgttaataagcctggttctgaagttgatgaaattagaggtggtgttgctggtggaagtatcctcaagggtgtgttgaaggtaaaccagttcatagaagtccgtcccggaattgttgtgaaagatgaaagtggcaacataaaatgcaccccaatatattccagaattgtttctttatacgcagaacaaaacgagcttcaatttgcggtacccggtggccttattggagtggggaccacaatggaccccatgttgactcgtgctgaccgtttggtcgggcaggttcttggtgaagtcgggtcccttcctgatgtctatgtggaactagaggtgaacttttttctgttgaggcggttgttgggagtgaagacgagaggaacagagaggcaagggaaggtgtcgaaattgtcgaaggcggagatactgatgttgaatatcgggtcgatgtcgactggggcccgtgtgttggcggttaagaatgacctggcgaaactgcagctgacgtcaccggtgtgtacgagtaaaggtgagaagattgcgctgagtaggcgagtggagaagcattggcgtttgattggttggggacagattcaagctgggctcactcttgagatcccgccttgcccgatttaaatcgtataatttggaattgttatccagttttggttcggtggtactacttgattcttgttatctggtttggtttagtttttggttagaatttgtgatttgtgactgtgtgtcattgacttgtgttgacgtacgtacaactttggatggtgtttcaagagaggatcataagacatgtttgtgccttttgttcttttctgtgttctttattttatttatatccatttagaaagcgatttacttaaac

SEQ ID NO: 2445 - DNA, 1990 bp, Trifolium pratense
acccgcagccttaattcgacactctcgtctcagtctatcactgccaccccctgcttgcttacacctccgctcacttgcaccttccttcttccttccgatagtttagcattaaacagtgttgggtcataacttcattccatcactcaattgaagtttccattggaagcagccaaaatgtcgcggaagggtttgatggaacaagacttgagtaaattggatgtgacaaaattgcatccactttctccagaagtcatatctcggcaggctactattaatattggcaccatcggtcatgtggcacacggcaaatcaacagttgtgaaagcaatatcgggtgttcagaccgtgcgtttcaaaaatgagttggagcgtaacattacaatcaagctcggttatgcaaacgcaaaaatatacaagtgtgaggatgaacgctgtccaaggcctatgtcctacaaggcttatggaagtggaaaggaagataatcctatgtgtgaggtgccagggtttgaaaactgcaagatgaaattgctgagacacgtttcttttgtcgattgcccaggtcatgatattctcatggctactatgcttaatggagcagcaatcatggatggagctttgctactcatagctgctaatgaaagctgtccacaaccacaaacctctgagcatttagctgctgtggaaattatgcgtcttcagcacatcataatccttcagaacaaggttgatctaattcaagagaatgtggctatcaatcagcatgaagcaattcagaagtttatagaaggaacggttgctgatggtgcaccagtcgtacctatttcagcacaattgaagtataatattgatgttgtgtgcgagtatatcgtgaaaaagatcccaatccctgaaaggaactttatttctccacctaatatgatagtaattcggtcctttgatgttaataaacctggttttgaggttgatgaaataaaaggaggtgtagctggtggaagcattctgaggggtgttttgaaggtcaaccaattcattgaagttcgacctgggatagttgttaaagacgagagcggaaatattaaatgcacacctatatactctagaatagtttcattgtttgctgaacaaaatgagcttcaatttgctgtgcctggaggcctaattggtgttggaacaacaatggatcccactttgacgcgtgctgataggttggtagggcaagttctcggagaggttggatcactgcccgaggtttacgttgagcttgaggtaaactttttcttgcttcggcggctacttggtgtccggacaaaaggatccgagagacagggaaaggtatctaagctggtcaaagcagaaatgctaatgttgaacataggatcaatgtcaacaggtgccagagtggttgctgtgaagaatgacttggcaaagttacaacttacttcccctgtgtgcaccagcaagggtgagaagattgctctaagtagacgtgttgagaagcattggcgtcttatcggttggggacaaatccaagctggaatcaccctcgaagtcccacctgcccccgtttttagttgaaagaacaacaaattaagagaaggactacaagaaaaacaccatttataaaaaaccttgagatgaatttaggtatgtggggagggaaaaaactgctgggagccatttttgtgagatggattagattgttaattttttgttttcacattgttgttggttacctattgttgaaattgtattttatgctgattgagtttagaatgcgagcatacgactcagccatcacttgttttcattcattggcaaccttaccaataattagtccagcaatcttgctatacagtgagacatttcatgattcatactgtaaacatatccaagaaactgttgaaaattttaagactggtacactttgtctggtccttgttactactatgctcttccagtattggaatgtgttcacatggctgtgtggacc

SEQ ID NO: 2446 - DNA, 1830 bp, Actinidia deliciosa
ctgctatcgaaaaccattcgacacctcccgccggctgccctagatagtagtaatcggctgtattttcaccacaatacctgtcttctttgctcactgagccttgccttctgtcggatcacaatagtactgcgggaatagccaaaatgtctcgaaaaggattgatggagcaggatctgagcaagctggatgtgaaaacactacatccactctcacctgaagtcatctctcgtcaggcaaccataaatattggtactattggtcatgtggctcatggaaagtcaacagttgtaaaagcaatatccggtgttcagactgttcgttttaaaaatgagctggagcggaacattaccattaagcttggatatgccaatgcaaagatatacaagtgtgaagatgaacgttgccctcggcctatgagctacaaggcatttggaagtggtaaagaagatagtcccatgtgtgatgtgcctggttttgagaactgtagaatgaaattgctgagacatgtctcttttgttgactgcccgggtcatgatattctcatggctacaatgcttaatggagcagcaattatggatggagcgttacttctcatagctgccaatgaaagttgcccccaacctcaaacttcagagcacttagctgctgttgaaataatgcggctccaacatataataattctccaaaataaggtagatcttattcaggaaaatgtagctatcaaccagcatgaagcaattcagaaattcattcagggaactgttgccggtggtgctcctgtgataccagtttctgcgcagctgaagtacaatattgatgttgtgtgtgaatatattgtgaagaagatacccattccggaaaggaatttcatctcacctcctaacatgattgtaatccggtcttttgatgtcaataaacccgggtttgaggttgatgaaataagaggtggtgttgctggtggaagtattctcaaaggtgttttgaaggtaaaccaattcattgaggttcgtcctgggattgttgttaaagatgagaatggaaacatcaaatgcacaccaatatactcgagaatagtttcgttgtatgctgagcaaaatgaactacaatttgctgtaccaggaggtctcattggggttggcaccactatggaccccactctgacacgtgctgatagattcgttggtcaggtgcttggtgaggttgggtcactccctgaaatttatgtggaactagaggtgaactttttcttgctgaggcggcttctgggtgtgaggacaaagggcacagagaggcaggggaaggtctcaaagctggtaaagggagagatcctgatgttgaacatcggttccatgtcaaccggcgctcgagtccttgctgtaaggactgatctggcgaaacttcaactcacgtctcccgtttgcaccagcaaaggggagaaaatagctctcagcaggcgagtcgagaagcactggcgtcttatcgggtggggtcagattcaagctggtaccactcttgatgttcctccttgccccatttgagtgaacctatatcatacacattattaagaagcaaaaggtcacccaactttgaaccgcgaaatgtgggagggtagagaactgctgggtacaatttttgtgagatggagaagaaaacattgatgcggatgctttataaattgttcgtgattgtttttgtttttgactactaatttttgcagcgttgtggatccttttagcttctgtttgaattttcggatttgttggatacgttttaatggccgagttcatggctattagtcaataacctatcactccctttagttaaaaaaaa

SEQ ID NO: 2447 - DNA, 1916 bp, Lactuca sativa
taaaacggggttcccaagtatgtcatgtgcgacgtcaatgctgcttttctaatttctactttgctgtagaaccctgaaaccctagcaacgttactgctcaatattatcgccttagccaccaccaacaccaatcgtctaaggatcggagaatctctccaacgtctcctcgattcggtgtttcctcactcaaaggcgaggtgttaacttagggtttctacactttgtgaggctgaatactgaaaagtccttgaagaacagtgaaaatgtctcgaaaaggtttaatggagcaggatttgagcaagctggatgtgacgaaactacatccgctctcaccggaggtcatttctcgccaggctacgattaatattggtactattggtcatgtggctcatggcaaatcaacagttgtgaaagcaatatctggtgtgcagactgttcgttttaaaaatgagttggaacgtaacatcactatcaaacttgggtatgccaatgcaaagatctacaaatgtgaagatgacaggtgtcctcgacctatgtgttacaaggcatatggaagtgggaaagaagacagccctcaatgtgatgttcctggatttgaaaacagcaagatgacattgatgaggcatgtgtcatttgttgattgccctggacacgatattctcatggctacaatgcttaatggagctgcaatcatggatggagcattacttctcatagctgcaaacgaaagctgtcctcaacctcaaacctctgaacatttagctgctgttgaaatcatgaggctccagcatatcataatccttcaaaacaaggttgatttaattcaagaaaacgtagccattaatcaacacgaggcaatccagaaattcatccagggaactgttgctgatggagcaccagtgattccagtttctgctcaactcaagtataacatcgatgttgtgtgtgaatacatcataaagagaatcccaattccagagagaaacttcatttcacctccaaatatgattgtgattcggtcttttgatgttaataagcctggatctgaagttgatgagattagaggtggtgttgctggtggaagtatcctcaagggtgtgttgaaggtaaaccagttcattgaagttcgcccagggattgttgtgaaagatgaaagtgggaacatcaagtgcactcctatatattctagaattgtttcactatatgcagagcagaatgagcttcagtttgctgttcctggagggcttatcggagtggggaccacgatggaccctatgctgacccgtgctgaccggctcgtcgggcaggttcttggagaagtcgggtctctgcccgatgtttatgttgaacttgaggtgaacttttttctgttgaggaggttgttgggtgtgaagacgaaaggaacagagaggcaagggaaggtgtccaagctggcaaaggcggaaatactgatgcttaatatcgggtccatgtcgactggggcccgtgtgttggcggttaagaatgacctggcgaaactgcagctgacgtcaccggtgtgtacgagtaaaggtgagaagattgcgctgagtaggcgagtggagaagcattggcggttgattggttggggacagattcaagcgggtcttactcttgaaatcccaccttccccaatctaaaaacacattttcgaattgctctccagttttgcctgttgctgtttctactacattactactacttgattcttgttatcatctattatctggtttagtttttttttttttttttgggtagaatttgtgatttgaattgttttgacttttgatacacaaaactttgcttggtgtttgaaggggggatcataagacatggttgtgccttttcctttgcttatatttttctttttactaaatgacgaaaaccgcaaatttttt

SEQ ID NO: 2448 - DNA, 1722 bp, Pseudotsuga menziesii
ggctgttgcacccacatagcctagccaatccaatcccattccttacagaaatcagagcagaaggcggaggaagaggaagaagtaaaggtgctcacattaccatctgaacagctttcaagaccaagcatttcatctcatctctgcggatctgtctgcagtcccaatattttctgcatctaaattcattttgtgagggcttatcatccgtcaagagccaaaaatgtcgaaaaaagggttaatggagcaggacctgaacaagctggatgtcaccaagttgcatccgctttctccagaggtcatttctcgtcaggctacaataaacataggtacaattgggcatgtggcccatgggaaatcgactgttgttaaagcaatatccggtgtccagacagttcgtttcaagaatgaactggagcgaaacatcactatcaagctaggatatgcaaatgcaaaaatatataaatgcgaagatgagcgctgccctcgaccaatgagctacaaggcatatggaagtgggaaggaagatagtcctttgtgtgatgttcctggatttgagaacactcgcatgaagcttttaagacatgtgtcttttgttgattgtccgggtcatgatattctaatggctactatgctcaatggtgcggctatcatggatggggcactgcttttgattgcaggcaatgagagctgtcctcaacctcaaacttcagagcatcttgcagctgtggaaatcatgcgtcttaagcatataattattttacaaaacaaaattgaccttatccaggagagtgtagcgatcaaccaacatgaggcaattcagaagtttattcagggtacaattgcggatggagcacctgtagtcccgatatctgcacaactgaagtacaacattgatgttgtctgtgaatacatagtaaacaagattcccattccagagcgaaattttgttgctccacccaatatgattgtaatcagatcttttgatgtgaataaacctggtgctgaagttgatgaaataaaaggaggtgttgctggtggaagtatactgaggggggtgttgaaagtgaatcaaaaaattgaagttcgccctggcattgttgtcaaagatgaaagtggcaatatcaagtgtacacctatcttttcaagaatagtttcactttatgctgagcaaaatgagttgcagtttgctgttcctggaggtcttattggtgtgggtacaacaatagaccccacactgacacgtgctgacaggcttgtagggcaggtccttggagaagtaggagaactacctgatgtatttgttgagcttgaggttaactttttcctcctccgccgcctcctgggagtcaggacaaaggggacagaaaaacaagggaaagtttcaaagctggccaagggagaagttctgatgcttaatattggttcaatgtccactggagctcgggtgcttgctgtgaaaaatgaccttgcaaagctccaacttacttctccagtctgcacaagtaaaggagaaaagatggcacttagtaggcgagtagaaaagcattggcgattaataggatggggtcaaattcaagctggagcaatgctggaaattccccaagcggccatttaagatagtggataaacgaagcagactaaaaggaaaaagggtacaaaggaagaatgtggatagggagagaattactaggaactatttttgttcggtggagaagaaaacct

SEQ ID NO: 2449 - DNA, 1748 bp, Silene vulgaris
aggcattgcaacggaagcggggtttagtcactgcatcgaaaatggcgcgcaaaggtctaatggagcaggatttgagaaagctggatgtgacaaaactacacccgctttcacctgaagttatttctcgtcaagcaacgattaatattggcaccattggtcacgtggcccatgggaagtcaaccgttgtgaaagctatatctggtgttcagaccgtgcgttttaagaatgagttggagcgtaatatcactatcaaacttggatatgctaatgcaaagatatacaaatgtgaggatgaacgatgcccacggcctatgtcctataaggcgtatggaagtggaaaggaagatagtcctgcatgtgatgtacctggatttgagaattgcaagatgaagctccttagacatgtatcttttgttgactgcccgggtcacgatattctcatggctaccatgcttaatggagctgcaattatggatggcgctttacttctcattgctgctaatgagagctgtccccaaccccagacttccgagcatcttgctgccattgaaattatgcgacttcagcatatcattatcctccaaaataaagttgatctagttcaagaaaatgtagcaataaatcagcatgaagcgatccaaaagtttgttcagggaactgttgcggatgcagcgccggtagttccaatttctgctcaattgaaatacaacattgatgttgtttgcgaatatatagtaaagaagattcctatacctgagagaaattttatctcgccgccaaatatgatcgtgattcgttcttttgatgtcaacaaacctggttacgaggttgatgatatacgtggcggtgttgctggaggaagtattcttaagggtgtcttgagggtgaaccaaaatatcgaggttcgtcctggaattgttgtcaaagatgaaaatggaaatatcaagtgcacacccatatattccagaatagtctcgttgtttgctgaccagaatgagctgcaatttgctgtgccaggaggtttaattggggttgggacgaccatggaccctactttgacccgagctgatcgattggttggtcaggttctcggagaggttgggtctcttccagatgtttttgttgagttggaggtaaatttctttttgctaaggcgactgcttggtgtcagaacaaagggtactgagaaacaaggcaaggtcacaaaactgaccaaggcagagattctgatgttgaatattgggtccatgtcgactggagcccgagtcattgccgtcaagaatgatttggcgaaactgcaacttacatccccagtctgcactagcaaaggtgagaaaattgcgctcagccgtagggtggagaagcactggcgactgatagggtggggacagattcaagccggcactactctcgagatcccggcttgtcctatctaagcacgaaacaaagccgagagacagaccaactaggaagatctcacaagtttgggaatgtcgaacgagagagaagtcttgggaactatatttctcaggtggagtaaaccatcttttttaatagtttttggtttcttatgggatttgtttcggagactatttgctttcagtcgtatgattattttgttttacgattattctaaatttttgagctgtacattactgcagctgtatgcacgtccgtgttttagtcactgctcggttgtcagtgtgtcactgtgaatctgtgatcatactcccttcccttcattccat

SEQ ID NO: 2450 - DNA, 1782 bp, Valeriana officinalis
tcgttccgagtcatcactcaccactcagcggaaacccaacctttttatcacgcagcttttcgtttctctcgcataccttccacctttctcgtctaccggagattgtcttcagccgaacaacgctcggttgtgactgattccggtctcaattgtttgaagtaagaaggtcgttgagtaaaggcaacaaaatggctcgcaaaggtttaatggagcaggatttgagcaaattggatgtaacgctactgcatcctttgtctcctgaagtaatttctcgacaggcgacgataaacataggcacaattggtcatgtggctcacggaaaatctacggttgtcaaagctatatcaggtgttcagacagttcgttttaaaaacgagctggaaaggaatatcactatcaagcttgggtatgctaatgcaaagatatataaatgcgaagatgagaaatgccctcgtcctatgtgttataaagcgtatggaagtggaaaagaagactctcctatgtgtgatgttcctggctttgagaatagcagaatgaaattactgagacatgtgtcttttgttgattgccctggacacgatattctcatggctactatgcttaatggagcagctatcatggacggtgcattgcttctcatagctgctaatgaaagttgtccgcagccccaaacatcagaacatttggctgctgttgaaattatgcgccttcaacatatcataatccttcaaaataaggttgacttaattcaagagaatgtagccatcaaccagcacgaatctattcagaaattcatagagggaacagttgctgacggtgctccagtcataccagtttctgcacagttaaagtacaacattgatgttgtatgcgaatacatcacaaagaggattccaatccctgaaaggaactttatctccccccctaatatgattgtaattcgttcttttgatgtcaacaagcctggatctgaagttgatgaggttagaggcggtgttgccggtggaagtattctcaagggtgttttgaaggtagatcaattcatcgaagttcgaccaggtattgttgttaaggacgagagcggcaacataaaatgcaccccaatttactctagaatcatttcgttattcgccgaacagaacgaattacaatttgccgttcctggaggactcattggagtcggtacaaccatggaccccaccttgactcgtgccgatcgcctcgtgggccaggttcttggcgaagtcggctcccttcccgaagtctatgtcgaactagaggtaaatttctttttactgagaaggcttctgggagtgaggacaaagggaacagagaggcaaggaaaagtgacgaagctggcgaaagccgagattctgatgttgaacatcggatctatgtcgactggagctagagttgttgcggtgaagaacgatctggcgaagctgcagctcacctcaccagtatgcaccagcaaaggcgagaaaatagctctgagtcgtcgtgttgagaagcactggcgtttaattggctggggccagatacaagccggtctaacactcgaagtaccaccgtgtccgatttgagtgaacatatatttcattttacagcgtcttttaccaaaagattagatgtgggaaggcagagagttgatcggtacgatttttttcaagtggagaagaaaactagcatgtttggttactttaagttcttatttcttttcgttttttattcatcgattttgtttatactgtgaattctgtataactggtttgtgctgctgct

SEQ ID NO: 2451 - DNA, 1641 bp, Ambrosia trifida
agaatagtgcaagatttgtgtagaagagtgaatatggctagaaaagggttaatggagcaggatttgagtaagctggatgtagcggcgctgcatccgctttctccggaggttatttctcgtcaggctacgattaatattggtactattggtcatgtggctcatgggaagtcaacagttgtaaaagctatatctggtgtgcagactgtgcggttcaaaaatgagttggagcgtaacattactatcaagcttgggtatgccaatgcaaagatatacaaatgtgaagatgaaaagtgccctcgacccatgtgttacaaggcatatggaagtggaaaagaagatagccctccttgtgatgtgcctggatttgagaacagcaagatgaaattgatgagacatgtatcgtttgttgactgtccaggacacgatattctcatggctactatgcttaatggagcagctatcatggacggagcgttacttctcatagcagcaaatgaaagttgtccccagcctcagacttctgagcacttggctgctgttgagattatgaggctccaacatatcataattcttcaaaataaggttgatctaattcaagaaaacgtagccattaaccaacacgacgcaattcaacaattcatacagggaacggttgctgatggtgcaccggtgatcccggtgtcagctcagcttaggtataatatcgatgtggtgtgcgaatacataataaaaaggattcccatcccagagaggaacttcatttcacctcccaatatgatagtaattcgttcatttgatgttaataagcctggatctgaggttgatgagattagaggtggtgtggctggtggaagtattctcaagggtgtgttgaaggtaaaccagcatattgaggtccgtccagggattgttgttaaagatgagagtggtaacatcaagtgcaccccaatttactcaagaatagtgtcgctatacgcggagcagaatgaacttcaatttgctgtacctggaggtcttattggtgttggaacaacaatggaccctatgttgacccgtgctgatcggttggtgggtcaagttcttggggaggtcgggtctcttcctgatgtctatgtcgaactcgaggtgaacttctttcttttgcgtcggttgcttggtgtgaagacgaaaggaacagaaaagcaagggaaagtatcaaagttgtcaaaggcggaaatactgatgctgaacataggatcaatgtcgactggggcccgtgttttggcagttaagaacgatttagcaaaactgcagttgacagcacccgtgtgtacgagcaaaggtgagaagattgctctgagcaggagagtagaaaagcattggcggctaatcggttggggacaaattcaagctggtgttactcttgatatcccaccctgtccaatttaaaggtctgggcgcccatttgatatccagttttgcctgccgctgctgctacttttctttcctatctttgattcttggtaatctgttttagctttttgtagtcgtttgtgtattttacacttattcgactttgttttagaactaaattacttttgactattggttgtttgcggtagaggtatcaataaaacgtgttacttttcaccttacaaattg

SEQ ID NO: 2452 - DNA, 1582 bp, Arnica chamissonis
gatcacagaatctatttagcgtctcagcgattcggcgcttcctcacgcaaaaaggttagtgtgtttaacctagggtttgtacgattctgatttcaaatagtgcaaaataccgtcaaacaacagtgaatatggctcgaaaaggactaatggagcaggatttgagcaagctggatgtagcaacgctacatccgctttctccggaggtcatatctcgccaagctacgattaatattggcactattggtcatgtggctcatggcaagtcaacagttgtaaaagcaatatctggtgtgcagaccgttcgtttcaaaaatgagttggagcgtaacattactattaagcttgggtatgccaatgcaaagatatacaaatgtgaagatgaaaagtgccctcgacctatgtgttacaaggcctatggaagtgcgaaagaagataaccctctttgtgatgtgcctggatttgagaacagcaagatgaaattgatgaggcatgtatcgtttgttgactgtccaggacatgatattctcatggctactatgcttaatggggctgctatcatggatggagcattacttctcatagcagcaaatgaaagttgtccccaacctcagacttctgagcacttggctgctgttgagattatgaggctccaacatattataattcttcaaaataaggttgatctaattcaagaaaatgtagccatgaaccaacaggaggcaattcagaaatttatccagggaacggttgctgatggtgcaccagttatcccagtgtcagctcagcttaggtataatattgatgtggtgtgcgaatacataataaaacggattcccattccagagaggaacttcatttcacctccaaatatgatagtaattcgttcatttgatgtcaataagcctggatccgaggttgatgagattagaggcggtgttgctggtggaagtatcctcaagggtgtgttgaaggtaaatcagcatattgaggtccgtccagggattgttgttaaagatgagagtggcaacatcaagtgcaccccgatttactcaagaatagtttcactatacgcagagcagaatgaacttcaatttgctgtacctggaggtcttattggtgttggaacaacaatggaccctatgttgacccgtgctgatcggttggtgggtcaagttcttggggaggttgggtctcttcctgatgtttatgtcgaactagaggtgaacttttttcttttgcgtcggctgctgggtgtgaagacaaaaggaacagaaaagcaagggaaggtatcaaagttgtcaaaggcggaaatactgatgctgaacattggatcaatgtcgactggggcccgtgttgtggcggttaagaacgatttagcaaaactgcagctgacatcaccggtgtgcacgagcaaaggtgagaagattgctctgagcaggagagtggagaagcattggcggttaatcggttggggacagattcaagctggtctgattcttgagatcccaccctgtccaatttagacacatttgaactccagttttgcccgctgctgctgctacttttgattctgaagtatctg

SEQ ID NO: 2453 - DNA, 2101 bp, Phaseolus vulgaris
ttaaaattgacacaagtttattacgcgagcagagaagaactgcgagtggagagcactgcaaccgccagcgtagagaacggcggcgagcagagagaaccgcgactggagagcacgacgacagaacagagcacgacgcaccaccacgcagccaaacgtcgataagtttggcgtggccggagaaaagaacgacacggcgcggtgaatagagaccagagcagcgaaccctaattggcgaggtggaagtgaagaacgacactaatcgcgatagtttagttctcaagtcataaattgatttcaccacttaagatcccattggaagcttgtcaaaatgtcgcggaagggtttgatggaacaagacttgagtaagttggatgtgacaaagttgcatccactttctccagaagtcatatctcggcaagctactattaatattggcactatcggtcatgtggcacatggcaagtcaacagttgtgaaagcaatatcaggtgtccagactgtgcgtttcaaaaatgagttggagcgtaacattacaatcaagcttggctatgcaaatgcaaaaatatacaagtgtgaagacgaacggtgttcaaggcctatgtgctacaaggcttatggaagtgggaaagaagatagccctatgtgtgatgtgccagggtttgaaaacagcaagatgaaattgctgaggcatgtttcatttgtggattgtccgggacatgatattctcatggctactatgcttaatggagcagcaatcatggatggagctttactactaatagctgctaatgaaagctgcccacaaccacaaacctctgagcacttggctgctgtggaaatcatgcgtctacagcatataataatccttcagaacaaggttgatttgattcaggaaaatgttgctatcaatcagcatgaagcaatttcaaagtttatacagggaactgttgctgatggtgcaccagtagtacccatttcagcacagttaaagtataatattgatgttgtgtgtgagtatattgtgaagaagatcccaatccctgagaggaattttatttctccacctaatatgattgtgatccggtcatttgatgtcaataaacctggttttgaggttgatgaaattaaaggaggtgtagctggtggaagcattctgaggggtgttttgaaggtgaatcaattcattgaagttcgaccagggattgttgttaaagatgagagtggaaatatccgatgcacaccaatatactcaagaatagtttcattgtatgctgaacaaaatgagcttcaatttgctgtacctggaggcctaattggtgttgggacaacaatggatcccacgctgacacgtgctgataggttggtaggtcaagttctaggagaggttggatccctacctgaggtttttgttgaactcgaggtaaactttttcctacttagacggcttcttggcgtccgaacaaaagggtctgagagacaggggaaggtatcgaagctgacgaaagcagagatgctaatgttgaacataggatcaatgtcaacgggggctagagtaattgctgtgaggaatgacttggcaaagttgcaacttacatcccctgtgtgcactagcaagggtgagaagatagcacttagtcgacgtgttgagaagcattggcgtcttattgggtggggccaaatccaagcaggaatcacccttgacgtccctcctgctccccagttcagttgaacgcagacaaggcaaaccacagaaaatacctgctgcggctataaaaaccctagaacaatttagatatgtgggaagggagacagttgttgggaaccatttttgtgaggtggcgaagaaaacgttttgattgttgtctatttttgttttcacatcgttattgttttattttgcccatgtaacttattaaagttcaatatgagttgttggtcctgggatgtgcttatcaggagcacaaaattcatctttaaatgtatgttcttagtaaatgttataatttagattgaagaattaacttcaaactcatgttttggagttaaaggagtttagtttgaacgaataagggtatatgcgtagtaagaagaatgacctcta

SEQ ID NO: 2454 - DNA, 2090 bp, Cannabis sativa
tttctccagacgcctcgcccaagaacttcatccagggattaagtactgcgaataatcgtttttcaaatttcgtgagtggtcatataagccaccaacaacttcttgaagcagaagagaatcactttagaacaggcacaatgtcacgaaaaggtttgatggagcaagacctgggtaaattggatgtaactaagttgcatccactttcacctgaagtaatatctcgtcaggcaaccatcaatattggcaccataggccatgtggcccatggcaagtcaacagttgtaaaagccatatctggtgttcagactgttcgtttcaagaatgaattggagcggaacattaccattaagcttggatatgcaaatgcaaagatatacaaatgtgaagatgagcggtgccctcgacctatgtgttacaaggcgtatggaagtggaaaggaagacagtcctctttgtgatgttccaggatttgagaatgctaggatgaaattgctgagacacgtttcatttgtcgactgcccgggtcacgatattcttatggctaccatgcttaatggtgctgcaatcatggatggagcgttgcttctcatagctgccaatgagagctgtccccaaccacagacatctgagcacttggctgctgttgaaattatgcgccttcaacacattattattcttcaaaataaggttgatctcattcaagaaaatgtagccatcaaccagaatgaagcaattaagaaattcattgagggaactgttgctgatggggcaccagtagtaccaatttctgctcagttgaagtataatattgatgtcgtatgtgagtacatcgtcaaaaagatccctattccagaaaggaattttatctcgcctcctaatatgattgtaattcggtcatttgatgtcaacaagcctggatttgaggtcgatgatataaaaggtggtgttgctggtggaagtatccttaggggtgttctgaaagtgaatcaatttattgaggttcgtcctgggattgttgttaaagatgaaaacggaaacaccaaatgcacaccaatttattccagaattgtttcattgtatgccgagcaaaatgagctgcaatatgcagtgccggggggtctcattggtgttggtacaaccatggatcctactttgactcgtgctgataggttggtgggacaagttcttggtgaagttggatcgctccccgaggtttttgtcgagcttgaggtgaacttctttcttctgcgtaggctattgggtgtgaagacaaagggctcggagaagcaggggagggtcacaaagctgaccaagggagagatgctgatgttgaacattggatccatgtcaacaggtgccagggttcttgctgtaaagaacgatttggcgaaactgcaactcacctccccagtttgcaccagcaaaggggagaagattgcacttagtcgaagggtagaaaagcactggcggctgatcggttggggccagattcaagctggaaccactcttgatgttccaccgtgccccatttgagccgaatctgcatagatagacagaaaagacaagaaaggttgaagagcaaaaggaagaaagatgtgggaaggtcgtgaactgttgggaacaattttttcgagatggagaagaaaacctgattttgatcaatactctgttgtttttgtttacctcgttatcaaatttatttttctggtttactgtttagtgtattttgagttggttaattggatactttgtgccgatttgaaatttagagttttggatttcattcttctcgatgactgtgggggtggtttgcttaaaaaccatgccagagtataatattgcatttttgtgagtgaagaagattcattagcaattggtatttttagctttttctatcactcatcatcttttggtggaaagttaaaggaaataggatggttaaagtcaccctctttttagtgtctactttccaaatgccctttttcactaattgattttagaaaaaagtaatgattgagacactcaaattgtaattataagtgtaaatacatctcatttgttgtgcaatttgaaagtgaaaatcacacagct

SEQ ID NO: 2455 - DNA, 2186 bp, Cannabis sativa
ggaatctttctcttctcgaccctaattccgaaaacaacagagaaacccctctctgcatatcatctttcttcttcttcttctgctgctcctgctccagacgcctcgcccaagaacttcatccagggattaagtactgcgaaaaatcgttttttaaatttcgtgagtggtcatataagccaccaacaacttcttgaagcagaagagaatcactttagaacaggcacaatgtcacgaaaaggtttgatggagcaagacctgggtaaattggatgtaactaagttgcatccactttcgcctgaagtaatatctcgtcaggcaaccatcaatattggcaccataggccatgtggcccatggcaagtcaacagttgtaaaagccatatctggtgttcagactgttcgtttcaagaatgaattggagcggaacattaccattaagcttggatatgcaaatgcaaagatatacaaatgtgaagatgagcggtgccctcgacctatgtgttacaaggcgtatggaagtggaaaggaagacagtcctctttgtgatgttccaggatttgagaatgctaggatgaaattgctgagacacgtttcatttgtcgactgcccgggtcacgatattcttatggctaccatgcttaatggtgccgcaatcatggatggagcgttgcttctcatagctgccaatgagagctgtccccaaccacagacatctgagcacttggctgctgttgaaattatgcgccttcaacacattattattcttcaaaataaggttgatctcattcaagaaaatgtagccatcaaccagaatgaagcaattaagaaattcattgagggaactgttgctgatggggcaccagtagtaccaatttctgctcagttgaagtataatattgatgtcgtatgtgagtacatcgtcaaaaagatccctattccagaaaggaattttatctcgcctcctaatatgattgtaattcggtcatttgatgtcaacaagcctggatttgaggtcgatgatataaaaggtggtgttgctggtggaagtatccttaggggtgttctgaaagtgaatcaatttattgaggttcgtcctgggattgttgttaaagatgaaaatggaaacaccaaatgcacaccaatttattccagaattgtttcattgtatgccgagcaaaatgagctgcaatatgcagtgccagggggtctcattggtgttggtacaaccatggatcctactttgactcgtgctgataggttggtgggacaagttcttggtgaagttggatcgctccccgaggtttttgtcgagcttgaggtgaacttctttcttctgcgtaggctattgggtgtgaagacaaagggctcggagaagcaggggagggtcacaaagctgaccaagggagagatgctgatgttgaacattggatccatgtcaacaggtgccagggttcttgctgtaaagaacgatttggcgaaactgcaactcacctccccagtttgcaccagcaaaggggagaagattgcacttagtcgaagggtagaaaagcactggcggctgatcggttggggccagattcaagctggaaccactcttgatgttccaccgtgccccatttgagccgaatctgcatagatagacagaaaagacaagaaaggttgaagagcaaaaggaagaaagatgtgggaaggtcgtgaactgttgggaacaattttttcgagatggagaagaaaacctgattttgatcaatactctgttgtttttgtttacctcgttatcaaatttatttttctggtttactgtttagtgtattttgagttggttaattggatactttgtgccgattcgaaatttagagttttggatttcattcttctcgatgactatgggggtggtttgcttaaaaaccatgccagagtataatattgcatttttgtgagtgaagaagattcattagcaattgatatttttagctttctctatcacttaatcatcttttggtggaaagttgaaggaaataggatggttaaattcaccctctttctagtgtctattttccaaatgctctttttcactaattgattttagaaaaaaagtaatgattgagacacttaaattgtaattataagtgtaaatacatcacatttgttgtgcagtttgaaagtgaaaatcacaacgcttacctt

SEQ ID NO: 2456 - DNA, 2191 bp, Citrus clementina
accccacggggatcgcaagaagtcccccaaaacctaaaattctctctcacacacacaccctctcacaatcaatatagcggtaaacctcagtcaaatctcggtctcgcagtcgttctccggtcgcaacttgctctgcattcaatcagttttacgggcttgaacattactagtggcaatacagacaataaggagaggggtattttcaaagaaacaggcaagatgtcacggaagggtttgatggaacaggacttgagtaagttggatgtaactaagttgcatcctctttctcctgaagtcatttctcgccaggctactattaatattggaactatcggtcatgtggcccatggcaaatcaactgttgtgaaggcaatatctggtgttcagactgttcgttttaagaatgaattagagcgtaacattactatcaagcttggatatgcaaatgccaagatatacaaatgtgaagatgatcgttgcccacgaccaatgtgctataaggcatatggaagtgggaaagaagataatcctctgtgcgatgtgcctggttttgagaactgcaggatgaaattgcttaggcatgtctcttttgttgattgcccgggtcatgatattcttatggctacaatgcttaatggagcagcaattatggatggagcattgcttctcatagcagccaatgaaagttgcccgcaaccacaaacatcggagcacttggcagctgttgaaatcatgcgtctccaacatataataattcttcaaaataaagttgatctcattcaggaaaatgtggccatcaaccaacatgaagctatcatgaagtttatccagggaactgttgctgatggcgcaccagtggttcccatttctgcacagctaaagtacaatattgatgttgtatgcgaatatattgtgaaaaagattcccattccagagaggaactttattgatccaccaaatatgattgtaattcgatcttttgatgtcaataaacctggttttgaggttgatgatataagaggtggtgttgctggtggcagcatcctgaggggtgttctgaaggtgaaccaatttattgaggttcgtcccggtattgttgtcaaagatgagtccgggaacatcaagtgcacacctatatactcgagaatagtttcattgtttgctgagcaaaatgagttacaatttgcagttccaggaggtctcattggggttggtacaaccatggatcctactttgacacgggcggatagactggtgggtcaggttcttggggaggttgggtcactccctgaagtttttgtcgagcttgaggtgaacttctttctattgcgccggcttttgggtgtgaggacaaagggctcagaaaggcagggaaaggtctccaaacttgccaaacaagagattcttatgctgaacataggatctatgtcgaccggagctagagttcttgctgtaaagaatgatttggcaaaactccaacttacatctccagtgtgcaccagtaggggggagaagattgcgctcagtcgaagagttgagaagcactggcgtcttattggctggggccagattcaagccggaactaccctcgacgtccctgccagccacccattacagtaaatcggataaatcagaagcagcaaggagaaacaagtaaaacagggagagtagtagcagggagatgtgggaaggtagggaattgttgggaacaatttttgttagatggagaagaaaacattgtttggatgattctattttgcctctttttcctttttcttggaaatgccttgaattgattggaaatttttctttggcagtctcatctattcatgaactattacaacgaataatcttctgttgaatgctggtggttgagtgacgtttaatattttccgaaaatatgaggggaaacttgaagatcacttttcaattcgcacaacaaatagtttcgaggatcataagtgttaattactttctttgcatacactctcatggtatgtctggtttagagattttttgggtggtgttgacactaaataattggatgtagtgtgctgaatgttgttgctgctgatggcagtaatacttcgcctaagaccctcatttggtgggtgtgtttttcttgaaaataattaaatgtattaacggattgagatatagacagaagtaaataaattttgaaatcggaaga

SEQ ID NO: 2457 - DNA, 2331 bp, Trifolium pratense
ttcactcctaccttcgatttcgaaaccctcttcttgttcgttctatctctcaccgtaaacaacaaaccctctcttcttcactcttttttctcacaccagattccgtcactgtagcttctctactcatccactttcaaatcccactaattgaagtgaaaatggcgactcgtagggggttgatggaacaagacctgagtaagttggatgtgacaaaattgcatccactttctcctgaagttatatcccgtcaggctactattaatattggcaccattggtcatgtggcacatggaaagtcaacagttgtgaaagcaatatcaggtgttcagactgtgcgttttaaaaatgagttggaacgtaacattacaatcaagcttggttatgcgaatgcaaaaatatacaagtgtgaagatgaacggtgtccaaggcctatgtcctacaaggcttatggaagtggaaaggaagataatcctatgtgtgatgtaccagggtttgaaaattccaagatgaaattgctgagacatgtttcttttgttgattgccctggacatgatattctcatggctactatgcttaatggagctgcaattatggatggagctttgctactaattgctgctaatgagagctgcccgcaacctcaaacctctgagcatttagctgctgtggaaattatgcgtctacagcacatcataatccttcagaacaaggtagatctgattcaagaaaatgtggcaatcaatcagcacgaagcaattcagaagtttatccaaggaactgttgctgatagtgcaccagtagtaccaatttcagcacaattgaagtataatattgatgtcgtgtgtgagtacatcgtgaaaaagatcccaatccctgaacggaacttcatttctccacctaatatgatagtaattcgatcgtttgatgtcaataaacctggttatgaggttgatgaaataaaaggaggtgtagctggtggaagtattctgaggggtgttttaagggtcaaccaattcattgaagttcgacctggaatagttattaaagacgagagtggaaatatccgatgcacacccatctactccagaatagtttcattatttgctgaacagaatgagcttcaatttgcagttcctggaggcttaattggtgttggaacaacaatggatcccactctgacacgtgctgacaggttggtagggcaagttctcggagaggttggatcactgcctgatgtttttgtggagcttgaggtaaactttttcttgcttcgacggcttcttggtgtccgcacaaaaggttccgagagacaaggaaaggtctcaaagctggtgaaagcagaaatgctaatgttgaacataggttctatgtcaacaggtgccagagtggttgctgtgaagaatgatttggcaaagttgcaacttacttcccctgtgtgcaccagcaagggtgagaagattgctctaagtagacgtgttgagaagcattggcgtcttatcggttggggacaaatccaagctggaatcacccttgaagtccctcctgcccccgtttttagttgaaagaaagacagattaagagaaagacaagaaaacaccatttataaaaaatcttgagatgaatttaggtatgtgggaagggaaaaaactgttgggaaccatttttgtgagatggattagattgttaattttttgttttctcattgttgttggttacctattgttgaaattgtatcttattctgattgagtttagaatgcgagcatatgtctcagccatcacttgttttcattcattggccaccttaccaataattaatccagtaatcttgctatacagcatatccaagcaattgttgaaattttaagactggtacacttcgtctggtccttgttactattaagctcttccagtattggaatgtgttaacaaaactgtgtggacctttggtggtaaaatttttattggggacttaacttctagtgcgaaggttgagtgacggctcatgagatgggtgttgtgcaaatgcagtggctccttggtggtcttgtgagagcattggaagacattatgttgtgatggagcggcttgttgataaggagtagttgttgcattcattgatcgaagcaatgatagttatgaaagagagtgcaaaggaaggagatcaaacaatgtctttgtgatggtcttgctcacaattgagggtgccgaaacaacaaaggtttgggagttcattctggggaaggcatcatggtggtgcgtgtagggtggtggttgcaattgcccgcgttggctgggaggatgatgtttttgttggcttcttgtgcaagat

SEQ ID NO: 2458 - DNA, 1604 bp, Eschscholzia californica
cacacaccaaatctcgtattcttccgcctctcggtctctccggcagccaaaccaccactcacggttgccctagatcaagtgggctggataattttgtagtagttgaaagatcctttaaagacattagagatggctcggaaaggtttgatggaacaggatttaagtaaactggatgtagcgaaattgcacccgctatcaccggaagttatttctcgccaagctaccataaatattggtactattggccatgtcgctcatggaaagtcgactgttgttaaagctatatccggtgtccagactgtaaggtttaaaaatgagttggagcgtaacatcactatcaagcttgggtatgcaaatgcgaaaatatacaaatgtgaagatgaacgatgccctcgtccttctgcctacaaggcatatggcagtggaaaagaagatagccctctatgtgatgttccaggttttgaaaatacaagaatgaaactactgagacacgtctcttttgtggattgcccgggtcatgatattcttatggctactatgctcaatggagcagcaattatggacggagctctacttttgatagctgcaaacgagagttgtccccagcctcagacttctgagcatcttgccgcagttgaaatcatgcgcctccaacacataatcatccttcaaaataaagttgatcttattcaagaaaatgttgctatcaatcaacatgaagctattaagaagttcattcagaaaactgtggctgataatgcaccaatcgtaccgatttctgcacagttaaaatacaatattgatgtagtgtgtgaatatatcgtaaaaaagataccaatcccagagagggactttatctcaccgccaactatgattgttatccggtctttcgatgtcaataagcctgggtcagaggtcgatgaagtaaagggtggtgttgctggtggaagtatactcaacggtgttttgagggtgaatcaatttattgaggtccgacctgggattgttgtaaaagatgaaaatggtagaatcaagtgtaccccaatatactctagaattgtttcactatacgctgagcaaaatgagctacaatttgctgtaccgggaggtcttattggagttggaacaaccatggaccccactctaacacgtgctgataggctggttggccaggttcttggtgaagttggttcgcttcctgaggtttttgttgaacttgaggtgaacttcttccttctccgacggcttctaggagtaaaaacaacgggaacagagaggcaggggaaagtatcaaagctaacaaaggctgagatattaatgttgaacattggttcaatgtcaacaggagctcgagtaatcgccgtgaaaaatgatttggctaaactgcagctaacttcacctgtctgcactagcaaaggagagaaggttgccctcagtcggcgggttgaaaagcattggcgtcttattggctggggacaaattcaagctggaaccaccctcgaagtcccaccgtgtcccatctgagtaaaacttacaaagggagagaaaaaccaaagcgaaaaaagagagtagactaagacttcaatcagagtctgagaataggg

SEQ ID NO: 2459 - DNA, 1874 bp, Eucalyptus grandis
gcggggtgctcgcttgtccggacaaaccaaaactcagaaaccctcgctcgcttagctctcagaggcttggcctgctaatctcccgaagctcagctccgtcctcccattctttgagcaaggatcatttaggaacaagccaaaatgtctcggaagggtttgatggagcaagacttaagcaaattggatgttacaaaactcactccactctctccagaagtaatctcgcggcaggcaaccataaatatcggcactataggtcatgtggcgcatggaaagtcaacagttgtgaaggcaatttccggtgtgcagactgttcgttttaagaatgagttggagcgtaacattacaattaagcttggatatgcaaatgcaaagatttacaagtgcgaggatgaacgatgcccacgccctacgtgctacaaggcttatggaagtggaaaggaagacagtcctctgtgtgatgtccctggttttgagaattgccgtatgaagctgctaaggcatgtttcctttgtggattgtccgggccacgatattctcatggctactatgcttaatggagccgctatcatggatggagcattacttcttatagctgccaatgaaagctgtccccagcctcagacttctgagcatttggcagctgttgaaattatgcgcctgcagcatataattatccttcagaataaagttgaccttattcaagaaaatgtagcgatcaaccagcatgaagcaattcaaaaattcattcagggaactgttgctgatggtgctccagttgtcccaatctctgcgcagttgaagtataacattgatgttgtctgtgagtatattgtcaaaaagatccccattccagagagaaattttgtgtcgccaccaaatatgattgtaatccggtcttttgatgtgaacaagcctggctatgaagttgatgagataagaggtggtgtggctggtgggagtatcctaaggggtgttttgaaggtaaatcaaatgatcgaagttcgccctgggattattgtgaaagatgagaatgggaataccaaatgcacaccaatatactcgagaattgtttcattgtatgctgagcaaaatgagctgcaatttgcagtgcctggaggccttattggtgttgggaccaccatggaccccactttgacacgagctgatagattggtgggtcaggttcttggggaggttgggtcacttcctgaaatcttcgttgagcttgaggttaacttcttcctactgcgacgacttcttggtgtgaggacaaagggctcagaaaggcagggaaaggtctcaaagctggctaaaggagagattctcatgttgaatattgggtcaatgtcgacgggggctcgagttgttgctgtgaggaacgatttagctaaactgcaactcacatctccagtctgcactagcaaaaacgagaaaattgcactcagtcgccgagtcgagaagcattggcgtctgattggctggggccagattcaagcaggaatgaccctcgatatcccgcctgtccaattctgatttactagtggcgaaaaaaagcaaagagaaagaaacgaaagaggttattgtcggaggaaccgggggagatgtggcgaggcagggatttgttaggaacgattttcgttaggagtagaaattgtctttgtcgaatttctttcctttgctctttttcccattaccatgcggcccgggtacgttgtttctggttgagtctccaagatgcgagttttggggcaatttgttcacgaaccacatcattcattgtacttctatttcttctctgcatgctggatatcaaatggcatatgttagggtttctgcaaatttatttgttcgatcaattatttgatgcctta

SEQ ID NO: 2460 - DNA, 1847 bp, Humulus lupulus
cgtatcattacggccgaaactttccctcacttgaccctaattccgaaaactacagaaaaacccctctttctttctctctctcgcacacactgtatcagcatcatcttcttcttcttctctagtcgcctcgcccaagaacttcatccagggttcaagtactgcgaatataaatcgttgtttaaattcgtgagtggccaaataacataccaacaacttcttgaagcagaagaaaatcactttagaacaggcacaatgtcacgaaaaggtttgatggagcaagacctgggtaaattggatgtaactaagttaaatccactatcgcctgaagtaatatctcgtcaggcaaccatcaatattggcacaataggccatgtggcccatggcaagtcaacagttgtaaaagcaatatctggtgttcagactgttcgtttcaagaatgaattggagcgcaacattaccattaagcttggatatgcaaatgcaaaaatatacaaatgtgaagatgagcggtgccctcgacctatgtgctacaaagcatatggaagtggaaaggaagacagtcctctatgcgatgttccaggatttgagactgctaggatgaaattgctgagacatgtttcatttgtcgactgcccgggtcatgatattcttatggctacaatgcttaatggtgctgccatcatggatggagcgttgcttctcatagctgctaatgagagctgcccccaaccacagacgtctgagcacttggctgctgttgaaattatgcgccttcagcacattataattcttcaaaataaggttgacctcattcaagaaaatgtagccatcaaccagaacgaggcaattaagaaattcattgagggaactgttgctgatggtgcaccagtggtaccaatttctgctcagttgaagtataatattgatgttgtctgtgagtacattgttaaaaagatccctattccggaaaggaattttatctctcctcctaacatgattgtaattcggtcattcgatgtcaacaaacctggatttgaggttgatgatataaaaggtggtgtggcgggtggaagtatcctcaggggtgttttgaaagtgaatcaatttattgaggttcgtcctgggattgttgttaaagatgaaaatggaaacaccaaatgcacaccaatttattccagaattgtttcattgtatgccgagcaaaatgagctgcaatttgcagtaccagggggtctcattggtgttggtacaaccatggatcctactttgactcgtgctgataggttggtgggacaagttcttggcgaagttggatcactgcccgaggtttttgtcgagcttgaggttaacttcttccttctgcgaaggctattgggtgtgaagacaaagggctcagagaagcaaggaaaggtcacaaagctgaccaagggagagatgctgatgttgaacattggatccatgtcaacaggagccagggttcttgctgtaaagaacgatttggcgaagttgcaactcacctccccagtttgcaccagcaaaggggagaagattgcacttagtcgaagggtagaaaagcactggcggctgatcgggtggggccagattcaagctggaactactcttgatgttccaccctgccccatttgagctgactctgcatacatagacagaaaagacaagaaagggtaaagagcgaaaggaagaaagatgtggcaaggtcgagaactgttgggaactaatttttttgagatggagaagaaaacctcatttggatcaatactcttgtttttttgtttacctcgttaccatattttttttgggtttactgtttagtgtattctgagttg

SEQ ID NO: 2461 - DNA, 2019 bp, Medicago truncatula
cagttctttggtctggacctcttcttgcattctcaatgataatcttgatcaatacactcttttccttatgttacttgattgttaagtggaaaagagctgaactaagacatcgtgcaaggactgcatgtatgcggcgtttgatttcgcgtcttgtcgcggtgttcgtttggttcctattgaaagatcaacttcagtcaattacagattcaaccaatgatttaggcgtcgacgttccacccccaaaaccacatacaccaagaatcttctacgatttctcgactcatataaccgatttcgaagagattcttgatttttctgcaatctttaacactacagctctctttctttgctatttacagcaaatttcattcactgtagctgctttactcatccactctcaaatcccactatttgtcaaaatggctcggagagggttgatggaacaagacctgagtacgttggatgtcaacaaattgcatccgctatctcctgaagtcatatctcgccaggctacgatcaatattggcaccataggtcatgtggcacatggaaagtcaacggttgtgaaagcaatatcaggtgttcagactgttcgatttaaaaatgagttggaacgtaacattacaattaagcttggctatgcgaatgcaaaaatatacaagtgtgaagatgaacggtgtccaaggcctatgtcctacaaggcctatggaagtggaaaggaagatagtcctatgtgtgatgtacctgggtttgaaaattccaagatgaaattgctgagacatgtttcttttgttgattgcccgggacacgatattctcatggctactatgcttaatggtgccgcaatcatggatggagctttgctactcattgcagctaatgaaagttgccctcaaccacaaacgtctgagcatttagctgctgtggaaattatgcgtctacaacacataataatccttcagaacaaggtagacttgattcaagaaaatgtggctatcaaccagcatgaagcaattcagaagtttatacaaggaactgttgctgatagtgcaccagtagtacctatttcagcacaattgaagtataatattgatgttgtgtgtgagtacatcgtgaaaaagatcccaattcctgaacggaacttcatttctccacctaatatgatagtaattcggtcatttgatgtcaataaacctggttatgaggttgatgaaataaaaggaggtgtagctggtggaagtattctgaggggtgttttaaaggtcaaccaattcatcgaagttcgacctggaatagttgttaaagacgagagtggaaatatccgatgcacaccaatctactccagaattgtttcactatttgctgaacaaaatgagcttcaatttgcagttcctggaggcctaattggtgttggaacaacaatggatcccactttgacacgtgctgacaggttggtagggcaagttcttggagaggttggatcactgcctgatgtttttgtggaacttgaggtaaactttttcttgcttcgacggcttcttggtgtccggactaaaggttctgagagacaaggaaaggtctcaaagctgacgaaatcagaaattctaatgttgaacataggatcaatgtcaacaggtgccaaagttaccgctgtgaagaatgacttggcaaagttgcaacttacttcccctgtgtgcaccagcaagggtgagaagattgctcttagtagacgcgttgagaagcattggcgtctcattggttggggccaaatccaagctggtatcacccttgatgtccctcctgccccccttctgagttgaaggaaagacagatcaagagaaagactacaagaaatagcttttataaaaacctgagattaatttagtaggtatgtcggaagggaaaaaactgttgggaaccatttttgtgagatgtagaagattgtcaatttttttgttttcacacattgttgttggttacctattgttgaaattgtattttatgctgattgagtttaga

SEQ ID NO: 2462 - DNA, 1785 bp, Nicotiana benthamiana
ttcttgttccagacttgaaattactgacatctgaagaagtatcaaagagcagctaaaaaatgtctaaaaaagggctgatggagcaggacctgagcaagttggatgtaacaaagctgcatccactttcaccagaggttatttctcgtcaggctacaataaatattggtacaattggccatgtggctcatggaaagtcaacagttgtaaaagctatatctggagtgcagactgttcgttttaaaaatgagctagaaagaaacatcacaattaagcttggatatgctaatgctaagatatataaatgtgaagaagatcgctgccctagacccatgtgctacaaggcatatggaagtggaaaagaagacagtccaatgtgtgatgtccctggtttcgagaactgtaggatgaaattgctgagacatgtatcgttcgttgattgtcctggtcatgatattctcatggctacgatgcttaatggagctgcaattatggatggagctttacttctaattgctgctaatgagagctgtccccaacctcagacttctgaacatttagctgctgttgaaattatgcgcctccaacacataataattctccaaaataaggttgatctagttcaggaaaatgttgccattaatcagcacgaggcaattcagaagtttattcagggaactgttgctgatggtgccccagttgtaccaatctctgcacaactgaagtacaacattgatgttgtggctgaatatattgtgaagaaaattcccattcctgaaaggaatttcatttcaccaccaaatatgatagtcatccgatcatttgatgttaacaaacctggttttgaagttgatgatatcagaggtggtgttgctggtggcagtatactgaagggtgtcctaaaggtaaatcaactcattgaggtccgtcctggtattgttgtcaaggatgagagtggcaacattaagtgtaccccaatatattcaagaatagtatcattgtttgctgagcaaaatgaactacaatttgctgtgcctggaggcctcattggagttggaacaactatggatccaacactgactcgtgctgaccgattagtggggcaggttcttggtgaggttggatcacttcctgaagtgtttgttgagctggaggtaaatttctttttgctccgtcgtcttctgggagtaagaacaaaggactcagaaaggcagggtaaagtctcgaagttggctaagggagaaatcctcatgttaaacatagggtctatgtcaactggcgctcgtgttgtcgctgtcaagaatgtatttgcaaaactgcaattgacatcacctgtgtgtaccagcaaaggtgagaaaattgcgcttagccgaaggatcgagaagcactggcgtcttattggttggggccaaatccaagctggtattactcttgatgttccaccttgccccgtctgagtacacaaccaaattactactgagtgacaggaaaaactagtgaaacaagtcgattttgggatttagatgtgggaaggcagacagttgctaggatctatttttgtccggtgtaggagaaaagattatttaaaatttcggatactctataatctgctacgtttccttttcatatttgtgacttcttttctctttttcttttttcttatttccccccttgttctagtggttgtaccttgtaattcattggtttataaggtggatattcttttgagttcgtcttgcggcacatgtttgaaccattactacaactatctttgggaatttctattgc

SEQ ID NO: 2463 - DNA, 1606 bp, Citrus sinensis
accccgcggggatcgcaagaagtcccccaaaacctaaaattctctctcacacacacaccctctcacaatcaatatagcggtaaacctcagtcaaatctcggtctcgcagtcgttctccggtcgcaacttgctcagcgttcaatctgttttacgggcttgaacattactagtggcaatacagacaataaggagaggggtattttcaaagaaacaggcaagatgtcacggaagggtttgatggaacaggacttgagtaagttggatgtaactaagttgcatcctctttctcctgaagtcatttctcgccaggctactattaatattggaactatcggtcatgtggcccatggcaaatcaactgttgtgaaggcaatatctggtgttcagactgttcgttttaagaatgaattagagcgtaacattactatcaagcttggatatgcaaatgccaagatatacaaatgtgaagatgatcgttgcccacgaccaatgtgctataaggcatatggaagtgggaaagaagataatcctctgtgtgatgtgcctggttttgagaactgcaggatgaaattgcttaggcatgtctcttttgttgattgcccgggtcatgatattcttatggctacaatgcttaatggagcagcaattatggatggagcattgcttctcatagcagccaatgaaagttgcccgcaaccacaaacatcggagcacttggcagctgttgaaatcatgcgtctccaacatataataattcttcaaaataaagttgatctcattcaggaaaatgtggccatcaaccaacatgaagctatcatgaagtttatccagggaactgttgctgatggcgcaccagtggttcccatttctgcacagctaaagtacaatattgatgttgtatgcgaatatattgtgaaaaagattcccattccagagaggaactttattgatccaccaaatatgattgtaattcgatcttttgatgtcaataaacctggttttgaggttgatgatataagaggtggtgttgctggtggcagcatcctgaggggtgttctgaaggtgaaccaatttattgaggttcgtcccggtattgttgtcaaagatgagtccgggaacatcaagtgcacacctatatactcgagaatagtttcattgtttgctgagcaaaatgagttacaatttgcagttcctggaggtctcattggggttggtacaaccatggaccctactttgacacgtgcggatagattggtgggtcaggttcttggggaggttgggtcactccctgaagtttttgtcgagcttgaggtgaacttctttctattgcgccggcttttgggtgtgaggacaaagggctcagaaaggcagggaaaggtctccaaacttgccaaacaagagattcttatgctgaacataggatctatgtcgaccggagctagagttcttgctgtaaagaatgatttggcaaaactccaacttacatctccagtgtgcaccagtaggggggagaagattgcgctcagtcgaagagttgagaagcactggcgtcttattggctggggccagattcaagccggaactaccctcgacgtccctgccagcc

SEQ ID NO: 2464 - DNA, 1968 bp, Cajanus cajan
gaggacgccacgaagcaagatttgttcgagcttcaatttaccggagaggaacgtgctttgctcgagcaaaattcgtcactctagttgcactgtgcatcactcggaaccaatcgatagtttagttgttaagtcataaatcagtttcatcccttgagtttctattcaaagcagtcaaaatgtcgcggaagggtttgatggaacaagatctgagtaagttggatgttacaaaattgcatccactttctccagaagtcatatcacgtcaggctactattaatatcggtactataggtcatgtggcacatggcaagtcaacagttgtgaaagcaatatcaggcgtgcagactgtccgtttcaaaaatgagttggagcgtaacattacaatcaagcttggctatgcaaatgcaaaaatatacaagtgtgaagatgaacggtgttctaggcctatgtgctacaaggcttatggaagtggaaaggaagataaccctatgtgtgatgtgccagggtttgaaaactctaagatgaaattgctgagacatgtttcatttgtggattgcccaggacatgatattctcatggctacaatgcttaatggagcagctatcatggatggagctttgctactcatagctgccaatgaaagctgcccacaaccacaaacctctgagcatttagctgctgtggaaattatgcgtctacagcacataataatccttcagaataaggtagacttgattcaagaaaatgtggcaatcaatcagcatgaagcaatttcaaagtttatacaaggaactgttgctgatggtgcaccagtagtgcctatttcagcacagttgaagtataatattgatgttgtgtgtgagtatattgtgaagaagattccaattcctgaaaggaactttatttctccacctaatatgatagtaattcggtcatttgatgtcaataagcctggttttgaggttgatgagataaaaggaggtgtggctggtggaagcatcctcaggggtgttttgaaggtcaatcaattcattgaagttcgacctggaattgttgttaaagatgagagtggaaatatcagatgcacacctatatactcgagaatagtttcattgtatgctgaacaaaatgagcttcaatttgctgtgcctggaggcctaattggtgttgggacaacaatggatcccactttgacacgtgctgataggttggtaggtcaagttctaggagaggttggatcactgcctgaggtttttgttgaacttgaggttaactttttcttgcttcgacggcttcttggtgtccggacaaaaggctcagagagacagggaaaggtatctaagcttgccaaaggagagatgttaatgttgaacataggatcaatgtcaacgggggctagagttattgctgtgaagaatgatttggcgaagttacaacttacttcccctgtgtgcaccagcaagggtgagaagattgcacttagtcgacgtgtggagaagcattggcgtcttattgggtggggccaaattcaagcaggaatcactcttgatgtccctcctgctccccatttgagttgaatacagataagagacagaccagaagtaaaagatcagttattataaaaatctgagatgaatctagatatgtgggaagggagacacttgttgggaaccatttttgtgaggtggagaagaaaacgttttgattgttgtctatttttgttttcacatcgttattggtttattttccccactgtacctattattgaagttgtgtatcttatgctgattgagttcaggctgggagtgagcatctcagcaagcacttgtttcaatccatgccatcttaccaatatgcattattggtttggtgtgtaccatgaagcattttgttttgcggtggttaaatattttcttaagcactttcttagaagaaaataaaaaatgtgaaaataataaaatttttcag

SEQ ID NO: 2465 - DNA, 1818 bp, Helianthus annuus
cagaaccctgaacgaaaccctagctaccgtttgtactcaccaatattatccacatcatcagccaccaccacacacacagtgttcatcgatcacagaatctcttcaacaccgtagcgaatcgccgattcttcacgcaaaaaggacagtgaatatggctagaaaaggtttaatggagcaggatttgagcaagctggatgtagcaacgctgcatccgctttctccggaggttatatctcgtcaggcgacgattaatattggtactattggtcatgtggctcatgggaagtcaacagttgtaaaagctatatctggtgtacagactgttcggttcaaaaatgagttggagcgtaacattactatcaagcttgggtatgccaatgctaagatatacaaatgtgaagatgaaaagtgccctcgacccatgtgctacaaggcctatggaagtggaaaagaagatagccctccttgtgacgttcctggatttgagaacagcaagatgaaactgatgaggcatgtatcgtttgttgactgtccaggacacgatattctcatggccactatgcttaacggagcagctatcatggatggagcattacttctcatagcagcaaatgaaagttgcccccaacctcagacttctgagcacttggctgctgttgagattatgaggctccaacatattataattcttcaaaacaaggttgatctaattcaagaaaatgtagccattaaccaacacgacgcaattcagcaattcatccagggaacggttgctgacggtgcaccagtgatcccggtgtcagctcagcttaggtataatatcgatgtggtgtgcgaatacataataaaaaggattcccattccagagaggaacttcatttcacctcccaatatgatagtaatccgttcgtttgatgttaataagcctggatctgaggttgatgagattagaggtggtgtggcgggtggaagtatcctcaagggtgtgttgaaggtaaaccagcatattgaggtccgtccagggattgttgttaaagacgagagtggtaacatcaagtgcaccccaatttactcgagaatcgtgtcactatatgcagagcagaatgaacttcaatttgccgtacctggaggccttattggtgttggaacaacaatggaccctatgttgacccgtgctgatcggttggtgggtcaagttcttggagaggtcgggtctcttcctgatgtttatgtcgaacttgaggtgaacttttttcttttgcgtcggctgcttggtgtgaagacaaaaggaacagaaaagcaagggaaggtatcaaagttgtcaaaggcggaaatactgatgttgaacataggatcaatgtcgactggggctcgtgttttggcagttaagaatgatttagcaaaactgcagttgacggcacccgtctgtacgagcagaggggagaagattgctctgagcaggagagttgagaagcattggcggttaatcgggtggggacaaattcaagctggtttgactctagagatcccaccttgtccgatttagagttttagacgacttttgaactccagttttgcctgcgctgctgatactcttctttgctacttctgattcttggttatccgtttgagtttttgtagcgtttgtgattttatactattcgatttgctttgaacaaatgctttgcatggtgtttgtggagaggatcataagacgagtgcttttcaccatcaaatgttttaattattggttattttttattaacttgtagtcttatgatagaaatttgaaagtagacctgtatcttatatcgttag

SEQ ID NO: 2466 - DNA, 1834 bp, Phaseolus vulgaris
atagtttacttgtcaagtcataaattagtttcaacacttaagatcccattggaagcttgccaaaatgtcgcggaagggtttgatggaacaagacctgagtaagttggatgtggcaaagctgcatccactttctccagaagtcatatctcggcaagctactattaatattggcactattggtcatgtggcacatggcaagtcaacagttgtgaaagcaatttcaggtgtccagactgtgcgtttcaaaaatgagttggagcgtaacattacaatcaagcttggctatgcaaatgcaaaaatatataagtgcgaagatgaacggtgttcaaggcctatgtgctacaaggcttatggaagtgggaaagaagatagccctatgtgtgatgtgccagggtttgaaaacagcaagatgaaattgctgaggcatgtttcatttgtggattgtccgggacatgatattctcatggctactatgcttaatggagcagcaatcatggatggagctttactactcatagctgctaatgaaagctgcccacaaccacaaacctctgagcacttggctgctgtggaaatcatgcgtctacagcatataataatccttcagaacaaggttgatttgattcaggaaaatgttgctatcaatcagcatgaagcaatttcaaagtttatacagggaactgttgctgatggtgcaccagtagtacccatttcagcacagttaaagtataatattgatgttgtgtgtgagtatattgtgaagaagatcccaatccctgagaggaattttatttctccacctaatatgattgtgatccggtcatttgatgtcaataaacctggttttgaggttgatgaaattaaaggaggtgtagctggtggaagcattctgaggggtgttttgaaggtgaatcaattcattgaagttcgacctgggattgttgttaaagatgagagtggaaatatccggtgcacaccaatatactcaagaatagtttcattgtatgctgaacagaatgagcttcaatttgctgtacctggaggcctaattggtgttgggacaacaatggatcccacgctgacacgtgctgataggttggtaggtcaagttctaggagaggttggatccctacctgaggtttttgttgaactcgaggtaaactttttcctgcttagacgacttcttggcgtccgaacaaaagggtctgagagacaggggaaggtatcgaagctggctaaaggagagatgctaatgttgaacataggatcaatgtcaacgggggctagagtaattgctgtgaggaatgacttggcaaagttgcaacttacatcccctgtttgcactagcaagggtgagaagatagcacttagtcgacgtgttgagaagcattggcgtcttattgggtggggccaaatccaagcaggaatcacccttgacgtccctcctgctccccagttcagttgaacgcagacaagacaaaccacaggaaacacccgctgcgtctataaaaaccctagaacaatttagatatgtgggaagggagacagttgttgggaaccatttttgtgaggtggcgaagaaaacgttttgattgttgtctatttttgttttcacatcgttattgttttattttgtccatgtaacttattaaagttcaatatgagttgttggtcctgggatgtgcttattaggagcacaaaattcatctttaaatgtatgttcttagtaaatgttattatttaaaggagtttagtttgaacgaataagggtatatgcgtagtaatttttaattacgagatattagataaatctgataagatattttaattggaa

SEQ ID NO: 2467 - DNA, 2163 bp, Cicer arietinum
ccgaaacccgtgaaacggaaaacccactaacccatttggtactctaaacgcaagaacaaaaaaaacctagccaccccaaagaacttcaaaacttttcactaccaacaaatttcgatcgaagaggctcttcttctcacaaagccctcttctttcgtatctatttctttcaacaaatttcgttactgtagctgctctactcacccactttcaaatcccactaattgccaaaatgtcgcggaaggggttgatggaacaagacctgagtaagttggatgtgacaaagttgcatcccctttctcctgaagtcatatcccgacaagctactattaatattggaaccataggtcatgtggcacatggaaagtcaacagttgtgaaagcaatatcaggtgttcagactgtgcgttttaaaaatgagttggagcgtaacattacaatcaagcttgggtatgcaaatgcaaaaatatacaagtgtgaagatgaacggtgtccaaggcctatgtcctacaaagcttatggaagtggaaaggaagataatcctatgtgtgatgtaccagggtttgaaaattccaagatgaaattgctgagacatgtttcctttgttgattgcccaggacatgatattctcatggctaccatgcttaatggagcagccatcatggatggagctttgctactcattgctgctaatgaaagctgcccacaaccacaaacttctgagcatttagctgctgtggaaattatgcgtctacagcacattataatccttcagaacaaggtagacttgattcaagaaaatgtggcaatcaaccagcacgaagcaattcagaagtttatacaaggaactgttgctgatagtgcacctgtagtacctatttcagcacaattgaagtataacattgacgttgtttgtgaatacatcgtgaaaaagatcccaatccctgaacggaacttcatttctccacctaatatgatagtaattcggtcatttgatgtcaataaacccggttatgaggttgatgaaataaaaggaggtgtagctggtggaagtatcctgaggggtgttttaaaggtcaatcaattcattgaagttcgacctggaatagttgttaaagatgagagtggaaacatccgatgcacacctatctactccagaatagtttcattatatgctgaacaaaatgagctccaatttgcagttcctggaggactaattggtgttggtacaacaatggatcccactttgacacgtgctgacaggttggttgggcaagttctcggagaggttgggtcactgcctgaggttttcgtggaacttgaggtaaactttttcttgcttcgacggcttcttggtgttcggacaaaaggttccgagagacaaggaaaggtctcaaagctggcgaaagcagagatgctaatgttgaacataggatcgatgtcaacaggtgccagggtggttgctgtgaagaacgacttggcaaagttgcaacttacttcccccgtgtgcactagcaagggtgagaagattgctctaagtagacgtgtcgagaagcattggcgtcttatcggttggggtcaaatccaagctggaatcaccctcgatatcccttctgccccccttctgagttgaaagaaagacagattaagagacagactacaagaaacaccttttttataaaaacctgagatgaatttaggtatgtgggaagggacaacaaaactgttggtaaccatttttgtgagatggagaagattgtcaattttttgttttcacattgttgcttatttatttattatccccactgtctatctattgttgaaattgtatcttatgctgattgagtttagaatgcgagcaagcgactcatctatcccttgttttcttttaatggtcaccttagcaataattaatccagcaatcttgctatacagtgaggcatttcataattcatattgtaaacacatatccaagcaatggttgaaacttttaagactgatacacttattatgattcttgttattcgtaagttcttctagagctataatttgtggcacgtttgctagaaacgacgttacaagttgaaaaacaccttaatttatcatgttatggatgcttggctatgtgaatgtttgcaatggcagccagattaatttgaattaagc

SEQ ID NO: 2468 - DNA, 2015 bp, Trifolium pratense
ctgttccagaacgcaacgcaaccaaaaaacctagctagccacccccaaaccgagaaacctcaaaaccacaataatcatcttcactcctagcttcgatttcgaataccttaaacactctttttctctctcactccagattccgtcactgtagcttctctactcatccactttcaaatcccactaattgaagtgaaaatggcgacgcgtagggggttgatggaacaagacctgagtaagttagatgtgacaaaattgcatccgctttctcctgaagttatatcccgtcaggctactattaatattggcaccataggtcatgtggcacatggaaagtcaacagttgtgaaagcaatatcaggtgttcagactgtgcgttttaaaaatgagttggaacgtaacattacaatcaagcttggttatgccaatgcaaaaatatacaagtgtgaagatgaacggtgtccaaggcctatgtcctacaaggcttatggaagtggaaaggaagataatcctatgtgtgatgtaccagggtttgaaaattccaagatgaaattgctgagacatgtttcctttgttgattgtccaggacatgatattctcatggctactatgcttaatggagcagcaattatggatggagctttgctactcattgctgctaatgaaagctgcccgcaacctcaaacctctgagcatttagctgctgtggaaattatgcgtctacagcacataataatcctccagaacaaggttgacttgattcaagaaaatgtcgcaatcaaccagcatgaagcaattcagaagtttatacaaggaactgttgctgatagtgcaccagtagtaccaatttcagcacaattgaagtataatattgatgttgtgtgtgagtacatcgtgaaaaagatcccaatccctgaacggaacttcatttctccacctaatatgatagtaattcggtcatttgatgtcaacaaacctggttatgaggttgatgaaattaaaggaggcgtagctggtggaagtattctgaggggtgttttaaaggtcaaccaattcattgaagttcgacctggaatagttattaaagacgagagtggaaatatccgatgcacacccatctactccagaatagtttcattatttgctgaacaaaacgagcttcaatttgcagttcctggaggtctaattggtgttggaacaacaatggatcccactctgacacgtgctgacaggttggtagggcaagttctcggagaggttggatcactgcctgatgtttttgtagagcttgaggtaaactttttcttgcttcgacggcttcttggtgtccggacaaaaggttccgagagacaaggaaaggtctcaaagctggtgaaagcagaaatgctaatgttgaacataggatcaatgtcaacaggtgccagagtggttgctgtgaagaatgacttggcaaagttacaacttacttcccctgtgtgcaccagcaagggtgagaagattgctctaagtagacgtgttgagaagcattggcgtcttatcggttggggacaaatccaagctggaatcacccttgaagtccctcctgcccccgttttcagttgaaagaacaacagattaagagaaagactacaagaaaaacaccatttataaaaacaccttgagatgaatttaggtatgtgggaaggggaaaaaatgttgggagccatttttgtgagatgggttagattgttaattttttgttttcacattgttgttggttacctattgttgaaattgtattttatgctgattgagtttagaatgcgagcatacgactcagccatcacttgttttcattcattggcaaccttaccaataattagtccagcaatcttgctatacagtgaggcatttcatgattcatactgtaaacatatccaagaaactgttgaaaattttaagactggtacactttgtctggtccttgttactactatgctcttccagtattggaatgtgttcacatggctgtgtggacc

SEQ ID NO: 2469 - DNA, 1781 bp, Allium cepa
aagcagaacaaactagaactcagccccttatctgaaaccctaaagctgccgcttctgccaccgtcatatcctccttcgccgtcgctatcttttcatctgctattcaagattccaaagcaaagatggctaagaagtcaggattaatggagcaagatctaagtaagcttgatgtgacgaagcttactcctctttcgcctgaagttatttctcgtcaagctacaattaatattggcaccattggccatgtggcgcatggaaagtcaactgtggtgaaagcaatatctggtgttcagactgtgcgatttaagaatgaactggagaggaatatcactatcaaacttggatatgctaatgcaaagatatataagtgtgaagatgagaaatgtccaaggccaatgtgctacaaagcttacggaagcggaaaggaggatagcccggattgtgatgtgcctggatttgagaaagccaagatgaaacttttgagacatgtttcattcgttgattgtcctggacatgatattctcatggctacaatgcttaacggagctgctatcatggatggagctctgctgttaatagctggcaacgaaagttgtccccaacctcaaacttctgagcatcttgctgctgttgaaatcatgcgacttgagcacataataattcttcaaaataagatcgatcttattcaagaaagcgttgcgatcaatcaacatgaatcaattcagaatttcatcaagggcacaattgctgatggtgccccagtagtgcctatatcggctcagctgaaatataacattgatgttgtgtgtgaatatcttgtcaacaaaatcccaattcctgtaagggattttacatcgccgccaaatatgattgttatccgatcatttgatgtaaataagcctggttctgaggttgatgaaatcaaaggtggtgttgctggtggaagtattcttaggggagttttgaaggtgaaccaattaattgaagttcgacctggtattgttcttaaagatgagagcggcaacatcaaatgtactcctatatactctagaatcaagtccttatttgctgaacaaaatgaattgcaatttgctgtacctggaggactcattggagttggtactaccatggatcctacattaacccgtgctgataggcttgttgggcaagttcttggtgaagttggctctcttcctgatgtttttgttgagcttgaggtaaatttctttttgctgaggaggctactgggagtgagaacgaaaggagcagaaaagcaaggaaaagtgtccaaactgacaaagggggaaattctgatgctgaacatcggctcaatgtcaactggagctaaagtgatagcagtgaagaatgatttagctaagctgcaactgacggcacctgtatgcacaagcaaaggggagaaagtggcgctcagcagaagagttgaaaaacattggcggcttattggttggggtcagatccaggctggctctactctccaaatcccacccccacctactttttaattttacaaagagagagagagagagtttgtatttgaattctagtataatttatggggagaggatttcaactgttagattatatttttgttagatggagaagattgcatatttttatcacatcatatttgtatttcattgtatgtgctatgtttcctttagtcgatgcataagaagctggttgctttgtgtttttctttgtacatgtattctaactttgataacttactctgtaatcagactagttgtatgatgatttaa

SEQ ID NO: 2470 - DNA, 2082 bp, Olea europaea
atgaatcaaatacatggagataatggagataagtccagtgacgaacaattaactcgtaaaatacctatccctagtttgctacctccttctgcaatttccccagtaaggtccgcaaccccgacagctgctcgtaaactaagctcaatccggcgacccattaagaacagtcaaaatgtctaaaaaaggtttgatggagcaggacttaagcaagctggatgtgacaaaactacatccgctctcacctgaagttatttctcgtcaggctacaatcaacattggcaccattggtcatgtggctcatgggaagtcaacagtggtgaaagccatatctggagtccagactgttcgttttaaaaatgagctggaacgtaatattaccatcaagcttggatatgccaatgcaaagatatacaaatgtgaagatgatcgatgtcctcgacctatgtgctacaaggcgtatggaagtggaaaagaagatagcccaatgtgtgatgtgcctgggtttgaaaactctaggatgaaactgctaagacatgtctcttttgttgattgcccgggtcatgatattctcatggctacaatgcttaatggagcggcaattatggatggagctttacttctcatagcggccaatgagagctgtccccaacctcagacttcagagcatttagctgctgttgaaattatgcgccttcagcatataataattcttcagaataaagttgatctagttcaagaaaatgttgcaatcaaccagcatgaagccattcagaaatttattcagggaactatcgcagatggtgcactagtggtaccaatttctgcacagctcaagtataatattgatgtcgtatgcgaatatattgtgaaaaaatccccattccagaaaggaacttcatttcaccaccaaatatgattgtcatccgttcttttgacgtcaataagcctggatttgaagttgatgaaattagaggtggggttgcgggtggaagtattctgaagggtgttttgaaggtgaatcaatttattgaggttcgccctggtattgttgttaaggacgaaaatggaaacatcaaatgtaccccaatatattctagaatagtttcgttgtatgctgagcaaaatgaactgcaatttgctgtgcctggcggcctcattggggtcggaaccactatggatcctacgcttacacgtgctgataggttggtgggacaggttcttggagaggttggttcacttcccgaggtgtttgttgaactggaggttaatttctttttgctgcggcggctattgggtgtgaggacaagggactcagagaggcagggtaaggtctcaaagctggctaagggagagattcttatgttgaacataggatctatgtcaacaggtgctcgagtcattgccgtaaagaatgtttttgcgaaactacaactcacatctcctgtgtgcacgagcaaaggcgagaaaattgctctcagccgaagaatcgtaaagcactggcgcctgattggttggggccagattcaagctggtattactctagaagtcccaccttccccatttaattgaaatacagttgatttcagagaagacaggaaaaactaagcaattacaagcaaattagggaatagatgtgggagggtgggcatctaagggttacaagttttgttcaatggagaaaagataatttggattttcgaatacttctattgtttgtggaaatcttcttctttcattttctagtgggagttccatattccttgttatcattgcttgaatgcctttttgttgtcaagttactaagcaagaaatgtgcttgttcaatgccataactgaaacagcaatgctgaaaatgctgctcgtacagaagggtgtttacattcttcttgacagatcagacacatgaagaggcggtggccacggcttcttgcattttttattcatgtgggatcgactcgggacccacacacatgtgagtatctatcatgtaggatgtaaaccattttctggtagaggagctttattctaactgaaatcaaactctccagtattgaaatgccaacttatacgacacttgttttg

SEQ ID NO: 2471 - DNA, 1852 bp, Olea europaea
cagcagtaacacaacgtatccctagtttgctaaatctctcttccccctccccggtccgtctcccatcctcagtaaagcagtagacacagacggctgttcgtaactaagttctttccagagacctattaagagcagtaaaaaatgtctaaaaaaggtttgatggagcaggacttaagcaagctggatgtgacagaactacatccactctcgcctgaggttatttctcgtcaggctacaattaacattggcaccattggtcatgtggctcatgggaagtcaacagtggtaaaagccatatctggagtccagaccgttcgttttaaaaatgagctggaacgaaatattaccatcaagcttggatatgccaacgcaaagatatacaaatgtgaagacgatcgatgtcctcgacctatgtgcttcaaggcatatggaagtggaaaagaagatagtccaatttgtgatgttcctgggtttgaaaactctaggatgaaattgctaagacatgtctcttttgttgattgcccgggtcatgatattctcatggctacaatgcttaatggagcggcaattatggacggggctttgcttctcatagctgccaatgagagctgtccccaacctcagacttcagagcatttagctgctgttgaaattatgcgccttcaacatataataattcttcagaataaagttgatctagttcaggaaaatgttgcaattaaccagcatgaagccattcagaaatttattcagggaaccgttgctgatggtgcaccagtggtaccaatttctgcacagctcaagtataatattgatgttgtatgcgaatatatagtgaaaaaatcccattccagagaggaacttcatttcaccaccaaatatgattgtcatccgatcttttgacgtcaataagcctgggtctgaagttgatgaaattagaggtggggttgctggtggtagtattctgaagggtgttttgaaagtgaatcaatttattgaggtccgtcctggtattgtcgtgaaggacgaaaatggtaacatcaaatgtaccccaatatattctagaatagtttcattatatgcggagcaaaatgaattgcaatttgctgtgcctggaggcctcattggggtcggaaccaccatggaccctactcttacacgtgctgataggttggtaggacaggttcttggagaggttggttcacttcctgaggtgtttgttgaactggaggttaattctttttgctgagacggctgttgggtgtgaggacaagggactcggagaggcagggtaaggtctcaaagctgactaagggagagattcttatgttgaacataggatctatgtcaacaggcgctcgagtcattgctgtcaagaatgtttttgcaaaactgcaactcacatctcctgtatgcaccagcaaaggagagaaaattgccctcagccgaagaatcgaaaaacactggcgtctgattggttggggccagattcaagctggtattactcttgaagtcccgccttctccatttaactgaactactggccattacagagaagccagagaaacctaagcaaaccagaaaattatggactagatgttgtcgggctgttatcaatgggtaaccatttttgtttgatggagaaaagattatttggagtttcagatacttttattgcttgtggtaattttcccccgtcttttttccgtcggagttctttataccttgctcgaatgtgatctggatgtcgagttatcaaacaaagctatgtgcttgttcaatgccattactgaaataaacttatctagtattagaatgtttgactaccgtgacaattttttgcaagagccag

SEQ ID NO: 2472 - DNA, 1604 bp, Ambrosia trifida
acagtaatattattattagaaccctgaacgaaaccctagctaacgtttctactcaccaatattatccacatcatcagccaccacacacacaccctcttcaaccccctatcaattccttcactcttcacgcaaaaagaatagtgcaagatttgtgtagaagagtgaacatggctagaaaagggttaatggagcaggatttgagtaagctggatgtagcggcgctgcatccgctttctccggaggttatttctcgtcaagctacgattaatattggtactattggtcatgtggctcatgggaagtcaacagttgtaaaagctatatctggtgtgcagactgtgcggttcaaaaatgagttggagcgtaacattactatcaagcttgggtatgccaatgcaaagatatacaaatgtgaagatgaaaagtgccctcgacccatgtgttacaaggcatatggaagtggaaaagaagatagccctccttgtgatgtgcctggatttgagaacagcaagatgaaattgatgaggcatgtatcgtttgttgactgtccaggacacgatattctcatggctactatgcttaatggagcagctatcatggacggagcattacttctcatagcagcaaatgaaagttgtccccagcctcagacttctgagcacttggctgctgttgagattatgaggctccaacatatcataattcttcaaaataaggttgatctaattccagaaaacatagccattaaccaacacgacgcaattcagcaattcatacagggaacggttgctgatggtgcaccagtgatcccagtatcagctcagcttaggtataatatcgatgtggtgtgcgaatacataataaaaaggattcccatcccagagaggaacttcatttcacctcccaatatgatagtaattcgttcatttgatgttaataagcctggatctgaggttgatgagattagaggtggtgtggctggtggaagtattctcaagggtgtgttgaaggtaaaccagcatattgaggtccgtccagggattgttgttaaagatgagagtggtaacatcaagtgcaccccaatttactcaagaatagtgtcactatacgcagagcagaatgaacttcaatttgctgtacctggaggtcttattggtgttggaacaacaatggaccctatgttgacccgtgctgatcggttggtgggtcaagttcttggtgaggtcggctctcttcctgacgtttatgtcgaactagaggtgaacttttttcttttgcgtcggctgcttggtgtgaagacaaaaggaacagaaaagcaaggaaaggtgtcaaaattgtcaaaggcggaaatactgatgctgaacataggatcaatgtcgactggggcccgtgttttggcagttaagaatgatttagcaaaactgcagttgacagcacccgtgtgtacgagcaaaggtgagaagattgctctgagcaggagagtagaaaagcattggcggctaatcggttggggacaaattcaagctggtgttactcttgatatcccaccctgtccaatttagaggtctaagcgcccatttgaaatccagttttgcctgctgctg

SEQ ID NO: 2473 - DNA, 1857 bp, Eucalyptus grandis
ttcttcctttctgctctctgcaacatcaccattccaaaagccctctctctctctctctctctctctctctctcttctttctctctctacctggtggattcgccgcgagctgaggagcagagagtttttgggagccagcaaaaatgtcgaggaagggtttgatggagcaggacctgagtaaattggatgtgacgacgttaactccactctctcctgaagtcatatcccgccaagccacgattaacattggcacgatcggccatgtggcgcatggaaagtcgacagtggttaaagctatatctggcgtccagactgttcgtttcaaaaacgaattagagcgaaacatcaccattaagcttggatatgccaatgcaaagatttacaaatgtgaagatgaacgatgtcctaggcctatgtgctacaaagcttatggaagtggaaaagaagatactcctgcgtgtgatgtacctgggtttgaaaattgccgaatgaagctcctcagacatgtgtcctttgttgattgtcctggtcacgatattctcatggctactatgcttaatggagcagctattatggatggtgcattgctgctcattgctgcaaatgagagctgcccccaacctcaaacttctgaacacctggctgctgttgaaattatgcgcctccaacatattataatcttgcaaaacaagattgatcttatacaggaaaatgtagctatcaaccagcatgaagcaattcagaaatttattcagggaactgtagctgatggtgcaccagttgtcccaatatctgcccagctaaagtacaacattgatgttgtttgtgagtacattgtgaaaaagattcccattccagagaggaactttattgatccaccaaatatgattgtgattcgatctttcgatgtcaataagcctggttttgaggttgatgagataagaggcggcgtggctggtggaagtattctcagaggtgttttgaaagtaaatcagatgattgaagttcgtccaggaattgttgttaaagatgcaaatggtactattcgttgtacaccaatatactccagaatagtatccctgtttgcggagcagaatgaactccagtttgctgtgcctggaggtctcattggagttggtactaccatggaccctaccttgaccagagctgatagattggtgggtcaggttcttggggaggttggatccctccccgagatctatgttgagctcgaggtgaatttcttccttctgcgacgacttctaggtgtcaggacaataggatcagagaggcaaggaaaggtgtcaaagttgaccaagggagagatcctcatgttgaacatcggctcaatgtccaccggcgctcgtgtcattgccgtgaagaatgatttggccaagctgcagctcacttctccagtgtgcacaagcaaaggcgagaagattgccctcagtcggcgagtcgaaagccactggcgtctgattggatggggccagatccaggctggaatgatacttgaggtcccgccagtacaatcgtgagtgaattgttacataaaaagatttgaaaagcgagagaaagacggagatttgtgaaagattcattgaagagttacaaagatgtgggaaggcagagaattgatgggtacgatttttgtcagatggagaagaaaacatttagcttggactccttattgcttttgttgtgtgattcttttttgctctgttcggaatcatgtgatttttgtgacagtcccctgttgagatgggggtcaaatatacactcccgtttgggcgaatgtggccgattctttcataaaaagtacactcaatgagagactcaaaagtcatacgttcattga

SEQ ID NO: 2474 - DNA, 1798 bp, Nicotiana benthamiana
ctaatttcagacttggaaattactgacatctgaagaagtatcaaagagctgcagaaaaatgtctcggaaaggactgatggagcaggacctgagcaagctggatgtgacaaaactgcatccactttcaccagaggttatttctcgtcaggctacaataaatattggtaccattggtcatgtggctcatgggaagtcaacagttgtaaaagctatatctggcgtacagactgttcgttttaaaaatgagctagaaagaaacatcacaattaagcttggatatgcgaatgctaagatatataaatgtgatgaagatcgctgtcctagacccatgtgctacaaggcatatggaagtggaaaagaagacagtccaatgtgtgatgtccctggttttgagaactgtaggatgaaattgctgagacatgtatctttcgttgattgtcctggtcatgatattctcatggctacaatgcttaatggagctgcaattatggatggagcattacttctaattgctgcgaatgaaagctgtccccaacctcagacttctgagcatttagctgctgttgaaattatgcgcctccaacacataataattctccaaaataaggttgatctagttcaggaaaatgttgcgattaaccagcatgaggcaattcagaaatttattcagggaactgttgctgatggtgccccagtggtaccaatctctgcgcaattgaagtacaacattgatgttgtggctgaatatattgtgaagaaaattcccattcctgagaggaatttcatttcaccaccaaatatgatagtcatccgatcatttgatgttaataaacctggttttgaagttgatgatatcagaggtggtgttgctggtggcagtatactgaagggtgtcttgaaggtaaatcaactcattgaggttcgtcctggaattgttgtcaaagatgagagtggcaacattaagtgcactccaatatattcaagaatagtatcattgtttgctgagcaaaatgaactacaatttgctgtgcccggaggcctcattggagttggaacaactatggatccaacactgactcgtgctgaccgattggtgggacaggttcttggagaggttggatcacttcctgaagtgtttgtcgaactggaggtaaatttctttttgctccgtcgtctattgggagtgaggaccaaggactcagaaaggcagggcaaggtctcgaagctggctaagggagaaatcctcatgttaaacatagggtctatgtcaacaggggctcgtgttgtcgctgtcaagaatgtctttgcaaaactgcaattgacatcacctgtgtgtaccagcaaaggggagaaaattgctcttagccgaaggatcgagaagcactggcgtcttattggttggggccaaatccaagctggtattactcttgatgttccaccttgccccgtctgagtacacaaccaaattactactgagtgacgggaaaaaactagtgaaacaactcgattttgggatttagatgtgggaaggcaaacagttgctaggatctatttttgtccggtgtaggagaaaagattattttaaatttcggatactctatactctgctatgtttctttttcctatttgtgatatcttttctctttttcttttttcttatttcctcccttgttctagtggttgtaccttgtgattcattagtttataaggtggatggttattcttatgagttcgtcgaaaacatttagcttgcggtacatgtttgaaccattactacaattgtctttcggaatttcta

SEQ ID NO: 2475 - DNA, 1789 bp, Petroselinum crispum
gtttggtacgagggttttggacatcctagttgacaagagtcgagtgttagggttaagttcttaatagatagatacagagtgtgcgtttgtataacaagctcaagttccatcaaatctgttcaggaataacaagtatttgattaaggaagagcaaaatgtcgcggaaaggactgatggagcaagatctgagcaagctggatgtgacacaactacatccattgtccccagaagtcatatctcggcaggctaccattaatattggtactattggccatgtggcgcatggaaaatcgacagttgtaaaagctatatctggtgttcagactgtacgttttaaaaatgaactagaacgaaatatcactataaagcttgggtatgccaatgcaaagatatacaaatgcgaagatgaaagctgccctcgaccaaagtgctacaaggcatatggaagtgggaaagaagatgctcctcaatgtgatgttcctgggtttgaaaactctaagatgaagttattgagacatgtctcttttgttgattgtccgggtcacgatattctcatggctacaatgcttaatggagccgcaattatggatggagcattactgcttatagctgctaatgaaagttgtccccaaccgcaaacttcagagcatttggctgctattgaaattatgcgccttaagcatattataattcttcaaaacaaggttgatctgatccaggaaaatgttgctactaatcagcatgatgcgattcagaaatttattcagggcactgttgcggacagttcaccagtgataccagtttcagcacagttgaagtataatattgatgtagtgtgtgaatatattgtgaagaagattcccatcccagaaagaaacttcatttctcctccaaatatgattgtcatccggtcttttgacgttaataagcctggatctgaagtcgatgaaatcaaaggtggtgttgcgggtggaagtatcctcaagggtgtattgaaggtcaatcaatacatagaggttcgtcctgggattgttgttaaagacgaaagtggcagcatcaagtgcacaccaatatactctagaatagtttcactatttgctgagcaaaatgaactacaattcgcggtgcctggaggcctgattggtgttgggacaacaatggacccaactttaacccgtgctgatcgactcgttggacaagttcttggagaggttggatcacttccagaagtgtatgtcgaactggaggttaactttttcttgttgcggagacttctgggtgtaaggacaaagggcacggagaggcagggaaaggtatcaaagcttacaaagggagagatactaatgttgaacataggatccatgtccacaggagccagagtccttgccgtgaggaacgatttggcaaaactgcagctgacatctccagtctgcaccagcaaaggagagaaaatcgctctgagccggagagttgagaaacattggcgtctgattggttggggtcagattcaagctggtactaccctagacatcccaccctgtcccctttaagaaccacatccatcaagaaagagtagtatcaagaatttgaaaaaagggggggggggggggggggggggggggggggggggggggggggggggggggggggggggggggggggggggaaaaattcttcttgctgttattacttgctcctttccggataatatattattgtacactgttttgacccttggttgtgttcgtacggtgtataatactttaaaaatacaccaaaccttcggaac

SEQ ID NO: 2476 - DNA, 1782 bp, Lippia dulcis
agaaccacccaaagctctgtattttcgtcttgccctaactagcctagtctgccctctccgttctcttcgtggcaaccaagcaacccgccggaactctccatatccttccaaggagatatacatttttttttttctgagcggctttcttttctctcgttcttgactttgaaatttgattgagggggactaatcaaaagctgagcaaaaatgtctagaaagggcttgatggagcaggacctaagcaagctggatgtaacagagctacatccactttcgcctgaggttatttcccgccaggctacgattaacattggcacaattggtcacgtggctcatgggaaatcaacagtcgtgaaggccatatctggcgttcagactgttcgttttaaaaatgagctagagcgtaatatcaccatcaagcttggatatgccaatgccaaaatttacaagtgtgaggatgatcgttgccctcgacccatgtgctacaaggcatatggaagtggaaaggaagatagtccaatgtgtgacgttcctgggtttgagaattgtagaatgaagttgcttagacacgtgtcttttgttgattgtccaggacatgatattctcatggctactatgcttaatggagcagcaatcatggatggagctttacttctcatagctgccaatgaaagttgtcctcaacctcagacatcagaacatttagctgctgttgaaattatgcgtctccaacatatcataatacttcaaaataaagtcgatcttgttcaggaaaatgttgccatcaaccagcatgaagccatttccaaatttattcagggaactgttgcagatggcgcaccagtcgtgccaatttcagcacaactcaagtataacattgatgttgtggctgaatatctagtgaaaaagatcccgatacctgaaaggaacttcatatcaccaccaaatatgattgttatcaggtcttttgatgtcaataagcctggttctgaggttgatgaaataaaaggtggtgttgctggtggaagtattctgaagggtgttttgaaagtaaatcaatttattgaggttcgacctggaattgttgttaaggatgagaatgataacataaagtgcaccccaatatactccaggattgtttccttatatgctgagcagaacgaattacaatttgctgtgcctggaggccttattggagttggaacaacaatggaccccacacttacacgtgctgataggcttgttggtcaggttcttggagaagttggctcactccctgaagtatatgttgaactagaggtcaatttctttttactgcgtcgtctgttgggagttaggacgaaggacacagaaagacagggtaaggtctcaaagttgacaaagggagagatcctcatgttgaacataggatccatgtcaaccggtgcccgcgttgttgctgtcaagaatgtgtttgcaaaactgcagcttacttctcctgtttgcaccagcaaaggagagaagattgcactgagcagaagaatcgacaggcactggcgtctgattggttggggccaaattcaagccggtattactctggacgtcccaccttgccccatctaagtgaagtatctgaatttacagacaaaaaaggtaaacagagtttagcagaaaactagaaactgagagatgtgggaaggcaggcaactgttggggacaatttttgttcgatggaggagaaaatattgttttgagttttggatgcttatattgtttgtggtaatttggatcgttttcttcttt

SEQ ID NO: 2477 - DNA, 2001 bp, Populus trichocarpa
aaataataaaaataaaaatatcgtctttactctttatccctcctcactcgcacactgaaaccctagctatctacaccgccgcgtgctctctcttccaagcaaacagcgctgccggagaggttttcgactcgtttgagaagtaaccagttgaagcagaggaagagtcaagatggcgcggaaaggtttgatggaacaagatttaagtaaactggacgtgacaacgttgcatccactctctcctgaagttatatcgcggcaggcaaccattaatataggtactattggtcatgtggcacatgggaagtctactgtcgtcaaagcaatttccggtgttcagacggttcgttttaaaaatgagttggagcgtaatattacaataaagcttggatatgcaaacgcaaagatatacaagtgtgaagatgagcggtgccctcggcctaagtgctacaaggcatatggaagtggaaaggaagataatcctatgtgtgatgtagaagggtttcaaaactgcaggatgaatttgctgagacatgtctcttttgttgattgcccgggtcatgacattcttatggctacaatgcttaatggagcagcaattatggatggtgcattgctgctcatagctgcaaatgagagctgcccccaaccacagacttctgaacatcttgctgctgttgaaattatgcgtctccaacatattataattcttcaaaataaagtggatcttattcaggaaaatgcagccatcaaccagcacgaggctattcagaaatttattcagggaactgttgctgatggtgcaccagttgtgccaatttctgctcagctaaagtataacatagatgttgtgtgtgagtatattgttaaaaagatcccaattccagagaggaactttatctcaccacctaacatgattgttattcgatcttttgatgtcaacaaacctggatacgaggttgatgagataagaggtggtgtggctggtggaagcatcctcaggggtgttttgaaggtcaatcaatttattgaggtccgtcctgggatcattgttaaggacgaggctgggaacatgaagtgcaccccaatatatactagaatagtgtcattatatgccgagcagaatgagctacaatttgccgtgcctggaggtctaattggtgttggcacaaccatggaccccactttgacacgtgctgatagacttgtgggtcaagttcttggtgatgttggctcactccctgaagtttttggtgagcttgaggtgaatttctttcttttgagacggcttattggtgtcaggacaaagggctcagagaagcagggaaaggtttcgaagctgaccaagggagagattcttatgttgaacattgggtccatgtcatctggtgctcgagttcttgctgtgaagaatgatttggcaaaactacaacttacttctccagtctgcaccagcaagggtgagaagatcgcattgagtcgccgagtggagaagcactggcgtctcattgggtggggtatgattcaagccggaaccaccatcgaagtcccaccttgccccctctgagtgtttttaaacaggtagacagctagagaaaatcagagtgaaaacagcataagaaaggcttttatctaatatgtgggaaggtaggcagttgaatggatcttttttttttccagtgcagaagaaaaaacatgatctgaatggcgcctatcattgtccgtgttctgttttttccttaatattccaatttttttgcacgagtcatgttgaattatattattctggcgggttctcaaggagtaaagatgaaaatacaatgtttatcgagaatttattctctgttttgtcatgctctttttttttcttttttacagttttggagaatgatattatggctttaggcatgatttgtttgctttggcaaggtcaggtaatctggccatgaaaaacatacgaaatttggtttatagacttcaatgcatttaacatatgtattttcc

SEQ ID NO: 2478 - DNA, 2131 bp, Pseudotsuga menziesii
ggattctttgtctgtctttgttggccataggttttagcgtctgttgggcattcgttactttacctatatttccattctccgttccattctgtgtaaagacagaggcagatggtggaggaagaggaagaagtggaggtggagcagttttgaagagaacagcaaacttatattgttctcttactacaacattttgtgaggccttatcaagtaggaaaaaatgtcgcgaaaagggttgatggagcaggacctgagtaagctggatgttgccaagttgcatccactttctccagaggttatttctcgtcaggctacaataaacattggtacaattgggcatgtggcacatggtaaatcgacagtggttaaagcaatatccggggtccagacagttcgtttcaagaatgaactggagcggaacatcactattaaactgggatatgctaatgcaaaaatatataaatgtgaagatgagcgctgtcctcgaccaatgtgttacaaggcatatggaagtgggaaggaagacagtcctatgtgcgatgttcctggatttgagaacactcgcatgaagcttttaagacatgtgtcatttgttgattgtccgggtcatgatattctcatggctactatgctcaatggtgcggctatcatggatggggcgcttcttttgattgctggcaatgagagctgtcctcaacctcaaacttcagagcatcttgctgctgtggaaattatgcgtcttaaacatataattattttacaaaacaaaattgatcttatccaggagagtgtagctatcaaccagcatgaggcaattcagaagtttatccagggtaccatcgcagatggagcacctgttgtaccgatatctgcacaactgaaatacaacattgatgttgtctgcgagtacataacaaacaagattcccattccagagcgtaattttgttgatccacccaatatgattgtaatcagatcttttgatgtaaataagcccggtgcagaagttgatgaaataaaaggaggtgttgcgggtggaagtatactgaagggtgtgttgaaggtgaatcaaaaaattgaagttcgtcctggcattgttgttaaagatgagagtggcaacatcaagtgtacgcctatcttttcaagaataatatcgctttatgctgagcaaaatgagttgcagtttgctgttcccggaggccttattggtgtgggtaccacaatagatcccacactgacgcgggctgacaggcttgtggggcaagtccttggagaagttggagagcttccagatgtgtttgttgaactcgaggttaattttttcctcctccgccgcctcctgggagtcagaacaaagggtacagaaaaacaggggaaagtttcaaagctggccaagggagaagttttgatgcttaatattggttcaatgtcaacaggagctcgggtgcttgctgtgaagaatgaccttgccaagctccaacttacttctccagtgtgcacaagtaaaggtgaaaagatggcacttagcaggcgagtagaaaagcattggcgattgataggatggggtcagattcaagctggagcaatgctggacatacccccagcatctgaataagatagtgcatagacaaaacccaattagatttgagaaaaaaagggtacttgaggaaattaagaatgtggatagggagagagtttctaggaacaatttttgttaggtggagaagaaaacctatcgaggtttgtgtttgaaattgaacacctagctcatatatttattctcatcttcttgattttttcattatgtttagcatttgttttagaatgagctcattatagaatccatattctcaggctattgaatttcaccacagctattgctcatgttgtactagagtccagaacccattgaccagtgaccattgtttacgaatcagttgtaattgtgattgttgttaaataggagttcatgaattgattgtttattaggttcccaatttatgttacctatattgcacatgacatatttttatggatgaaattttgtctgctacaatttctcaattcttcaaaaggacttgtgtgcaatgcagataagctcatatgcactcttgtggatataactcatatgcgg

SEQ ID NO: 2479 - DNA, 1877 bp, Sesamum indicum
ctctccactctgcttctgaaacgctctccgacggctgctctaagacaaaggctatttctgctagaggcattttttatctgagccgagatcttgcaatttggaattgagtgagaccagcttatctagagctgccaaaatgtctaggaaaggtttgatggagcaggacttaagcaagctggatgtaacaaaactacatccactttcacctgaggttatatctcggcaggccacaataaacattggcaccattggtcatgtggctcatgggaagtcaacagttgtgaaggccatatctggtgtccagactgttcgcttcaaaaatgaactggaacgtaatatcaccatcaagcttggatatgccaatgcgaagatatacaagtgcgaagacgatcgatgtcctcggcccatgtgctacaaggcatatggaagtggaaaagaggatagtccaatgtgtgatgtgccggggtttgagaactataagatgaaattgcttagacacgtgtcttttgttgattgcccgggacatgatattctcatggctactatgcttaacggggctgcaattatggatggagctttacttcttatagctgcaaatgagagctgccctcaaccccagacatcagagcatttagctgctgttgaaattatgcgtctccaacatatcataatacttcagaataaagttgatcttgttcaggaaaatgttgccatcaaccagcatgaagccattcagaaatttattgagggaactgtcgcagatggtgcaccagtggtaccgatttctgcccagctgaagtacaatattgatgttgtatgtgaatatattgtgaagaaaatccctatcccagaaaggaacttcatctcacccccaaatatgattgtaataaggtcttttgatgtcaataagcctgggtctgaagttgatgaaatcaaaggtggtgttgctggtggaagtatcctgaagggtgttctgaaggtaaatcaatatattgaggttcgtcctggtattgtcgtcaaggacgaaaatgacaacatcaagtgcacgcctatatactccaggatagtttccttgtatgctgagcaaaatgagttacaatttgctgtgcctggaggccttattggagtaggaacgacaatggaccccacacttacacgagctgataggttggtgggccaggttcttggagaagttggttcactccctgaagtctatgttgaactagaggttaatttctttttgctgcggcggctgcttggtgttaggacaaaggacacagaaaggcagggtaaggtctcaaagctggccaagggagagatcctcatgttgaacataggatctatgtcaacaggggctcgtgttgttgctgtcaagaatgtttttgcaaaactgcagcttacatcccttgtgtgcaccagcaaaggagaaaaaattgcactgagccgcagaattgataggcactggcgtctgattggctggggtcaaattcaagctggtattactcttgatgttccaccctgtccaatctaagtgaattattgaattacacatcgacgggaaaaaagtaaacaaacaccacaaaactagggactgagatgtgggagggcagagaaatgctcggaacaatttttgttcgatggaggagaaaacattatttggagttttggatacttttattatttctgatgatatttgtcattgccttttccttttggagttttctccatattgttgggttaatgtggcgtgagcccattttggatgttgagttgttaactagaggtatgtgcttgtgcaatattcctttgagcaagttctccagtgtgctttaagagaggtctggatggaaatccccagagaaaactaaagttggcac

SEQ ID NO: 2480 - DNA, 1677 bp, Silene vulgaris
tcatttctccgcttcttctctaggtgttgcaagggtagcggagtttaatcactgcattcagaatggcgcgaaaagggctaatggagcaagacttgaagaaattggatgtggcaaagctacatcctctttcaccagaagttatttctcgtcaagcaactattaatattggaaccattggtcatgtggcccatggaaagtcaactgttgttaaagcaatatctggtgtacagactgttcggtttaagaacgagttggagcgtaatatcaccatcaagcttggatatgctaatgcaaagatatacaagtgtgaggatgaacgatgcccacgacccaagtcctataaggcatatggaagtggaaaggaagatagtcctatgtgtgacgtgcctggatttgaaaactgcaagatgaagcttctgagacacgtgtcttttgtcgactgtccaggtcatgatattctcatggccaccatgcttaatggagctgctattatggatggcgctttacttctcattgctgccaatgagagctgtcctcaaccccaaacctccgagcatcttgctgccattgaaatcatgcgacttcagcatatcatcattcttcaaaataaggttgatctagttcaagaaaatgtagctatcaaccaacatgaagcgattgagaaattcgttcagggaactgttgctgatgcagctccagtagttccaatttctgcacaattgaagtacaacattgatgttgtttgcgagtatatcgtaaaaaagattcccattcctgagaggaattttatctcgccaccaaatatgattgtgattcgttcttttgatgttaacaaacctggttatgaggttgatgatatacgtggtggtgttgctggaggaagtattcttaagggtgttctgagggtgaaccaaagtattgaggttcgtcctggaattgttgtgaaagatgaatctggaaacattaagtgcactcccatatattccagaatagtttcattgtatgctgaccagaacgagctacaatttgctgtgccaggaggtctgattggggttggaacaaccatggaccctactttaacccgtgctgaccgattggtaggtcaagtacttggcgaggttggatctcttccagatgttttcgttgagctagaggtgaatttcttcttgctaagacggctgcttggtgtcaggactaaggggacggagaaacaaggcaaagtcacaaaattaaccaaaggtgaaattcttatgttgaacattggatccatgtcaactggcgcccgagtacttgccgtcaaaaacgacttggcaaaattgcaactgacatctccagtttgcacaagcaaaggtgagaagatcgcactcagccgtcgtgtcgagaagcattggcgacttattgggtggggccaaattcaagccggtacaacaatcgatataccaccctgccccatttaactgaaacaaaaccgagacagactagatagaaagaatacaagaattcggggatgttgaagcttattgtttcttttggaatgtcttggagattatttgcaatttcgtatattttgtttttttagtttcggtcgtttttcttttgtagttgtacatctctgcggcttttttgcaatacggtttttgggtccacttgttacagttgattcatttgagatcttgg

SEQ ID NO: 2481 - DNA, 1876 bp, Solanum lycopersicum
ttgcctctgaattacttgcaataaataggacaggactcacgaattgctgacctctaaattatcgaagagcagccaaaatgtctcgaaaaggactaatggagcaggacctgagcaagttggatgtaacacagctgcatccactttctcccgaagtgatttctcgtcaggctacgatcaacattggtaccattggccatgtggctcacggaaagtcaacagttgtaaaagctatatctggtgtgcagactgtccgttttaagaatgagctagagcgtaacattaccatcaagcttggatatgctaatgccaagatttacaaatgtgaagaagagcgctgccctagacccatgtgctataaggcatatggaagtggaaaagaagacagccccatgtgtgatgtccctggttttgagagctgcaagatgaaattgctgagacacgtgtcctttgttgattgtcctggtcatgatattctcatggctacgatgcttaatggagcagccattatggatggagcattacttctaattgctgccaatgagagctgtccccagcctcagacttctgaacatttagctgcagtcgaaattatgagactccaacacataataattcttcaaaataaggttgatcttgttcaggaaaatgttgccatcaatcagcatgaagctattcagaaatttattcagggaactgtagcagatggtgccccagttgtaccaatctctgctcaactgaagtataacattgatgttgtttgtgaatacattgtgaaaagaattccgattcctgtgagggatttcacttcaccaccaaatatgatcgttattcggtcatttgacgttaataaacctggttttgaagttgatgagattagaggtggcgttgctggtggcagtattttaaagggtgtgttgaaggtaaatcaattgatcgaggttcgtccaggtattgttgtcaaggatgaaagtggcaatattaaatgtacccccatatattcaagaatcgtgtcactgtttgccgagcaaaatgaactacaatttgccgtgcctggaggccttattggagttggaacaaccatggatccaacactgacacgtgctgatcgattggtgggacaagttctcggggaggttgggtcgcttcctgaagttttcgtcgaattagaggtgaatttctttttgctccgtcgtcttttgggtgtgaggacaaaggacacagaaaggcagggtaaagtttcaaagttggcaaagggagaaatccttatgttaaatatagggtctatgtcaactggggctcgcgttgtagctgttaaaaatgtatttgcgaaactgcaattgacgtccccagtgtgtaccagcaaaggcgaaaaaattgctctaagtcggagaattgagaagcattggcgtcttattggttggggtcaaatccaggctggtattactcttgatgtaccaccgtgccccatctaagtgaatcgaaatagtgagttactgaaagaagagggataaagtagtgaagcagcataagacagtatcagatgtgggaaggcaggcagttgctgggaacaatttttgtcaggtggagaagaaaacaaaacattatttggagtttttcgaaacgttatgatccgtctttctacctctcattttcttttccttgttggaatggtgttgtacctttgtgtaattcattagttgcggcggatgttaaaatgagttccatcagaaatattgagcttgcggcagaaaatttgaaccaccttgtatcatctatttctttgcatcatctcagactttggaagacaaatctgtgttgatactagcaaattcttttcttcttagtctatataactaaggttgttaatcatatgaag

SEQ ID NO: 2482 - DNA, 1554 bp, Rosmarinus officinalis
ggaacagccaaaatgtctcgaaaaggcttgatggagcaggatctgagcaagctggatgtaacaacgctacatccactttcacctgaagttatttctcgtcaggccacaattaacattggcacaattggtcatgtggcacatggcaagtccactgttgttaaagccatctctggtgtccagactgttcgtttcaagaatgagttggaacgtaatattaccataaagcttggttatgccaatgcaaagatataccaatgcgaggatgaacgctgcccccgacctatgtgctataaggcttatggaagtggaaaagaagatagcccaatgtgtgatgtccctggttttgagaactgccggatgaaattgttgagacatgtttcttttgttgattgtccagggcatgatattctcatggctacaatgcttaatggagctgctattatggatggagctttacttcttatagctgccaatgaaagttgtccacaacctcagacatctgaacatttagctgctgttgagattatgcgtctccaacatattataattcttcaaaacaaggttgatttagtgcaggaaaatgtagctgtcaatcaacatgaagctattcagaagtttatacagggaactgttgcagatggtgcacaagtcataccaatttctgcacagctgaagtataacattgatgttgtttgtgaatacattgtgaaaaagattcctattccagtgagggacttcatttcaccgccaaatatgattgttatccggtcttttgatgtcaataagcctggatttgaggtggatgagattaaaggtggtgttgctggtggaagcatactgaagggtgttctgaaggtaaatcagtacattgaggttcgccctggcattgttgtgaaggatgagaacggcaacatcaaatgcactccgatatattctagaatagtttctctgtatgctgagcaaaatgaactgcaatttgccgtccctggtggtcttattggagttggtaccaccatggacccgacgctgactcgtgctgatcgattggttggacaagttcttggtgaggttggatcattgcctgaagtttatagtgaactagaggtgaacttcttcctactgaggcgacttctcggtgttaggacaaaagacactgaaaggcagggtaaagtttccaagctagccaagggtgaaatcctcatgttgaatataggatcaatgtcaacaggggctcgtgttgttgcggttaaaaatgtgtttgcaaaactgcaactcacatctcctgtatgtaccagcaaaggagagaaaattgctctcagcagaagaattgagaagcactggcgtctcattggttgggggcaaatccaagctggtattactcttgatgtcccaccctgcccacttaagtgaagtagagagatttgctgacagaggagaatagacagtaaagacgagacatattagatgtgggagggtagagaagcactgggaacaatttttgtacgctggagaagaaaacctgtttcaaaattttggatacttccattgtttgtg

SEQ ID NO: 2483 - DNA, 2099 bp, Trifolium pratense
cttccttccgatagtttagcattaaacagtgttgggtcataacttcattccatcactcaattgaagtttccattggaagcagccaaaatgtcgcggaagggtttgatggaacaagacttgagtaaattggatgtgacaaaattgcatccactttctcccgaagtaatatctcggcaggctactattaatattggcaccatcggtcatgtggcacacggcaaatcaacagttgtgaaagcaatatcgggtgttcagaccgtgcgtttcaaaaatgagttggagcgtaacattacaatcaagctcggttatgcaaacgcaaaaatatacaagtgtgaagatgaacgatgcccgaggcctatgtcctacaaggcttatggaagtggaaaagaagataatcctatgtgtgatgtgccagggtttgaaaactgcaagatgaaattactgagacatgtttcttttgtcgattgcccaggtcatgatattctcatggctactatgcttaatggagcagcaatcatggatggagctttgctactcatagctgctaatgaaagctgtccacaaccacaaacctctgagcatttagctgctgtggaaattatgcgtcttcagcacatcataatccttcagaacaaggttgatctaattcaagagaatgtggctatcaatcagcatgaagcaattcagaagtttatagaaggaacggttgctgatggtgcaccagtcgtacctatttcagcacaattgaagtataatattgatgttgtgtgcgagtatatcgtgaaaaagatcccaatccctgaaaggaactttatttctccacctaatatgatagtaattcggtcctttgatgttaataaacctggttttgaggttgatgaaataaaaggaggtgtagctggtggaagcattctgaggggtgttttgaaggtcaaccaattcattgaagttcgacctgggatagttgttaaagacgagagcggaaatattaaatgcacacctatatactctagaatagtttcattgtttgctgaacaaaatgagcttcaatttgctgtgcctggaggcctaattggtgttggaacaacaatggatcccactttgacgcgtgctgacaggttggtagggcaagttctcggagaggttggatcactgcccgaggttttcgttaagcttgaggtaaactttttcttgcttcgacggcctcttggtgtccgcacaaaaggttccgagagacaaggaaaggcctcaaagctggtgaaagcagaaatgctaatgttgaacataggttctatgtcaacaggtgccagagtggttgctgtgaagaatgacttggcaaagttacaacttacttcccctgtgtgcaccagcaagggtgagaagattgctctaagtagacgtgttgagaagcattggcgtcttatcggttggggacaaatccaagctggaatcacccttgaagtccctcctgcccccgtttttagttgaaagaaagacagattaagagaaagacaagaaaacaccatttataaaaaatcttgagatgaatttaggtatgtgggaagggaaaaaactgttgggaaccatttttgtgagatggattagattgttaattttttgttttctcattgttgttggttacctattgttgaaattgtatcttattctgattgagtttagaatgcgagcatatgtctcagccatcacttgttttcattcattggccaccttaccaataattaatccagtaatcttgctatacagcatatccaagcaattgttgaaattttaagactggtacacttcgtctggtccttgttactattaagctcttccagtattggaatgtgttaacaaaactgtgtggacctttggtggtaaaatttttattggggacttaacttctagtgcgaaggttgagtgacggctcatgagatgggtgttgtgcaaatgcagtggctccttggtggtcttgtgagagcattggaagacattatgttgtgatggagcggcttgttgataaggagtagttgttgcattcattgatcgaagcaatgatagttatgaaagagagtgcaaaggaaggagatcaaacaatg

SEQ ID NO: 2484 - DNA, 1642 bp, Distylium racemosum
ggaaatatcagcaccagaaggcccaaggaactctcgccagcaaactgtattttggtgataattcctacggagaagatcattcttagacaagcaaatttgtgttatttgttcagtataacattttctggggccttatcaagcagaaaaaatgtcgagaagagggttaatggaacaggatctgagcaagttggatgtcacaaagctgcatcctctttatcctgaggtcatttctcgtcaggctactataaatattggcacaattgggcatgtggcacatgggaaatcaacagtggttaaagccatatctggtgttcagacagttcgtttcaaaaatgaattggagagaaacatcaccattaagctgggatatgcaaatgcaaaaatttacaaatgtgaagatgagcgctgccctcgaccaatgtgttacaaggcatatggtagtggaaaggaagatagccctctttgtgatgtccttggatttgataatacacgcatgaagcttctaagacacgtttcatttgttgattgccctggtcatgatattctcatggctacaatgcttaatggtgctgctattatggatggggcattgcttttgattgcaagtaatgagagctgtcctcagcctcaaacttcagagcatcttgctgctgtggagataatgcgtcttcagcatattatcattctacagaataaaattgatctgatccaggagagtgtagccattaatcagcatgaggcaattcagaaatttattcagggtaccattgctgatggagcacctgtggtaccaatatccgcacaactaaagtacaacattgatgttgtatgtgaatacatagtgaaaaagattcctattccagagcgtaattttgttgacccaccaaatatgattgtaatcagatcttttgatgtgaataagcctggtgctgaagtagatgacataaaaggtggtgttgcgggtgggagtatactcaagggcgttttgaaggtgaatcaaaaaattgaagttcgccctggcattgttgtcaaagacgagagtggcaatatcaagtgcacacctatcttttcaagaatagtttcattatatgctgagcaaaatgaattgcagtttgctgttcctggaggccttattggtgtgggtacaacaatagatcccacccttacacgtgctgacaggcttgttgggcaagtccttggagaagttggagaattacctgatgtgtttgttgagctagaggtaaacttttttctcctccgtcgtctcctgggagtcaggaccaaaggtacagagaaacaagggaaggtttcaaaactggctaagggagaagttttgatgcttaatattggctccatgtcaactggagctcgtgtgcttgctgtgaaaaatgatcttgctaagctccaactaacttctcctgtatgcacaagtaaaggagaaaaggtggctcttagcagacgagtagaaaagcattggcgattgataggttggggtcaaattcaagcaggattaatgctggacattccccaggtatctgtagaaggtagttaattaagcaaagcagtttttgaggaacagttgtatttcattaaaggaaaaatgtggataggaagaggattattaggttcaatttttgtcaga

SEQ ID NO: 2485 - DNA, 1839 bp, Lotus japonicus
atctaatctaaagaaaacaaataaacgccacctagggtttgctcttcgactcacttcttcttcaaccttctactctctgaggctcactccttgcaccgtcgccgtctccgccaccgtcgccgacaggtctattactcagttagagttttcattggaagctgccacaatgtcgcggaagggtttgatggaacaggacctcagcaagctggatgtggctaagttgcatccactttctcctgaagtcatttctcgccaagctactattaacattggcaccataggccatgtggctcatggaaagtcaacagttgtgaaagcaatatcaggcgttcagactgtgcgttttaagaatgagttggaacgtaacattacaatcaagcttggctatgcgaatgccaaaatatataaatgtgaagatgaacggtgtccaaggcctatgagctacaaggcttatggaagtggaaaggaagatagtcctatgtgtgatgtaccagggtttgagaactccaagatgaaattgttgagacatgtttcttttgttgattgcccgggacatgatattctcatggctacaatgcttaatggagcagcaatcatggacggagctttgctactcattgctgctaatgaaagctgccctcaaccacaaacttctgagcatttagctgctgtggaaattatgcgtctacagcacattataatccttcagaacaaggtagacctgattcaagaaaatgtggcaatcaatcagcatgaggcgattcagaagtttatacaaggaactgttgctggtggtgcaccagtggtacctatttcagcacagttgaagtataatattgatgtcgtgtgtgaatatattgtgaaaaagatcccaatccctgaaaggaacttcatttctccaccaaatatgatagtaattcgatcatttgacgtcaataaacccggttatgaggttgatgaaataaaaggaggcgtagctggtggaagcattctgaggggtgttttgaagttcaaccaattcattgaagttcgacctgggataattgttaaagacgacagtggaaacattcgatgcacacccatatactcgagaatagtttcattgtatgctgaacaaaatgagcttcaatttgctgtgccgggaggccttattggtgtcgggacaacgatggatcccactttgacacgtgctgacaggttggtagggcaagttcttggagaggttggatcactgcctgaggtttttgttgaacttgaggtaaactttttcttgctccggaggcttcttggtgtccggacaaaaggctctgagagacagggtaaggtaactaagctgactaaaacagagatgcttatgttgaacatagggtcaatgtcaacaggtgcaagagtaattgctgtgaagaatgacctggcgaaattgcaacttacttcccccgtgtgcactagcaagggtgagaagattgcactcagtcgacgtgtcgagaagcattggcgccttatcgggtggggtcaaatccaagctggactcacccttgatgtccctcctgctcctctactgaattgaaagacgagttgaaagacaaacagaacagttataaaaatctgagatgaatttagatatgtgggaaggaagaccactgttgggaaccattttttttaggtggagaagaaaacatttgaatttagcaaattttgtttcattatcatttctatttttaattctcactgctgtcaacctattactgaaattgtctgtctgatcactgattgagtttaggctgggaggaacatctcagcttgcacattttttattccattccattccatgttcacctt

SEQ ID NO: 2486 - DNA, 1604 bp, Allium cepa
tcagccccttatctgaaaccctaaagctgccgcttctgccaccgtcatctcctccttcgccgtcgctatcttttcatctgctgttcaagataccaaagcaaagatggctaagaagtcaggattaatggagcaagatctaagtaagcttgatgtgacgaagcttactcctctttcgcctgaagttatttctcgtcaagctacaattaatattggcaccattggccatgtggcgcatggaaagtcaactgtggtgaaagcaatatctggtgttcagactgtgcgatttaagaatgaactggagaggaatatcactatcaaacttggatatgctaatgcaaagatatatacatgtgaagatgagaaatgtccaaggccaatgtgctacaaagcttacggaagcggaaaggaggatagcccggattgcgatgtgcctggatttgagaaagccaagatgaaacttttgagacatgtttcattcgttgattgtcctggacatgatattctcatggctacaatgcttaacggagctgctatcatggatggagctctgctgttaatagctggcaacgaaagttgtccccaacctcaaacttctgagcatcttgctgctgttgaaatcatgcgacttgagcacataataattcttcaaaataagatcgatcttattcaagaaagcgttgctatcaatcaacatgaatcaattcagaatttcatcaagggcacaattgctgatggtgccccagtagtgcctatatcggctcagctgaaatataacatcgatgttgtgtgtgaatatcttgtcaacaaaatcccaattcctgtaagggattttacatcgccgccaaatatgattgttatccgatcatttgatgtaaataagcctggttctgaggttgatgaaatcaaaggtggtgttgctggtggaagtattcttaggggagttttgaaggtgaaccaattaattgaagttcgacctggtattgttcttaaagatgagagcggcaacatcaaatgtactcctatatactctagaatcaagtccttgtttgctgaacaaaatgaattgcaatttgctgtacctggaggactcattggagttggtactaccatggaccctacattaacccgtgctgataggcttgttgggcaagttcttggtgaagttggctctcttcctgatgtttttgttgagcttgaggtaaatttctttttgctgaggaggctactgggagtgagaacgaaaggagcagaaaagcaaggaaaagtgtccaaactgacaaagggggaaattctgatgctgaacatcggctcaatgtcaactggagctaaagtgatagcagtgaagaatgatttagctaagctacaactgacggcacctgtatgcacaagcaaaggggagaaagtggctctcagcagaagagttgaaaaacattggcggcttattggttggggtcagatccaggctggctctactctccaaatcccgcctccacctactttttaattttacaaagagagagagagagagagtttgtatttgaattctagtataatttatggggagaggatttcaactgttagattatatttttgttagaaggaga

SEQ ID NO: 2487 - DNA, 1634 bp, Allium cepa
agatcgcagcttgtttgttctttaaaattttcttttggaagagtttcaagggcgatcctgatttccacaaataaaatccggtaagcagcaatttcttattgccatctaggaaccctaaaaaccgccgttttctgccgtcatctctatctcatccgccgtcacttgcttctccaacttcgccaagggtttgaaagcaaagatggctaagaaaactggattaatggagcaggatcttagtaagcttgatgtgtcaaagctcactcctctttcacctgaagttatttcacgtcaagctactatcaatatcgggactattggtcatgtggcccatggaaaatctaccgtggtcaaagcaatatctggtgttcagactgtacggtttaagaatgaattggagaggaatatcactatcaagcttggatatgctaatgcaaagatatataaatgtgaagatgaaaaatgtccaaggccaatgtgttacaaagcgtacggaagtggaaaggaggatagtccagattgtgatgttcctggatttgacaaaactaaaatgaaacttttgagacatgtttcgtttgtggattgtccgggtcacgatattctcatggctacaatgcttaatggagcagccattatggatggagctttgctgttaatagctggcaatgaaagttgtccccagcctcagacttctgagcatcttgctgctgttgaaatcatgcgacttgaacacataatcattcttcaaaataaaatcgaccttattcaagaaagtgctgcaatcaatcaacatgaatcaattcaaagtttcatcaaaggtacaattgcagacggtgcaccagtggttcccatatcagctcagctgaagtacaatattgatgttgtttgtgaatatctcgtcaacaaaatcccgattcctattagggattttacatcacctccaaatatgattgtgattcgatcatttgatgttaataagcctggctctgaggttgatgagatcaaaggtggtgttgctggcggaagtattcttaggggagttttaaaagtgaatcagttaatcgaagttcgacctggaattgtactcaaagacgagagcggcaacatcaaatgcaccccaatatattctagaatcaagtctctttttgcagagcaaaatgaactacagtttgcagtgcctggagggcttattggtgttggtacaactatggacccaacactgactagagctgataggcttgttggtcaagttcttggtgaagttggttctctacctgatgtatttgttgagcttgaggttaacttctttttactgagaaggctattgggagtaagaacaaaaggtgcagaaaagcagggaaaagtatcgaagctaacaaaagcagaaattctgatgcttaacattgggtccatgtcaaccggagctaaagtaattgcagtgaaaaacgatttagcaaagcttcagttaactgcaccggtatgtacaagcaaaggcgagaaggttgctctcagcagaagagtggagaagcattggagactgattggttggggtcagatccaggcaggctctactctcaaaatcccaccacgtcccagtttttaagaaagaaaagagagaaggaaaaaagcgagtcaaa

SEQ ID NO: 2488 - DNA, 1635 bp, Allium cepa
cgaatattttgctgctcaaaacgaccactttcatcgacttttttagtagggtttcgtgggcgatcctgatttccacaaaatcacaaatagaaatatagaatccggtaaacagcaatttcttattgccatctaggaaccctaaaaaccgccgttttttgccgtcatctcaatatcattcgccgtcacttgcttctccaacttcgccaagggtttgaaagcaaagatggctaagaaaactggattaatggagcaggaccttagtaagcttgatgagtcaaagcttactcctctttcacctgaagtcatttcacgtcaagctactatcaatattgggactattggtcatgttgcccatggaaaatctactgtggtcaaagcaatctctggtgttcagactgtacggtttaaaaatgaattagagaggaatatcactatcaaacttggatatgctaatgcaaagatatacaaatgtgaagatgaaaaatgtccaaggccaatgtgttacaaagcctacggaagtggaaaggaggatagtccggattgcgatgttcctgggttcgagaaaactaaaatgaaacttttgagacatgtttcgtttgtggattgtccgggtcacgatattctcatggctacaatgcttaatggagcagccattatggatggagctttgctgttaatagctggcaatgaaagttgtccccagcctcagacttctgagcatcttgctgctgttgaaatcatgcgacttgaacacataatcattcttcaaaataaaatcgaccttattcaagaaagtgctgcaatcaatcaacatgaatcaattcaaagtttcatcaaaggtacaattgcagacggtgcaccagtggttcccatatcagctcagctgaagtacaatattgatgttgtttgtgaatatctcgtcaacaaaatcccgattcctattagggattttacatcacctccaaatatgattgtgattcgatcatttgatgttaataagcctggctctgaggttgatgagatcaaaggtggtgttgctggcggaagtattcttaggggagttttaaaagtgaatcagttaatcgaagttcgacctggaattgtactcaaagacgagagcggcaacatcaaatgcaccccaatatattctagaatcaagtctctttttgcagagcaaaatgaactacagtttgcagtgcctggagggcttattggagttggtacaactatggaccccacactgactagagctgatagacttgttggtcaagttcttggtgaagttggttctctacctgatgtatttgttgagcttgaggttaacttctttttactgagaaggctattgggagtaagaacaaaaggtgcagaaaagcaaggaaaagtatcgaagctaacaaaagcggaaattctgatgcttaatataggttccatgtcaactggagctaaagtcattgcagtgaaaaacgatctagcgaaacttcagttaactgcaccagtatgtacaagcaaaggtgagaaggtcgctctcagcagaagagtggagaagcattggaggctgattggttggggacagattcaggcaggctctactctgaaaatcccaccacgtcccagtttttaagtgaggaaaag

SEQ ID NO: 2489 - DNA, 1885 bp, Arachis hypogaea
gttccaaccggccggggattgtcatttctcgattttcttctgagcaattactatagttagggtttctttcttctttcacttggcttcagccgcacgcagtctctctgcactattctcagctgccatcatcttccttctcctcctcctccgccgcctccgccgccgctcaacacttctgagctgctctacttcttccagataggttaccatcacacattttgaattgtaaagtcattcataccatcttaaacatccaagatgtcgcggaagggtttgatggaacaagacctgagtaaactggatgtaaagaaattggatccactctctcctgaagtcatatcacgacaggctaccattaatattggcactataggtcacgtggcacatggcaagtcaactgttgtgaaagcaatatcaggtgttcagactgttcgtttcaaaaatgagttggagcgtaatattacaattaagcttggctatgcaaatgctaagatatataaatgtgaagatgaacgttgtcctaggcctatgtgctacaaggcatatggaagtgggaaggaagacagtcctatgtgtgatgtgccagggtttgaaaacagcaggatgaaattgctgaggcatgtttcttttgtggattgcccgggccatgatattctcatggctacaatgcttaatggagctgcaatcatggatggagctttgctacttatagctgctaatgagagctgtccacaaccacaaacctcagagcatttagctgctgtagagattatgcgtctgcagcacataatcatccttcagaataaagtagacttgattcaagaaaatgtggcaatcaatcaacatgaagcaataacgaagtttattgcgggaactgttgctgatagtgcaccagtagtacctatttcagcacaactgaagtataacattgatgttgtgtgcgagtatattgtaaaaaagatcccaattccaataagggatttcgtctctccacccaatatgatagtaattcggtcatttgatgtcaacaaacctggttttgaggttgatgatataaaaggaggtgtagctggtggaagtattctgaggggtgttttgaaggtaaaccaattcattgaagttcgacctggtatagttgttaaagacgagagcgggaatatcaagtgcacccctatatactccagaatagtatcattatatgctgagcaaaatgagcttcaatttgctgtgcctggaggtctcattggtgttgggacgacaatggatccaactttgacacgtgctgacaggttggttgggcaagttcttggtgaggttggatctctgcctgatgtttttgttgaacttgaggtgaactttttcttgcttcgacggcttttgggtgtgcggacaaaaggctcagagaaacaggggaaggtatcgaagcttgctaaaggagagatgcttatgttgaatattggatccatgtcaacgggagccagagttgttgctgtgagaaacgatttggcaaagctgcaacttacttccccggtgtgcaccagcaaaggtgagaagattgctcttagtcggcgtgttgagaagcattggcgtctgattggatggggacaaatccaagcaggaatcactctgaatgtcccggccgctccccaactgagttaaacaagagagagtagacctgttattaaaacttgagagggatttaagagatgtgggaaggaagagaattgctgggaaccatttttttgaggtggagaagaaaacatatgaatgacgatgagtttttgtttttgctttattatttttgtatactgttgtctacctataactgaagctgtatgttatgcccaattgagttttacactaggcttcaataatttcacattca

SEQ ID NO: 2490 - DNA, 1779 bp, Ambrosia trifida
tattattattagaaccctgaacgaaaccctagctaacgtttctactcatcaatattatccacatcatcagccaccacacacacaccctcttcaaccccctatcaattccttcactcttcacgcaaaaagattagtgcaagatttgtgtagaagagtgaatatggctagaaaagggttaatggagcaggatttgagtaagctggatgtagcggcgctgcatccgctttctccggaggttatatctcgtcaagctacgattaatattggtactattggtcatgtggctcatgggaagtcaacagttgtaaaagctatatctggtgtgcagactgtgcggttcaaaaatgagttggagcgtaacattactatcaagcttgggtatgccaatgcaaagatatacaaatgtgaagatgaaaagtgccctcgacccatgtgttacaaggcatatggaagtggaaaagaagatagccctccttgtgatgtgcctggatttgagaacagcaagatgaaattgatgagacatgtatcgtttgttgactgtccaggacacgatattctcatggctactatgcttaatggagcagctatcatggacggagcattacttctcatagcagcaaatgaaacgttgtccccagcctcagacttccgagcacttggctgccgttgagattatgaggctccaacatatcataattcttcaaaataaggttgatctaattcaagaaaacgtagccattaaccaacacgacgcaattcagcaattcatacagggaacggttgctgatggtgcaccggtgatcccggtgtcagctcagcttaggtataatatcgatgtggtgtgtgaatacataataaaaaggattcccatcccagagaggaacttcatttcacctcccaatatgatagtaattcgttcatttgatgttaataagcctggatctgaggttgatgagattagaggtggtgtggctggtggaagtattctcaagggtgtgttgaaggtaaaccagcatattgaggtccgtcccgggattgttgttaaagatgagagtggtaacatcaagtgcactccaatttactcaagaatagtgtcgctatacgcggagcagaatgaacttcaatttgctgtacctggaggtcttattggtgttggaacaacaatggaccctatgttgacccgtgctgatcggttggtgggtcaagttcttggggaggtcgggtctcttcctgatgtctatgtcgaactcgaggtgaacttctttcttttgcgtcggttgcttggtgtgaagactaaaggaacagaaaagcaagggaaagtatcaaagttgtcaaaggcggaaatactgatgctgaacataggatcaatgtctactggggcccgtgttttggcagttaagaatgatttagcaaaactgcagttgacagcacccgtgtgtacgagcaaaggtgagaagattgctctgagcaggagagtagaaaagcaattggcggctaaatcggttggggaacaaattcaaagctggtgttactcttgatatcccaccctgtccgatttagaggtctaggcgcccatttgaaatccagttttgcctgctgctgttgctaccctcctttcctacatttgactcttggtaatctgttttagctttcgtagcatttgtgattttacactattctattcaacttgttttgaacaaatactctgcatggtgtttgcggagaggatcataaaacgtgtacttttcacctttaaatgttttaattggctatttttta

SEQ ID NO: 2491 - DNA, 1523 bp, Arnica chamissonis
tcgaaaagtgaatatggctcgaaaaggtctaatggagcaggatttgagcaagctggatgtagcaacgctgcatccgctttctccggaggtcatatctcgccaggctacgatcaatattggtacaattggtcatgtggctcatggtaagtcaacagttgtaaaggcaatatctggtgtgcagactgttcgttttaaaaatgagctggaacgtaacattactattaagcttgggtatgccaatgcaaagatatacaaatgtgaagatgaaaagtgccctcgacccatgtgttacaaggcctatggaagtggtaaagaagataaccctccttgtgacgtgcctggatttgagaacagtaagatgaaattggtgaggcatgtatcatttgttgactgcccggggcatgatattctcatggctactatgcttaatggagctgcaatcatggatggagcattacttctcatagctgcaaacgaaagttgtccccaacctcaaacttctgagcacttggctgctgtagaaattatgaggctccaacatattataattcttcaaaataaggttgatctaattcaggaaaatgtagccatgaatcagcacgaggcgattcagaagtttatccagggaacggttgctgatggtgcaccgatcatcccggtgtctgctcaacttagatacaatattgatgtcgtttgcgaatacataattaagcggatccccattccagaaaggaacttcatttctcctccaaatatgatagtaattcgttcatttgatgttaacaaacctggatctgaggttgatgagattagaggtggtgttgctggtggaagtatccttaagggtgtgttaaaggtaaccaaaatattgaggtccgtccggggattgttgttaaagatgagaatggcaacatcaagtgcacccccatctactctagaatagtgtcactatacgcagagcagaatgaactacaatatgctgtacctggaggtcttattggagttggaacaactatggatcctatgttgacccgtgctgatcggttggtgggtcaggttcttggggaagttgggtctcttcctgatgtttatgtcgaactagaggtaaacttttttcttttgcgtcggctattgggcgtgaagacaaaaggaacagaaaagcaggggaaggtatcaaagctatcaaaggcggaaatactgatgctgaacataggatcaatgtcgactggggctcgtgttttggcagttaggaacgatttagcaaaactgcagctgacatcacccgtgtgtactagcaaaggcgagaagatcgctttgagcaggagagtggagaagcattggcgactaattggttgggggacaaattcaagcaggtttaactcttgaaatcccaccttgcccaatttagacacacattcgaattccagttttgcctttccttcatccttgattcttatttctgatttagctttcagatttcgtatcatttgtgattttacacttttagtttcttttaaacaaat

SEQ ID NO: 2492 - DNA, 1634 bp, Cedrus atlantica
gaacagcaaacttatattgttctcttactacaacattttgcgaggccgtatcaagtggcaaaaatgtcgcgaaaagggttgatggagcaggacctgagtaagctggatgtgaccaagttgcatccactttctccagaggtcatttctcgtcaggctacaataaacattggtacaattgggcatgtggcacatggtaaatcaacagtggttaaagcaatatctggggtccagacagttcgtttcaagaatgaattggagcggaacatcactattaagctgggatatgccaatgcaaaaatatataaatgtgaagatgagcgctgtcctcgaccaatgtgttacaaggcatatggaagtgggaaggaagacagtcctctttgtgatgctaatggatttgagaacactcgtatgaagcttttaagacacgtgtcatttgttgattgtcctggtcatgatattctcatggctactatgcttaatggtgcggctatcatggacggggcgcttcttttgattgctggcaatgagagctgtcctcaacctcaaacttcagagcatcttgctgctgtggagatcatgcgtcttaaacatataattattttacaaaacaaaattgaccttatccaggagagtgtagctatcaaccagcatgaggcaattcagaagtttatccagggtaccattgctgatggagcacctgtagtaccaatatctgcacaactgaagtacaacattgatgttgtctgtgaatacataataaacaagattcccattccagagcgtaattttgttgatccacccaatatgattgtaatcagatctttcgatgtaaataagcccggagctgaagttgatgaaataaaaggaggtgttgcaggtggaagtatactgaggggtgtgttgaaggtgaatcaaaaattgaagttcgtcctggcattgttgtcaaagatgagagtggcaatatcaagtgtacgcctatcttttcaagaataatttcactttatgctgagcaaaatgagttgcagtttgctgttcctggaggccttattggtgtgggtaccacaatagatcccaccctgacacgtgctgacaggcttgtggggcaagtccttggagaagttggagagctaccagatgtgtttgttgaacttgaggttaattttttcctccttcgccgcctcctgggagtcagaacaaagggtacagaaaaacagggtaaagtttcaaagctgaccaagggagaagttttgatgcttaatattggttctatgtcaactggagctcgggtgcttgctgtgaagaatgaccttgccaagctccaacttacttcaccagtgtgcaccagtagaggtgaaaagatggcactaagcaggcgagtagaaaagcattggagattgataggatggggtcaaattcaagctggagcaatgctggacattcccctagcatccgaataagactgcatggacaaaacccaattatatttgagaaaagaaaaagggtacttgaggaaaggaagaatgtggatagggagagagttactaggaagaagttttgttaggggaagaaaaccaatcgaggttttgttttttaaattgaacacctagctcatatatttattcccatcttcttga

SEQ ID NO: 2493 - DNA, 1628 bp, Spinacia oleracea
caatcgaacatattttctctctcctcaggctcagactcaaactcgaactcgcagctgctgttatatcctcctccttcctcccgcctccccctcataaaaccctaactactctcgtccaacagaaccagcatcttttagttatatcaccacctcccctcggcggcgcctctccttctctgccgcttctattcttggcattttaggggaagagagctttgacaactgcgttcaatatggcacgaaaaggattgatggagcaggacttgagcaagttggatgtggcaaaattacatcctctttcgcctgaagttatttctcgccaggctacaatcaacattggaactattggtcatgtggcccatggaaagtcaacagttgtgaaggctatttctggtgttcagactgtacgatttaagaatgagttagagcgtaatattactatcaaacttggttatgctaatgccaagatatataaatgtgatgatgaacggtgtccacgacctatgagctataaggcatatggaagtggaaaggaagacactccgatgtgtgacgtgcctggatttgagaatgccaagatgaagcttctgagacatgtgtcatttgtcgattgcccaggtcatgatattcttatggctactatgcttaatggagctgcaattatggatggagcattacttcttattgctgctaatgagagctgcccccaaccccagacttctgagcatcttgctgctattgagatcatgcgacttcagcacattatcatcctccaaaataaagttgatctcatccaagaaaatgttgctataaaccagcatgaggctattcagaaatttgttcagggaactgttgctgatggagcgcctgtagttccaatttctgctcaattgaagtacaacatcgatgttgtttgtgaatacattgtcaaaaatattcctatccctgagagaaattttatttcaccaccaaatatgattgtgatccggtcttttgatgttaacaaacctgggtatgaggttgatgaaatatgcggtggtgttgctggtggaagtattttaaagggtgtcttgagagtaaaccaaaatattgaggttcgacctggaatagttgtgaaagatgatagtggcaacatcaaatgcacacccatatactcaagaattgtttctttgaaagctgaggagaatgagttacaatttgctgtgcctggaggtctgattggggtaggaacaaccatggatcctactttaacccgagctgatagattggtaggtcaggtactcggggaggttgggtctcttccagatgtattcgttgagctagaggtgaatttcttcttgcttcgaagactgatgggtgtgagaacaaaaggaactgagaagcagggaaaagtgacaaaactgacaaaggcagagattctcatgttgaatattggatccatgtcgactggtgcgcgtgtaattgctgtaaaacatgatttggcaaagttgcaactaacatctccagtttgcacaagcaaaggagagaagatcgccctgagtcggcgggttgaaaagcattggcgactgattgggtggggacagattcaagctggtattaccctcgatatcccaccctgtcctctttga

SEQ ID NO: 2494 - DNA, 1708 bp, Coffea canephora
cggccgggggtaaattacaaagttactgaagattgagaaaaatgtctcgaaaaggtttaatggagcaggatctaagcaagctggatgtaacaaaactacatccactctcacctgaagttatttcccgccaggctacgataaatattggcactattggtcatgtggcacatggcaagtcaactgttgtggaagccatatctggtgtccaaactgttcgttttaaaaatgagctggagcgtaatattactataaagcttggttatgccaatgccaagatatataaatgtgaggatgataaatgccctcgacccatgtgctataaggcttatggaagtggaaaagaagatagtcccatgtgtgacgttcctggttttgagaactgcaggatgaaattgttgagacacgtctcttttgttgattgccctggtcatgatattctcatggctacaatgtttaatggagcagctatcatggatggggcgttacttcttatagccgcgaacgaaagttgtccacaacctcagacttctgagcatttagccgctgttgaaattatgcggctccagcatataattattcttcaaaacaaggttgatcttgtccaggaaaatatagccatcaaccagcacgaagccattcagaaatttatacagggaactgttgcagatggcgcgccagtcataccaatttctgcacagttgaagtacaatatcgatgttgtggctgaatatatagtaaagaagattcctattccagaaaggaacttcatttcaccgccaaatatgattgttattcgatcttttgatgtcaataagcctggttttgaagttgatgagattaaaggtggtgtcgctggtggcagtatcttgaagggtgtgttgaaagtaaaccaatacattgaggttcgtcctggtattgttgtaaaggatgagaatggcaacatcaagtgtacaccaatatattccagaatagtgtcattgtttgccgaacaaaatgaacttcagtttgcagtgccaggaggccttattggagttggaaccactatggaccctacattgactcgtgctgatcgattggtgggtcaggttcttggggaagttgggtcgttgcctgaagtttttgttgaactggaggtaaacttctttctgctccggcggcttttaggcgtccggacaaaggatactgagagacagggtagagtctcaaagctagccaagggagagatccttatgttgaacatagggtctatgtcaacaggggctcgtgttgttgctgtgaagaacgtatttgcaaaattacaactcacatctcctgtctgcaccagtaaaggggagaaaattgccctcagtcgcagaattgagaagcactggcgtcttattggctggggccaaattcaggctggtataactctggacgtcccaccctgccctatctgagtgaattagacgaacaaccacttacaaaggagagaagaaagcaactgaaacagttgagagaactacggattagatgtgggagggcaggcaactgcagcagggaacagttttcgtttgttggcggagaaaagaaaatgtttcagaattttggatacttgattattattctgtgctgtttcggccactttttatctttgtgcaagagtctgtaccttatctaattctttattagttgttgcgttgatgattggatattgttacgtataagaaac

SEQ ID NO: 2495 - DNA, 1514 bp, Flaveria ramosissima
tgtaaaatccgtctagaacagtgaatatggctcgaaaaggtttaatggagcaggatttgagcaagctggatgtaacaacgctgcatccgttgtctccggaggttatatctcgtcaggctacgattaatattggtactattggtcatgtggctcatggtaagtcaacagttgtaaaagccatatctggtgttcagactgttcgtttcaaaaacgagttggagcgtaacattactattaagcttgggtatgctaatgcaaagatatacaaatgtgaagatgataggtgccctcgacccatgtgttacaaggcctatggaagtgggaaagaagataaccctccttgtgatgtgcctggctttgagaacagcaagatgaagttgatgaggcatgtatcattcgttgactgcccggggcacgatattctcatggctactatgcttaatggagcggctatcatggatggagcattacttctcatagcagcaaatgaaagttgtccccaacctcagacttctgaacacttggctgctgttgagattatgaggctccaacatattataattcttcaaaataaggttgatcttattcaagaaaatgtagccattaaccaacatgaggcaattcagaaatttatccagggaacggttgctgatggtgcaccagtgatcccagtgtcagctcagcttaggtataatattgatgtggtgtgcgaatacataataaaacggattcccattccagagaggaactttatttcacctccaaatatgatagtaattcgttcatttgatgttaataagcctggatctgaggttgatgagattagaggtggtgttgctggtggaagtatcctcaagggtgtgttgaaggtaaaccagcatattgaggtccgtccagggattgttgttaaagatgagagtggcaacatcaagtgcacaccaatatactcaagaatagtgtcactatacgcagagcagaatgaacttcaatttgccgtacctggaggtcttatcggtgttggaacaacaatggaccctatgttgacacgtgctgatcggttggtgggtcaagtacttggggaggttgggtctcttcctgatgtttatgttgaactagaggtgaactttttccttttgcgtcggctgcttggtgtgaagacaaagggcacagaaaagcaagggaaggtatcaaagttgtcaaaggcggaaatcctgatgctgaacataggatcaatgtcgactggggcccgtgttttggcagttaagaacgatttagcaaacttgcagttgacatcaccggtgtgcacgagcaaaggcgagaagattgctctgagcaggagagtggagaagcattggcggttaatcggttggggacaaattcaagctggtctgacccttgatatcccaccctgcccaatttagagttttagacacaacacatttgaactccagttttgcctgttgctgctgcttctgctacctttggttatcggtcatctgttttagcttttatag

SEQ ID NO: 2496 - DNA, 1970 bp, Mimulus guttatus
cacactctgctctagaaaacgcgctccgacggctgctctaagacgaaggctattgttaatttcctaagtggccttctcttctttgcgccttgactttacaatttgatattgagagcgacctatctaaagctgccaaaatgtctagaaagggtttgatggagcaggatttaagcaagttggatgtaacacaactacatccactttcacctgaggttatttctcgccaagctacaataaacattggtaccatcggtcatgtggctcatggtaagtcaacagtggtgaaggccatatctggtgttcagactgttcggtttaaaaatgaattggaacgtaatatcactatcaagcttggatatgccaatgcaaagatatacaagtgtgaagatgatcgatgccctcgacccatgtgctacaaggcatatggaagtggaaaagaagacagtccagcatgtgatgttcctgggtttgagaatgccaggatgaaattgcttagacatgtgtcctttgtcgattgccctggtcacgacattctcatggctacaatgcttaacggggcagcaattatggatggagctttacttcttatagctgccaatgagagttgtcctcaacctcagacttcagagcatttagctgctgttgaaatcatgcgtctccaacatatcataattcttcagaataaagttgaccttgttcaggaaaatgttgccatcaaccagcacgaagccattcagaaatttattcagggaactgtcgcagatggtgcacctgtggtaccaatttctgcgcagctgaagtataatattgatgttgtatgcgaatacattatcaagagaattcctatcccagagaggaatttcatttcaccaccaaatatgattgtgatcaggtcttttgatgtcaataagcctgggtctgaagttgatgaaatcaaaggtggtgttgctggtggaagtattttgaagggtgttttgaaggtaaaccaatttatcgaggtccgtccaggtattgttgtgaaggacgaaacagataacatcaagtgcacacctatctactccaggattgtttccttgtacgcagagcaaaatgaattacaatttgctgtgcctggaggccttattggagttggaacaacaatggaccccacacttacacgtgctgacaggttggtcggccaggttcttggtgaagtcggttcactccctgaaatctatgttgaacttgaggtgaatttctttttgctgaggcgattgctaggtgttaggacaaaggactcagaaaggcaggttaaggtgtcgaagctgacaaagggagagattcttatgttgaacataggatccatgtcaacaggtgcacgtgttgttgctgtgaagaatgttttcgctaaactacagctgacatcccctgtgtgcactagcaaaggagagaaaattgcgctgagccgaagaatcgataggcactggcgtctaattggctggggtcaaatccaagctgggattactctcgaggttcccccctgtcccatctaagtgaactagttctctactgaatttacaccgcaaacgagagtagaagaaaaacagagaactagatgggaacaatttttgttcgatggaggagaaaagattttttggattttcggatacttatgtgtttatttttttttttaaattacgtttttttgcttttaatattgtttgtctgaagttggtttaattgcattttggacgttgagtgttgaactaaaaaccaatctgttgcagtatgattcttgtatgcaaattgtcttgagtatggcccatttacgaattttttggactttagtaggcccaatttcgatttctgtaaaattatgggcttctttcatattgaaaaaagtttctaattctaaaaaagtttgggattattactgggcccaattactatttcgagacaagtttgggctttaatggggcccactttcaaaa

SEQ ID NO: 2497 - DNA, 1860 bp, Mimulus guttatus
aggctattgttaatttcctaagtggccttctcttctttgcgccttgactttacaatttgatattgagagcgacctatctaaagctgccaaaatgtctagaaagggtttgatggagcaggatttaagcaagttggatgtaacacaactacatccactctcacctgaggttatttctcgccaagctactataaacattggtaccatcggtcatgtggctcatggtaagtcaacagtggtgaaggccatatctggtgttcagactgttcggtttaaaaatgaattggaacgtaatatcactatcaagctcggatatgccaatgcaaagatatacaagtgtgaagacgatcgatgccctcgacccatgtgctacaaggcatatggaagtggaaaagaagacagtccagcatgtgatgttcctgggtttgagaatgccaggatgaaattgcttagacatgtgtcctttgtcgattgcccgggtcacgatattctcatggctacaatgcttaacggggcagcaattatggatggagctttgcttctaatagctgccaatgagagttgccctcaacctcaaacttcagaacatttagctgctgttgaaatcatgcgtctccaacatatcataattcttcagaataaagttgaccttgttcaggaaaatgttgctatcaaccagcatgaagccatccagaaatttattcagggaactgtcgcagatggtgcacctgtggtaccaatttctgcgcagctgaagtataatattgatgttgtatgcgaatacattatcaagagaattcctatcccagagaggaatttcatttcaccaccaaatatgattgtgatcaggtcttttgatgtcaataagcctgggtctgaagttgatgaaatcaaaggtggtgttgctggtggaagtattttgaagggtgttttgaaggtaaaccaatttatcgaggtccgtccaggtattgttgtgaaggatgaaaccgataacatcaagtgcacacctatctactccaggattgtttccttgtacgcagagcaaaatgaattacaatttgctgtgcctggaggccttattggagttgggacaacaatggaccccacacttacacgtgctgacaggttggtcggccaggttcttggagaagtcggttcactccctgaaatctatgttgaacttgaggtgaatttctttttgctgaggcgattgctaggtgtcaggacaaaggactcagaaaggcaggttaaggtgtcgaagctgacaaagggagagattctcatgttgaacataggatccatgtcaacaggtgcacgtgttgttgctgtgaagaatgtttttgctaaactacagctgacttcccctgtgtgcacaagcaaaggagagaaaatagcactgagccgaagaatcgataggcactggcgtctgattggctggggtcaaatccaagctggcattactctcgaggttcccccctgtcccatctaagtgaactagttctctactgaatttacaccgcaaacgagagtagaagaaaaacagacaactagatgggaacaatttttgttcgatggaggagaaaagattttttggatttccggatacttatgtgtttatttttttttaaatttcgtttttttgcttttaatattgtttgtctgaagttggtttaattgcattttggacgttgagtgttaaactaaaaaccaatctgttgcagtatgattcttgtatgcaaattgtcttgagtatggccatttacgaatattttggactttagtaggcccaatttcgatttctgtaaaattatgggctttttttatatttgaaatagaaaattatgggcttcttttatattgaaa

SEQ ID NO: 2498 - DNA, 1738 bp, Nicotiana benthamiana
gatgagtccctctgtcgtcggtggtgggtcaggtggagattggtctttgatcggcaatgttccatttctttggaagggtaaggacagtaaaagaaagttaacgaggtttactgaatttattcgttgcttatggtaacaatcatggtgattaagctgtgttgtctgtaagactatgcattgggttttttgatgtgttgctcgactttctatcataagtcatttatagttctgagcatgggctttttgtctttgttcctaatttcagagttgaaacttgctactaaagtattcaacaaccgcaaaaaatgtctcggaaaggattgatggatcaggacctaagcaaattggatgtgacaaagttacatccactttcgcctgaagttatttctcgtcaggctacaataaacattggtactattggccatgtggctcatgggaagtcaacagttgtaaaagctatatctggtgtgcagactgttcgttttaaaaatgagctagaacgtaatattacaattaagcttggatatgcaaatgctaagatatacaaatgtgaagaagagcgctgtcctagacccatgtgctacaaggcatatggtagtggaaaagatgacagtcccatgtgtgatgtccctggttttgagaactgcaggatgaaattactaaggcatgtatcttttgttgattgcccaggtcatgatattctcatggctacgatgcttaatggagctgcaattatggatggagccttacttctgattgctgccaatgagagctgtccccaacctcaaacttctgaacatctagcagctgttgaaattatgcgcctccaacatatcataattcttcaaaataaggttgatctagtccaggaaaatgttgccatcaaccagcacgaggcaattcagaaatttattcaaggaactgttgcagatggtgccccagttgtaccaatatctgcacaattgaagtacaacattgatgtcgttgctgaatatattgtgaaaaaaattcccattcccgaaaggaatttcatttcaccaccaaatatgattgttatccggtcatttgatgtcaataaacctggttttgaagttgatgatatcagaggtggtgttgctggtggcagtattttgaagggtgtattgaaggtaaatcaacttattgaggttcgccctggaattgttgtcaaagatgagagtggaaacatcaagtgtactccaatatattcaagaatagtatcattgttcgccgagcaaaatgaactacaatttgccgtgcctggaggactcattggagttggaacaactatggatccaacattgacacgtgctgatcgattggtgggacaggttcttggggaggttggatcactccctgaagttttcgtcgaactagaggtgaatttctttttgctccgacgtcttttgggtgtgaggacaaaggattcagagaggcagggtaaagtctcaaagttggcaaagggagaaatcctcatgttaaatatagggtctatgtcaacaggggctcgtgttgtcgctgtcaagaatgtattcgcgaaattgcaattgacatcacctgtgtgtaccagtaaaggtgagaaaattgctcttagccggagaattgagaagcactggcgacttattggttggggccaaatccaagctggtattactattgatattccaccctgccccatctgagtaaattttacacgactagttgctgaacagctagaaaa

SEQ ID NO: 2499 - DNA, 1523 bp, Capsicum annuum
ctttttactttctctctctagagctgcgccgctgccgttcttactcttctccgacttgaaaagtaccgacatccggagaagtatcaaagagcagctacagaatgtctcgaaaaggattgatggagcaagaccttagtaagttggatgtaacaaaactgcatccactttcaccagaggtcatttctcgtcaggctacgataaatattggtaccattggccatgtggctcatggaaagtcgacagttgtaaaagctatatctggagttcagactgttcgttttaaaaatgagttggaaagaaacatcacaattaagcttggatatgctaatgctaaaatatataaatgtgaagaggaccgctgtcctagacccatgtgctacaaggcatatggaagtggaaaagaagacagtcccatgtgtgatgtcccaggttttgagaactgtaggatgaaattgctgagacatgtatctttcgttgattgccccggtcatgatattctcatggctacaatgcttaatggagctgcaattatggatggagcattacttctaattgctgctaatgagagctgtccccaacctcagacttctgaacatttagctgctgttgaaattatgcgcctccaacacataataattctacaaaataaggttgatctagttcaggaaaatgttgctattaaccagcatgaggcaattcagaaatttattcagggaactgttgctgatggtgccccagtagtaccaatctctgctcaattgaagtacaacatcgatgttgttgctgaatatattgtgaagaaaattcccattcctgttagggatttcatttcaccaccaaatatgatagtcatccgatcatttgatgttaataaacctggttttgaagttgatgatatcagaggtggtgtcgctggtggcagtatactgaagggcgtcctgaaggtaaatcaactcattgaagttcgtcctggtattacagtcaaggatgagagtggcaacattaagtgtaccccaatatattcaagaatagtgtcgttgttcactgagcaaaatgagctacaatttgctgtgcccggaggcctcattggagttggaacaactatggatccaacactgactcgtgctgatcgattggtgggacaggttcttggggaggttgggtcacttcctgacgtatttgtcgaactggaggtaaatttcttcttgctccgccgtcttctaggagtgaggacaaaggaatctgaaaagcagggtaaagtctcaaagttggccaagggagaaatcctcatgttaaacataggatctatgtcaacaggggctcgtgttgttgctgtcaagaacgtctttgcaaaactgcagttgacatcaccagtgtgcaccagcaaaggtgagaagatcgctcttagccgaagaattgagaagcattggcgtctcatcggctggggccaaattcaagctggaattacccttgatgtcccaccttgcccaatctgagtgaactacacaccaattactgattta

SEQ ID NO: 2500 - DNA, 1831 bp, Solanum phureja
tctcattcttcgttttactttctctctcgagtgcagctgcgacgccgccgtttcactcttctccgtttcagacttgaaaattactgacatctgaagaagtatcaaagaacagctaaaatgtctcggaaaggattgatggagcaggacctgagtaagttggatgtaacaaagttgcatccactttcaccagaggttatttctcgtcaggctacaataaatattggtaccattgggcatgtggctcatggaaagtcaacagttgtaaaagctatatctggagtgcagactgttcgttttaaaaatgagctagaaagaaacatcacaattaagcttggatatgctaatgctaagatatataaatgtgaagaagaccgctgccctagacccatgtgctacaaggcatatggaagtggaaaagaagacggtcccatgtgtgatgtccccggtttcgaaacctgtaggatgaaattgctgagacatgtatctttcgttgattgccccggtcatgatattctcatggctactatgcttaatggagctgcaattatggatggagcattacttctaattgctgctaatgagagctgtccccaacctcagacttctgaacatttagctgctgtagaaattatgcgcctccaacacataataattctccaaaataaggttgatctagttcaggaaaatgttgccattaaccagcatgaggcaattcagaaatttattcagggaactgttgctgatggtgctccagttgtaccaatctctgcacaattgaagtacaacatcgatgttgttgctgaatatattgtgaagaaaattccaattcctgagaggaatttcatttcaccaccaaatatgatagtcatccgatcatttgatgttaataaacctggttttgaagttgatgatatcagaggtggtgtcgctggtggcagtatacttaagggcgtcctgaaggtaaatcaactcattgaggttcgtcccggtattactgtcaaggatgagagtggcaacattaagtgtaccccaatatattcaagaatagtgtcattgtttgctgagcaaaatgagctacaatttgctgtgcccggaggcctcattggagttggaacaactatggatccaacattgactcgtgctgatcgattggtcggacaggttcttggggaggttggctcacttcctgaagtgtttgtcgaactggaggtaaatttcttcttgctccgccgtcttctgggagtgaggacaaaggacacggaaaggcagggtaaagtctcaaagttggccaagggagagattctcatgttaaacataggatctatgtcaactggggctcgtgttgtcgctgttaagaatgtctttgcaaaactgcaattgacatcacctgtgtgtaccagcaaaggtgagaaaattgctcttagcaggagaatcgagaagcactggcgtctcatcggttggggccaaatccaagctggtatcacccttgatgttccaccttgcccaatctgagtgaactacacagaaacacgattttgacatttagatgtggaaatgcatacaattgctaggaactaaaaaagattatctgaaatttcgaatactttgtaatttgcaatgtttcctttttcttatttacgacttctctttgttttctcttattttcctctttgttctagtggttgtaccttgtaattcattagttgttaagggtggatattattcctatgagtttcatcataaacattgaggttgcggcatgtttttatctaaaagtttaaactatcataaacgacatacttttatttacatttcatgtgggactcgattc

SEQ ID NO: 2501 - DNA, 1839 bp, Solanum lycopersicum
acaccactaagccaaaatcatattctcattcctcgttttactttctctctcgagtgcagctgcgacgccgccgtttcactcttctccgtttcaggcttgaaattcacggacatctgaagaagtatcaaaaaacagctaaaaaatgtctcggaaaggattgatggagcaagacctgagtaagttggatgtaacaaagttgcatccactttcaccagaggttatttctcgtcaggctacgataaatattgggaccattgggcatgtggctcatggaaagtcaacagttgtaaaagctatatctggagttcagactgttcgttttaaaaatgagctagaaagaaacatcacaattaagcttgggtatgctaatgctaagatatataaatgtgaagaagaccgctgccctagacccatgtgctacaaggcatatggaagtgcaaaagaagacagtcccatgtgtgatgtccctggttttgagacctgtaggatgaaattgctgagacatgtatctttcgttgattgccccggtcatgatattctcatggctactatgcttaatggagctgcaattatggatggagcattacttctaattgctgctaacgagagctgtccccaacctcagacttctgaacatttagctgctgtagaaattatgcgcctccaacacataataattctccaaaataaggttgatctagttcaggaaaatgttgccattaaccagcatgaggcaattcagaaatttattcagggaactgttgctgatggtgctccagttgtaccaatctctgcgcaattgaagtacaacatcgatgttgttgctgaatatattgtgaagaaaattcccattcctgagaggaatttcatttcaccaccaaatatgatagtcatccgatcatttgatgttaataaacctggttttgaagttgatgatatcagaggcggtgtcgctggtggcagtatactgaagggagtcctgaaggtaaatcaactcattgaggttcgtcccggtattactgtcaaggatgagagtggcaacattaagtgtaccccaatatattcaagaatagtgtcattgtttgctgagcaaaatgagctacaatttgctgtgcccggaggcctcattggagttggaacaactatggatccaacattgactcgtgctgatcgtttggtcggacaggttcttggggaggttggctcacttcctgaagtgtttgttgaactggaggtaaatttcttcttgctccgccgtcttctgggagtgaggacaaaggacacggaaaggcagggtaaagtctcaaagttggccaagggagagattctcatgttaaacataggatctatgtcaactggggctcgtgttgtcgctgttaagaatgtctttgcaaaactgcaattgacatcacctgtgtgtaccagcaaaggtgagaaaattgctcttagcaggagaatcgagaagcactggcgtctcataggttggggccaaatccaagctggtatcacccttgatgttccaccttgcccaatctgagtgaactacacacaaacacgattttgacatttagatgtggagaggcatacaattgttaggaactataaaagattatcttaaatttcgaatactttgtaatttgcaatgtttcctttttcttatttacgacttctctttgttttctcttgtttcccttgttctactggtttgtaccttgtaattcattagttgttaagggtggataatattcctatgagtttcatccgaaacatcaaaggaggctgcatcacatgtttcatctaaaagcttaaactattagaagcgacgtactttaatttaca

SEQ ID NO: 2502 - DNA, 1643 bp, Allium cepa
aaatttgtttcaagcggaacagcctcgaactcagctccttatctggaaccctaaaactgccgcttctgccaccgtgatctcctcctctgctgtcgctgtctcttcaaccgctattcaagataccaaagcaaagatggctaagaaatcaggattaatggagcaagatctcagtaagcttgatgtggcaaagcttactcctctttcacctgaagttatttctcgtcaagctacaattaatatcggcaccattggccatgtggcacatggaaagtcaaccgtggtgaaagcaatatctggtgttcagactgtgcgatttaagaatgaactggagaggaatatcactatcaaacttggatatgctaatgcaaagatatacaaatgtgaagacgagaaatgtccaaggccaatgtgctacaaagcttacggaagcggaaaggaggatagcccagattgcgatgtgcctggatttgagaaagccaagatgaaacttttgagacatgtttccttcgttgattgtcctggacacgatattctcatggctacaatgcttaacggagctgctatcatggatggagctctgcttttgatagctggcaatgaaagttgtccccagcctcaaacttctgagcatcttgctgctgttgaaatcatgcgactggagcacataataattcttcaaaataagattgatcttattcaagaaagtgttgcgatcaatcaacatgaatcaattcagaatttcatcaagggcacaattgccgatggtgccccagtagtgcctatatccgctcagttgaaatataacattgatgttgtgtgtgaatatctcgtcaacaaaattccaattcctgtaagggattttacatcgccgccaaatatgattgttatccgatcatttgatgtaaataagcctggttctgaggttgatgaaatcaaaggtggtgttgctggtggaagtattcttaggggagttctgaaggtgaaccaattaattgaagttcgacctggcattgttcttaaagatgagagtggcaaaatcaaatgtactcctatatactctagaatcaagtcgttatttgctgaacaaaacgaactgcaatttgctgtacctggaggacttattggtgttggtactaccatggaccccacattaacccgggctgatagacttgttgggcaagttcttggtgaagttggttctcttcctgatgtttttgttgagcttgaggtaaacttctttttgctgaggaggctactgggggtgagaacaaaaggagcagaaaagcaaggaaaagtatccaaactgacaaagggggaaattctaatgcttaacattggttcaatgtcaactggagctaaagtgatagcagtgaagaacgacttagctaagctacaattgacagcacctgtatgcacaagcaaaggggagaaagttgctctcagcagaagagtcgaaaaacattggcggcttattggttggggtcagatccaggccggctctactctccaaattcctccatctcccactttttaatttcacaaagaaagcaagaaaaaagattgtatttgaattctggtttaatttatgtgggaaaggatttcagctgttagattatatttttgttagacagagaggattgtgc

SEQ ID NO: 2503 - DNA, 1626 bp, Allium cepa
tcgcagcttgtttgttctttaaaattttcttttggaagagtttcaagggcgatcctgatttccacaaataaaatccggtaagcagcaatttcttattgccatctaggaaccctaaaaaccgccgttttctgccgtcatctctatctcatccgccgtcgcttgcttctccaacttcgccaagggtttgaaagcaaagatggctaagaaaactggattaatggagcaggatcttagtaagcttgatgtgtcaaagcttactcctctttcgcctgaagttatttcacgtcaagctactatcaatattgggactattggtcatgtggcccatggaaaatctaccgtggtcaaagcaatatctggtgttcagactgtacggtttaagaatgaattggagaggaatatcactatcaagcttggatatgctaatgcaaagatatataaatgtgaagatgaaaaatgtccaaggccaatgtgttacaaagcgtatggaagtggaaaggaggatactccagattgtgatgttcctggatttgacaaaactaaaatgaaacttttgagacatgtttcgtttgtggattgtccgggtcacgatattctcatggctacaatgcttaatggagcagccattatggatggagctttgctgttaatagctggcaatgaaagttgtccccagcctcagacttctgagcatcttgctgctgttgaaatcatgcgacttgaacacataatcattcttcaaaataaaatcgaccttattcaagaaagtgctgcaatcaatcaacatgaatcaattcaaagtttcatcaaaggtacaattgcagacggtgcaccagtggttcccatatcagctcagctgaagtacaatattgatgttgtttgtgaatatctcgtcaacaaaatcccgattcctattagggattttacatcacctccaaatatgattgtgattcgatcatttgatgttaataagcctggctctgaggttgatgagatcaaaggtggtgttgctggcggaagtattcttaggggagttttaaaagtgaatcagttaatcgaagttcgacctggaattgtactcaaagacgagagcggcaacatcaaatgcaccccaatatattctagaatcaagtctctttttgcagagcaaaatgaactacagtttgcagtgcctggagggcttattggagttggtacaactatggaccccacactgactagagctgataggcttgttggtcaagttcttggtgaagttggttctctacctgatgtatttgttgagcttgaggttaacttctttttactgagaaggctattgggagtaagaacaaaaggtgcagaaaagcagggaaaagtatcgaagctaacaaaagcagaaattctgatgcttaacattgggtccatgtcaaccggagctaaagtaattgcagtgaaaaacgatttagcaaagcttcagttaactgcaccggtatgtacaagcaaaggcgagaaggttgctctcagcagaagagtggagaagcattggagactgattggttggggtcagatccaggcaggctctactctcaaaatcccaccacgtcccagtttttaagaaagaaaagagagaaggaaaaaagcgag

SEQ ID NO: 2504 - DNA, 1772 bp, Gnetum gnemon
cagcattgttccctgcctctaccgtcttattcttcattatctgatagtttgattaaagagcattatcaaaaaatgtcgcgaagggggctaatggaacaggaccttagcaaactggatgtaactcaattacatccactttcgcctgaggtcatttctcgtcaagctacaattaacattggtacaattgggcatgtcgcacatggaaaatcaactgtagttaaagctatttctggtgttcagactgtttcgttttaaaaatgaactggaaagaaatattactatcaagttaggatatgcaaatgacaaaaatctataaatgtgaagatgaaagttgccctcggccaatgtgttacaaggcatatggtagtgggaaagaagatagtccactctgtgaggtgccagggtttgaaaagaagcgcatgaagcttttgagacatgtctcttttgtggattgcccgggccatgatattctcatggctaccatgcttaacggtgctgctatcatggatggtgcattacttcttatagctggaaatgaaagctgtcctcaacctcaaacatctgaacatttggctgcggttgagatcatgcgtcttcaacacatcattatattacaaaacaaaattgatctaattcaggagagcgtagccatgaaccaacatgaggccattcagaagtttattcagggtactattgctgacaaagcgcctgtagtgccaatatcagcacagctgaagtacaacattgatgttgtctgtgaatacattgtgaacaaaattcctattccagagcgtaactttgtttctcctccaaacatgattgtgattcgatcatttgatgtgaataagcctggtgctgaagttgatgagataaaaggaggtgttgctggtggaagtatactgaggggtgttttaaaggtaaaccaaaaaattgaggttcgccctgggattgtcatcaaagatgaacatggaaacatcaaatgcacacctattttctcaagaataatctctctttatgctgagcaaaacgagttgcaatatgctgttcctggtggtcttattggtgttggtacaaccatagatccgacactgacacgagctgatcgactggttggacaagttcttggagaagttggtgaattgcctgatgtttacgttgaacttgaggtaaatttcttcctccttcggcgtcttcttggagttaggacgaaaggtaccgaaaaacaaggaaaagtttcaaaactaacgaagggagaagttttgatgcttaatattggttcaatgtctactggagctaaagtgattgcagtaaggaatgatcttgcaaaactccaactgacctctcctgtgtgcacaagcaaaggagaaaagatggctcttagcaggagagtagaaaacattggcgattgataggatggggtcaaattcaggctggtgtaatgcttgagattcccaaggaaactatgtaacaagactgcatagagaacttgttttcatctgaagcgagtgaaaatttgaaatgtggataggacgagagttgttaggaacaatttttgttagatggaggagaaaaccttttcagtaccaaccagatattatttgtttcatatgttttaatattgtaaaactacgatgagtaaaacagatgcctttttatttatgattgcatgtctgagatgtttggaaccagtttatgagatgcactcaatccaattgctagatgtaaagtattttgtatactgcaaaagttacctagccaattttgattaacac

SEQ ID NO: 2505 - DNA, 2143 bp, Conyza canadensis
ccaccaccaccacatctcaaagattctatccttccgaataataagggtataatattccgccgtttcgaaaaaataaattagggtttaataaaagtaaagatatcatggcgaaaaaaggtctaatggagcaagatttgagtaagctggatgtggctaccctacatccgctttctccggaagttatctcccgccaagccactatcaatattggtacaattggtcatgtggctcatgggaaatcaaccgttgtaaaagcgatatccggtgttcagactgttcgttttaaaaatgagttggagcggaacattaccatcaagctcgggtatgctaatgcaaagatatacaaatgtgaagatgaccggtgccctcgacctatgtgttacagggcctacggaagtggcaaagaagatagcccacaatgtgaagtccctggatttgaaaacagcaagatgaagttgatgaggcacgtgtcatttgttgattgccctggacacgatattctcatggctactatgcttaatggagcagcaatcatggatggggcgttacttctcatagctgctaatgaaagttgtcctcaaccacaaacttctgaacatctggctgctgttgaaattatgcgactccagcatattatcattcttcaaaataaggttgatctaattcaggagaatgtagccattaaccaacacgaggccattcagaaattcatccagggaaccgttgctgatggtgcaccagtcattcctgtgtctgctcagcttaagtacaacattgatgttgtttgcgaatacataattaagcggattcccattccagagaggaacttcatctcacctccaaatatgattgtgatacgttcatttgatgtgaacaaacctggttctgaagttgatgagatcaaaggtggtgttgctggaggaagtattctcaagggtgtgttgaaggtgaaccagaacattgaggtccgccctgggattgttgttaaagatgagagtggcaacatcaagtgcacgcctatttacaccagaatagtttcactgtatgccgaacagaacgaactacaatttgctgtacctggaggtctcatcggagttggaacaacaatggaccctatgctgactcgtgctgatcggctggtgggacaagttcttggggaggttgggtctttacctgacgtttatgtcgaactagaggtgaacttctttctcttgcgtcgtctgctaggtgtaaagacaaaaggaactgaaaagcaagggaaggtttcaaagttagcgaaggcagaaattctgatgttgaacatcgggtcaatgtctacaggagctcgtgttttggcggttaagaacgatttagcgaaactgcatttgacatctccagtgtgtacgagcaaaggtgagaagattgccctaagcaggagagttgagaaacattggcgattgattggttggggacaaattcaagcaggatcgacccttgagattccaccctgcccaatatagacacatttgaattccagttttgcctcctgctgttttcatatttgattcttaatatctgtttagatctggtagtaattgtgattttacactattaactcattttgagcacaactttgcatggtgtgtgaaggaagaatcataagacaggtgcctttctttattactttttcatctaagaatggacatgggaacaccttgattctatataaccatattggtacctacgaaaccctcatgttgagtttttacattgatgattagctatcataacgcgtccctcaagatgctaaggccctcaatggtgtcattgtggccactggccaaccaaccaaactgagttagaagcaacaatttctgatatgattttgaagcaacatttgctgtgttacataataagcatggtcagtttgggttgtactctctaaccaaagacttttgtaggtaaatacgagtataagttaaaaaatatcggaacgtatcaaagacttgaaagccggtgctctttgcatgaaggtaaatatataagtgttgtttgttatgcttgtcatttgatatgtttgatatggactggaacgtatatttaggggtgttgaaattaattacgccagaataacccgaaccaacggaacacaaataaacctatc

SEQ ID NO: 2506 - DNA, 1863 bp, Nicotiana benthamiana
gactcaaaaattagtgatctctgaattagcaaggagtatccaaaatgtctagaaaaggactgatggagcaggacctaagcaagttggatgtagcacagctgcatccactttcgcctgaagtgatttctcgtcaggctaccattaacataggtaccattggccatgtggcacatggaaagtcaacagttgtaaaagctatatctggtgtgcagactgttcgttttaagaatgagctagagcgtaacattacaattaagcttgggtatgctaatgcaaagatatacaaatgtgaagatgagcgctgtcctagacccatgtgttacaaggcatatggaagtggaaaagaagacagtccaatgtgtgatgtccctggttttgagacctgcaggatgaaattgctgagacatgtgtcctttgttgattgtcctggtcatgatattctcatggctaccatgcttaatggagctgccattatggatggagcgttacttctaattgcagccaatgagagctgtccccaacctcagacttctgaacatttagctgctgttgaaattatgcgcctccaacatataataattcttcaaaataaagttgatcttgttcaggaaaatgttgccatcaatcagcatgaagctattcagaaatttattcagggaactgtagcagatggtgccccagttgtaccaatctctgctcaactgaagtataatattgatgttgttgctgaatatattgtgaagaagattcccattcctgtgagggatttcacttcaccaccaaatatgattgttattcggtcatttgatgttaataaacctggttttgaagttgatgatatcagaggtggcgttgctggtggcagtattttaaagggtgtgttgaaggtaaatcaattgatcgaggttcgtccaggtattgttgtcaaggatgagagtggcaacattaaatgtacccccatatattcaagaatcgtgtcattgtttgctgagcaaaatgaactacaatttgctgtacctggaggcctaattggagttggaactatcatggatccgacgctgacacgtgctgatcgattggtgggtcaggttcttggggaggttgggtcacttcctgaagtttttgtcgaactagaggtgaatttctttttgctccgccgtcttttgggtgtgaggacaaaggactcggaaagacagggtaaagtttccaagttggcaaagggagaaatccttatgttaaatataggttctatgtcaactggggctcgagtggttgctgttaaaaatgtgttcgcgaaactgcagttgacgtccccagtgtgtacaagcaaaggtgaaaaaattgctcttagccggagaattgaaaagcactggcgtcttattggttggggccaaatccaagctggtattactcttgacgttccaccgtgccccgtctaagcgagtcggattacacaatcaattactaaaaggacagatcaagtagtgaaacaacataagacagtattagatgagtcgggttacacaatcaattactaaaaggacagataaagtagtgaaacaacataagacggtattagatgtgggaaggcaggcagttgctggaaatgatctttgccaggtggagaaaacattattttgaatttcgatgctttataatctgcgatattttacatttcctactgatgacatgtttctttccccctctttttcatgccttgttcgagtggttgtaccttgtaattcattaggccgggttgatagtaaaatgtgttctattggagatattgagcttgcggcagattttgaaccacttgtattgtttcttcaagtttttggaccaaagtttttttggatgtctgcc

SEQ ID NO: 2507 - DNA, 1855 bp, Nicotiana benthamiana
ctctcttaagtcacctgcaattatgtggatgactctttttatctgatccaaattccagactcaaaaattactgatctctgaatttatcaaagagcatctaaaatgtctagaaaaggactgatggagcaggacctaagcaagttggatgtagcacagctgcatccactttcacctgaagtcatttctcgtcaggctacaataaacataggtaccattggccatgtggctcatggaaagtcaacagttgtaaaagctatatctggtgtgcagactgttcgttttaagaatgagctagagcgtaatattacaattaagcttgggtatgctaatgcgaagatatacaaatgtgaagatgagcggtgtcctagacccatgtgctacaaggcatatggaagtggaaaagaagatagtcccatgtgtgatgtccctggttttgagacctgcaggatgaaattgctgagacatgtgtcttttgttgattgtcctggtcatgatattctcatggctaccatgcttaatggagctgccattatggatggagcattacttctaattgcagccaatgagagctgtccccaacctcagacttctgaacatttggctgctgttgaaattatgcgcctccaacatataataattcttcaaaataaagttgatcttgttcaggaaaatgttgccatcaatcagcatgaagctattcagaaatttattcagggaactgtagcagatggtgctccagttgtaccaatctctgctcagcttaagtataacattgatgttgtcgctgaatatattgtgaaaaagattcccattcctgtgagggatttcacttccccaccaaatatgattgttattcggtcgtttgatgttaataaacctggttttgaagttgatgacatcagaggtggtgttgctggtggcagtattttaaagggtgtgttgaaggtaaatcaattgatcgaggttcgtccaggtattgttgtcaaggatgagagtggcaacattaaatgtacccccatatattcaagaatcgtgtcattgtttgctgagcaaaatgaactacaatttgctgtacctggaggcctaattggagttggaactatcatggatcctacgctgacacgtgctgatcgattggtgggtcaggttcttggggaggttgggtctcttcctgaagtttttgtcgaactagaggtgaatttctttttgctccgccgtcttttgggtgtgaggacaaaggactcggaaagacagggtaaagtttccaagttggcaaagggagaaatccttatgttaaatataggttctatgtcaactggggctcgagtggttgctgttaaaaatgtgttcgcgaaactgcagttgacgtccccagtgtgtacaagcaaaggtgaaaaaattgctcttagccggagaattgaaaagcactggcgtcttattggttggggccaaatccaagctggtattactcttgacgttccaccgtgccccgtctaagcgagtcggattacacaatcaattactaaaaggacagatcaagtagtgaaacaacataagacagtattagatgtgggaaggcaggcagttgctgggtataatctttgccaggtggaggggaaaacattatttggaattttcgatactttataatctgcgatattttacatttcctactgatgacatgttctttccccctttttttccatgccctgttcgagtggttgtaccttgtaattcattaggtcgggttgatagtaaaatgagttctattggagataagcttgcggcagattttgaacctactttgtattgtcccttcaagtttatggactaaagttttttggcatgtctgcca

SEQ ID NO: 2508 - DNA, 1851 bp, Pinus taeda
acctcatcgcacaggagagagtcctcttttggctttgggtgtgttttgcaataggtttctcatctctcgttggcacccgctgctgcacttacatagccagtccaatccaatcggagcaggaggaagaagtgaaggtgcccatatactatctgatcaactttgaataccgagctctgatccgcgcagacagatctgcagtctccatattctccgcacctaaattcattttgtgagggcttatcatccaccaagtgccaaaaatgtcgaaaaaagggttaatggagcaggacctgaacaagctggatgttaccaagttgcatccgctctctccagaggtcatttctcgtcaggctacaataaacataggtacaattgggcatgtggcacatgggaaatcaacagttgttaaagcaatatctggtgtccagacagttcgtttcaagaatgaactagagcgaaacatcactattaagctgggatatgctaacgcaaaaatatataaatgtgaagatgatcgctgccctcgaccgatggcctacaaggcatatggaagtgggaaggaagatagtcctttgtgtgatgtctctggatttgaaaacactcgtatgaagcttttaagacatgtgtcttttgttgattgtccgggtcatgatattctcatggctactatgctcaatggtgcggctatcatggatggggcactgcttttgattgctggaaatgagagctgtcctcaacctcaaacttcagagcatcttgctgcggtggagatcatgcgtcttaagcatataattattttacaaaacaaaattgaccttatccaggagagtgtagccatgaaccagcatgaggcaattcagaagtttattcagggtaccattgcggatggagcacctgttgtaccgatctctgcacaactgaaatacaacattgatgttgtctgtgaatacatagtaaacaagattcccattccagagcggaattttgttgatccacccaatatgatcgtaatcagatcttttgatgtgaataagcctggtgctgaagttgatgaaataaaaggaggtgtcgctggtggaagtatactgaagggtgtgttgaaagtgaatcaaaaaattgaagttcgccctggcattgttgtcaaagatgaaagtggtagcatcaagtgtacccctatcttttcaagaataatttcactttatgctgagcaaaatgagttgcagtttgctgttcctggaggccttattggtgtgggtacaacaatagaccccacactgacacgtgctgacaggcttgtggggcaagtccttggagaagttggagcgctacccgatgtatttgttgagcttgaggttaactttttcctcctccgccgacttctcggagttaggacaaaaggaacagagaaacaagggaaagtttcaaagctggccaagggagaggtcttgatgcttaatattggttccatgtccactggagctcgggtgcttgctgtcaaaaatgatcttgcaaagctccagctgacttctccagtctgtacaagcaaaggagaaaagatggcacttagtaggcgagtagaaaagcattggcgattgataggatggggtcaaattcaagctggggcaatactggaaattccccaggggtcaatataagatagtcaataaacaaagcaagttatatttgagaaaagaaaaagggtacttcagtaaaaggaagaatgtggatagggagagaattactaggaacaatttttgttagatggagaagaaaacctattgggctgaatgttttttggtattttggttgttgtaaaatcacatttatgaaaattgaacacctagattatat

SEQ ID NO: 2509 - DNA, 1823 bp, Trifolium pratense
aaaaccacaataatcatcttcactcctagcttcgatttcgaataccctctcttctcttgttccttctatcacttctcaccttaaacactcgttttctctcactccagattccgtcactgtagcttctctactcatccactttcaaatcccactaattgaagtgaaaatggcgacgcgtagggggttgatggaacaagacctgagtaagttagatgtgacaaaattgcatccgctttctcctgaagttatatcccgtcaggctactattaatattggcaccataggtcatgtggcacatggaaagtcaacagttgtgaaagcaatatcaggtgttcagactgtgcgttttaaaaatgagttggaacgtaacattacaatcaagcttggttatgccaatgcaaaaatatacaagtgtgaagatgaacggtgtccaaggcctatgtcctacaaggcttatggaagtggaaaggaagataatcctatgtgtgatgtgccagggtttgaaaacagcaagatgaaattgctgagacatgtttcttttgtcgattgcccaggtcatgatattctcatggctacaatgcttaatggagcagcaatcatggatggagctttgctactcatagctgctaatgaaagctgtcctcaaccacaaacctctgagcatttagctgctgtggaaattatgcgtcttcagcacatcataatccttcagaacaaggttgatctaattcaagaaaatgtggctatcaatcagcatgaagcaattcagaagtttatagaaggaacggttgctgatggtgcaccagtcgtacctatttcagcccagttgaagtataatattgatgttgtgtgcgagtatatcgtgaaaaagatcccaatccccgaaaggaactttatttctccacctaatatgatagtaatccggtcctttgatgtcaataaacctggttttgaggttgatgatataaaaggaggtgtagctggtggaagtattctgaggggtgttttgagggtcaaccaattcattgaagttcgacctgggatagttgttaaagacgagagtggaaatattaaatgcacacctatatactctagaatagtttcattgtttgctgaacaaaatgagcttcaatttgctgtgcctggaggcctaattggtgttggaacaacaatggatcccactttgacgcgtgctgataggttggtagggcaagttctcggagaggttggatcactgcccgaggttttcgttgagcttgaggtaaactttttcttgcttcgacggctacttggtgtccgaacaaaaggatccgagagacagggaaaagtatctaagctggtcaaagctgaaatgctaatgttgaacataggatcaatgtcaacaggggcgagagtaattgctgtgaggaacgacttggcaaaattgcaacttacgtctcctgtgtgcactagcaaaggtgagaagattgcactcagtcgacgtgttgagaagcattggcgtcttattgggtggggtcaaatccaagctggaatcactctccaagtccctcctacacccatcttgagttgaagacagacacgaaagagaagagacagtacaagaaagcgccttttttaaaaaacgtgagatgaatttagatatgtgggaaggtagacaatttttgggaaccatttttgtgagatggagaagaaaacatttggattgtcaatttttgttttagcaatgtgatttgtttcttgttttctttactgtcaacatatttttgaagttgtatctaatgttgattgtgtttagactgagagcaagtgtgttcactgctaag

SEQ ID NO: 2510 - DNA, 1860 bp, Arachis hypogaea
ccagcttcaatcttcactcctcactcactactgactccgccgcatacttcgttgttgggttgctgttatccgtcgtattcaccggcggagcaactactgaatccattctgcgctttagctccttccagatatttcagcatcaaatattgtcaagttattcacttaactgaagtttccatcgaaaaagccaagatgtcgaggaagggtttgatggaacaggacctgagtaagttggacgtgacaaaattgcatccactttctccggaagtcatatctcggcaggctacaattaatattggcaccatagggcatgtggcacatggcaaatcaactgttgtgaaagcaatatcaggtgttcagaccgtgcgttttaaaaatgagttggagagaaacatcacaatcaagcttggctatgcaaatgcaaagatatataagtgtgaagatgataggtgtccaaggcctatgtgctacaaggcttatggaagtggaaaggaagatagtccaatgtgtgatgtaccagggtttgaaaactccaagatgaagttgctgagacatgtttcttttgtggattgcccaggacatgatattcttatggccacaatgcttaatggagctgcaatcatggatggagctttactactcatagctgctaatgagagttgcccgcaaccacaaacctctgaacatttagctgctgtggaaattatgcgtctacagcacataataattcttcagaacaaggttgatctgattcaagagaatgtggcaatgaatcagcatgatacaattaaaaagttcattgaaggaactgtagctgatagtgcaccagtggtacctatttcagcacaactgaagtataatattgatgttgtgtgtgagtatattgtgaaaaagatcccaatcccagaaaggaattttacttctccacccaatatgattgttattcggtcatttgacgttaataaacctgggtttgaggttgacgaaataaaaggaggtgtagctggtggaagtatcctgaggggtgttttgagggtcaaccaattcattgaagttcgacctgggatagttgtgaaagatgagagtggaaatatcagatgcacacccatatactctagaatagtttcattatttgccgagcaaaatgagcttcaatttgctgtgccaggaggtttaattggtgttggaacaacaatggatcccactttgacccgtgctgacaggttggtcgggcaagttctaggagaggttggatcactgccggaggtctttgttgaacttgaggtaaatttcttcttgcttcgacggcttctcggtgttcggaccaagggctcagagagacagggaaaggtatctaagctggctaaagcagagatgctaatgttgaacataggatcaatgtcgacgggtgcgagagttgttgccgtgaagaatgatctggcgaagttgcaacttacctcccctgtgtgcactaacaagggtgagaagatcgcacttagccgacgtgttgagaagcattggcgtctaatcgggtggggtcaaatccaagccggaatcactcttgacgtccctgccgccccaactgagttgaagtgagacgacatgtgtacaagagacaggttactagacacaccttgttataaaagcttgagaggaatttagatatgtgcgaggaatacacttgttaggaaccattttttttggaggtggaaaagaattggattgtcaatttttgtttctttctgcatttttttgttctctcttgtcttgtacctattattgaagttgtatctcattttctggttgagtctaagactattggataatggacggagaaacatgaaatagttccgtgattaa

SEQ ID NO: 2511 - DNA, 1777 bp, Zostera marina
gggtgttttcaataaaacccatctttctccttccctccttccttctttatcgtgaatccctctaaaccctaattccaattttttcatcctttcggcgaaatcagtgcttattggaatttgtatctgtgcgttgaacaaaaagagcaaacatgtcgagaaaaggattaatggagcaagatttgactaagttggatgtcacccaattgcatccactttctcccgaagttatatctaggcaggctacaataaatattggtacaattggtcatgtggcacatgggaagtcaactgtcgtaaaagcaatatctggtgttcagactgttcgttttaagaacgagctggagcgtaatattaccatcaaattaggatatgctaatgcaaaaatatacaaatgcgaaagtgacacatgcccacgaccaatgtgctacaagtcctatggaagtggaaaagaagacagcccattgtgtgatgtacctgggtttgaaaatgttcggatgaaactcttgagacatgtctcttttgtggactgcccgggtcatgatattcttatggccactatgcttaatggtgctgctatcatggatggagcattgcttttgatagctggcaatgaaagttgtccccaacctcaaacatctgaacatctggctgctgttgaaatcatgcgcttgcaacatataattatactacaaaataaagtcgatcttattcaagaaagtgtcgccattaatcagcacgaaaccattcaaaagtttattcagggaaccattgctgatggtgcaccagtggtgccaatctctgctcaactgaagtataatatcgatgttgtttgtgagtatattgttaacaagattcctattccaataagagacttcgtaaagcccccaaatatgatagtgattcgatcctttgacgtgaataagcctggatctgaggttgatgaaataaaaggtggcgttgcgggaggaagtatcctaagaggtgttttgaaggtgaaccaaaagattgaggttcgtccgggtattgttgttaaagatgagaatggcaatatcaagtgtactccgatatactcccggatagtttcgttatttgctgagcagaatgagcttcagtttgctgttcctggtggtcttattggagtcggcactacgatggatcctacattgactcgagctgatagactggtgggtcaggtgcttggagaagttggttctttgcctgatgtttatgtagagcttgaggtaaactttttccttcttagacgtcttcttggagtgaggacaaaaggcacagagaaacagggcaaagtttcgaaactagccaagggtgagatcctgatgcttaacatcgggtcaatgtcaacaggtgcccgagtagttgccgtaaggaatgaccttgcgaaactccaactcactgcacctgtttgcaccagcaaaggtgaaaagattgctctgagtcgacgtgttgagaagcattggcgtctcattggttggggtcagattcaagctgggtcagttctcgacatcccagctcctcctctcgaaattttgttctaattattttatataagagtgagtgtacacttatttttatgcctccattgaattagaagactcctgagttacttctgctcatcatactctggtttgcctctgttttagtatatttgttattcctctcctgtttggaatacacattattattttttagtgataaaatctagtgcagttaatctcaaaattatcccaaggtaagttgaggttctgccaagaagcat

SEQ ID NO: 2512 - DNA, 1483 bp, Persea americana
taatggagcaggacttaagtaagctggatgtgacaagcttacatccactctctcctgaagtcatttcacgtcaagccacaattaatattggtaccataggtcatgtggcacatgggaagtcaacagttgtgaaggcaatatctggtgttcagactgttcgttttaagaatgagctagagcgcaatattacaatcaagctgggatatgcgaatgccaaaatatacaagtgcgaggatgagcggtgctcacggcccatgtgctacaaggcctacggaagtggaaaagaggacagccctttatgtgatgttccagggtttgagaatgccaggatgaaactcttgaggcatgtttctttcgtggactgcccgggtcatgatattcttatggccaccatgcttaatggagcggctatcatggacggagctctgcttttgatagctagcaatgaaagttgtcctcaacctcaaacttctgagcatctggctgctgttgaaatcatgcgtctccagcatataattatcttacaaaacaaaattgatctcatacaagaaagtgttgccataaaccagcaagaagcaatccaaaagtttattcagggcactattgcggatggcgcgccagtggtaccgatatctgcacagttgaaatacaatattgaatgttgtttgcgaatatcttgtcaaaaaaatcccaatcccagagaggaattttgtttcaccgccgaatatgatagtaatccggtcgtttgatgtgaataagcctggttttgaggttgatgaaataaagggtggtgttgctgggggaagcattctcaggggtgttttgaaggtaaatcaatacgttgaagtccgtcctggcattgtcgttttggaaaagaaatgaggctggtaatatcaagtgtaccccaatatactcaagaatagtttcattatttgccgagcaaaatgagttgcagtttgctgttcctggaggtctgattggtgttggcaccacgatggatccaacactaacacgtgctgataggttggtgggtcaagtccttggagcagttgggtccctccctgatatatttgttgagcttgaggtgaacttctttctgctacggcggcttcttggggtgaggaccaagggtacagagaaacaggagaaggtctcaaagctagccaagggtgagatcttgatgttgaacattgggtctatgtcaactggggctcgggtgcttgctgtgaagaatgatcttgccaagttgcagctcacctcgcccgtttgcaccagcaaaggggagaaggtggcactgagccggcgggttgagaagcactggcgtctcattgggtggggccagatacaagctgggtcaacacttgatgtcccaccctgccccatttaagtaattccatgcacacatgtactggtgaaaccatgagaaggaaattgtaggtgagccctttttgtgaggtacagacagttgaaatgcatgaaccgc

SEQ ID NO: 2513 - DNA, 1630 bp, Arabidopsis lyrata
catcctcttcaagctgcgccgcttttctcactcttttatctctcaaatttaaccgaccttcttcgatttctccccagtcgttgttctttcgcatcgctcaggagaagaagcttcaatctttgataatgtcgaggaacaagggtttggctgagcaagatcttaaaaaattggatgtaactgtgctacatcctttgtctcctgaggtcatttctcgccaggccactattaatataggaaccattggccatgtcgctcatggaaagtccactgttgtgaaagctatttctggtgttcagactgtccgttttaagaatgaattggagcgtaacattaccattaagcttggatatgcaaatgctaagatttacaaatgtgaggatgagaaatgccctagaccaatgtgctacaaggcctacggaagtggaaaagaagacagtccaaattgtgatgtccccggatttgagaactccaagatgaaactattgaggcatgtgtcattcgtggattgcccgggacacgatattctcatggcaacaatgcttaacggagcagccatcatggatggtgcactacttttaatcgctgcaaatgagacgtgtccacaaccacaaacgtctgaacatcttgctgccgtcgagattatgcaactgaagcatatcatcatccttcagaacaagattgatcttattcaagaaaacgttgccattaatcagcacgaggcaattcagaaatttataatgaacactgttgccgatgctgctccgatcgtccccgtctcagcacaactgaaatacaacattgatgttgtgtgcgagtacattgtcaagaagatcccaatccctgagaggaattttgtgtcacccccaaatatgatagtgattcgatcttttgatgtcaacaaacctggttatgaggttgatgagattaaaggtggagttgcaggtggaagtatcctccggggtgttttgaaagtcaaccaattaattgaaatccgacctggtatcgttaccaaagacgagcgtggcaactcaaaatgcactccaatttactctcgcataatctcactctacgcggaacagaacgagcttcagtttgctgttcctgggggtctaataggagttgggacaacaatggacccaactcttactcgtgcagatcgattagttggtcaagtccttggtgagatcggttcacttcctgatgtctttgttgaactcgaggttaacttctttcttctacgacgtttgttgggagtgagaacaaagggatcagagaaacaagggaaggtgtcaaagctaacgaagggagagattctgatgctcaacattggttctatgtccactggagccaaagttgtgggagttaaagtcgatctggctaaactgcaactgacagcgccggtttgtaccagcaaaggagagaaagtggctctaagcaggcgtgtggaaaagcattggcgtttgattggttggggtcagattcaagctggaaccaccattgaagttcctccttcacctttctaagctgtgtgttattttttgtttctggaaaaaattatttaacccctcaaaaagataataaaactcttttttctcgtgtggggttttggagagtacctgatttgttgttt

SEQ ID NO: 2514 - DNA, 1745 bp, Arabidopsis thaliana
aaaccctttagggacttggatagaaaaaaaaaaaccattttgtgcatcttcttcaagctgcgccgctttctcactcttttttatctctcaaatttgaccttctccgttgttctttcgcatcgctcaggagcagaagcttcaatctttgataatgtcgaggaacaagggtttggctgagcaagatcttaaaaaattggatgtaactgtgctacatcctctgtctcctgaggtcatttctcgccaggccactattaatataggaaccattggtcatgtcgctcatggaaagtccactgttgttaaagctatttctggtgtccagactgtccgttttaaaaatgaattggagcgtaacattaccattaagcttggatatgcaaacgccaagatttacaaatgtgaggatgagaaatgccctagaccaatgtgctacaaggcctacggaagtggaaaggaagacactcccaattgtgatgtccccggatttgaaaactccaagatgaaactattgaggcatgtctcattcgttgattgcccgggtcacgatattctcatggcaacaatgcttaatggagcagccatcatggatggtgcactacttttaatcgctgcaaatgaaacttgtccacaaccacaaacgtctgaacatcttgctgccgttgagattatgcaacttaagcatatcatcatccttcagaacaagattgatcttattcaagagaatgttgccattaatcagcacgaggcaattcagaaatttataatgaacactgttgctgatgctgctccgatcgtccctgtctcagcacaactgaaatacaacattgatgtggtgtgcgagtacattgtcaagaagatcccaatccctgagaggaattttgtgtcacccccaaatatgatagtgattcggtcttttgatgtcaacaaacctggttatgaggttgatgagatcaaaggtggagttgcaggtggaagtatcctacggggtgttttgagagtcaaccaattaatcgaaatccgacctggtatcgttaccaaagacgagcgtggcaactcaaaatgcactccaatttactctcgcatcatttcactctacgcggaacagaacgagcttcagtttgctgttcctggaggtctaataggagttggaacaacaatggacccaactctcactcgtgcagatcgattagttggtcaagtccttggtgaaatcggttcacttcctgatgtatttgttgaactcgaggtgaacttctttcttctacgacgtttgttgggagtgagaacaaagggatcagagaaacaagggaaagtgtcaaagctaacgaaaggagagattctgatgctcaacattggttcgatgtccactggagccaaagttgtaggagttaaagtcgatctggctaaactgcaactgactgcgcctgtttgtaccagcaaaggagagaaagtggctctaagcagacgtgtggaaaagcattggcgtttgattggttggggtcagattcaagctggaaccaccatcgaagttcctccttcacctttctaagctatgtgttatttttgtcctttttgtttgtgtttctgaaaaaaagattgttaaacccctcaaaaagataataaaactctttttctcgttgggggattttggagagttcgtctttgcggattaaacatcttcaaacagtacctgatttgttattgttactagtttgctctttgttattgttactagtttgctcttt

SEQ ID NO: 2515 - DNA, 1584 bp, Artemisia annua
tggcgaagaaaggattgatggaacaggatttgagtaagttagatgtggccaagctccatccgttatcgcccgaagttatatcgcgtcaagcgactattaatatcggtactattggtcatgtggctcacgggaagtcgactgttgtcaaagctatttcgggcgtgcagactgttcggtttaaaaatgagttggagcgtaacattactatcaagcttgggtatgccaacgcgaagatctataagtgtgaagatgaaaagtgcccgagaccgatgtgttacaaggcctatggaagtggaaaagaagatagccctgcttgtgatgtgcctggatttgagaacagcaagatgaaattgatgaggcatgtatcatttgttgattgcccgggacacgatattctcatggctactatgcttaatggagctgctatcatggatggagcattacttctcatagctgcaaatgaaagttgtcctcaacctcaaacatcagagcacttggctgctgttgaaattatgcgcctccagcatatcataattcttcaaaacaaggttgatctcattcaggaaaatgtagccataaatcaacacgaggccattcagaaattcatccagggaactgtggctgatggtgcaccagtcattccagtgtctgctcagctgaagtataatattgatgttgtatgtgaatacatcataaagcgtattcccattccagaaagaaacttcatttcaccaccaaacatgattgtcatccgatcatttgatgttaataaacctggtgcagaggttgaggagattagaggtggtgttgctggaggaagtattctcaagggtgtgttgaaggtaaaccagaacatcgaggttcgtccaggaattgttgttaaagatgagagtggcaacatcaagtgcaccccaatttactccagaatagtttcactgtttgcggagcagaatgaactccagtttgctgtacctggaggtcttattggagttggaactacaatggaccctatgttgactcgtgctgatcggttggtgggtcaggttcttggggaggtcggatcacttcccgatgtttatgttgaactggaggtgaacttctttttgttgcgccggttgttgggtgtgaagacaaaaggaacagaacgacaagggaaagtgtcaaagctatcaaaggctgaaattcttatgctcaacataggatcaatgtctaccggagctcgtgttttggcagttaagaacgatttggcaaaactgcagctgacatcacccaaaggagagaagattgcactgagcaggagagtggagaagcattggaggttgattggttggggacagattcaagcaggattgacccttgagatcccaccgtgcccaatttagaccaagacatttgaattccagttttgcctgctgttgctttttaatacttgattctaaattgttatatctgttttagctttttggtagccattgtgattttacactatcaacttgtacttgcattgagcacaactccgcatggtgtttgaagaaaggatcataagacgtgcttttgtcttttttttgccgaaagacacgcgag

SEQ ID NO: 2516 - DNA, 1673 bp, Brassica oleracea
aaaaccttgagcaccaccatctcttgttatcttcgtcgtcgtcgtcttcttcgtcatcctcttacctgcgccgctttcttactcaggagaagaaaacctctcataatgtcgaggaacaagggcttggcggagcaagatcttagtaaattggatgtgactgtgcttcatcctttgtcccctgaggtcatctctcgccaggctactatcaacattggaaccattgggcatgtcgctcacggcaagtccactgttgtgaaagctatttctggtgtccagactgttcgttttaagaatgagttggagcgtaatatcactattaagcttggatatgcgaatgctaagatttacaaatgcgaggatgagaaatgccctagacctatgtgttacaaggcttatggaagtggaaaggaagacaccccgaattgtgatgtccctggatttgagaacgccaagatgaaactgttgaggcatgtgtcgtttgttgattgcccgggacacgatattctcatggcgactatgcttaacggagcagccatcatggatggtgcactgcttctcatcgctgcaaacgaaacttgtccgcaaccacagacgtccgaacatcttgctgctgttgaaatcatgcaactcaagcatatcatcatccttcagaacaagattgatcttatccaagagaacgttgccatcaaccagcacgaggccattcagaaatttataatgaacactgtcgcagatggtgccccaatcgtcccagtgtctgcacaactgaaatacaacatcgatgttgtgtgcgagtacattgtcaagaagatcccaatccctaagaggaacttcgtgtccccaccaaatatgatagtgattcggtcttttgatgtcaacaaacctggttttgaggttgatgatattaaaggtggagttgcgggtggaagtatcctccggggtgttttgaaagtgaaccaattgattgagatccgacctggaattgttgtgaaagacgagcgtggcaacccaaaatgcactccaatttactcccgcatcatttcactctacgcggaacagaacgagcttcagtttgctgttcctggaggtctaattggagttggaacaacaatggacccaactcttactcgtgctgatcgtttggttggtcaagtccttggtgaaatcggttcccttcctgatgtctttgttgaactcgaggtgaacttctttcttctacggcgtctgttgggagtgagaacaaagggatcagagaagcaagggaaagtgtcaaagctaacaaagggagagattctgatgctcaacatcggttccatgtcgactggagccaaagttgttggagttaagaacgatctggctaagttgcagctgaccgcgccggtgtgcacgagcaaaggagagaaagtggctctgagtaggcgtgtggagaagcattggcgtttgataggttggggtcagattcaagctggaaccaccattgaagtgcctccttcacctttctgaggtgtgttgtcttaattttcatgttggtttttttttggagagtacctatctgcggatatacatttgttactagttttactcttgttttgtgcttttctttcttagatgtttattgcatttttgtctcattttcattaacttctctgtttaattatactctgggaatttca

SEQ ID NO: 2517 - DNA, 1697 bp, Brassica napus
ggagcaccaccatctcttgttatcttcgtcgtcgtcgtcttcttcgtcatcctcttacctgcgccgctttcttactcaggagaagaaaacctctcataatgtcgaggaacaagggcttggctgagcaagatcttagtaaattggatgtgactgtgcttcatcctttgtcccctgaggtcatctctcgccaggctactatcaacattggaactattgggcatgtggctcacgggaagtccactgttgtgaaagctatttctggtgtccagactgttcgttttaagaatgagttggagcgtaatatcactattaagcttggatatgcgaatgctaagatttacaaatgcgaggatgagaaatgccctagacctatgtgctacaaggcgtatggaagtggaaaggaagacaccccgaattgcgatgtccctggatttgagaacgccaagatgaaattgttgaggcatgtgtcgtttgttgattgcccgggacacgatattctcatggcgactatgcttaacggagcagctatcatggatggtgcgctgcttctcatcgctgcaaacgaaacttgtccgcaaccacagacgtccgaacatcttgctgccgttgaaatcatgcaactcaagcatatcatcatccttcagaacaagattgatcttatccaagagaacgttgccatcaaccagcacgaggccattcagaaatttataatgaacacagtcgcagatggtgccccaatcgtcccagtgtcagcacaactgaaatacaacatcgatgttgtgtgcgagtacattgtcaagaagatcccaatccctaagaggaacttcgtgtccccaccaaatatgatagtgattcggtcttttgatgtcaacaaacctggttttgaggttgatgatattaaaggtggagttgcgggtggaagtatcctccggggtgttttgaaagtgaaccaattgattgagatccgacctggaattgttgtgaaagacgagcgtggcaacccaaaatgcactccaatctactcccgcatcatttcactctacgcggaacagaacgagcttcagtttgctgttcctggaggtctaattggagttggaacaacaatggacccaactcttactcgtgctgatcgtttggttggtcaagtccttggtgaaatcggttcccttcctgatgtctttgttgaactcgaggtgaacttctttcttctacggcgtctgttgggagtgagaacaaagggatcagagaagcaagggaaagtgtcaaagctaacaaagggagagattctgatgctcaacatcggttccatgtcgactggagccaaagttgtgggagttaagaacgatctggctaagttgcaacttaccgctcctgtatgcacgagcaaaggagagaaagtggcactgagtaggcgtgtggagaagcattggcgtttgattggttggggtcagattcaagctggaaccaccattgaagtgcctccttcacctttctgaggtgtgttgtcttaattttcatgttggtttttttttggagagtacctatctgcggatatacatttgttactagttttactcttgttttgtgcttttctttcttagatgtttattgcatttttgtctcattttcattaacttctctgtttaattatactctgggaatttcagtatggccggtgaagtttacagaaacgagtt

SEQ ID NO: 2518 - DNA, 1607 bp, Cirsium arvense
taccatatcatcgactactcgaacgccgcttcctaatagctcacaactgtgcctgctcgtacggctctctcaccggaatccacttacgatcaccaatccagaatcggagaatctcattctccttcccgacggcgtgttggttctcacggtgacggcttcacaactctcagttgggtgttcacttagcgtttctacaatttgtgaggttgaatagtgcaaagtctttcaagaacagcaaaaatgtctcgaaaaggtctaatggagcaggatttgagcaagctggatgtggcacaactacatccactctccccagaggtcatatctcgccaggctacaattaatattggtactattggtcatgtggctcatggcaagtcaacagttgtaaaagcaatttctggtgtgcagactgttcgttttaaaaatgagctggaacgtaacattactattaagcttgggtatgcaaatgcaaagatctacaaatgtgaagatgagcgatgccctcgacctatgtgttacaaggcttatggaagtggcaaagaagacagcccactctgcgatgtgcctggatttgagaacagcaagatgacattgatgaggcatgtatcctttgttgattgcccgggacacgatattctcatggctactatgcttaatggagctgcaattatggatggagcgttacttctgatagctgcaaatgaaagttgtccccaacctcagacttctgaacacttggctgctgttgaaattatgcgtctccagcatattataattcttcagaataaggttgatctaattcaggaaaatgtagcaattaaccaacatgaggctattcagaaattcatccagggaactgttgctgatggtgcaccagtcatcccagtgtctgctcagcttaagtataatattgatgttgtgtgcgaatacataataaagcgcattcccattccagagaggaacttcatttcacctcctaatatgatagtaattcggtcatttgatgtgaataagcccggatctgaggttgatgagatcagaggaggtgttgctggtggaagtatcctcaagggagtgttgaaggtaaaccagaacattgaggtccgtcctgggattgtggtcaaagacgaaagtggcaacattaaatgcaccccaatatactctagaatagtttcgttatatgctgagcaaaatgaacttcaatttgctgtgcccggaggacttattggagtcggaacaacaatggaccctatgttgactcgtgctgatcggcttgtaggacaggttcttggggaagtcgggtctcttcccgatgtttatgttgaactcgaggtgaacttctttcttttgcgtcggctgttgggtgttaagacaaaaggaaccgagaggcaagggaaggtttcaaagttagcaaagggtgaaatactgatgctgaatataggatctatgtcgacaggggctcgtgttttggcggttaagaacgatttagcaaaactgcagctgacttcaccggtctgtacaagcaaaggtgagaagattgcattaagcaggagagtggagaagcattggcgtctgattggttggggacagattcaagcaggtctgac

SEQ ID NO: 2519 - DNA, 1686 bp, Trifolium pratense
gatagtttagcattaaacagtgttgggtcataacttcattccatcactcaattgaagtttccattggaagcagccaaaatgtcgcggaagggtttgatggaacaagacttgagtaaattggatgtgacaaaattgcatccactttctctagaagtcatatctcggcaggctactattaatattggcaccatcggtcatgtggcacacggcaaatcaacagttgtgaaagcaatatcgggtgttcagaccgtgcgtttcaaaaatgagttggagcgtaacattacaatcaagctcggttatgcaaacgcaaaaatatacaagtgtgaagatgaacgatgcccgaggcctatgtcctacaaggcttatggaagtggaaaagaagataatcctatgtgtgatgtgccagggtttgaaaacagcaagatgaaattgctgagacatgtttcttttgtcgattgcccaggtcatgatattctcatggctacaatgcttaatggagcagcaatcatggatggagctttgctactcatagctgctaatgaaagctgtccacaaccacaaacctctgagcatttagctgctgtggaaattatgcgtcttcagcacatcataatccttcagaacaaggttgatctaattcaagagaatgtggctatcaatcagcatgaagcaattcagaagtttatagaaggaacggttgctgatggtgcaccagtcgtacctatttcagcccagttgaagtataatattgatgttgtgtgcgagtatatcgtgaaaaagatcccaatccccgaaaggaactttatttctccacctaatatgatagtaatccggtcctttgatgtcaataaacctggttttgaggttgatgaaataaaaggaggtgtagctggtggaagcattctgaggggtgttttgaaggtcaaccaattcattgaagttcgacctggaatagttattaaagacgagagtggaaatatccgatgcacacccatctactccagaatagtttcattatttgctgaacaaaacgagcttcaatttgcagttcctggaggtttaattggtgttggaacaacaatggatcccactctaacacgtgctgacaggttggtagggcaagttctcggagaggttggatcactgcccgaggttttcgttgagcttgaggtaaactttttcttgcttcgacggctacttggtgtccgaacaaaaggatccgagagacagggaaaagtatctaagctggtcaaagctgaaatgctaatgttgaacataggatcaatgtcaacaggggcgagagtaattgctgtgaggaacgacttggcaaaattgcaacttacgtctcctgtgtgcactagcaaaggtgagaagattgcactcagtcgacgtgttgagaagcattggcgtcttattgggtggggtcaaatccaagctggaatcactctccaagtccctcctacacccatcttgagttgaagacagacacgaaagagaagagacagtacaagaaagcgccttttttaaaaaacgtgagatgaatttagatatgtgggaaggtagacaatttttgggaaccatttttgtgagatggagaagaaaacatttgcattgtcaatttttgtttttgcattgtgatttgtttcttgttttctttactgtcaacatatttttgaagttgtatct

SEQ ID NO: 2520 - DNA, 2011 bp, Trifolium pratense
ctctacaaacgactgacagtatagcattactcgtctatcactattcagttcactaccaccacctgcttgcttacacctccgctcactcgcaccttccttcagatagtttagcatcaaacggtgtcgggtcataacttcattccgtcacgcaattgaagttttcattggaagcagccaaaatgtcgcggaagggtttgatggaacaagacttgagtaaattggatgtggcaaaattgcatccactttctcccgaagtcatatctcggcaagctactattaatattggcaccattggtcatgtggcacacggcaaatcaacagttgtgaaagcaatatcgggtgttcagaccgtgcgtttcaaaaatgagttggagcgtaacattacaatcaagctcggttatgcaaatgcaaaaatatacaagtgtgaagatgaacgatgtccaaggcctatgtcctacaaggcttatggaagtggaaaggaagataatcctatgtgtgaggtgccagggtttgaaaactgcaagatgaaattgctgagacacgtttcttttgtcgattgcccaggtcatgatattctcatggctactatgcttaatggagcagcaatcatggatggagctttgctactcatagctgctaatgaaagctgtccacaaccacaaacctctgagcatttagctgctgtggaaattatgcgtcttcagcacatcataatccttcagaacaaggttgatctaattcaagagaatgtggctatcaatcagcatgaagcaattcagaagtttatagaaggaacggttgctgatggtgcaccagtcgtacctatttcagcacaattgaagtataatattgatgttgtgtgcgagtatatcgtgaaaaagatcccaatccctgaaaggaactttatttctccacctaatatgatagtaattcggtcctttgatgttaataaacctggttttgaggttgatgaaataaaaggaggtgtagctggtggaagcattctgaggggtgttttgaaggtcaaccaattcattgaagttcgacctgggatagttgttaaagacgagagcggaaatattaaatgcacacctatatactctagaatagtttcattgtttgctgaacaaaatgagcttcaatttgctgtgcctggaggcctaattggtgttggaacaacaatggatcccactttgacgcgtgctgacaggttggtagggcaagttctcggagaggttggatcactgcccgaggtttacgttgagcttgaggtaaactttttcttgcttcggcggctacttggtgtccggacaaaaggatccgagagacagggaaaggtatctaagctggtcaaagcagaaatgctaatgttgaacataggatcaatgtcaacaggggcgagagtaattgctgtgaggaatgacttggcaaaattgcaacttacatctcctgtgtgcactagtagaggtgagaagattgcactcagtcgacgtgttgagaagcattggcgtcttattgggtggggtcaaatccaagctggaatcactctcgaagtccctactgcacccatcttgagttgaagacagacacggaagagaagagacagtacaagaaagcgccttttttaaaaaacgtgagagatgaatttagatatgtgggaaggtagacaatttttgggaaccatttttgtgagatggagaagaaaacatttggattgtcaatttttgttttagcaatgtgatttgtttcttgttttctttactgtcaacatatttttgaagttgtatctaatgttgattgtgtttagactgagagcaagtgtgttcactgttaagcaagcactttttcattccagggtaccctaccattattagggtatctttgtattggtggtatagggtgaaaatgatagtgaatatcatctatttgaaatataacaagacttttcaatatcactctaaaccatttcactatataccaccaatctaaatatatacagcattattagttt

SEQ ID NO: 2521 - DNA, 2042 bp, Pinus pinaster
atggtcacaaacctcatcacacaggagagaaagtcctctttgtgctttgggtgtgttttgcaataggtttctcgtctctcgttggcacccgctgctgcacctacatagccaatccaatccaatcggggcagaaaaaatcagagcagaaagcggagcaagaggaagaagtgaaggtgcccatataccttctgatcaactttgaataccgagctctgatccgtgcagacagatccgcagtccccatattctccgcacctaaattcattttgtaagggcttatcatccaccaagtgccaaaaatgtcgaaaaaagggttaatggagcaggacctgaacaagctggatgttaccaagttgcaccctctctctccagaggtcatttctcgtcaggctacaataaacataggtactattgggcatgtggcacatgggaaatcaacagttgttaaagcaatatctggtgtccagacagttcgtttcaagaatgaactagagagaaacatcactattaagctgggatatgctaatgcaaaaatatataaatgtgaagatgatcgctgccctcgaccgatggcctacaaggcatatggaagtgggaaggaagatagtcctttgtgtgatgtcgctggatttgaaaccactcgtatgaagcttttaagacatgtttcttttgttgattgtccgggtcatgatattctcatggctactatgctcaatggtgcggctatcatggatggggcactgcttttgattgctggaaatgagagctgtcctcaacctcaaacttcagagcatcttgcagcggtggagatcatgcgtcttaagcatataattattttacaaaacaaaattgaccttatccaggagagtgtagccatgaaccagcatgaggcaattcagaagtttattcagggtaccattgcggatggagcacctgttgtaccgatctctgcacaactgaaatacaacattgatgttgtctgtgaatacatagtaaacaagattcccattccagagcggaattttgttgatccacccaatatgatcgtaatcagatcttttgatgtgaataagcctggtgctgaagtggatgaaataaaaggaggtgtcgctggtggaagtatactgaagggtgtgttgaaagtgaatcaaaaaattgaagttcgccctggcattgttgtcaaagatgaaagtggtagcatcaagtgtacacctatcttttcaagaataatttcactttatgctgagcaaaatgagttgcagtttgctgttcctggaggccttattggtgtgggtacaacaatagaccccacactgacacgtgctgacaggcttgtggggcaagtccttggagaagttggagcgctacccgatgtatttgttgagcttgaggttaactttttcctcctccgccgacttctcggagttaggacaaaaggaacagagaaacaggggaaagtttcaaagctggctaagggagaagttctgatgcttaatattggttcaatgtccactggagctcgggtgcttgctgtgaagaatgacctggccaagctccaacttacttctccagtgtgcacaagtaaaggtgaaaagatggcacttagcaggcgagtagaaaagcattggcgattgataggatggggtcaaattcaagctggagcaatgctggacatacccccggcatctgaataagatagtgcacacacaaaacccaattatacttgagaaaataaaaagggtacttgagaaaagggacaatgtggatagggagagagttattaggaacaatttttgttaggtcgagaagaaaacctttcaaggtattgtgttctaaagggaacagctagctcatatatttattctgatcttgatttttttattcagtatttagcatttgttttagaatgagctcagttacagaacccgtatttccaggttactgaatttcactacagctattgcttatgttgtaatagagtccagacccattgaagaatgaccattgttttcaaattcagttgtaattatgatttttgttaa

SEQ ID NO: 2522 - DNA, 1869 bp, Nicotiana benthamiana
gaaccctctctctcagctgccaactcaagctttctccttctcggacggctgatattagcttttattgacgtggggtgctttttatcgcttttcgcccttgacaacactggtcgtcggtggtggagattggtctttgatcagcaatgttccatttctttgggaggcgttgaaacttgctactgaagtattcaacagcagccaaaaatgtctcggaaaggattgatggagcaggacctaagcaaattggatgtgacaaagttacatccactttcacctgaagttatttctcgtcaggctactataaatattggtactattggccatgtggctcacgggaagtcaacagttgtaaaagctatatctggtgtgcagactgttcgttttaaaaatgagctagaacgtaatattacaattaagcttggatatgcaaatgctaagatatacaaatgtgaagaagagcgctgtcctagacccatgtgctacaaggcatatggtagtggaaaagaagacagtcccatgtgtgatgtcgctggttttgagaactgcaggatgaaattactgaggcatgtatcttttgttgattgcccaggtcatgatattctcatggctacgatgcttaatggagctgcaattatggatggagccttacttctgattgctgccaatgagagctgtccccaacctcaaacttctgaacatctagcagctgttgaaattatgcgcctccaacatatcataattcttcaaaataaggttgatctagtccaggaaaatgttgccatcaaccagcacgaggcaattcagaaatttattcaaggtactgttgcagatgctgccccagttgtaccaatatctgcacaattgaagtacaacattgatgtcgttgctgaatatattgtgaaaaaaattcccattcccgaaaggaatttcatttcaccaccaaatatgattgttatccggtcatttgatgtcaataaacctggttttgaagttgatgatatcagaggtggtgttgctggtggcagtattttgaagggtgtattgaaggtaaatcaacttattgaggttcgccctggaattgttgtcaaagatgagagtggaaacatcaaatgtactccaatatattcaagaatagtatcattgtttgccgagcaaaatgaactacaatttgccgtgcctggaggactcattggagttggaacaagtatggatccaacattgacacgtgctgatcgattggtgggacaggttcttggagaggttgggtcacttcctgaagttttcgtcgaactagaggtgaatttctttttgctccgacgtcttttgggtgtgaggacaaaggactcggagaggcaaggtaaagtctcaaagttggcaaagggagaaatcctcatgttaaatatagggtctatgtcaacaggggctcgtgttgtcgctgtcaagaatgttttcgcgaaactgcaattaacatcccctgtgtgcaccagcaaaggtgagaaaattgctcttagccggagaattgagaagcactggcgacttattggttggggtcaaatccaagctggtattactattgatattcctccctgccccatctgagtaaattttacacgactagttactgaacagctggaaaaactgttaaaacaacgcaaaaaattggatttagatgtaggaaggcgagtaattgcgggtaactattttttccaggtagagtagaaaaggttatttgaaattccagatattctatagtcatacatttaattttccacttttgtttctttgtccaagtggttgaatcttgtatttcattagtttaagtgtttactagaatgagttccattcatcttgcggcagatttacgaacca

SEQ ID NO: 2523 - DNA, 1929 bp, Pinus taeda
ccacaccattctgcgggaaaacgcatgtagatggtggaggaagaggaagaagtggaggtgaatcagttttgaagataccagaaaaataatattgtactcttactacaaggtcttgtaagggcttgtcaagtggcaacaatgtcgcgaaaagggttgatggagcaggacctgagtaagctggatgttaccaagttgcatccactttctccagaggtcatttctcgtcaagctacaataaacattggtacaattggacacgtggcacatggtaaatcaacagtggttaaagcaatatctggggtccagacagttcgtttcaagaatgaactggagcgtaacatcactattaaactgggatatgccaatgcaaaaatatataaatgtgaagatgagcgctgtcctcgaccaatgtgttacaaggcatatggaagtggcaaggaagacagtcctctgtgtgatgttgctggttttgagaacactcgcatgaaacttttgagacatgtgtcatttgttgattgtccgggtcatgatattctcatggctactatgctcaatggtgcggctatcatggatggggcgctgcttttgattgctggcaatgagagctgtcctcaacctcaaacttcagagcatctggctgctgtggaaatcatgcgtcttaaacatataattattttgcaaaacaaaattgatcttatccaggagagtgtagctatcaaccagcatgaggcaattcagaagtttattcagggtactatcgctgatggagcacctgtagtcccaatatctgcacaactgaaatacaatatcgatgttgtctgcgaatacataacaaacaagattcccattccagagcgtaattttgttgatccacccaatatgatcgttatcagatcttttgatgtaaataagcctggtgctgaagttgatgacataaaaggaggtgttgcaggtggaagtatactgaagggcgttttgaaggtaaatcaaaaaattgaagttcgtccaggcatcgttgtcaaagacgagggtggcaacatcaagtgtacgcccatcttttcaagaataatttcactttatgctgagcaaaacgagttgcagtttgctgttcctggcggccttattggtgtgggtaccacaatagatcccatgctgacacgtgctgacaggcttgtggggcaagtccttggagaagttggcgagctaccagatgtgtttgttgaacttgaggttaattttttcctacttcgtcgcctcctgggtgttaggacaaagggtacagaaaaacagggaaaagtttcaaaactggctaagggagaagttctgatgcttaatattggttcaatgtccactggagctcgggtgcttgctgtgaagaatgacctggccaagctccaacttacttctccagtgtgcacaagtaaaggtgaaaagatggcacttagcaggcgagtagaaaagcattggcgattgataggatggggtcaaattcaagctggagcaatgctggacatacccccggcatctgaataagatagtgcacaagacaaaacccaattatacttgagaaaataaaaagggtacttgagaaaagggacaatgtggatagggagagagttattaggaacaatttttgttaggtggagaagaaaacctttcaaggtattgtgttctaaagggaagagctagctcatatatttgttctcatcttgatttttttattcagtatttagcatttgttttagaatgagctcagttacagaacccgtatttccaggttactgaatttcactacagcaattgcttatgttgtaatagagtccagacccattgacgaatgaccattgttttcaaattcagttgtaattgtgatttttgttaaatacaagtttattaattgattgtccattaggttctcaaaaaaaaaaa

SEQ ID NO: 2524 - DNA, 1999 bp, Picea glauca
ggaatcctttgtgtgtctttgttggccataggttttagcgtttcttgggcatttgttgcttcacctatatttctattctccatcccattctgtggaaaaacagaagtagatggtggaggaagaggaagaagtggaggtagatcagtcttgaagagatcagcaaacttatattgttctcttactacaagattttgtgaggccttatcaagtggcaattatgtcgcgaaaagggttgatggagcaggacctgagtaagctggatgttaccaagttgaatccactttctccagaggtcatttctcgtcaggctacaataaacattggtacaattgggcatgtggcacatggtaaatcaacagtggttaaagcaatatctggggtccagacagttcgtttcaagaatgaactggagcggaacatcactattaaactgggatatgccaatgcaaaaatatataaatgtgaagatgagcactgtcctcgaccaatgtgttacaaggcatatggaagtggtaaggaagacagtcctctgtgtgaggtttctggatttgagaacactcgcatgaagcttttaagacatgtgtcatttgttgattgtccgggtcatgatattctcatggctactatgctcaatggtgcggctatcatggatggggcgcttcttttgattgctggcaatgagagctgtcctcaacctcaaacttctgagcatcttgctgctgtggaaatcatgcgtcttaaacatataattattttacaaaacaaaattgatcttatccaggagagtgtagctatcaaccagcacgaggcaattcagaagtttatccagggtaccattgctgatggagcacctgtagtaccaatttctgcacaattgaaatacaacattgatgttgtctgtgaatacataacaaacaagattcccattccagagcgtaattttgttgatccacccaatatgattgtaatcagatcttttgatgtaaataagcccggtgctgaagttgatgaaataaaaggaggtgttgcaggtggaagtatactgaagggtgtgttgaaggtgaatcaaaaaattgaagttcgtcctggcattgttgtcaaagatgagagtggcaacatcaagtgtacacccatcttttcaagaataatttcgctttatgccgagcaaaacgagttgcagtttgctgttcctggaggccttattggtgtgggtaccacaatagatcccacactgacacgtgctgacaggcttgtggggcaagtccttggagaaattggagagctaccagatgtgtttgttgaacttgaggttaattttttcctcctccgtcgcctcctgggagtcagaacaaagggtacagaaaaacagggaaaagtttcaaagctggccaagggagaagttttgatgcttaatattggttcaatgtcaactggagctcgggtgcttgctgtgaagaatgacctggccaagctccaacttacttctccagtgtgcacaagtaaaggtgaaaagatggcactcagcaggcgagtagaaaagcattggcgattgataggatggggtcaaattcaagctggagcaatgctggacatacccccagcatccgaataagatagtgcacagacaaaaccgaattataattgagaaaagaaaaagggtacttgagcaaaggaagaatgtggatagggagagagttactaggaacaatttttgttcggtggagaagaaaacctatcaaggttttgtgttttaaattgaacgcctagcttatatatttattctcatcttctttattttttcattcagtgtctagcatttgttttagaatgagctcatttacagaatccgtgtttccaggtagttgaatttcactacagctattgctcatgttgtaatagagtccggaacccattgaccaatgaccattgtttttgaattcagttgtaattgtgatttttgttaaatacaagttcattaattaattgtccattaggttta

SEQ ID NO: 2525 - DNA, 1860 bp, Picea glauca
gcgtttcttgggcatttgttgcttcacctatatttctattctccatcccattctgtggaaaaacagaagtagatggtggaggaagaggaagaagtggaggtggatcagttttgaagagatcagcaaacttatattgttctcttactacaagattttgtgaggccttatcaagtggcaattatgtcgcgaaaagggttgatggagcaggacctgagtaagctggatgttaccaagttgaatccactttctccagaggtcatttctcgtcaggctacaataaacattggtacaattgggcatgtggcacatggtaaatcaacagtggttaaagcaatatctggggtccagacagttcgtttcaagaatgaactggagcggaacatcactattaaactgggatatgccaatgcaaaaatatataaatgtgaagatgagcactgtcctcgaccaatgtgttacaaggcatatggaagtggtaaggaagacagtcctctgtgtgaggtttctggatttgagaacactcgcatgaagcttttaagacatgtgtcatttgttgattgtccgggtcatgatattctcatggctactatgctcaatggtgcggctatcatggatggggcgcttcttttgattgctggcaatgagagctgtcctcaacctcaaacttctgagcatcttgctgctgtggaaatcatgcgtcttaaacatataattattttacaaaacaaaattgatcttatccaggagagtgtagctatcaaccagcacgaggcaattcagaagtttatccagggtaccattgctgatggagcacctgtagtaccaatatctgcacaattgaaatacaacattgatgttgtctgtgaatacataacaaacaagattcccattccagagcgtaattttgttgatccacccaatatgattgtaatcagatcttttgatgtaaataagcccggtgctgaagttgatgaaataaaaggaggtgttgcgggtggaagtatactgaagggtgtgttgaaggtgaatcaaaaaattgaagttcgtcctggcattgttgtcaaagatgagagtggcaacatcaagtgtacacccatcttttcaagaataatttcgctttatgccgagcaaaacgagttgcagtttgctgttcctggaggccttattggtgtgggtaccacaatagatcccacactgacacgtgctgacaggcttgtggggcaagtccttggagaaattggagagctaccagatgtgtttgttgagcttgaggttaactttttcctcctgcgtcgacttctgggagttaggacaaaggggacagaaaaacaggggaaggtttccaagctggccaagggagaagttttgatgcttaatattggttcaatgtccactggagctcgggtgcttgctgtgaaaaatgatcttgcaaagctccaacttacttctccagtctgcacaagtaaaggagaaaagatggcacttagtaggcgagtggaaaagcattggcgattgataggatggggtcaaattcaagctggagcaatgctggaaattccccaagggtccatataagatggtgaataaacaaagcaaattatatttgagaaaagaaaaagggtatttcagtaaaggaagaatgtggatagggagagaattactaggaacaatttttgttaggtggagaagaaaacctattgggctgatctttttttggtgttttggttgttgtaaaatcatttttatgaaaattgaacacctagattatatatttatcctcatcttattttttacataactttttagtattggttttagactgagctcatttacagaacattataattttcaggtttttag

SEQ ID NO: 2526 - DNA, 1609 bp, Eutrema halophilum
ttgaagcaggaggaagaagcttcaaatctgtcataatgtctcggagcaagggtttggctgagcaagaccttaagaaattagatgtaactgtgcttcatcctttgtctcctgaggtcatttctcgtcaggcaactattaatataggaaccattgggcatgtcgctcacggaaagtcgactgttgtgaaagctatttctggtgtgcagactgtccgttttaagaatgaattagagcgtaacatcaccattaagcttggatatgcaaatgcgaagatttacaaatgcgaggatgagaaatgccctagaccaatgtgctacaaggcatatggaagtggtaaggaagacaacccaaattgtgatgtacctggatttgagaactccaagatgaaactattaaggcatgtgtcattcgtggattgcccgggacacgatattctcatggcgacaatgcttaacggagcagccatcatggatggtgcacttcttttaatcgctgcaaatgagacctgtccgcaaccacaaacgtctgaacatcttgctgctgttgagattatgcaacttaagcatatcattatcctccagaacaagattgaccttattcaagaaaacgttgccatcaatcagcacgaggcaattcagaaattcataatgaacactgtggctgatggtgctcctatcgtacccgtttcagcacaactgaaatataacatcgatgttgtatgcgagtatattgtcaagaagatcccaatccctaagaggaattttgtgtcaccaccaaatatgatagtgattcggtcttttgatgtcaacaaacctgggtttgaggttgatgagattaaaggtggagttgcaggtggaagtattcttcggggtgttttgaaagtgaaccaattaattgaaatccgacctggtattgttgtcaaagacgagcgtggcaacccaaaatgcactccaatctactcgcgcataatttcactctatgcggaacagaacgagcttcagtttgctgttcctggaggtctaattggagttggaacaacaatggatccaactcttactcgtgcggatcgattagttggtcaagtccttggggaaatcggttctctccctgatgtatttgttgaactcgaggtgaacttttttcttctacggcgtctgttgggagtgagaacaaagggatcagagaaacaagggaaagtgtcaaagctaacaaagggagagattctgatgctcaacatcggttccatgtccactggagccaaagttgttggagttaagaacgatctggctaagttgcaactaaccgctccggtttgcaccagcaaaggagagaaagtggctctaagccggcgtgtggaaaagcattggcgtttgattggttggggtcagattcaagctggaaccaccactgaagttcctccttcaccgttctgagaggcgatgtcttttttttttagttttttttttctggtttctggaaaattttatcaacccctcaaaagataataaaactcttctatttcactgtgggggtttttggagagttcctatttgcctgataaatttgttactagcttactcttgtttgtgtttattaatttttttgtctc

SEQ ID NO: 2527 - DNA, 1698 bp, Vinca minor
aacccaaatctttcctttcccacattcccaatatttcagtccccagctctttctctcagagtctcgcttaccccgcaagaaacacgaatctctcctctcccagggttgtaagaatccttctgacatagaaccactttcctcaccgaattttacatttcataccttaacaaccaaaatgtctcgaaaagggttgatggagcaggatttaagcaagctggatgtgacacaactgcatccacttacacctgaagttatttctcgtcaggccacaattaacattggcacaattggccacgtggcacatgggaagtccactgttgtcaaagccatctctggtgttcagactgttcgtttcaagaatgagttggaacgtaatattacgataaagcttggttacgccaatgcaaagatatacaaatgtgaggatgaaaaatccccccgacccgcgtgctataaggcttatggaagtggaaaagaagatagtccactatgtgatgtacctggttttgagaactcccggatgaaattgttgagacatgtttcttttgttgattgtcctgggcatgatattctcatggctacaatgcttaatggagctgcaattatggatggagctttacttcttatagctgccaatgaaagttgcccgcaacctcaaacatctgaacatttagctgctgttgagattatgcgtctccaacatattataattcttcaaaacaaggttgatctagttcaggaaaatgtagcaatcaaccaaaatgaagccattcagaattttataaagggaaccgttgcagatggtgcaccagtcgtacctatttctgcacagctgaagtataacattgatgtcgtttgtgaatatattgtgaaaaagattcctatcccagaaaggaacttcatttcaccgccaaatatgattgttatccggtcttttgacgtcaataagccaggatttgagattgatgatattagaggtggtgttgctggtggaagcatactcaagggtgtttttaaagtaaatcagtacattgaggttcgccctggcattgttgtcaaggatgagaaaggcaacatcaaatgcactccaatatattctaggatagtatctttgtatgccgagcaaaatgaactacaatttgcagttccagggggtcttattggagttggtaccacgatggaccccacactcactcgtgctgatcggttggttggacaagttcttggcgaggttggatcattgcctgaagtttttgttgaattagaggtgaacttctttctactaaggcgacttcttggtgtgaggacaaaagaaaccgagaagcagggtaaagtctcaaagctagcaaagggagagatcctaatgttgaacataggatctatgtcaacaggagcccgtgttgttgcagtcaagaacgtgtttgcaaaactgcaactcacctcccctgtatgcaccagcaaggacgagaaaatcgctctcagcagaaggattgagaagcactggcgtctcatcggttgggggcaaatccaagctggtgttactcttgatgtcccaccctgccctatctaaaacaaatttgcttgaaagaggagattaaagagagaagaaagtaaagacttagagatattattagatgtgggaagggagaaaattgctgggaacaatttttgtaaggtggagaagaaaacaatgtttgt

SEQ ID NO: 2528 - DNA, 3376 bp, Rosmarinus officinalis
cttctttttcacgctacttctcttccttttcaatcatcttctctgtcaacacacacgaaatctgtacagagtagatctaagaagatatagcaaacgctgctaacaagctgcgattcagcaaatctgaggtttgcattttcatattgagtgaaccaatttactaagagctgccaaaatgtcgaggaagggcttgatggagcaggatttaactaagctggatttaacaaaattaaatccactatcgcctgaggttatttctcgccaggccaccatcaacattggcaccattgggcatgtggctcatgggaagtcaacagttgtgaaggccatctctggtgtccagactgttcgcttcaaaaatgaactggaacgtaatattactatcaagcttgggtatgccaatgccaagatatataagtgtgaagaggatcgatgccctcggcctatgtgttacaaggcatatggaagtgggaaagaagatagtccaatgtgtgatgtccctgggtttgagaactgtaggatgaaattgcttagacatgtatctttcgttgattgtccgggtcatgacattctcatggcgacaatgcttaatggagcagcaattatggatggagctttacttctaatagctgcgaatgagagttgtcctcaacctcagacatcagaacatttagctgctgtggaaatcatgcgtctccaacatatcataatacttcaaaataaagttgatcttgttcaggaaaatgtcgccatcaaccagcatgaagccattcagaggtttattcagggaactgttgcagatggtgcgccggtggttccaatttctgcgcagctgaaatataacattgatgttgtatgtgaatatattgtgaaaaaatcccaataccagagaggaacttcacatcgccaccaaatatgattgtgatcaggtcttttgatgtcaacaagcctgggtctgaagttgatgaaattaaaggtggcgttgctggtgggagtattcttaagggtgttttgaaagtaaatcagtatattgaggtccgtcctggtattgttgtcaaagacgagaatgataacatcaagtgtacaccaatatactccagaatagtatccttgtatgctgagcagaatgaattgcaatttgctgtgcctggaggacttattggagttggaacaacaatggaccccacacttactcgtgctgataggttggtgggccaggttcttggagaagttggttctctacctgaagtctatgttgaactagaggttaacttctttttgctgagacggctgcttggtgttaggacaaaggacacagaaaggcagggtaaggtcacaaagctgaccaagggagagatgctaatgttgaacataggatctatgtcaactggagctcgtgttgttgctgtcaagaacgtgtttgcaaaactgcagctaacttctcctgtctgcaccagtaaaggagaaaaaattgctttgagtagaagaattgataggcactggcgtctgattggctggggacaaattcaagccggtatcactcttgatgttccaccctgccccatctaagtgagttgctgcatttacatatcaactgaagttaagaatcactagaaagcaaggaagtgagatgtgggaaggccgacaattgctgggaacaatttttgttcgttggaggagaaaagattgtctagagttttggatacttctattattgtttgtgacgcatttttatcctttccttttggagttcatatattgttgtctcatctgtttttcatgcattttagatgttgagttactaagcagatcccattcaacgcggcgagttatttcatcttattatcggttacatgagctcagtcctgctattagagatggctggacgaaaaatcctagggaactggcaaattaattttgttccatcgtgaatcttttgacattattccgagaacatgggatttcagactgttttacaccaatgtataccattagcttcgatgtagcttagtttatactagattgaataatatgaagagttcctctctacataaagtaattcttgacataagctcgtacaagataatcatacatttacaaaccagtcaggtgtgacaacaatgttaaaatcttggatggctgcaaatggtgagaatcttcccaatctcctaaataaaatgtcgagttgtctcctctcggtaggtcgttccatatcaccaactatctaccaaatctctggactctccgctgtcgtaattcctcaagcgaaatggactcactgtcactgtagtaactagttggcgtgggtgcgaatccatctccatcaccattgcgttctgttccacacatctcgcaaacatttaacaagcccgagttggagttctcgtacgtacatgctccacaactccatacacccccgctcccaccaagagttcctcttccaaacactcggccggatgaaggtcggaacataccgttgacaaaccttaacggccagcctaacagacgggtgacacccctcatcatcttcacaaaagggttggcaccagatcgtgcacccgtaagatataagtaggagattccagcaagtattcccccaagatgacccagaaatgacactccaggtaccaacatttgaatgagaagaagttctgcccacgcagcataacgtgcagggaccataattccgtgcacatatgcatagctatccgactgagagtagagaacaactttcatggcgaatagcacaccagagaatcccacggcgtattcattgtagtaggctctctcgtagtcaaagagcagaagaaatttggctagcagtaatgtgatgccctgagacataccaagtagagctgcgaccattgatgcgaattcgacgcttcccattgcactctccaactgtattcccttccacagtagtgatagcatattgtacacaaggtgcggttcaccagtgtggtacaacggtgatagaagaaggcgcttcaaatccttgttcttgacaatgagatgtggattaaaccagacttgattgagggtggggagaattggatcgagaaatttagggcgcaggtaaataagtgtattagcggcgataaggcctgcggtgacgggtggcttgcggtcgaggcggccatactcgctcaacgcctgcagcagaagcagccctaccatccctccgcctcttcttcctctacccatctctaaattcgatcggagtttctcctctttctttctctacagcagtgggctagatttgtgaattgtggaatgaatctgatcagattttagcgcgagtttcttggttccgaagtttgcccagaaagttctagatctctcagtattttcatcactaatccaattcccccggccg

SEQ ID NO: 2529 - DNA, 1705 bp, Flaveria ramosissima
ccaccaccactactatcagcaccattatcaaacgatcagaatctctataacgcatcagcgattcggtgcttcatcacttcaaaagaggttttgtggtgatttagggtttttgtaatcagattttggtttcgagtagtgcgaattcctgtaagaacagtgaatatggctcgcaaaggtctaatggagcaggatttgagcaagctggatgtagcgacgctgcatccgctttcgccggaggtcatatctcgacaggcgacgattaatattggtactattggtcatgtggctcatggcaaatcaacagttgtaaaagcaatatctggtgtgcagactgttcgatttaaaaatgaattggaacgtaacatcactattaagcttgggtatgccaatgcaaagatatacaaatgcgaagatgaaaggtgccctcgacccatgtgttacaaggcatatggaagtggaaaagaagataaccctccttgtgatgtacctggatttgagaatagcaagatgaaattgatgaggcatgtatcctttgttgactgcccgggacatgatattctcatggctactatgcttaatggagctgcaattatggatggagcgttacttctcatagcagcaaatgaaagttgtccccaacctcagacatctgagcacttggctgctgttgaaatttgaggctccagcatatataattcttcaaaataaggttgatctaattcaggaaaatgtagccattaatcaacatgaggcaattcagaaattcattcagggaactgttgctgatggtgcaccggtcatcccagtatctgctcagcttaggtataatattgatgtcgtttgcgaatacataattaagcggattcctattccagagagaaacttcatttcacctccaaatatgatagtaatccgttcatttgatgttaacaaacctggatctgaggttgatgagattagaggtggtgttgctggtggaagtattctcaagggtgtgttgaaggtaaaccagaatattgaggtccgtcctgggattgttgttaaagatgagagtggcaacatcaagtgcaccccgatctactccagaatagtgtcactatatgcagaacagaatgaacttcaatatgctgtacctggtggtcttattggagttggaacaacaatggaccctatgttgacccgtgctgatcgtttggtgggtcaggttcttggggaagttgggtcgctacctgatgtttatgttgagctagaggtgaactttttccttttacgtcggctgttgggtgtgaaaacaaaaggaacagaaaagcaggggaaggtgtcaaagttgtcaaaggcagaaatactcatgctgaacataggttccatgtccactggggcccgtgtattggcggttaagaacgatttagcaaaactgcagctgacatcaccgtgtgcactagcaaaggcgagaagatcgctctaagcaggagagtggagaagcattggcgactaatcggttggggtcagattcaagcaggtttaactcttgatatcccaccctgccctatttagacacacatttgagttccagttttgcctttcttcattcttattgctgttttagctttcgatttttgtatttgcatggtgtttgaagaaatcatcataaggcattgtaccttcacctttaattgttattattattggttatttcttttatgat

SEQ ID NO: 2530 - DNA, 1636 bp, Flaveria ramosissima
cagtgaatatggctcgaaaggtctaatggagcaggatttgagcaagctggatgtagcaacgctgcatccgctttcgccggaggttatatctcgacaggcgacgattaatattggtactattggtcatgtggctcatggcaaatcaacagttgtgaaagcaatatctggtgtgcagactgttcgatttaaaacgaattggaacgtaacattactattaagcttgggtatgccaatgcaaagatatacaaatgtgaagatgaaaggtgccctcgacccatgtgttacaaggcctatggaagtgggaaagaagataaccctccttgtgatgtgcctggatttgagaacagcaagatgaaattgatgaggcatgtatcctttgtgactgcccgggacatgatattctcatggctactatgcttaatggagctgcaattatggatggagcgttacttctcatagcagcaaatgaaagttgtccccaacctcagacatctgagcacttggctgctgttgaaattatgaggctccagcatattataattcttcaaaataaggttgatctaattcaggaaaatgtagccattaatcaacatgaggcaattcagaaattcattcaggggactgttgctgatggtgcaccagtcatcccagtatctgctcagcttaggtataatattgatgtcgtttgtgaatacataattaagcggattcctattccagagagaaacttcatttcacctccaaatatgatagtaatccgttcatttgatgttaacaaacctggatctgaggttgatgagattagaggtggtgttgctggtggaagtattctcaagggtgtgttgaaggtaaaccagaatattgaggttcgtcccgggattgttgttaaagatgagagtggcaacatcaagtgtactccgatctactccagaatagtatcactatatgcagaacagaatgaacttcaatatgctgtacctggtggtcttattggagttggaacaacaatggaccctatgttgacccgtgctgatcgtttggtgggtcaggttcttggggaagttgggtcgctacctgatgtttatgtcgagctagaggtgaactttttccttttacgtcggctgttgggtgtgaaaacaaaaggaacagaaaagcaggggaaggtgtcaaagttgtcaaaggcagaaatactcatgctgaacataggttccatgtccactggggcccgtgtattggcggttaagaacgatttagcaaaactgcagctgacatcacccgtgtgcactagcaaaggcgagaagatcgccctaagcaggagagtggagaagcattggcgactaatcggttggggacagattcaagcaggtttaactcttgatatcccaccatgccctatttagacacacatttgattccagttttgcctttccttgattattattgctgttttagctttcgatttttgtatctgcatggtgtttgaagaaaccatcataaggcattgtacctttcacctttaattgttattattatcggttatttctcttatgatcgagctccaacaagctcgattggtctcgttgggataacatagtgctgaattttgataacatgtaatgtgtaactgattcgaggt

SEQ ID NO: 2531 - DNA, 1563 bp, Allium cepa
agttacgggcctagttaggggggatcaaaatttgtttcaagcagaacactagaactcagccccttatctgaaaccctaaagctgccgcttctgccaccgtcatctcctccttcgccgtcgctatcttttcatctgctgttcaagataccaaagcaaagatggctaagaagtcaggattaatggagcaagatctaagtaagcttgatgtgacgaagcttactcctctttcgcctgaagttatttctcgtcaagctacaattaatattggcaccattggccatgtggcgcatggaaagtcaactgtggtgaaagcaatatctggtgttcagactgtgcgatttaagaatgaactggagaggaatatcactatcaaacttggatatgctaatgcaaagatatatacgtgtgaagatgagaaatgtccaaggccaatgtgctacaaagcttacggaagcggaaaggaggatagcccggattgcgatgtgcctggatttgagaaagccaagatgaaacttttgagacatgtttcattcgttgattgtcctggacatgatattctcatggctacaatgcttaacggagctgctatcatggatggagctctgctgttaatagctggcaacgaaagttgtccccaacctcaaacttctgagcatcttgctgctgttgaaatcatgcgacttgagcacataataattcttcaaaataagatcgatcttattcaagaaagcgttgctatcaatcaacatgaatcaattcagaatttcatcaagggcacaattgctgatggtgcccagtagtgcctatatcggctcagctgaaatataacattgatgttgtgtgtgaatatcttgtcaacaaaatcccaattcctgtaagggattttacgtcgccgccaaatatgattgttatccgatcatttgatgtaaataagcctggttcggaggttgatgaaatcaaaggtggtgttgctggtggaagtattcttaggggagttctgaaggtgaaccaattaattgaagttcgacctggcattgttcttaaagatgagagtggcaaaatcaaatgtactcctatatactctagaatcaagtcgttatttgctgaacaaaacgaactgcaatttgctgtacctggaggacttattggtgttggtactaccatggaccccacattaacccgggctgatagacttgttgggcaagttcttggtgaagttggttctcttcctgatgtttttgttgagcttgaggttaacttctttttactgagaaggctattgggagtaagaacaaaaggtgcagaaaagcaaggaaaagtatcgaagctaacaaaagcggaaattctgatgcttaatataggttccatgtcaactggagctaaagtcattgcagtgaaaaacgatctagcgaaacttcagttaactgcaccagtatgtacaagcaaaggtgagaaggtcgctctcagcagaagagtggagaagcattggaggctgattggttggggacagattcaggcaggctctactctgaaaatccccccacgtcccagtttttaagtgag

SEQ ID NO: 2532 - DNA, 1588 bp, Vaccinium corymbosum
ctggatgtgacacagctacatccactctcaccggaagtcatttcacgtcaggcaacaataaatattggtactattggtcatgtggctcatggaaaatcaacagttgttaaagcaatatctggtgttcagactgtacgctttaaaaatgagctggagcgcaatattactattaagcttggatatgcaaatgcaaaaatatacaaatgtgaagaggaacgttgtcctcggcccatgtgctacaaggcatatggaagtggtaaagaagacagtccaatgtgtgatgtgccggggttcgagaattgtagaatgaaattgctgaggcatgtatcatttgttgattgcccgggtcatgatattctaatggctacaatgcttaacggagcagcaattatggatggagcattacttcttatagctgccaatgaaagttgtccccaacctcaaacttctgagcacttggctgctgttgaaataatgcggcttcaacatataataattctccaaaataaggttgatcttattcaggaaaatgttgctatcaaccagcatgaagcaatccagaaattcattgaggggacagttgctgatggtgccccagtgatcccagtttctgcgcagcttaagtataatattgacgttgtgtgcgagtatattgtgaagaagattcccattccagaaaggaacttcatctcaccgcctaatatgattgtaattcggtcttttgatgtcaataaacccgggtttgaggttgatgaaattagaggcggtgttgctggtggaagtattcttaaaggtgttttgaaggtaaatcaattcattgaggttcgtcctggcattgttgttaaagatgagagcggcaacattaaatgcacacccatatactccaggatagtttcattgtatgcagagcaaaatgaactacaatttgctgtacctggaggtctcattggggtcggcacaactatggaccccactttaacacgtgctgataggttggttggtcaggttcttggtgaggttgggtcactccccgaagtttttgttgaactagaggtgaattttttcttgttgagaaggctcctgggcgtgaggacaaagggcactgagaagcagggaaaagtttcaaagctagcaaaggcagagatccttatgttgaacataggttcaatgtcaactggtgctagagttgttgctgtaagaaacgatttggcgaaactgcaactcacttctccggtttgcaccagcagaggtgagaaaatagctctcagcaggcgagtcgagaagcactggcgtctgattgggtggggtcagattcaagctggtatcacacttgaggttcccccttgccctatttgattgaatttgacacacagttgaaacccgttagggagaaaaaatacgtgtggagaattggattagaaaatgtgggattgaatttgacacagttgaaacccgtaaaggagaaaaatacgtggagagaattggattagaaaatgtgggagagtagagagtgttggatacaattttttgtgagatggagaagaaaacaatgttggtttttgaagctttatgaattatttgtgatggt

SEQ ID NO: 2533 - DNA, 1687 bp, Daucus carota
caagagttgagttttagggttaagctgttgaagatagatacacacaaaatatagatacaagaagctaaagttggatcaaatctatctgggaagaacagagatttacctctattgaagtgggaagtattcaagaaaagcaaaatggcgcggaaaggactgatggagcaagatcttagtaagctggatgtgacgcaactacatccgctgtccccggaagtcatatctcggcaagctaccattaatattggtactattggccatgtggcgcatggaaaatcaacagttgtaaaagctatctctggtgttcagactgtgcgttttaagaatgaacttgaacgaaatatcactataaagcttgggtatgccaatgcaaagatatacaaatgcgaagatgaaagctgcccccgaccaaagtgctacaaggcatatgggagtgggaaagaagatgctcctcagtgtgatgtgcctggatttgagaactctaagatgaagttattgagacatgtctcttttgttgattgcccgggtcacgatattctcatggccacaatgcttaacggagccgcaatcatggacggggcactactgcttattgctgctaatgaaagttgtccccaaccgcaaacttcagagcacttggctgctattgaaattatgcgccttaaacatattataattcttcaaaataaggttgatcttatccaggaaaatgttgctactaatcagcatgatgcgatacagaaatttattcagggcactgttgctgacagttctccggttataccagtttcagcacagttgaagtataatattgatgtagtgtgtgaatatattgtgaaaaagattcccatcccagaaagaaacttcatttctcccccaaatatgattgtcatccggtcttttgacgttaataagcctggatctgaagtcgatgaaatcagaggaggtgttgcgggtggaagtatcctcaagggtgtgttgaaggtcaatcaatacattgaggtccgtcctgggattgttgttaaagatgaaactggaagcatcaagtgcacaccaatatactctagaatagtttcattatttgctgagcaaaatgaactacaatttgcggtgcctggaggcctgattggtgttgggacaacaatggacccgaccttgactcgtgctgatcgactggttggacaagttctcggggaggttggatcacttccggaagtgtatgtcgaactagaggttaactttttcttgttgcggagacttctgggtgtaaggacaaagggcacggagaggcagggaaaagtatccaagctaaccaagggagagatactaatgttgaatataggatccatgtccactggagccagagttcttgctgtaaggaatgatttggcaaaactgcagcttacatctccagtctgcaccagcaaaggagagaaaatcgcactgagcaggagagttgagaaacattggcgcctgattggttggggtcagattcaagctggtataaccctagatatcccaccctattccctctgagaaccacatccaacaagaaagagaagaagcatcaagaattcgagtaaagaacaaactacacagagatgtgggagggcaggcaactgctgggaacaatttttgtcaggtggaggagaaaacgataaatgtgatattttagttacttgctgct

SEQ ID NO: 2534 - DNA, 1548 bp, Centaurea maculosa
cggggaatgaaaaatgccaatatgcagccatcatactccaattaattaaaagttaaaaccctagccgctgtccttgcttccttttacgactgttatcaagcttgctgcacttgttcatcatcaattatccaggttgaggttttgtgttcatttaggatttgtgagattgaaagtccttgaagaagaacgaaaatgtctcgaaaaggtctaatggagcaggatttgagcaagctggatgtgacacaactacatccactctccccagaggtcatttctcgtcaagctacaattaatattggtactattggtcatgtggctcatggcaagtcaaccgttgtaaaagcaatttctggtgttcagactgttcggtttaaaaacgagttggagcgtaacatcactattaagcttggatacgcaaatgcaaagatctacaaatgcgaagatgagcgttgccctcgacctatgtgttacaaggcctatggatctggcaaagaggatagtcctctttgcgatgtgcctggatttgagaacgccaagatgactttgatgaggcatgtatcgtttgttgactgcccggggcatgatattctgatggctactatgctgaatggagctgcgattatggatggagcgttgcttttgatagctgcaaatgaaagttgtccgcaacctcagacttctgagcacttggctgccgttgaaattatgcgtctccagcatattatcattcttcagaataaggttgatttaattcaggagaatgttgcaattaaccaacatgaggcaattcagaagttcatccagggaacggtagctgatggtgcaccagtcatcccagtgtctgctcagctcaagtataatatcgatgttgtatgcgaatacataataaagcggattcccattccagagaggaacttcatttcacctcctaatatgatagtaattcggtcatttgatgttaacaagcccggatccgaggttgatgagattagaggtggtgttgccggtggaagtatcctcaagggagtgttgaaggtgaaccaaaatattgaggtccgaccagggattgttgtgaaagacgagagtggcaacatcaagtgcaccccgatatattctagaatagtttcgttatatgccgagcagaacgagcttcagtttgccgtacccggagggcttattggagttggaactacgatggaccctatgttgacacgtgctgaccggcttgtaggacaggttcttggggaggtcggatctcttcctgatgtttatgtcgaactagaggtgaacttctttcttttgcgtcggttgttgggtgtaaagacaaaaggaacagagaggcaagggaaggtatcgaagttggcaaagggagagattctcatgctcaacataggatccatgtccacaggggctcgtgtattggccgtcaagaacgatttagcaaaactccagctcacatcacccgtgtgtacaagcaaaggcgagaagattgcattaagccgacgagtggagaagcattggcgtctgattggttggggacaaattcaa

SEQ ID NO: 2535 - DNA, 1790 bp, Solanum tuberosum
gctgcgacgccgccgtttcactcttctccgtttcagacttgaaaattaccgacatctgaagaagtatcaaagaacagctaaaaatgtctcggaaaggattgatggagcaggacctgagtaagttggatgtaacaaagttgcatccactttcaccagaggttatttctcgtcaggctacaataaatattggtaccattgggcatgtggctcatgggaagtcaacagttgtaaaagctatatctggagtgcagactgttcgttttaaaaatgagctagaaagaaacatcacaattaagcttggatatgctaatgctaagatatataaatgtgaagaagaccgctgccctagacccatgtgctacaaggcatatggaagtggaaaagaagacggtcccatgtgtgatgtccccggtttcgagacctgtaggatgaaattgctgagacatgtatctttcgttgattgccccggtcatgatattctcatggctactatgcttaatggagctgcaattatggatggagcattacttctaattgctgctaatgagagctgtccccaacctcagacttctgaacatttagctgctgtagaaattatgcgcctccaacacataataattctccaaaataaggttgatctagttcaggaaaatgttggcattaagcagcatgaggcaattcagaaattaatccagggaactgttgctgatggagccccagttgtaccaatctctgcgcaattgaagtacaacatcgatgttgttgctgaatatatagtgaagaaaattcccattcctgagaggaatttcatttcaccaccaaatatgatagtcatccgatcatttgatgttaataaacctggttttgaagttgatgatatcagaggcggtgtcgctggtggcagtatactgaagggcgtcctgaaggtaaatcaactcattgaggttcgtcccggtattactgtcaaggatgagagtggcaacattaagtgtaccccaatatattcaagaatagtgtcattgtttgctgagcaaaatgagctacaatttgctgtgcccggaggcctcattggagttggaacaactatggatccaacattgactcgtgctgatcgattggtcggacaggttcttggggaggttggctcacttcctgaagtgtttgtcgaactggaggtaaatttcttcttgctccgccgtcttctgggagtgaggacaaaggacacggaaaggcagggtaaagtctcaaagttggccaagggagagattctcatgttaaacataggatctatgtcaactggggctcgtgttgtcgctgttaagaatgtctttgcaaaactgcaattgacatcacctgtgtgtaccagcaaaggtgagaaaattgctcttagcaggagaatcgagaagcactggcgtctcatcggttggggccaaatccaagctggtatcacccttgatgttccaccttgcccaatctgagtgaactacacagaaacacgattttgacatttagatgtggaaaggcatacaattgttaggaactaaaaaagattatctgaaatttcgaatactttgtaatttgcaatgtttactttttcttatttacgacttctctttgttttctcttattttcctctttgttctagtggttgtaccttgtaattcattagttgttaagggtggatattattcgtatgagtttcatcataaacatcgaggttgcggcacgtttttgtctaaaagtttaaactatcaaaaacttttatttacatttcatgtgggactctattc

SEQ ID NO: 2536 - DNA, 1588 bp, Primula obconica
atttaagctacaagtttcttgtattggagaataagatcccagtcgccaagatgtctaagaaagggttgatggagcaagatttgagtaagctggatgtggcagcacttcacccactgtcacctgaagttatatcccgccaagcaacaattaatatcgggactatcggtcatgtggcccatggaaagtcaacagtggttaaagctatttctggggttcagactgttcgtttcaagaatgagttggaacgcaacattaccattaagctgggatatgcaaatgcaaaaatttataagtgtgaagatgatcggtgccctcgtcctatgtgctacaaggcatatggaagtggaaaagaagataaccctatgtgtgatgtgcctgggttcgaaagttgtaggatgaaactgttgagacatgtatcttttgttgattgtccgggccatgatattctcatggccaccatgcttaatggagccgcaattatggacggagctctacttcttatagctgctaatgaaacatgcccgcaaccgcaaacttcggagcatttggctgctgttgaaattatgcgtcttcaacatataataattctccaaaataaagtggatcttattcaggaaaatgtagccctgaaccagcatgaagctattcagaaatttatccagaaaactgttgctgatggtgcaccgattgtaccagtttctgcacagcttaagtataatattgacgttgtgtgcgaataccttgtgaagaagatcccaattcctgaaaggaacttcatctcgccccctaacatgattgttattcgttcatttgatgtcaataagcccgggtttgaagttgatgaagttagaggtggtgttgctggggggagtattctcaaaggtgttttgaaagtgaaccaatttattgaggttcggcctggcattgtagtcaaagatgagagaggcaacatcaaatgcactcctatatactctagaatagtttcattatttgcagagcaaaatgaactacaatttgcagtaccaggaggtctcattggggttggaactactatggaccctactttaacccgtgcagataggttggttggtcacgttcttggtgaggtcgggtcgcttccggatgtatttgttgaattagaggtgaactttttcttgttgagacgtcttctgggtgtgaggacaaagggggaggagagacaagggagggtctcaaagctggcaaaggcagagattttgatgctgaacattgggtcaatgtccacaggtgcacgagttattgctgtaaagaatgatcttgcgaagctacaactgacttctccggtttgtacaagcaaaggcgaaaaaattgctttgagtagaagagttgagaagcattggcgtttgatcggctggggacagattcaagctggtaagacgctcgaggttcctccctgccccatttgagtgcgactctgatataacaagaaagaagaaatctaaaagagagggaaaatgtgggaggggagagatctgctgggcactatttttgttagatggagaagaaaacacctataaacttgatgtgcattttcatttaattctttttt

SEQ ID NO: 2537 - DNA, 1664 bp, Eutrema halophilum
ctttaatctgtcataatgtctcggaacaagggtttggctgagcaggaccttaaaaaattagatgtaactgtgctacatcctttgtctcctgaggtcatttctcgccaggcaactattaatataggaaccattgggcatgtcgctcacggaaagtcgactgttgtgaaagctatttctggtgtgcagactgtccgttttaagaatgaactggagcgtaacattaccattaagcttggatatgcaaatgccaagatttacaaatgcgaggatgagaaatgccctagaccaatgtgctacaaggcctatggaagtggtaaggaagacaacccaaattgtgatgtccctggatttgagaactccaagatgaaactattgaggcatgtctcattcgtggattgcccgggacacgatattctcatggcgacaatgcttaacggagcagccatcatggatggtgcacttcttttaatcgctgcaaatgagacctgtccgcaaccacaaacgtctgaacatcttgctgctgttgagattatgcaacttaagcatatcattatcctccagaacaagattgatcttatccaagaaaacgttgccatcaatcagcacgaggcaattcagaaatttataatgaacacagtggctgatggtgcccctatcgtaccggtctcagcacaattgaaatacaacatcgatgttgtatgtgagtacattgtcaagaagatcccaataccaaaaaggaattttgtgtcaccaccaaatatgatagtgattcggtcttttgatgtcaacaaacctggttttgaggttgatgagattaaaggtggagttgcaggtggaagtatacttcggggtgtattgaaagtgaaccaattgattgaaatccgacctggtattgttgtgaaagacgagcgtggcaacccaaaatgcactccaatatactcccgcataatctcactctatgcagaacagaacgagcttcagtttgctgttcctggaggtctaattggagttggaacaacaatggacccaactcttactcgtgctgatcgattggttggtcaagttcttggggaaataggttccctccctgatgtttttgttgaactcgaggtgaacttctttcttctacggcgtctgttgggagtgagaacaaagggatcagagaaacaagggaaagtgtcaaagctaacaaagggagagattctgatgctcaacatcggttccatgtccactggagccaaagttgttggagttaagaacgatctggctaagttgcaactgaccgctccggtttgcaccagcagaggagagaaagtggctctaagccgccgtgtggaaaagcattggcgtttgattggttggggtcagattcaagctggaaccaccactgaggttcctccttcaccgttctgagaggtcttgtcttctttttcatgtgggaggttttctggagagtacacgtacctatttgcggataaatttgttactactgtagtttactcttgtttgtgttttgctttcttagatgattactaattttttgtctcatgtttctataaaaaaaaattctctgtttagttttatactgggaaatttagtaacatcattcaacttttccgaaacgttttcttaaatgtttttttgttatcaattaaaaatcacta

SEQ ID NO: 2538 - DNA, 1614 bp, Eutrema parvulum
ccgttttaagcaggagaaaagccttcaatcggtcataatgtctcggaacaagggtttggcggagcaagatcttagtaaattggatgtaactgtgctacatcctttgtctcctgaggtcatttctcgtcaggctactataaatataggaaccattgggcatgtcgctcacggaaagtccaccgttgtgaaagccatttctggtgtgcagactgtccgttttaagaatgaattggagcgtaacatcaccattaagcttggatatgcaaatgccaagatttacaagtgcgaggatgagaaatgccctagacctgtgtgctacaaggcatatggaagtggaaaggaagacaacccacattgtgatgtccctggatttgagaactccaagatgaaactattgaggcatgtttcattcgtggattgcccgggacacgatattctcatggcgactatgctcaacggagcagccatcatggatggtgcactgcttttaattgctgcaaatgaaacttgtccgcaaccacaaacatccgaacatcttgctgctgttgagattatgcaacttaagcatatcataatccttcagaacaagattgatcttattcaagagaacgttgccattaatcagcatgaggcaattcagaaatttataatgaacactgttgccgatggtgcaccaatcgtcccagtctcagcacaactgaaatacaacatcgatgttgtatgcgagtacattgtcaagaaaatcccaatccctaagaggaattttgtgtcaccaccaaatatgatagtgattcggtcttttgatgtcaacaaacctgggtttgaggttgatgagattaaaggtggagttgcaggtggaagtatccttcggggtgttttgaaagtgaaccaattaattgaaatccgacctggtattgttgtcaaagacgagcgtggcaacccaaaatgcactccaatttactcccgcataatttcactctatgcggaacagaacgagcttcagtttgctgttcccggaggtctaattggagttggaacaacaatggacccaactcttactcgtgctgatcgattggttggtcaagtccttggtgaaatcgattcccttcctgatgtctttgttgaactcgaggtgaacttctttcttctacgacgtctgttgggagtgagaacaaagggatcagagaaacaagggaaagtgtcaaagctagcaaagggagagattctgatgctcaacatcggttccatgtcgacgggagccaaagttgttggagttaagaacgatctggctaagttgcaactgaccgcgcctgtttgcacaagcaaaggagagaaagtggctctgagccggcgtgtggaaaagcattggcgtttgattggttggggtcagattcaagctggaaccaccatcgaagttcctccttcacctttctgaggttttgagtcttctttttttgtttttttttttttggtttctgaaaaaatttatcaacccctcaaaagataataaaactcttctatttcgtgtgggggtttttggagagtacctatttgcggataaacttgttactagtttactcttgtttgttagatgtttattaatttgtccgtctc

SEQ ID NO: 2539 - DNA, 1555 bp, Cedrus atlantica
actgtgaaggtcacccgagttacatctgatcagttttgaacagctaagcgtttactctcgtctgtgcagacagatctgctgtcctgatattctctgcatataaattcattttgtgagggcttatcatccatccagtgccaaaatgtcgaaaaaagggttaatggagcaggacctgaacaagctggatgttaacaagttgcatccgctttctccagaggtcatttctcgtcaggctacaataaacataggtacaattggtcatgtggcacatgggaaatcaacagttgttaaagcaatatctggtgtccagacggttcgtttcaagaatgaactggagcgaaacatcactattaagctgggatatgcaaatgcaaaaatatataaatgcgaagacgagcgctgccctcgaccaatgagctacaaggcatatggaagtgggaaggaagatagtcctctctgtgaagttactggatttgagaacactcgtatgaagcttttgagacatgtgtcttttgttgattgtccgggtcatgatattctcatggctactatgctcaatggtgcggctatcatggatggggcactgcttttgattgcaggcaatgagagctgtcctcaacctcaaacttcagagcatcttgctgctgtggagatcatgcgtcttaagcatataattattttacaaaacaaaattgaccttatccaggagagtgtagctatcaaccaacatgaggcaattcagaagtttattcagggtaccattgcagatggagcacctgtagtaccaatatctgcacaactgaaatacaacattgatgttgtctgtgaatacatagtaaacaaaattcctattccagagcgaaattttgttgatgcacccaatatgattgtaatcagatcttttgatgtgaataaacctggtgctgaagttgatgaaataaaggaggtgttgctggtggaagtatactgaggggtgtgttgaaagtgaatcaaaaaattgaagttcgtcctggcattgtcgtcaaagatgaaagtggcaacatcaagtgtacacctatcttttcaagaataatttcactttatgctgagcaaaatgagttgcagtttgctgttcctggaggtcttattggtgtgggtacaacagtagaccccatgctgacacgtgctgacaagcttgtggggcaagtccttggagaagttggagcactacctgatgtatttgttgagcttgaggttaactttttcctcctccgtcgcctcctgggagttaggacaaaggggacagagaaacaggggaaagttacaaagctggccaagggggaagttttgatgcttaatattggttcaatgtccactggagctcgggtgcttgctgtgaaaaatgaccttgcaaagctccaacttacttctccggtctgcacaagtaaaggagaaaagatggcacttagtaggcgagtagaaaagcattggcgattgataggatggggtcaaatacaagctggagcaatgctggaaattccccaagtgtccatataagatagtgaataaacaaagc

SEQ ID NO: 2540 - DNA, 1724 bp, Sciadopitys verticillata
gcacaagcaggcagtcgtggtaatatcactaccagaagaaatctcattcaccacaaggctgggatatctcagcagaaaactgtcaactttttcttcgtttttcactgcaacattttgtggggcctttataagcagcaaaaatgtcgagaaaagggttaatggagcaggacctgagcaagctggatgtttcccagctgcatccactttctccagaggtcatttctcgtcaggctactataaacattggcacaattgggcatgtggcacatgggaaatcaacagtggtaaaagccatatctggcgtccagacagttcgtttcaaaaatgaattggaaaggaacatcactattaagctgggttacgcaaatgcaaaaatatacaagtgtgaagatgagcgttgcccacggccaatgtgttacaaggcatatggcagcggaaaggaagatactccactctgtgatgtccccggttttgagaacacacgcatgaaacttttaagacatgtgtcatttgttgattgtccgggtcatgatattctcatggctactatgctcaatggtgctgctattatggatggggcactgcttttgattgcaagtaatgagagctgtcctcagcctcaaacttcagagcatcttgctgctgtagagataatgcgtcttcagcatattatcattctacaaaacaaaattgatctgatccaggaaagtgtagccattaaccagcacgaggcaattcaaaaatttattcagggtaccattgcggacggagcacctgtagtaccaatatctgcccaactaaagtacaacattgatgttgtatgtgaatacataacaaataaaattcctatcccagagcgtaattttgttgccccacccaatatgattgtcatcagatcttttgacgtgaataagcctggtgcagaagttgatgaaataaaaggtggtgttgctggtggaagtatactaaggggtgtgttgaaggtgaatcaaagaattgaagttcgtcctggcattgttgtcaaagatgaaagtggcaatatcaagtgtacacctatcttttcgagaataatttcactttacgctgagcaaaatgagttgcagtatgctgttcctggaggtcttattggtgtgggtacaacaatagatcccacactcacacgggctgacaggcttgttgggcaagtccttggagaagttggagaattacctgacatatttgttgagcttgaggtaaactttttcctcctccgccgcctcctgggagttaggaccaaaggtacagagaaacaagggaaggtttcaaaattaggccaagggagaagttttgatgcttaacattggttccatgtcaactggagctcgggtgcttgctgtgaaaaacgatcttgctaagctccagcttacctctcctgtctgcacaagtaaaggagagaagatggctcttagcagacgagtagaaaagcattggcgattgataggatggggtcaaattcaagctggagtgatgctggacatttcccaaggtagtgcataatacaagcagtttgaagaaggtatttcagtaaggaaaaatgtggataggaagagagttattagggacaatttttgtcaggtggagaagaaaacctattggttataacttattatatttgatgtgttgttttcggtagctgtaatatcatcttttgaaattgagcaaataacttgtattttttcctgggc

SEQ ID NO: 2541 - DNA, 1761 bp, Brassica juncea
caaccctaaaagaaaccttaagcagcaccaccatctgttatcttcttcgtcgtcgtcttcgtcctctcactgcgccgccgctttcttcactcagcaggagagtaataaacctttttcaagaatgtcgaggaacaagggattggcggagcaagatcttagtaaattggatgtgactgtgcttcatcctctctcccctgaggtcatctctcgccaggctactatcaacattggaaccattgggcatgtcgctcacggaaaatccactgttgtcaaagctatctctggtgtccagactgttcgttttaagaatgaattggagcgtaatatcactattaagcttggatatgcgaatgctaagatttacaaatgcgaggatgagaaatgccctagacctatgtgttacaaggcttatggaagtgggaaggaagacaccccgaattgtgatgtccctggatttgagaacgctaagatgaaactgttgaggcatgtgtcgtttgttgattgcccgggacacgatattctcatggcgactatgcttaacggagcagcaatcatggatggtgcactgcttctcatcgctgcaaatgaaacttgtccgcaaccacagacatccgaacatcttgctgctgttgaaattatgcaactcaagcacatcataatccttcagaacaagattgatctgattcaagagaacgttgccatcaaccagcacgaagccattcagaaatttataatgaacactgtcgcagatggtgccccaatagtccctgtatcagcccaactgaaatacaacatcgatgttgtgtgcgagtacattgtcaagaagatcccaatccctaagagaaattttgtgtcaccaccaaacatgatagtgattcggtcttttgatgtcaacaaacctggatttgaggttgatgagattaaaggtggagttgcaggtggaagtatcctccggggtgttttgaaagtgaaccaattaattgagatccgacctggaattgttgtgaaagacgagcgtggcaacccgaaatgcactccaatatactcccgcattatttcactatacgcggagcagaacgagcttcagtacgcagtgcctggaggtctaattggagtaggaacaacgatggacccaactctaactcgtgctgatcgtttggttggtcaagtccttggtgaaatcggttcccttcctgatgtctttgttgaactcgaggtgaacttctttcttctacggcgactgttgggagtgagaataaagggatcagagaaacaagggaaagtgacaaagctaacaaagggagagattctgatgctcaacattggttccatgtcgacgggagccaaagttgtaggagtaaagaacgatctggctaagttgcagctgaccgcgccggtgtgcacgagcaaaggagagaaagtggcactgagtaggcgtgtggagaagcattggcgtttgataggttggggtcagatccaagctggaacaaccattgaagttcctccttcacctttctgatgatgaggtgttcgtctttattttcatgttggggtttttggagagtacctacccatttgttactagttttactcttgtttgtttttttatttcttagatgtttattacaattgttttttgtctcatgtttaattaacttctctgtttaattaccctgggaatttcattaatactggtgaagtctgcagaaacgagttttaaaatattttttatgttctctttaaaatatactattacctttg

SEQ ID NO: 2542 - DNA, 1771 bp, Brassica rapa
tgggataaaaaccttgagctccaccatcttctgttcttcctctagctgcgccgctttctcactctctttgcgtcattcagcaggagcagtcacaatgtcgcggaacaagggtttggcggagcaggatcttagtaaattggatgtgactgtgctacatcctctgtctcctgaagtcatttctcgccaggctactatcaacataggaaccattgggcatgtcgctcacggaaagtccactgtcgtgaaagctatatctggtgtgcagactgtccgttttaagaatgaattggagcgtaacatcactattaagcttggatatgcaaatgctaagatttacaaatgtgaagatgagaagtgtcccagaccgatgtgctacaaggcatatggaagtggaaaggaagacaacccactttgtgatgtccctggatttgagaactccaagatgaaactactgaggcacgtgtcattcgttgattgcccgggacacgatattctcatggcgactatgctcaacggagcagccatcatggacggtgcacttctccttatcgctgcaaatgaaagctgtccgcaaccacaaacatccgaacatctcgctgcagttgagattatgcagctcaagcatatcataatcctccagaacaagattgatcttattcaagagaacgttgccattaatcagcacgaggccattcagaaatttataatgaacactgtcgcagatggggccccaatagtccctgtatcagcccagctgaaatacaacatcgatgttgtatgcgagtacattgtcaagaagatcccaatccccaagaggaatttcatttcaccgccaaatatgatagtgattcggtcttttgatgtcaacaagcccgggtttgaggttgatgagatcaaaggtggagttgcaggtggaagtatcctacggggtgttttgaaagtgaaccaactaattgagatccgacctggaatcgttgtgaaagacgagcgtggcaacccgaaatgtacaccaatatactcccgcattatttcactatacgcggagcagaacgagcttcagtacgcagtgcctggaggtctaattggagtagggacaacgatggacccaactctaactcgtgctgatcgtttggtcggtcaagtccttggtgaaataggctccctacctgatgtctttgttgaactcgaggtgaacttctttcttctacggagactgttgggagtgagaataaagggatcagagaaacaagggaaagtgacgaagctaacgaagggagaggttctgatgctcaacattggttccatgtcgacgggagccaaagttgtaggagtaaagaacgatctggctaagctgcaactcactgctcctgtttgcacgagcaaaggagagaaagtggcactgagcaggcgtgtggaaaagcattggcgtttgattggttggggtcagattcaagctggaaccaccattgaagtgcctccctcacctttctgagcttgaaattttttatttaaccctcaaaaagataataaaaactctttcttgttcatgtggggattttttgaaagagtacctattagtttactctgtttctgtgtgtgtgttttttttctttcttagtaggttattaatttttgttatcatgtttttactgggtgcaattacccaattttttttaattaacaaaaaatatagagcatggttcaatttgtggaccaacccttgtagaccggattggtttgttcggttaaatcagatgaatttttttatttt

SEQ ID NO: 2543 - DNA, 1801 bp, Chrysanthemum coronarium
atcgtatatgaataaaatatacacccaaaaacaaactaaaaatattatcttcatccccacttttagccaccaaaccctaactcacacaacaatcgaatcatctcatctcatcgtaacaacaggttgttgtgtgttaatcgttaaggttttgatacttcaattactgttttttttaattgagtgagttaagaagtgtgaaaacatggcgaacaaaaaaggattgatggaacaggatttgaaaaagctggatgtggcgaagcttcatccgctttcgcccgaagtaatatcgcgccaggcgactattaatatcggtactattggacatgtggctcacgggaagtccactgtcgtcaaagctatttctggtgtgcagactgttcgttttaaaaatgagttggagcgtaacattactatcaagcttgggtatgccaacgcgaagatctataagtgtgaggatgaaaggtgtccacgacccatgtgttacaaggcctatggaagtggaaaagaagacagccctgcttgtgatgtgcctggatttgagaacagcaagatgacattgatgaggcatgtatcatttgttgattgcccgggacacgatattctcatggctactatgcttaatggagcggctatcatggatggagctttacttctcatagctgcaaatgaaagttgtccccaacctcaaacatcagagcacttggctgctgttgaaataatgcgactccagcatataataattcttcaaaacaaggttgatctcattcaggaaaatgtagccataaatcaacacgaggccattcagaaatttattcagggaactgtggctgatggtgcaccagtcattccagtttctgctcagctgaagtataatattgatgttgtttgtgaatacatcataaagcgtattcccattccagaaaggaacttcatttcaccaccgaacatgattgttattcgatcgtttgatgttaacaaacctggtgcggaggttgaggagattagaggtggtgttgctggaggaagtattctcaagggtgtgttgaaggtaaaccagaacattgaggttcgtccaggaattgttgttaaagatgagagtggcaacatcaagtgcaccccaatttactcaagaatagtttcactgtttgcggagcagaacgaactccagtttgctgtacctggaggtcttattggagttggaactacaatggaccctatgttgactcgtgctgatcggttggtgggtcaggttcttggggaggttggatcacttcctgatgtttatgttgaactggaggtgaacttctttttgttgcgtcggctgttgggtgtgaagacgaaaggagcagaaagacaaggaaaagtggcaaaattagcgaaggctgaaattcttatgcttaacataggatcaatgtctactggagctcgtgttttggcagttaagaacgatttagcaaaactgcagctgacatcacctgtgtgtactagcaaaggagagaagattgcactgagcaggagagtggagaagcactggaggttgattggttggggacagattcaagcaggacttacccttgagatcccaccgtgcccaatttaaaccgacacatctgaattccagttttgcctgctgttgctttttaatactcgattctaaattgttacatctgttttagctttttggtagccattgtgattttacactatcaacttgtacttgcgcgcacaacttcgcatggtgtttgaagaaaggatcataaaacatgtgcttttgtcttctctttgctctttttcattctct

SEQ ID NO: 2544 - DNA, 2494 bp, Panax ginseng
ccgttgcctacccacgactgtttaagtaaaatttagataaaattcccaaaattgggatggtgtaacgtgcagcaaaacctctattttttctcgtctctcttcttcactaaggtgttggactgctcgcgacggctaccctagatttcttaaaaactgaatttagttctgttgaagcgcaaagtctacaagaagagccaaaatggcgcgaaaaggtttgatggagcaggatttgagcaagctggatgtgacaaaactacatcctctctcgcctgaagttatatctcggcaggctacaataaatattggcactattggccacgtggcacatggaaaatcgacagttgtaaaagctatatctggtgtgcagactgttcgtttcaaaaatgagctggaacgcaacatcactattaagcttgggtatgcaaatgcaaaaatatacaaatgtgaagatgaacgttgccctcgacctatgtgttacaaggcatatggaagtgggaaagaagatgctcctctttgtgatatgccggggtttgagaacgccaggatgaatttactgagacatgtgtcgtttgttgattgcccaggtcatgatattctcatggctacaatgcttaatggagcagcaattatggatggggcattacttctcattgctgccaatgaaagttgtccccaacctcagacttcagagcacttggctgctgttgaaattatgcgccttcagcatataataattcttcaaaataaggtcgatctaattcaggaaaatgtggccatcaaccagcatgaagctatccagaaatttatccagggaaccgttgcagatggtgctccagtgataccagtttctgcacagctgaagtacaacattgatgtcgtgtgtgaatatattgtgaaaaggattcccattccagagaggaatttcatctcaccgccaaatatgattgtgatccggtcttttgacgttaacaagcctggctttgaagttgatgaaattagaggtggtgttgctggtggaagcatcctcaagggggttttgaaggtcaatcaatacatagaggttcgtcctgggattgtagttaaagatgaaagtggcaacattaagtgcaccccaatatactctagaatagtttcattatatgcagagcaaaatgaattacaatttgctgtgccaggaggcctgattggtgttggcacaaccatggaccccaccttaactcgtgctgatcgtttggtgggacaggtccttggggaggtcggatcacttcctgaggtgtatgttgaactagaggtgaactttttcttgcttcgacgtcttctgggtgtaaggacaaagggcacagagaggcagggaaaggtctcaaagcttgcaaagggagagatacttatgctgaatattggatctatgtcaacaggtgctcgagttcttgctgtaaggaacgatttagcaaaattacaacttacatctccggtatgcaccagcaaaggggagaaaattgcactgagccggcgggttgaaaaacattggcgtcttattggttggggtcagattcaagcgggtatattggtgataaggaacattgattggatattcaagtgattgaagaatttttctttactaggaaaaccaactgttggtgaagttattggcatatttgagaagaaaggttttactttgaaaggtttgaagcttattactatggatcagtcttttgctgagaagcacgatgctgacctctccagaaaaccttattaccgtggattggttgactatattgtcgctggtcctgttgttgcaatggtttgggagggtaagagtgtagttacgactggtcgaaagattattggtgcggcaaaccctgcagattctgcccctggcactatccgtggtgatttttctattgatattgagtatgatgaatttggtcggattgagtttagctttgggaacagacaagttcagaatggagtgtccagagaacagttatctggatggggaagaagcaagaaacagttcaggatgtaccgtgcggaaatatagttgccttggttggcttggatcagttcgtcactaaaaatgctactttgacgaatgagaaagaagttgatgcccatccaattaaagttatgaagttttctgtgtcacctgttgtgcgtgttgcggtgcagtgaaatactgttgttgggcagatgatttcgtcgtatctgaccaataagtcacagctggatgatcatgcaatccatctactctttagtgcaaaccgctgggagaagaggtatgttttgttattgtattgcatcatgatatgccacaatttgttcgaactgcatacagagacaatagttcagtgtaacatgcaattttcatttttatagaccagcagttggttagtttagttatatgtgttctacataatctgtattaagattcatgggtgtcaagataacatgtgattcatacttctagcctgcttatgaaactcttggaactgaa

SEQ ID NO: 2545 - DNA, 1640 bp, Podocarpus macrophillus
tttggcggctaatcaagaagcagaagaagagaaaattgtctcggagagggttgatggagcaggatctgagtaagttggatgtgactaagttgcatcctctttctccggaggttatttctcgccaggctactattaacattggcacaattgggcatgtggcacatgggaaatcaacagtggttaaagccatatctggtgttcagacagttcgtttcaagaatgagttggagaggaatatcactattaaactgggttatgcgaatgcaaaaatttacaaatgtgaagatgagcgctgccctcgaccaatgtgttacaaggcatatggtagtggcaaggaagatagccctctttgtgatgtcccaggatttgagaacactcgcatgaagcttctaagacatgtgtcatttgttgattgtccgggtcacgatattctcatggccactatgcttaatggtgctgctattatggatggagcattgcttttgattgcaagtaacgagagctgtcctcaacctcaaacatcagagcatcttgctgctgttgagataatgcgacttcagcacatcatcattttacaaaacaaaattgatctgatccaggaaagtgtagccctgaaccagcaagaagcaattcagaaatttattcagggaacaattgctgatggagcacctgtagtaccaatatctgcacagctaaaatacaacatcgatgtcgtatgtgaatacatagtgaacaagattcccattccagaacgtaactttgttgacccacccaatatgattgtaatcagatcttttgatgtgaataagcctggtgctgaagttgatgaaataaaaggaggtgttgctggtggaagtatattgaagggtgtcttaaaagtgaaccaaaaaattgaagtccgacctggcattgttgtcaaggatgagagtggcaatatcaaatgtacacctattttctcaagaataatttctctttatgctgagcaaaatgagttgcagttcgctgttcctggagggcttattggtgtgggtacaacaatagatcccacactcacacgtgctgacaggcttgttggacaagtccttggagaagtgggacagctacccaatgtattcgttgagcttgaggtgaactttttcctccttcgtcgccttcttggagttaggaccaaaggtacagagaaacaaggcaaggtttcaaagttagccaaggcggaagtgttaatgctcaacattggttcaatgtcaactggagctaaggttcttgctgttaaaaatgaccttgctaagctccaactcacttctcctgtctgcacaagtaaaggagaaaaagttgctcttagcagacgagtagaaaagcattggcgattgattggatgggggcaaattcaagctggattgatgttggatattccccaaggatccatataaaaacaagacaaagcacatcggtttatagtttgagaaaaggaggtatattttagtataggaaaaatgtggattgggagggagttattaggaactatttttgttaggtggagaagaaaacatgaagggtatttgacttttgtgattttggttctggtattcgtacaaaattgaaatctatttctgtttgtttactgtatttttgaccatctt

SEQ ID NO: 2546 - DNA, 1630 bp, Ambrosia trifida
tagtaataataataataatatgggcgcgaaaaggattaatggagcaggatttgagtaagctggatgtatcgacgctgcatccgctttctcctgaggttatatctcgtcaagctaccattaatattggtactattggtcatgtggctcatggaaagtcgacggttgtgaaagcaatatctggtgtgcagactgttcgatttaaaaatgaactggaacgtaacattactatcaagcttgggtatgccaatgcgaagatatacaaatgtgaagatgaaaggtgccctcgacccatgtgttacaaggcctatggaagtgggaaagaagattgccctccttgtgacgtgcctggatttgagaacagcaagatgaaattgatgaggcatgtatcttttgttgactgcccgggacatgatattctcatggctactatgcttaacggagctgcaatcatggatggtgcattacttctcatagctgcaaatgaaagttgtccccaacctcagacttctgagcacttggctgctgttgaaattatgaggctccaacatattataattcttcaaaataaggttgatctaattgcggaacatgtagccatcaatcaacacgaggcgattcagaaattcatccagggaacggttgccgatggtgcaccagtcgtccctgtatctgctcagcttaggtataatattgatgttgtttgcgaatacataattaagcggattcccattcccgagagaaacttcatttcacctccaaatatgatagtaattcgttcatttgatgttaacaaacctggatctgaggtggatgagattagaggtggtgtagctggtggaagtatactcaagggtgtgttgaaggtaaaccagaatatcgaggtccgtccagggattgttgttaaagatgagagtggcaacatcaagtgcaccccgatttactctagaattgtatcactatatgctgagcagaatgaacttcaatatgctgtacctggaggtcttattggagttggaacaacaatggatcctatgttgacgcgtgctgataggttggtgggtcaggttcttggggaagtcgggtctctacctgatgtttacgtcgaactagaggtgaacttttttcttttgcgccggttgctgggtgtgaagaccaaaggaacagaaaagcagggaaaggtatcaaagctgtcaaaggcagaaatactgatgctgaacattggatctatgtcgactggggcgcgtgttttggccgtcaagaacgatttagcgaagctgcagctgacatcacccgtatgtactagcaagggtgagaaaatcgctttgagcaggagagtcgagaagcattggcgactgattggttggggacagattcaagcaggtctgacacttgaaattccaccttgccctatttagacacacttgaattccagttttgccttgatttcatccttgattcttatttcttgttttgcattcgattttcgtcctctttttttgtgattttatactatttttaacccgttttaagcaaatactttgcatggtgcttgaagaaatgatcataagacatgtacctttcacctttacccgtccttgttattttatgaagaaaactcaatttgtcgata

SEQ ID NO: 2547 - DNA, 2192 bp, Lupinus angustifolius
gataaaatctttttgtaattttatttttttcgcgaattagggtttgttatctctttagcttagccttagcctcacgcagtctcgctcttacacactctcacattccgctcttacacacctcttctccaccgccatcgccgccgcataatctattctccggccacctaaatctgccgtagcttctgccccgccgatcacaaaatcttcctgcttctttcagataatttagcctaaaattttgggaagtcagaaactactctcaaaatgtcgcggaagggtttgatggaacaagacctgaaaaaattggatgtgacaaaattgcatccactttctcccgaagtcatatctcggcaggctaccattaatattggtaccattggtcatgtggcacatggcaaatcaacagttgtgaaagcgatttctggtgttcagactgtgcgttttaaaaatgagttggagaggaacattacaatcaagcttggctatgcaaatgcaaaaatatacaagtgtgaagatgaacggtgtccaaggcctatgtcctataaggcttatgggagtggaaaggaagacactcctgtgtgtgatgtgccagggtttgaaaacagcaaaatgaaattgctgagacatgtttcttttgtggattgcccgggacatgatattctcatggctacaatgcttaacggagcagcaatcatggatggagctttgctactcattgctgctaatgagagctgcccacaaccacaaacctctgagcatttagctgctgttgaaattatgcgcctacagcacattataatccttcagaacaaggtagacctgattcaagaaaatgtcgcaatcaatcagcatgaagcaattcagaagttcatacaaggaactgttgctgatggtgcaccagtggtacctatttcagcacaactgaagtataatatagatgttgtgtgtgagtatatagtgaaaaagattccaattcccgaaaggaacttcatatctccacctaatatgattgtcattcggtcatttgatgtcaataaacccgggtttgaggttgatgacataaaaggaggtgtagctggtggaagcattctaaggggtgttttaaaggtcaatcaattcattgaagttcgacctggtatagttgttaaagatgagaatggaaatatcaaatgcacacccatatactctagaatagtctcactgtttgctgaacaaaatgagcttcagtttgctgtgcctggaggactcattggtgttgggacaacaatggaccccactttgacacgtgcggatagattggtagggcaagttcttggagcagttggatcattgccagaagtttttgttgaacttgaggtgaattttttcttgcttaggcggcttctaggtgtccgaacaaaaggcactgagagacagggaaaggtatctaaactggctaaaggagagatgctaatgttgaacataggatcaatgtcaactggggccagagttgttgctgtgaagaatgatttggccaagttgcaacttacttcccctgtatgcaccagcaagggtgagaagatcgcacttagtcgacgtgttgagaagcattggcgtcttatcgggtggggtcaaatccaagcaggaatcactcttgatgttcctagtgctcccttttcagctgaagacataatagaatagacaaaaaaacaagaaacacctgctacaaaatcacaagaggagtttagaaatgtgggaagggagacaattgttgggaaccatatttttgaggtggagaagaaaacatttgaattgtccaatttttgttgttatttgctttttatgcccttgtctatctactatataagttgtactttgtgtcaattgagtttatttatattggggtaagcatatcaaccagtacttgctactttccatggttgcattacctcaccaataagggttattgttccggcatattatatggtgttgcattcatttggattacattttttgaagagtcaattatgattaaataatgaatgatgcattaatagtgtatagaattcatacactgtcagtgtacatatagtaaataacatattagcataagattctataaatactcatgcatgtttgagtttatggaagggtctgagtgtcaaggtgggcctgattaatgatgggtgagggaccaaccttatctatctttt

SEQ ID NO: 2548 - DNA, 3218 bp, Brassica oleracea
tctgttcttgctccagctgcgccgcttcctcacactctctgcgtcgctcaggtttgtttcgatctccacacgcttcttcttaggagaaatgaagtcaagagattccttccgctctcccgttctgttgtaggaacttcacatagatcagtgggaatctaattgtaaagttgtagattgggaatccaattggttttgatatttaggagccgtcacaatgtcacggaacaagggtttggcggagcaggatcttagtaaattggatgtgactgtgcttcatcctctgtctcctgaggtcatttctcgccaggctactatcaacattggaaccattgggcatgtcgctcacggaaagtccactgttgtcaaagctatatctggtgtgcagactgtccgttttaagaatgaactggagcgtaatatcaccattaagcttggatatgcaaatgccaagatttacaaatgcgaggatgacaaatgccctagacctatgtgctacaaggcatatggaagtggaaaggaagacaacccactttgtgatgtccctggatttgaaaactccaagatgaaactattgaggcatgtttcattcgtggattgcccgggacacgatattctcatggcgactatgctcaacggagcagccatcatggacggtgcactgcttcttatcgctgcaaatgaaagctgtccgcaaccacaaacatccgagcatctcgctgcagttgagattatgcagctcaagcatatcataatccttcagaacaagatcgatcttatccaagagaacgttgccattaatcagcacgaggccattcagaaatttataatgaacactgtcgcagatggggccccaatactccctgtatcagcccaactgaaatacaacatcgatgttgtatgcgagtacattgtcaagaagatcccaatccctaagaggaatttcatctcaccaccaaatatgattgtgatccggtcttttgatgtcaacaagcccgggtttgaggttgatgagattaaaggtggagttgcaggtggaagtatcctacggggtgttttgaaagtgaaccagttaattgagatccgacctggaatcgttgtgaaagacgagcgtggcaacccgaaatgcactccaatatactcccgcattatttcactatacgcggagcagaacgagcttcagtacgcagtgcctggaggtctaattggagtaggaacaacgatggacccaactcttactcgtgctgatcgtttggtcggtcaagtccttggtgaaataggctccctacctgatgtctttgttgaactcgaggtgaacttctttcttctacggagactgttgggagtgagaataaagggatcagagaaacaagggaaagtgacgaagctaacaaagggagagattctgatgctcaacattggttccatgtcgacgggagccaaagttgttggagtaaagaacgatctggctaagctgcagctcactgctcccgtttgcaccagcaaaggagagaaagtggctttgagcaggcgtgtggagaagcattggcgtttgattggttggggtcagattcaagctggaaccaccattgaagtgcctccttcacctttctgagcttgaacatttttattaaaccctcaaaaagataatacaaactctttcttgttcatgtggggaagagtgcctattagtttaatctgtttctgtgtgtgtgtttttttctttctttcttagatggttattaaatttttgttatcatgtttttactgggaattttaattaaccaaaaaatgtagaacatggttcaatctgtggaccaacggtcgcttctagaccggattggtttgttcggttaaatcagatgaattattattttattgttttaaagccttctccactctataaaccctattagaaaagcagattcagaagaaaaaaatcaccagattttctcttcgattcgtcttctttggcggttctcgaatagtgatatggcggagagaggagtggaatcagggtctaacggtggagaagctgagaagtctctaaaggagaaagggaacgagttcttcaaagctgggaactacctgaaagccgcagctctctacactcaggccatcaagctcgatccttctaacgctactctttacagtaaccgagctgctgcgttcttgagtcttgttaagcttagcaaagccttggctgatgctgagactaccatcaaactcaaccctcaatgggagaaggggtacttcaggaaaggatctgtgcttgaagccatggaaaaatatgatcatgccttggctgcgtttgaaatggctctacagtacaacccacagagcgcagaagtttcaaggaagatcaagaggctcggtcagctgcagaaggagaaacagagagctcaagaactcgagagtttgagatctaacgtcaacatggccaagcatcttgacagctttaaatctgaattgtctgcaaactatggagctgaagagggttggaaagagatgttctcttttcttgttgagactatggaaacagctgtcaagtcgtggcacgaggcatctaaagtggataccagagtctatttccttcttgacaaagagaaaacacaaaccgataagttcgcaccagcagtcaacatcgataaggcttttgagtcaccacacactcacagtaactgctttacatatctgaggcaatacgcagaagagtccttttccaaagctgcttgcttagtgacatcaaaaagtagcatatcctacccacaggtgtggaaaggtcaaggctcaaggaagtggaagctcggacaaaacgatggaatctttgttcagttcgagtctccgtctattcgaaatgtttggttcattcctagctcgaaagaaaaggggcaaaccttatgcagggatcctcaagctctagatatcggtgcacatgagattctccctcgcatcttcaaggaagtatcgaagagctcgtagtgcattgttttattgcagtttgattctctactctctatccagtttttgatcaatactgaagaaaaaaaaggagtttcttgtgtgtttgtgctactcagacaacccacccacctgtgttgtttcttgtttaagagctttttgttttatgtcttgaagtgtgaaaatccaatgttaacgtccaatattcatcattgacatcaacacaaccgtatggtttgttaagttttaggtagaaatgc

SEQ ID NO: 2549 - DNA, 1765 bp, Brassica rapa
atcataaggggaaaaaagaagaaacgcaacaaccctaaaaaaaccttgagcatcaccatctcttgttatcttcgtcgtcgtcgtcttcatcctcttacctgcgccgctttctcactcaggagaagaaaacctctgataatggcgaggaacaagggcttggcggagcaagatcttagtaaattggatgtgactgtgcttcatccgttatcccctgaggtcatctctcgccaggctactatcaacattggaaccattgggcatgtcgctcacggcaagtccactgttgtgaaagctatttctggtgtccagactgttcgttttaagaatgagttggagcgtaatatcactattaagcttggatatgcgaacgccaagatttacaagtgcgaggatgataaatgccctagacctatgtgttacaaggcttatggaagtggaaaggaagacaccccgaattgtgatgtccctggatttgagaacgccaagatgaaactattgaggcatgtgtcgttcgttgattgcccgggacacgatattctcatggcgactatgcttaacggagcagccatcatggatggtgcactgcttctcatcgctgcaaacgaaacttgtccgcaaccacagacatccgaacatcttgctgctgttgaaattatgcaactcaagcatattatcatccttcagaacaagattgatcttattcaagagaacgttgccatcaaccagcacgaggccattcagaaatttataatgaacactgtcgcagatggtgccccaatcgtcccagtgtctgcacaactgaaatacaacatcgatgttgtgtgcgagtacattgttaagaagatcccaatccctaagaggaacttcgtgtccccaccaaatatgatagtgattcggtcttttgatgtcaacaaacctgggtttgaggttgatgacattaaaggtggagttgctggtggaagtatcctccggggtgttttgaaagtgaaccaattgattgagatccgacctggaattgttgtgaaagacgagcgtggcaacccaaaatgcactccaatttactcccgcatcatttcactctacgccgaacagaacgagcttcagtttgccgttcctggaggtctaattggagttggaacaacaatggacccaactcttactcgtgctgatcgtttggttggtcaagtccttggtgaaatcggttcccttcctgatgtctttgttgaacttgaggtgaacttctttcttctacggcgattgttgggagtgagaacaaagggatcagagaagcaagggaaagtgtcaaagctaacaaagggagagattctgatgctcaacattggttccatgtcgactggagccaaagttgttggagttaagaacgatctggctaagttgcagctgaccgcgccggtgtgcacgagcaaaggagagaaagtggctctgagcaggcgtgtggagaagcattggcgtttgataggttggggtcagattcaagctggaaccaccattgaagtccctccttcacctttctgaggtgtgttgtcttaattttcatgttgggttttttttggagagtacctatctgcggatatacatttgttactagtttactcttgtttgggttttttctttcttagatgtttatcacattttttggtctcatgttttattaacttctctgtttaattatacgctgggaatttcaggatgaccggtgaagtttacagaaacgattttaaaaatattttaaatttgttctctt

SEQ ID NO: 2550 - DNA, 1726 bp, Brassica napus
gaaaagaagaaacgcaacaaccctaaaaaaaccttgagcatcaccatctcttgttatcttcgtcgtcgtcgtcttcatcctcttacctgcgccgctttctcactcaggagaagaaaacctctgataatggcgaggaacaagggcttggcggagcaagatcttagtaaattggatgtgactgtgcttcatccgttatcccctgaggtcatctctcgccaggctactatcaacattggaaccattgggcatgtcgctcacggcaagtccactgttgtcaaagctatttctggtgtccagactgttcgttttaagaatgagttggagcgtaatatcactattaagcttggatatgcgaatgctaagatttacaagtgcgaggatgataaatgccctagacctatgtgttacaaggcttatggaagtgggaaggaagacaccccgaattgtgatgtccctggatttgagaacgccaagatgaaactattgaggcatgtgtcgttcgttgattgcccgggacacgatattctcatggcgactatgcttaacggagcagcaatcatggatggtgcactgcttctcatcgctgcaaacgaaacttgtccgcaaccacagacgtccgaacatcttgctgctgttgaaatcatgcaactcaagcatatcatcatccttcagaacaagattgatcttattcaagagaacgttgccattaaccagcacgaggccattcagaaatttataatgaacactgtcgcagatggtgccccaatcgtcccagtgtcagcacaactgaaatacaacatcgatgttgtgtgcgagtacattgtcaagaagatcccaatccctaagaggaacttcgtgtccccaccaaatatgatagtgattcggtcttttgatgtcaacaaacctgggtttgaggttgatgacattaaaggtggagttgctggtggaagtatcctccggggtgttttgaaagtgaaccaattgattgagatccgacctggaattgttgtgaaagacgagcgtggcaacccaaaatgcactccaatttactcccgcatcatttcactctacgccgaacagaacgagcttcagtttgctgttcctggaggtctaattggagttggaacaacaatggacccaactcttactcgtgctgatcgtttggttggtcaagtccttggtgaaatcggttcccttcctgatgtctttgttgaacttgaggtgaacttctttcttctacggcgattgttgggagtgagaacaaagggatcagagaagcaagggaaagtgtcaaagctaacaaagggagagattctgatgctcaacattggttccatgtcgactggagccaaagttgttggagttaagaacgatctggctaagttgcagctgaccgcgccggtgtgcacgagcaaaggagagaaagtggctctgagcaggcgtgtggagaagcattggcgtttgataggttggggtcagattcaagctggaaccaccattgaagtccctccctcacctttctgaggtgtgttgtcttaattttcatgttggggtttttttgagagtacctatctgcggatatacatttgttactagtttacccttgtttgcgttttttctttcttagatgtttatcacattttttggtctcatgttttattaacttctctgtttaattatacgctgggaatttcagtatgaccggtgaagtttacagaaacgattt

SEQ ID NO: 2551 - DNA, 1914 bp, Medicago truncatula
gcaaccttgattcgacactaactcactctctctctccgcttatcgccttttgctgccaccttctgcttgcttacacctccgcaccgcacctttcttcttctttcaggtagtttagcattaaacagtgtccgctcataaattcattccatcacacaattgaagtttctattggaagcagccaaaatgtcgcggaagggtttgatggaacaagacttgagtaaattggatgtaacaaaattgaatccactttctcctgaagtcatatctcgtcaggctaccattaatattggtactattggtcatgtggcacatggcaaatcaacagttgtgaaagcaatatcgggtgttcagactgtgcgtttcaaaaatgagttggagcgtaacattacaatcaagctgggctatgcaaatgcaaaattatataagtgtgaagatgaacgatgtccaaggcctatgagctacaaggcttatggaagtggaaaagaagataatcctatgtgtgatgtggcagggtttgaaaactgcaagatgaaattgctgagacatgtttcttttgtcgattgccccggtcatgatattctcatggctacaatgcttaatggagcagctattatggatggagctttgctactcatagctgctaatgaaagctgtccacaaccacaaacctccgagcatttagctgctgtggaaattatgcgtcttcagcacatcataatccttcagaacaaggtcgacctaattcaagagaatgtagctatcaaccagcatgaagcaattcagaggtttatagaaggaacggttgctgatggtgcaccagtggtacctatttctgcccaattgaagtataatattgatgctgtgtgtgaatatatcgtgaaaaagatcccaatccctgaaaggaactttgtttctccgcctaatatgatagtgattcggtcctttgatgtcaataaacctggttttgaggttgatgaaataaaaggaggtgtagctggtggaagcattctgaggggtgttttgaaggtcaaccaattcattgaagttcgacctggtatagttgttaaagatgaggatggaaatatgagatgcacacctatatactctagaatagtttcattgtatgctgaacaaaatgagcttcaatttgctgtgcctggaggccttattggtgttggaacaacaatggatcccactttgacgcgtgctgacaggttggtggggcatgttcttggagaggttgggtcactgcccgaggttttcgttgagcttgaggttaactttttcttgcttcgacggcttcttggtgtccgaacaaaaggatccgagaaacaggggaaggtagctaagctgactaaatcagaaatactaatgttgaacataggatcaatgtcaactggtgcgaaagtaactgctgtgaagaatgacttggcaaaattgcaacttacatctcctgtgtgcactagcaagggtgagaagattgcactcagtcgacgtgttgagaagcattggcgtcttattgggtggggtcaaatccaagctggaatcactctcgaagtccctcctacacccatcttgaattgaagacagacaagaaagagaaagagaaagagaagagacaagactacaagaaagcgccttttttttaattaaaacgtgagagatggatttagatatgtgggaaggtagacaatttttgggaaccatttttgtgagatggagaagaaaacatttgaattgtcagtttttgtgtatgcgttgtgaattacttgttattttctatactgtcaacctatttttgaagttttatctaatactgattttgtttagaccaagaactagcgttcattgtttagcaagccctgtttcattccacggttaccttaccattaccctgtattggttcggtatgtg

SEQ ID NO: 2552 - DNA, 2039 bp, Populus trichocarpa
cagccatggtcgcacaccgatccattataccaccggagcgtcaaaattacccttacatccaattcaaaataacagcaaacccacctactcaaacccgaaattaaaaagaaaaaggaaaaaaagaacatcgtctctgcgcccactgaaaccctagctacccacatcgccgcgtgttccatctctacagcaaacagagtcgcagaaaagaggttttgcgattcgtttgagaaggaatcagttgaagcaggggggaatcaagatggcgcggaaaggcttgatggaacaagacttgagtaaattggatgtgacgaagttgcatccactctctcctgaagttatatcgcgtcaggccactattaatataggtactattggtcatgtggcgcatgggaagtctactgttgtgaaagcaatttctggtgttcagacagttcgttttaaaaatgagttggagcgtaatattacaataaagctcggatatgcaaacgcgaagatatacaagtgcgaagatgagcggtgtcctcggccaaagtgctacaaggcatatggaagtggaaaggaagataatcctgtgtgtgatgtagatcccaaacactgcaggatgaatttgctgagacatgtctcttttgttgattgcccgggtcatgacattctcatggctactatgcttaatggagcagcaattatggatggagctttacttctcattgctgcgaatgagagctgtccccaaccacagacttctgaacaccttgctgctgttgaaatcatgcgtctccaacatattataattcttcaaaataaagtggatcttattcaggaaaatgcggccataaaccagcatgaagctattcagaaatttattcagggaactgttgctgatggtgcaccagtagtgccaatttctgctcagctaaagtataacatagatgttgtgtgtgagtacatcataaaaaagatcccgattccagagaggaactttacctcaccacctaacatgattgtgattcgatcttttgatgtaaacaagcctggatatgaggttgatgagataagagggggcgtggctggaggaagcatcttcaggggtgtcttgaaggtcaatcaatttattgagatccgtcccgggatcattgttaaagatgatgctgggaacatgaaatgcaccccaatatatactagaatagtatcattgtatgctgagcagaatgagctacaatttgctgtgcccggaggtctcattggtgttggcacaaccatggaccccactctgacacgtgcagataggttggtgggtcaggttcttggtgatgttggatctcttcctgaaatttttggtgaacttgaggtgaatttcttccttttgagacggcttattggtgtcaggacaaagggttcggagaagcagggaaaggtatcaaaactgacgaagggagagattcttatgctgaacatcgggtcaatgtcatctggggctcgagttattgctgtgaagaatgatttggcaaagctacaactgacttccccagtctgcaccagcaagggtgagaagattgcattgagccgccgagtggagaagcactggcggctcattgggtggggtatgattcaagctggaaccaccattgaagttccaccctgccctctctgagtgttttttgaacaggtagaccagctagagaaaagcagtaaaaccaggataagacaggattatctaatatgtgggaagggaggcaattgcttggatcaatttttttccggtggcgaagaaaacatgctgcgatgaatggctcatctcattgtctgtgttttgtttttttctttaatattccaatttttaaccgcgagtcattttggatcatactagtgatccgtgctccaccaccgtgggcaggataatttttttctaaccttaaaagtaaagacgctaggaagaaatttttttgatgcgtactgaacaacttctaaaaatgacattttattaaaagaaatattataacaatgacacccaggattcacatgtatcaattatggataac

SEQ ID NO: 2553 - DNA, 1989 bp, Picea glauca
tggttattagtcccatcccactgaagagaaagtcctctttctgctctgggtgtattttgcaataggtttctcgtcttcttcggcacccattgctgcacccacatagccaatccaatcccattctttggaaaaatcagagcagacggcggaggaagagcaagaagtgaaggtgcccacatatcttctgataaactttgaacagcaagcatttcgtctcatctgtgcagacagatctgcagtcccgatactctctgcatctaaattcattttgtgagggcttatcatccatcaagtgccaaaaatgtcgaaaaaagggttaatggagcaggacctaaacaagctggatgttaccaagttgaatccgctttctccagaggtcatttctcgtcaggctacaataaacataggtacaattgggcatgtggcacatgggaaatcaacagttgttaaagcaatatctggtgtccagacagttcgtttcaagaatgaactggagcgaaacatcactattaagctgggatatgctaatgcaaaaatatataaatgcgaagatgatcgctgccctcgaccaatgagctacaaggcatatggaagtgggaaggaagatagtcctttgtgtgatgtcactggatttgacaacactcgtatgaagcttttaagacatgtgtcttttgttgattgtccgggtcatgatattctcatggctactatgctcaacggtgcggctatcatggatggggcactgcttttgattgcaggcaatgagagctgtcctcaacctcaaacttcagagcatcttgctgctgtggagatcatgcgtcttaagcatataattattttacaaaacaaaattgaccttatccaggagagtgtagctatcaaccaacatgaggcaattcagaagtttattcagggtaccattgcggatggagcacctgtagtaccgatatctgcacaactgaaatacaacattgatgttgtctgtgaatacatagtaaacaagattcccattccagagcggaattttgttgatccacccaatatgattgtaatcagatcttttgatgtgaataagcctggtgctgaagttgatgaaataaaaggaggtgttgctggtggaagtatactgaagggtgtgttgaaagtgaatcaaaaaattgaagttcgccctggcattgttgtcaaagatgaaaatggtaacatcaagtgtacacctatcttttcaagaataatttcactttatgctgagcaaaatgagttgcagtttgctgttcctggaggccttattggtgtgggtacaacaatagaccccacactaacacgtgctgacaggcttgtggggcaagtccttggagaagttggagaactacccgatatatttgttgagcttgaggttaactttttcctcctgcgtcgacttctgggagttaggacaaaggggacagaaaaacaggggaaggtttccaagctggccaagggagaagttttgatgcttaatattggttcaatgtccactggagctcgggtgcttgctgtgaaaaatgatcttgcaaagctccaacttacttctccagtctgcacaagtaaaggagaaaagatggcacttagtaggcgagtggaaaagcattggcgattgataggatggggtcaaattcaagctggagcaatgctggaaattccccaagggtccatataagatggtgaataaacaaagcaaattatatttgagaaaagaaaaagggtatttcagtaaaggaagaatgtggatagggagagaattactaggaacaatttttgttaggtggagaagaaaacctattgggctgatctttttttggtgttttggttgttgtaaaatcatttttatgaaaattgaacacctagattatatatttatcctcgtcttatttttacataactttttagtattggttttagactgagctcatttacagaacattataattttcaggtttttagatttcacta

SEQ ID NO: 2554 - DNA, 1382 bp, Vinca minor
cgaaaagggttgacggagcaggatctaagcaagctggatgtgacgcaactgcatccactttcacctgaagttatttctcgtcaggccacaattaacattggcacaattggccacgtggcacatgggaagtccactgttgtcaaagccatctctggtgttcagactgttcgtttcaagaatgagttggaacgtaatattacgataaagcttggttacgccaatgcaaagatatacaaatgcgaggatgaaaaatccccccgacccgcatgctataaggcttatggaagcggaaaagaagatagtccactatgtgatgtacctggttttgagaactcccggatgaaattgttgagacatgtttcttttgttgattgtcctgggcatgatattctcatggctacaatgcttaatggagctgcaattatggatggagctttacttcttatagctgccaatgaaagttgcccgcaacctcaaacatctgaacatttagctgctgttgagattatgcgtctccaacatattataattcttcaaaacaaggttgatctggttcaagaaaatgtagccatcaatcaaaatgaagccattcagaattttataaagggaaccgttgcagatggtgcaccagtcgtacctatttctgcacagctgaagtataacattgatgtcgtttgtgaatacattgtgaaaaagattcctattccagaaaggaacttcatttcaccacctaatatgattgttatccgctcttttgacgtcaataagccaggatttgagattgatgatattagaggtggtgttgctggtggaagcatactcaagggtgttctgaaggtaaatcagcacatagaggttcgccctggcattgttgtcaaggatgagaaaggcaacatcaagtgcactccaatatactctagaatagtttctttgtatgccgagcagaacgaactacaatttgcagtcccaggcggtcttattggagttggtacaacgatggaccccacactcacccgtgctgatagattggttggacaagtccttggtgaggttggatccttgcctgaagtttttgttgaacttgaggtgaacttctttcttctaaggagacttctcggtgtgaggacaaaagacaccgaaaagcagggtaaagtctctaagctagcaaagggtgagatcctaatgttgaacattggatctatgtcaacaggagcacgtgttgttgcagtcaagaacgtctttgcaaaactgcaactcacctcccctgtatgcaccagcaagaacgagaaaatcgctctcagcagaaggatcgagaagcactggcgtctcattggttggggggcaatccaagccggtgttactcttgatgtcccaccctgccc

SEQ ID NO: 2555 - DNA, 1692 bp, Brassica oleracea
gtcgtcttcttccctctctacctgcgccgctttcttactctctccaaatctctctccctaccaaaagaatcgttcctcttcgcatcgctcaggagaataaagaactttggataatcaatctcgctatggctcggaacaagggattggcggagcaagatcttagtaaattggatgtggctgtgctgcatcctctgtcccctgaggtcatttctcgccaggctactatcaatattggaaccattggacatgtcgctcacgggaagtccactgttgtcaaagctatttctggtgtgcagactgttcgttttaagaatgaattggagcgtaacatcacgattaaacttggttatgcgaatgcaaagatttataaatgcgaggatgacaaatgccctagaccaatgtgctacaaggcatatggaagtgggaaagaagacagtccaaattgtgatgtccctggatttgagaacgctaagatgaaactgttgaggcatgtgtcgttcgtggattgcccggggcacgatattctcatggcgacaatgctcaacggagcagctatcatggacggtgcgctacttctaatcgctgcaaatgagacctgtccgcaaccgcaaacttctgaacatcttgctgctgttgagattatgcagctgaagcatatcataatcctccagaacaagattgatctcattcaagagaacgttgccattaaccagcacgaagcaattcagaaatttataatgaacactgtcgccgatggtgcgcctattgtccccgtctcagcacaacttaagtacaacatcgatgttgtatgcgagtacattgtcaagaagatcccaatccctaagagaaattttgtgtcaccaccaaacatgatagtgattcggtcttttgatgtcaacaagcctgggttcgaagttgatgacattaaaggcggagttgcaggtggaagtatcctccggggtgttttgaaggtcaaccaattaatcgagatccgacctgggattgttgtcaaagacgagcgtggcaacccaaaatgcactccgatctactctcgcatcatttcactctacgcagaacagaacgagcttcagtatgcagttcccggaggtctaattggagttggaacaacaatggacccaacacttactcgtgctgatcgattggttggtcaagtccttggtgaaatcggttcccttcccgatgtctttgttgaactcgaggtgaacttctttcttctacggcgactgttgggagtgagaacaaagggatcagagaagcaagggaaagtgtcgaagctaacaaagggagagattctgatgctcaacattggttccatgtccactggtgccaaagttgttggagttaagaacgatctggctaagttgcagttgaccgcgcctgtatgcaccagcaaaggagagaaagtggctctgagtaggcgtgtggagaagcattggcgtttgattggttggggtcagattcaagctggaaccaccattgaagtacctccttcacctttctaagatgttgtcgtcttcttttttttctttctgaaaaagtttattaacccctcaagagacaataaaactcttttttttctgtcatgttgtggggtggttttggagagttgcggattgatttgttactagtaacagcgtccaaataacatttattacacaaaataaaaaacat

SEQ ID NO: 2556 - DNA, 1551 bp, Brassica napus
agccgtcacaatgtcacggaacaagggtttggcggtgcaggatcttagtaaattggatgtgactgtgcttcatcctctgtctcctgaggtcatttctcgccaggctactatcaacataggaaccattgggcatgtcgctcacggaaagtccactgttgtcaaagccatatctggtgtgcagactgttcgttttaagaatgagttggagcgtaacatcaccattaagcttggatatgcaaatgctaagattttcaaatgtgaagatgataaatgccctagaccaatgtgctacaaggcatatggaagtggaaaggaagacaacccactttgtgatgtccctggatttgaaaactccaagatgaaactattgaggcatgtttcattcgtggattgcccgggacacgatattctcatggcgactatgctcaacggagcagccatcatggacggtgcactgcttcttatcgctgcaaatgaaagctgtccgcaaccacaaacatccgagcatctcgctgcagttgagattatgcagctcaagcatatcataatccttcagaacaagatcgatcttatccaagagaacgttgccattaatcagcacgaggccattcagaaatttataatgaacactgtcgcagatggggccccaatactccctgtatcagcccaactgaaatacaacatcgatgttgtatgcgagtacattgtcaagaagatcccaatccctaagaggaatttcatctcaccaccaaatatgattgtgatccggtcttttgatgtcaacaagcccgggtttgaggttgatgagatcaaaggtggagttgcaggtggaagtatcctacggggtgttttgaaagtgaaccagttaattgagatccgacctggaatagttgtgaaagacgagcgtggcaacccgaaatgcacaccaatatactcacgcattatttcactgtacgcggaacagaacgagcttcagtacgcagtgcctggaggtctaattggagtaggaacaacaatggacccaactctaactcgtgctgatcgtttggtcggtcaagtccttggtgaaataggctcccttcctgatgtttttgttgaactcgaggtgaacttctttcttctacggagactgttgggagtgagaataaagggatcagagaaacaagggaaagtgacgaagctaacaaagggagagattctgatgctcaacattggttccatgtcgacgggagccaaagttgttggagtcaagaacgatctggctaagctgcagctcactgctcccgtttgcaccagcaaaggagagaaagtggctttgagcaggcgtgtggagaagcattggcgtttgattggttggggtcagattcaagctggaaccaccattgaagtgcctccttcacctttctgagattgaacatttttattaaaccctcaaaaagataatacaaactctttcttgttcatgtggggaagagtgcctattagtttaatctgtttctgtgtgtgtgtttttttctttctttcttagatggttattaaatttttgttatc

SEQ ID NO: 2557 - DNA, 1569 bp, Brassica napus
tcgctcaggagaataaagaactttggataatcaatctcgctatggctcgaaacaagggattggcggagcaagatcttagtaaattggatgtggctgtgctgcatcctttgtcccctgaggtcatctctcgccaggctactatcaatattggaaccattggacatgtcgctcacgggaagtccactgttgtcaaagctatttctggtgtgcagactgttcgttttaagaatgaattggagcgtaacatcacgattaaacttggttatgcgaatgcaaagatttataaatgcgaggatgacaaatgccctagaccaatgtgctacaaggcatatggaagtgggaaagaagacagtccaaattgtgatgtccctggatttgagaacgccaagatgaaactgttgaggcatgtgtcgttcgtggattgcccggggcacgacattctcatggcgacaatgctcaacggagcagctatcatggacggtgcgctacttctaatcgctgcaaatgagacctgtccgcaaccgcaaacttctgagcatcttgctgctgttgagattatgcagctgaagcatatcataatcctccagaacaagattgatcttattcaagagaacgttgccattaaccagcacgaagcaattcagaaatttataatgaacactgtcgccgatggtgcgcctattgtccccgtctcagcacaacttaagtacaacatcgatgttgtatgcgagtacatcgtcaagaagatcccaatccctaagaggaattttgtgtcaccaccaaacatgatagtgattcggtcttttgatgtcaacaagcctgggttcgaagttgatgacattaaaggtggagttgcaggtggaagtatcctccggggtgttttgaaggtcaaccaattaatcgagatccgacctggaatcgttgtgaaagacgagcgtggcaacccaaaatgcactccgatctactctcgcatcatttcactctacgcagaacagaacgagcttcagtatgcagttcccggaggtctaattggagttggaacaacaatggacccaactcttactcgtgctgatcgattggttggtcaagtccttggtgaaatcggttcccttcccgatgtctttgttgaactcgaggtgaacttctttcttctacggcgactgttgggagtgagaacaaagggatcagagaagcaagggaaagtgtcgaagctaacaaagggagagattctgatgctcaacattggttccatgtccactggtgccaaagttgttggagttaagaacgatctggctaagttgcagttgaccgcgcctgtatgcaccagcaaaggagagaaagtggctctgagtaggcgtgtggagaagcattggcgtttgattggttggggtcagattcaagctggaacgaccattgaagttcctccttcacctttctaagatgttgtcgtcttccttttttcttctgtaaaaagtttcttaaccctcaagatacaataaactctttactctgtcatgttgtggggtgtttggagtagttacctacctatttgcggtattaattgttact

SEQ ID NO: 2558 - DNA, 1839 bp, Trigonella foenum-graecum
cccgacccgcagccttgattcgatactcacagtccgcttatcactttcactgccacctcctgcttgcttgcacctccgcactctgcacctttcttcttctttcaggtagtttagcattttacagtgtcaggttataaattctttccatcacgcaattgaagtttccataggaagcagccaaaatgtcgcggaagggtttgatggaacaagacttgagtaaattggatgtgaccaaattgcatccactttctcctgaagtcatatctcggcaggctactattaatattggcaccattggtcatgtggcacatggcaaatcaaccgttgtgaaagcaatatcgggtgttcagactgtgcgttttaaaaatgagttggagcgtaacattacaatcaagcttggctatgcaaatgcaaaaatatataagtgtgaagatgaacgatgtccaaggcctatgagctacaaggcttatggaagtggaaaagaagataatcctatgtgtgatgtcgtagggtttgaaaactgcaagatgaaattgctgagacatgtttcttttgtcgattgcccgggtcatgatattctcatggctacaatgcttaatggagcagctatcatggatggagctttgctactcatagctgctaatgaaagctgtccacaaccacaaacatctgagcatttagctgctgtggaaattatgcgtcttcagcacatcataatccttcagaacaaggtcgacctaattcaagagaatgtggctatcaatcagcacgaagcaattcagaagtttatagaaggaacggttgctgatggtgcaccagtggtacctatttcagcccaattgaagtataatattgatgctgtgtgcgagtatctcgtgaaaaagatcccaatccctgaaaggaacttcatttctccacctaatatgatagtaattcgctcctttgatgtcaataaacctggttttgaggttgatgaaataaaaggaggtgtagctggtggaagcattctgaggggtgttttgaaggtcaaccaattcattgaagttcgacctgggatagttgttaaagatgagggtggaaatatgcgatgcacacctatatactctagaatagtttcattgtatgctgaacaaaatgagcttcaatttgctgtgcctggaggcctaattggtgttggaacaacaatggatcccactttgacgcgtgctgacagattggtagggcatgttcttggagaggttgggtcactgcccgaggttttcgttgagcttgaggtaaactttttcttgcttcgacggcttcttggtgtccgaacaaaaggatccgagagacagggaaaggtagctaagctggctaaagcagaaatgctaatgttgaacataggatcaatgtcaactggtgcgagagtaattgctgtgaagaatgacttggcaaaattgcaacttacatctcctgtgtgcactagcaagggtgagaagattgcactcagtcgacgtgttgagaagcattggcgtcttattggatggggtcaaatccaagctggaatcactctcgacgtcccccctgcacccatcttgaattgaagacagacaggaaagagaaagagaacttagagaagagacagactacaagaaagcacttttttttttaaaacgtaagagatgaatttagatatgtgggaaggtagacaatttttgggaaccatttttgtgagatggagaagaaaacatttggattgtcaattttcttttcgcattttaatttacttgttattttccttactgtcaaccttattttgtaagttttatttaatgctgattgtgtttagacacaaaaaaa

SEQ ID NO: 2559 - DNA, 1594 bp, Vinca minor
taaggtcacgagaatctttccaacttagagccactccgtcctcactgaattttgaaacatttcatactttactgaagccaaaattaaccacggaacagaaaaatgtctcgaaaaggattgatggagcaggatctgagcaagctggatgtgacgcaactgcatccactctcacctgaagttatttctcgtcaagccacaattaacattgggacaatcggtcacgtggcacatggcaagtccactgttgtcaaagccatctctggtgtccagactgttcgcttcaagaatgagttggaacgtaatattacaataaagcttggttacgccaatgcaaagatatacaaatgcgaggatgaaaaatgcccccgacccgcgcgctacaaggcttatggaagcggaaaagaagatagcccactatgtgatgtacctggtttcgagaactcccgaatgaaattgttgagacatgtttcttttgttgattgtcctgggcacgatattctgatggctacaatgctcaacggagctgcaattatggatggagctttacttcttatagctgccaatgaaagttgcccgcaacctcaaacatctgaacatttagctgctgttgagattatgcgtcttcaacatattataattcttcaaaacaaggttgatctggttcaggaaaatgtagccatcaatcaaaatgaagccattcagaattttataaagggaaccgttgctgacggtgcaccagtcgtacctatttctggtcagctgaagtataacattgatgtcgtttgtgaataccttgtgaaaaaggttcctattccagaaaggaacttcatttcaccgccaaatatgattgttatccggtcttttgacgtcaataagccgggatttgagattgatgatattagaggtggtgttgctggtggaagtatactcaagggtgttttgaaagtaaatcagaacattgaggttcgtcccggcattgttgtcaaggatgagaatggcaacatcaaatgcactccgatatattctaggatagtatctttgtacgcagagcaaaatgaactgcaatttgcagttccaggcggtcttattggagttggtaccacgatggaccccacactcacccgtgctgatagattggttggacaagttctcggtgagattggatccttgcctgaagtttttgttgaattggaggtgaacttctttctactaaggagactcatcggagtgaggacaaaagacaccgagaagcagggtaaagtcgcaaagctagcaaagggtgagatcctaatgttgaacataggatctatgtcaaccggagctcgtgttgttgcagtcaagaacgtctttgcaaagctgcaactcacgtctcccgtatgcaccagcaaggatgagaagatcgcactaagcagaaggatcgagaagcactggcgtctcatcggttgggggcaaatccaagctggtgttactcttgatgtcccaccctgccccatcatctaagtgtagtagtagattagaacaaatcatttactgaaaaagaagaatagatagtaaagactagagagagattttaaaaatgtgggaggggagaaaa

SEQ ID NO: 2560 - DNA, 1952 bp, Abies balsamea
ttcgggttgtccgcagcacacaaaagaaagagcccagatcatttgcgagtctttgttggccataggtttaagctttcttgggcatttgttgctgcacctatatttccattctccatttcattctgtggaaacacagaagcagatggtggaggaagaggaaaaagtggaggtggattagttttgaagagaacagcaaacttatattgttctcttactacaacattttgtgaggccttatcaagtggcaaaaatgtcgcggaaagggttgatggagcaggacctgagtaagctggatgttaccaagttgcatccactttctccagaggtcatttctcgtcaggctacaataaacattggtacaattgggcatgtggcacatggtaaatcaacagtggttaaagcaatatccggggtccagacagttcgtttcaagaatgaactggagcggaacatcactattaagctgggatatgccaatgcaaaaatctataaatgtgaagatgaccgctgtcctcgaccaatgtgttacaaggcatatggaagtgggaaggaagacagtcctctgtgtgatgctgttggatttgagaatgctcgcatgaagctcttaagacacgtgtcatttgttgattgtccgggtcatgatattctcatggctacgatgctcaatggtgcggctatcatggatggggcgcttcttttgattgctggcaatgagagctgtcctcaacctcaaacttcagagcatcttgctgctgtggaaatcatgcgtcttaaacacataattattttacaaaacaaaattgaccttatccaggagagtgtagctatcaaccagcatgaggcaattcagaagtttatccagggtaccatagcggatggagcacctgtagtaccgatatctgcacaactgaaatacaacatcgatgttgtctgtgaatacataataaacaagattcccattccagagcgtaattttgttgatccacccaatatgattgtaatcagatctttcgatgtaaataagcccggtgctgaagttgatgaaataaaaggaggtgttgctggtggaagtatactgaagggtgtgctgaaggtggatcaaaaaattgaagttcgtcctggcattgttgtcaaagacgagagtggcaacatcaagtgtatccctatcttttccagaataatttcgctttatgctgagcaaaatgagttgcagtttgctgtccctggaggccttattggtgtgggtaccacaatagatcccaccctgacacgtgctgacaagcttgtggggcaagtccttggagaagttggagagctaccagatgtgtttgttgaacttgaggttaattttttcctcctccgccgactcctgggagtgagaacaaagggtacagaaaaacaggggaaagttacaaagctggccaaaggagaggttttgatgcttaatattggttccatgtcaactggagctcgggtgcttgctgtgaagaatgaccttgccaagctccaacttacttctccagtgtgcacaagtaaaggtgaaaagatggcactcagcaggcgagtagagaagcattggaggttgataggatggggccaaatacaagctggagcaatgctggacattcccccagcatccgaataagagagtgcatggacaaacgcaattatatttgagaaaagaaaaaggcttactcgagggaaggaagaatgtggatagggagagagttactaggaactatttttgttaggtggagaagaaaatctattgaggttttgtcttttaatcaaacacctagctcatatttattctcatcctcctgattttttttattcagtgtttagcataggttttagaatgagttaaccttgctaaaatttgattgacacaccgagcataattagcacacgaacatccctggaggggttgacaaaagacaggcctgtaatga

SEQ ID NO: 2561 - DNA, 1699 bp, Ocimum basilicum
ccaagagctgccaaaatgtcgaggaagggcttgatggagcaggacctaagcaagctggatgtaactaaactaaatccactgtcacctgaggttatttctcgccaggcaacaatcaatattggcacaattggacatgtggctcatgggaagtcaaccgtcgtgaaggccatatctggtgtccagactgttcgctttaaaaatgagctagaacggaacattactatcaagcttgggtatgccaatgccaagatatacaagtgtgaagaggatcgttgcccccggcccatgtgctacaaggcatatggtagtggtaaagaagatagtccaatgtgtgatgtccctgggtttgagaacagtaggatgaaattgcttaggcatgtatcttttgttgattgcccgggtcacgatattctcatggctactatgcttaatggagcagcgattatggatggagctttacttcttatagctgctaatgagagttgtccccagcctcagacatcagaacatttagcggctgtggaaattatgcgtctccaacatatcattatccttcaaaataaagtagatcttgttcaggaaaatgttgcaatcaaccagcatgaagccattcagaagttcattgagggaactgttgcaggtggtgcaccagtggttccaatttctgctcagttgaaatataacattgatgtcgtatgtgaatatattgtgaagaaaatcccaattccagtgagggatttcacttcggcacctaatatgatcgtgatcaggtcatttgatgtcaataagcctgggtctgaagttgatgaaattaaaggtggtgttgctggtgggagtattctgaagggtgttttgaaagtaaaccagcatatcgaggtccgtcctggtattgttgtcaaggatgagaacgataacatcaagtgcacccctatatactcgagaatagtttcattgtttgctgagcagaatgaattgcaatttgctgtgcctggaggccttattggagtcggaacgacaatggaccccacacttactcgtgctgatagattggtcggccaggttcttggagaagttggttctcttcctgaagtctatgttgagctagaggttaatttctttttgctgaggcggctgctgggtgtgaggacgaaagacacggaaaggcaaggaaaggtcacaaagctggcaaaaggagagatgctaatgttgaacatagggtccatgtcaacaggagctcgtgttattgctgtgaagaacgttttcgcaaaactgcagctcacttctcccgtgtgcaccagcaagggtgaaaaaattgcactgagtagaagaatcgacaggcattggcgtctgattggctggggtcaaattcaagctggtatcactctcgacgttccatcctgcccaatctaagtgaatcgctgcatttatacatcaacgaaggcggagtaaaaaggatcataaaaccggtgagtgagatgtgggaaggcagacaactgatgggaacagtttttgctcgttggaggagaaaagattgtttggagttttggatacttgtattgtttatgatgatatttactttttggagttcatattgttctctcaggtggtttttatgcattttagatgttgagttattaacttatgaaattcttggatgcagtcaattattaaatcttattgatctgttgcatgttgagtt

SEQ ID NO: 2562 - DNA, 1735 bp, Triphysaria pusilla
cgccgtcgcacgacagctaacctcgacgtcgccgccgcaactagtcagccatctcagttatcgcctccgtcgcgatatattggctattactgattttcaagtgagcatagtaagatcaatcagactgcaatatggctgctcggaaaggattgatggagcaggacttaagcaagctggatgtaacaaaactacatccactctcacccgaggttatttcacgacaagctacaataaacattggtaccattggtcatgtggctcatgggaagtcgacagttgtgaaggccatatctggtgtccagactgttcgctttaagaatgagcttgagcgtaacattacaatcaagcttggatacgccaatgcgaagatttataaatgcgaagatgataaatgtcctcgaccgatgtgttacaaggcatatggaagtggaaaagaagatagcccaatgtgtgacgttcctggatttgagagctgtaggatgaaattgcttaggcacgtgtcttttgttgattgtccgggtcacgatattctcatggctaccatgcttaacggggcagccattatggatggagctttactcctcattgctgccaatgaaagttgccctcaacctcagacttctgaacatttagctgctgttgaaatcatgcgactcaaacacattattattcttcaaaataaagtcgaccttgttcaggaaaacgtcgctatcaaccagcatgaagccattcagaaatttattcagggaactgtagcagataatgcaccagttgtgcccatttctgcccagctgaagtataatattgatgtcgtagccgaatacattacgaagaaaattcctatcccagagaggaacttcatttcaccaccaaacatgattgttatcaggtcgtttgatgtcaataagcctggttctgaagttgatgaaattaaaggtggtgttgctggtggaagtattcttcagggtgttctgagggtaaatcaatttatcgaggttcgtcctggtattgtggtaaaggatgaaaatgataaccaaaagtgcactcctatatactcccggattgtctccttgtatgctgagcagaacgagttacaatttgctgttcctggaggtcttattggagttggaaccacaatggaccccacacttacacgtgctgataggcttgtcggtcaggttcttggagaagttggctcactccctgaagtctatattgagctcgaggttaatttcttcttgttgcgtcggcttttgggggttaggacaaaggactcagaaaggcaaggtaaggtttcaaagctggccaagggagaaatactcatgttgaacatcggatccatgtccactggggcccgcgttgttgctgtcaagaatgtctttgccaaactacatctcaccgcacctgtgtgcaccagcaaaggagagaaaattgcgctgagccgcaggatcgacaggcactggcgtctgattggctggggtgcaattcaagcaggtattactctcgaggtcccaccgtgtccggttgaggtgacccagtaagtggtggatgaaaaaagtcgaagaataggaactagagactcatgtggaaaggggtacgatttttgaggagaaaatattgttcttacaaatttgggtatttgtatttttgttgtggttttcttgtttcattttgcttttgcatattcaaggttgagtttttaactattaaatctttgtgctggtgcaatattttt

SEQ ID NO: 2563 - DNA, 1891 bp, Triphysaria pusilla
aaaagaaaaaagaatatcgcagctgtaatcttctctgccctaaactgaaaccaaaaccctaccctcactcccccaatcgccgtcgcacgacagctaaccttgacgtcgccgccgccgccactagtcagccatctcacttatcgcctccgtcgcgatatattggttattactgatttctaagggagcatagtaagatcaacctatcagactgcaatatggctgctcggaaaggattgatggagcaggacttaagcaagctggatgtaacaaaactacatccactctcacccgaggttatttcacgccaagctacaataaacattggtaccattggtcatgtggctcatgggaagtcgacagttgtgaaggccatatctggtgtccagactgttcgctttaagaatgagcttgagcgtaacattacaatcaagcttggatacgccaatgcgaagatttataaatgcgaagatgataaatgtcctcgaccgatgtgttacaaggcatatggaagtggaaaagaagatagcccaatgtgtgacgttcctgggtttgagagctgtaggatgaaattgcttaggcacgtgtcttttgttgattgtccgggtcacgatattctcatggctaccatgcttaacggggcagccattatggatggagctttactcctcattgctgccaatgaaagttgtcctcaaccacagacgtctgaacatttagctgctgttgagatcatgcgtctcaatcatatcattattcttcaaaataaagtagaccttgttcaggaaaatgttgctatcaaccagcatgaagccattcagaaatttattcagggaactgtagcagataatgcaccagttgtgcccatttctgcccagctgaagtataatattgatgtcgtagccgaatacattacgaagaaaattcctatcccagagaggaacttcatttcaccaccaaacatgattgttatcaggtcgtttgatgtcaataagcctggttctgaagttgatgaaattaaaggtggtgttgctggtggaagtattcttcagggtgttctgagggtaaatcaatatatcgaggttcgtcctggtattgtggtaaaggatgaaaatgataaccaaaagtgcactcctatatactcccggattgtctccttgtatgctgagcagaacgagttgcaatttgccgttcctggaggtcttattggagttggaaccacaatggaccccacacttacacgtgctgataggcttgttggccaggttcttggagaagttggttcactccctgaagtatatattgaacttgaggttaatttcttcttgctgcgtcgtcttttgggcgttaggacaaaggactcagaaaggcaaggtaaggtttcaaagctggccaagggagaaatactcatgttgaacatcggatccatgtccactggggcccgcgttgttgctgtcaagaacgtgtttgccaaactacatctcaccgcacctgtgtgcaccagcaaaggagagaaaatagcgctgagccgcaggatcgacaggcactggcgtctgattggctggggtgcaattcaagccggtattactctcgaggtcccaccgtgtccggttgaggtgacccagtaagtggtggatgaaaaaagtctgaagaataggaactagagactcaagggatgtggaaaggggtacgatttttgaggagaaaatattgtttcttacaaatttgggtatttgtattttttgttgtggtttttcttgtttcattttgcttttgcatattcaaggttgagtttttaactattaaatctttgtgctggtgcaatatttttcccttggttggtaaattatctggtgtggtgatttcttttagatgataattacaataactattt

SEQ ID NO: 2564 - DNA, 1837 bp, Brassica rapa
aaaataaaaaaacatagagcagcagcaccatttgttcgtcgtcgtcttcttcctcctctacctgcgccgctttcttactctcttcaaatctctcccagccaaaaagaatcgctgctcttcgcatcgctcaggagaataaagaacttcgataatcaatctcgcaatggctcgaaacaagggattggcggagcaagatcttagtaaattggatgtggctgtgcttcatcctctctctcctgaggtcatttctcgccaggctactatcaatattggaaccattggacatgtcgctcacgggaagtccactgttgtcaaagctatttctggtgtgcagactgttcgtttcaagaatgaattggagcgtaacatcaccattaaacttggttatgcgaatgcaaagatttataaatgcgaggatgacaaatgccctagaccaatgtgctacaaggcatatggaagtgggaaggaagacagtccaaattgtgatgtccctggatttgagaacgctaagatgaaactgttgaggcatgtgtcgttcgtggattgcccggggcacgatattctcatggcgacaatgctcaacggagcagctatcatggacggtgcgctacttctaatcgctgcaaacgagacatgtccgcagccacaaacttctgaacatcttgctgctgttgagattatgcagctgaagcatatcataatcctccagaacaagattgatcttattcaagagaacgttgccattaaccagcacgaagcaattcagaaatttataatgaacactgtcgccgatggtgcgcccattgtccccgtctcagcacaacttaagtacaacatcgatgttgtatgcgagtacattgtcaagaagatcccaatccctaagagaaattttgtgtcaccaccaaacatgatagtgattcggtcttttgatgtcaacaagcctgggttcgaagttgatgacattaaaggtggagttgcaggtggaagtatcctccggggtgttttgaaggtcaaccaattaatcgagatccgacctgggattgttgtcaaagacgagcgtggcaacccaaaatgcactccaatctactctcgcattatctcacgctacgcagaacagaacgcgcttcagtatgcagttcctggaggtctaattggagttggaacaacaatggacccaactcttactcgtgctgatcgattggttggtcaggtccttggtgaaataggttcccttcctgacgtctttgttgaactcgaggtgaacttctttcttctacggcgactgttgggagtgagaacaaagggatcagagaagcaagggaaagtgtcaaagctaacaaagggagagattctgatgctcaacatcggttccatgtcgactggtgccaaagttgttggagttaagaacgatctggctaagctgcaactaaccgcgccggtgtgcaccagcaaaggagagaaagtggctctgagtaggcgtgtggagaagcattggcgtttgattggttggggtcagattcaagctggaaccaccattgaagtacctccttcacctttctaagattttgtcttctttttttttttctgaaaaagtttattaacccctcaagagacaataaaactcttttttttctgtcatgttgtggggtggttttggagagttgcggattgatttgttactagtaacagcgtccaaataacatttattacacaaaataaaaaacatgctagaacggtttaattcgagaagcatgatatctaactataaccacattctgcaatacttttatgttttgaaatgtggtttctgagtcaaatgctgatgactcctaatcat

SEQ ID NO: 2565 - DNA, 1676 bp, Abies balsamea
ttttgcaatacgtttcgcgtctttcttcagcacccgctgctgcacccacattgccgatccaatccaatcccattctttataaaaacagagcagaaggtggaacaggcggaagaagtgaaggtgtccacataccatctgatcagctttgaacagcaaacatttcatctcatccgtgcagacggatctgcagtccagatattctctgcatctaaactcattttgtgagggcttatcatccatcaagtgacaaaaaatgtacgaaaaaagggttaatggagcaggacctgaacaagctggatgctaccaagttgcatccgctttctccagaggtcatatctcgtcaggctacaataaacataggtacaattgggcatgtggcacatgggaaatcaacagttgttaaagcaatatctggtgtccagacggttcgtttcaagaatgaactggagcgtaacatcacaattaagctaggatatgcaaatgcaaaaatatataaatgcgacgatgaacgctgccctcgaccgatgagctacaaggcgtatggaagtggaaaggaagatagtcctttgtgtgacgttgctggatttgagaacactcgtatgaagcttttaagacatgtatcttttgttgattgtccgggtcatgatattctcatggctactatgctcaatggtgcggctatcatggatggggcactgcttttgattgcaggcaatgagagctgtcctcaacctcaaacttcagagcatcttgctgctgtggagatcatgcgtcttaagcatataattattttacaaaataaaattgacctcatccaggagagtgtagctatcaaccaacatgaggcaattcagaagtttattcagggtaccattgcagatggagcacctgtagtaccgatatctgcacaactgaaatacaacattgatgttgtctgtgaatacatagtaaacaagattcccattccagaacgagattttgttgctccagccaatatgattgtaatcagatcttttgatgtgaataagcctggtgctgaagttgatgaaataaaaggaggtgttgctggtggaagtatactgaggggtgtgttgaaagtgaatcaaaaaattgaagttcgtcctggcattgttgtcaaagatgaaagtggcaacatcaagtgtacacctatattttcaagaataatttcactttgtgctgagcaaaatgagttgcagtttgctgttcctggaggccttattggtgtgggtacaacaatagatcccacactgacacgtgctgacaggcttgtgggacaagtccttggagaagttggagagctacccgatatatttgttgagcttgaggttaactttttcctcctccgtcgcctcctgggagttaggacaaaggggacagagaaacaggggaaagtttcaaagctagccaaaggagaagttttgatgcttaatattggttcaatgtccactggagctcgggtgcttgctgtaaaaaatgaccttgcaaagctccaacttacttctccagtctgcacaagtaaaggagaaaagatggcacttagtaggcgagtagaaaaacattggcgattgataggatggggtcaaattcaagctggagccatgctggaaattcctcaagagtccatataagatagtgaataaacaaagcaaattaaa

SEQ ID NO: 2566 - DNA, 1573 bp, Pteridium aquilinum
acacgggggagagagagagagagagagagggagagggacagagatcaaagcttcggcagccatggcgaggcgcggcctgatggaacaggacctcagcaaactggatgtcaccaagctcacccctctctcacccgaggttatctcccgccaggccaccattaacattggcaccattgggcatgtggcccatgggaagtccacagtagtgaaggccatttctggagtgcagacggtcaggtttaaaaatgaactggagcgcaatattaccatcaagcttggttatgcaaatgctaaaatttatgtatgtgaagatgaaaagtgtccaagacctatgtgctacaaggcctatggaagtgggaaggaagacaccccgctctgcgatgtacctggatttgagaacgcgcgcatgaagctactacgacatgtatcttttgtggactgcccagggcacgatattctcatggcaactatgctcaatggtgcagctatcatggatggagcacttcttttgattgcaggaaatgagagctgcccacagcctcagacgtcggagcatcttgccgcagttgagatcatgaggctgaagcacataattattttgcagaacaagattgatcttgtccaagaaagcgtggctcttaaccagcatgaggcaattcagaagtttatagagggtacgattgcaggtggagctcctgtggttccaatctcagcacagttgaagtataacatagatgtcgtgtgcgaatacatagtgaacaagattcctatcccagagcgcaactttacagatcctccaaacatgattattatcaggtcttttgatgttaataagcctggtgctgaagtggatgagatcaaaggaggtgtggctggtggaagcattctaaagggtgtcttgagggtgggacagaaaattgaggtccgccctggaattgtggtgaaagacgagaataataatatcaagtgtacgcccattttttccaggataatttcactgtatgcagagcaaaatgaattgcagtttgcagttcctggtgggcttataggtgtgggtacaactgttgacccgactctgactcgggctgaccggcttgttggtcaagttttgggggagtgtggggttctcccagaggtgtatttggagcttgaggtgaatttttttctactgcgtcggcttcttggagtgaagatcaagggtgcagaaaagcaagggagggtcacaaagctcactaagggtgaagttttaatgcttaatattggatccatgtccactggtgcgcgtgttgtggcagtgaaaaatgatgttgccaagcttcagcttatgtcacccgtctgcactagcaaaggggagaaggttgctttgagtagaagggtggaaaaacattggcgtcttattgggtggggacagattcaagcaggtcacactttggacttacccccggttgcataggaagtacacaaaaaagcaaagagaggagagttacaaaagctcaaagaaagtagagtttcggaagaagcgatgtggtctggtagagagttgctaggtacaatttttgtgagatggagaaga

SEQ ID NO: 2567 - DNA, 2197 bp, Panax ginseng
ccatcagacgccgacaatacaacgagtcggtctagtaagtagccgtccgccgtcgtcgttcagtgggaggcgagtgacgtcttctagtgagtcttcgtcgggacaaccgtaacccggaaaccggaacggcggtgggggagatacaaagaaccattacaagcagtggatgggctttatatattgtttgtgggtttttttatatcttgattaatggtcgtgtgttgtttgaaacccatttactcttgatttcgtgttccctatttttgtgtttatgaaatatcttatcaataacttatgaaggtttgcttttcttttgagattctgttggaattcttttttgaaataaaaaccatgcacctacttcgtagtatgagtatatcctatcagttagttaatgtgtggatgctgaatattagttgccatctttggctatactgagaagggccaactttgtatccaagagctaaacatataatgatttagctcgtctctactttttagtttttgtttttctgtgcaattttgcctgctgttgtggttaccttatcttataaacttctttgggtattctttttgggctagttgaggcaaaatagcaatttagtataattgccttttcataataaacaacattcatggttattattataatggtgtttgtggtcttgcagaaacattgtgtttgtgatctattcaaggattccactacaactaatttcgcataattctgattctacttacaaggttgctttaatggcttctaaaagagcatccagatctagtgctagctgttccaatgacccgaaaattaataaaaatgaagataatgagacccatgtcgatgagcctcatgcagaggaggaaactattcatgagaatgatgaaggatctgagcaagctggatgtgacaaaactacatcctctctcacctgaagttatatctcggcaagctacgataaatattggaactatcggtcatgtggcacatggaaaatcaactgttgtaaaagctatatctggtgttcagactgttcgtttcaaaaatgagctggaacgaaacattaccataaagctcggatatgcaaatgcaaagatatacaaatgtgaagatgaacgctgcccacgcccgatgtgttacaaggcttatggaagtgggaaagaagatgctcccgtgtgtgatgtgcctggatttgagaactccaggatgaagttactgaggcatgtgtcttttgttgattgcccaggtcatgatattctcatggctacgatgcttaatggagccgcaattatggatggcgctttacttctcattgctgctaatgaaagttgtccccaacctcagacttcagagcacttggctgctgttgaaattatgcgtcttcaacatataataattcttcaaaataaggttgatttaattcaggaaaatgttgccattaaccagcatgaagccattcagaaatttatccagggaactgttgcagatggtgcacctgtgataccagtttctgcacagctgaagtataatattgacgttgtgtgcgaatacattgtgaaaaggatacctattccagagaggaactttatatcgccaccaaatatgattgtgatccggtctttcgatgttaacaagcctggttttgaagttgatgagattagaggtggtgttgctggtggaagtatcctcaagggtgttttgagggtcaatcaatatatagaggtgcgtcctgggattgttgttaaagatgaaagcggtaacatcaagtgcacaccgatatactctagaatagtttcactctatgcagagcaaaacgaactacaatttgctgtgccaggaggcctgattggtgttggcacaacgatggacccgactttaactcgtgctgatcggttggtaggacaagttcttggggaggttggatcacttcccgaagtgtatgttgaactagaggtcaacttcttcttgctgcgacggcttctgggtgtgaggacaaagggtacagagaggcagggaaaggtctcaaagttggcaaagggagagatacttatgttgaacattggatccatgtcaactggtgctagagttcttgcggttaagaacgatttggcaaaattgcaacttacttctccggtatgcaccagcaaaggtgagaaaattgcactgagtcggcgagttgagaagcattggcggcttatt

SEQ ID NO: 2568 - DNA, 1599 bp, Cyclamen graecum
cagcaaagagattctcaaagctgtcaagatgtcgcgaaaggggttgatggagcaagatttaagcaagctggatgtgacaacactacatccactctcccctgaagttatttctcgtcaggcaacaattaatataggtaccattggccatgtggctcatggaaaatctacagttgtgaaagcaatatctggtgttcagactgtccgttttaaaaatgagttggaacgtaacattaccataaagcttgggtatgccaatgcaaaaatattcaagtgtgaagatgatcgctgcccacggcctatgtgctacaaatcatatgggagcggaaaagaagactgccctatgtgtgatgtgcctggatttgagaactcaagaatgaagttgcttagacatgtttcttttgttgattgcccgggtcatgatattcttatggctaccatgcttaatggagctgctattatggatggggcattactactgatagctgccaacgagagttgccctcaacctcaaacctcagagcacttggctgctgttgaaattatgcggctcaaacacataattatacttcaaaataaggttgaccttattcaggagaatgttgccatcaaccagcatgaagcaataaagaaatttattgagggaactgttgctgataaggccccagttgtaccagtgtctgcacagctgaagtataatattgacgtcgtctgtgagtatattgtgaaaaagattcccatcccagaaagggacttcatctcgcctccgaatatgattgtcataaggtcttttgatgtcaataagcctgggtttgaggttgatgatatcagaggtggtgttgcaggtggaagtattctcaaaggtgttcttaaagtaaaccagttaattgaagttcggccagggattgttgtgaaagatgaaagtggcaacatcaaatgcacacccatttattctagaataatttcattgtatgctgagcagaatgaactgcaatttgctgttccgggaggtctcatcggggtgggtactactatggatcccaccttgacgcgtgctgatagattggtcggtcatgtacttggtgaggttggatcacttcctgaagttttcgttgaactcgaggtcaactttttcttgttgaggcgtcttctaggtgtgaggacgaaaggtacagagcgacagggaagagttacaaagctagcaagggcggagattctcatgttaaacataggttctatgtcaaccggtgctcgtgttgttgccgtgaggaatgatctggcgaaattgcaacttacatctccggtttgtaccagcagaggtgagaaaatcgctttgagtaggcgagtggaaaagcactggcgtttaattgggtggggccagattcaggctggtatcaccctcgatattcccccgtttgagtgaagtggagtcagcagaggttattttgcaagaaattgatatggttttgtatttgatttgaagtttgttggagtatgttgtatcttaggccgaactgtttgtttatgcgaaaatgctggatcctcttcaacattttggcaaatgagtcgtcgcaacaactttgttgtcggtagatttttgag

SEQ ID NO: 2569 - DNA, 1744 bp, Plantago ovata
cggccgggaacgctaccctaaattcttctctgtcgtcttcacttcctccggcgtccttgagcgttctccgttcgcgttttccgatcagtctctgtaacccacgaaggcaacaatatggctagaaagggcttgatggagcaggacttgagcaagctggatgtagcgcagctacatccactgtcgcctgaggtgatttctcgccaggcgacaattaatattggaaccattggccatgtggctcatggaaagtccacagttgtaaaagccatttctggtgtccagacggtacgattcaaaaatgagcttgaacgtaatatcacaatcaagcttgggtatgctaatgcaaagatatacaaatgtgaagatgatcgatgcccgcgacctatgtgctacaaggcatatggaagtggaaaagaagatagtccaatgtgtgacgtgcctggttttgagaactctaggatgaaattgctgaggcatgtgtcatttgtagattgcccgggtcacgatattctcatggctactatgcttaatggggcagccattatggacggtgctttacttcttattgctgccaatgagacatgtccccaacctcagacatcagagcacttggctgctgttgaaatcatgcgtcttcaaaacatcattatacttcaaaacaaggttgatcttgttcaggaaaatgttgccattaaccagcatgaagccattcagaaatttattgagggaaccgttgcagatagtgcaccagtggtaccaatttcagctcagctgaaatacaacatagatgtggtatgtgaatacattgtgaagcgaatccccatcccaaagagagagttcattctaccgccaaatatgattgttatccgttcttttgacgtcaataaaccaggattcgaagttgatgatgtaaaaggtggtgttgctggtgggagtattctgaagggtgttttgaaagttaatcaaaaaattgaagtccgtcctggtatagttgtcaaggatgagagtggtaacatcaagtgcacccccatatattccaggatagtttccttgtatgctgagcaaaatgaactgcaatatgctgttcctggaggacttattggagtcggaacaaccatggatcctactcttacacgtgcagataggttagtgggccaggtccttggggaggtcggttcgcttcctgaagtgtatgtagaattggaggttaatttctttttgctgcggcgactactgggtgttaggaccaaggagtcggaaaagcaggggagggtttcaaaattgggcaagggagagattcttatgctgaacattggatctatgtccactggtgctcgtgtgattgctgtgaaaaatgttttcgcaaaactgcagctcacttccccagtctgtaccagcataggagaaaaggttgcactgagccgaagaatagagaagcattggcgtctgatcggctggggtcaaattcaagccggtaaaactcttgacatcccaccgtgccccatctaagtgtgaaacacaactgcactacacaagaaacagagaggaactaagaaacactaatgggggaagacccgagtcctgctaggggcatttttgattgttggataaggaaatttattattttagactttcggatactctacttttgttctgttgattaatattcttagcatttttagcatttttatggtgggtattgtattgtgggtactaatgcatgcgtggttcgctactaggtctg

SEQ ID NO: 2570 - DNA, 2210 bp, Lupinus angustifolius
acttaaaataagaacttgaaccaacaaacacttgacagacaccaagcacactagtactctataaaatttaaacatttcactcgatttaattttcattatgcatgtaataagtgatgatattgcttactatactaatagataaaatgaatatgtaatattgtaattttctgttttctcgaattagggtttgtcatctcttacccttgccttagccacacacagtctaccgctctcacacacctcatctgcactgtccctcttcctccccgccgtacacactatttccggccacctttatccgccgtagctgccacccctccgatcaccaaagcctccagcttctttcagatagtttagcatcaaatatttgtaaagtcataaaacacttgcaaaatggcacggaagggtttgatggaacaagatctgaaaaaattggatgtgacaaaattgcatccactttctcctgaagtcatatctcggcaagctaccattaatattggcaccataggtcatgtggcacatggcaagtcaacagttgtgaaagcaatatcaggtgttcagactgtacgttttaaaaatgagttagagaggaacattacaatcaagcttggctatgcaaatgcaaagatatataagtgtgaagatgaacggtgtccaaggcctatgtcctataaggcttatgggagtggaaaggaagatgctcctatgtgtgatgcgccagggtttgagaactccaaaatgaaattgctgagacatgtttcttttgtagattgcccgggacatgatattctcatggctacaatgcttaatggagcagcaatcatggatggagctttgctactcatagctgctaatgagagttgcccacaaccacaaacctctgagcatttagctgctgtggaaattatgcggctgcagcacataataatccttcagaacaaggtagacctgattcaagaaaatgtggcaatcaatcagcatgaagcaattcagaagttcatacaaggaactgttgctgatggtgcaccagtagtacctatttcagcacaactgaagtataatattgatgtcgtatgtgagtatatcgtgaaaaagatcccaattcctgaaaggaacttcatctctccccctaatatgattgttattcggtcatttgatgtcaataaacctgggtttgaggttgatgacataaaaggaggtgtagctggtggaagcattctaaggggtgttttgaaggtcaatcaattcattgaagttcgacctggtatagttgttaaagacgagaatggaaatatcaaatgcacacccatatactctagaatagtttcgctgtttgctgaacaaaatgagcttcaatatgctgtgcctggaggcctaattggtgttgggacaactatggatcccactttgacacgtgctgataggttagttgggcaagttctcggatcagttggatcactgccagaggtttttgttgaacttgaggtaaattttttcttgcttaggcgacttctaggtgtccggacaaaaggcaccgagagacaaggaaaggtttcgaaactggctaaaggagaaatgctgatgttgaacataggatcaatgtcgaccggggccagagttgttgctgtgaagaatgatttggccaagttgcaactcacttccccggtatgcaccagcaagggtgaaaagattgcccttagtcgacgtgttgagaagcattggcgtcttattgggtggggtcaaatccaagcaggaatcactcttgatgttcctagtgcccccttttcagctgaagacataaaagaatagacaaacaagaaaacctgttacagaatcctgagtggaatttagagatgtgggaagggacatatttgttgggaaccatttttgaggtggagaagaaaatgtttggattgtccaattttttgttttacattgttatttggtttttgtctctgtctactatataagttgtatcttatgtcgattgagtttagattggagtaagaatatgaatgagtatttattactttccatgaccacattactcgccaataaattttactgctccagcatattatatggtgaggcattctttattttaagcattatatgcccaagcattttgtgaagcttttcttgtctccctattgttctactatagattggatgtctgagatttaagtacgtgaacagcttggggctggttt

SEQ ID NO: 2571 - DNA, 1958 bp, Physcomitrella patens
cttttcgtcgtcgtcgtgcaattagggtttgctgcccccacccccctcccttcgataccggcccttccgctttcctcactccccctctctctcggaggtctattctcttcatcatccttcctcctcgccccttcttgctctctttttgcttcactgtgtgtttcttgcttcgcgcaagggttcttcacagtccgcagccatggcgaagcgggggttgatggagcaggatcttagtaagctggacgtgacgacgctacatccgctgtcacctgaagttatctctcgtcaggccaccatcaatattggtacaattggccatgtggctcacgggaagtcgacagtagtgaaggccatatctggtgtgcagaccgtccgattcaagaacgagttggagaggaatatcaccattaagctgggttatgccaacgccaaaatctacaagtgtgaagatgagcgctgtcctcgacccatgagctataaagcttatgggagtgctaaggaagacaatcctctttgtgatgttcctggatacgaatctgcccgcatgaagctgttgaggcatgtctcattcgtcgattgccctggacacgatattctcatggctactatgcttaatggagctgctattatggatggtgctttacttttgattgccagcaatgagagttgcccccagccccaaacttcggagcatcttgctgccgtcgagattatgcgcttgaagcacatcatcattctccaaaataaaattgatctgattcaggaaagcgtggctattaaccagcacgagtctatccaaaaatttattcaggggacgatcgccgatggggctcctgtcgtgcccatttcagctcagctcaagtataatgttgatgtggtatgcgagtacattgtgaacaagattcctatcccagagaggaacttcgtggctcctccgaacatgatcgttattcggtcgttcgatgtcaacaagcctggtgccgaagttgacgaaatcaagggtggcgtggctggtggcagtattctgaggggagtgttacgggtggggcaaagaatcgaagtgcggcctggaatcactaccaaggacgagagtggtggaatcaagtgcacaccaattttctcgcgaatcacatccttgttcgctgagaagaatgagctccaatttgcggtgcctggtggtctaattggagtgggaacaaccattgatcctactcttactcgtgctgacagactggttgggcaagtgcttggtgaggttggggagcttcctgatgtctttgtggagttggaggtcaactttttccttcttcgaaggttgttgggtgtgcggaccaagggttcggagaagcaaggaaaggtgtccaagttgactaagagtgaggttctcatgttgaacatcgggtctatgtccacgggagctcgtgtgattgctgttaaaaacgatcttgccaagttgcaactaactactccggtctgcactagcaagggagagaaagtggctctgagcaggcgagtggagaagcattggcgtttgatagggtggggtcaaattcaagccggagtcgttattgacattccacaaacagcgtagagcagagacatttgtgataattagtaatttgatatctgaaattttgagtcttggtgagggtgtcgaggaccaatttgtaaccatgtgggctttgaccaacttcatgaattccaaatgttcactcctctgtgtttgtctattgaggggttctttttgttcattatgccagtgtccagttacatgtaataggcattgtgtgtgaaatgacactaggtcaaagcttagtggggctttgagcatagagggagaaggtggagaccacagcttgtggttggattaatatttacaaaagtattgtgacggaaaagcatatgatagaatgtactttttcatttcataacataaatagtgttccctttgctttttc

SEQ ID NO: 2572 - DNA, 1926 bp, Solanum phureja
gtaatttaatttgtaagaaattggtggtatcaaagtaaatattatcagccaaaattacacctcacgcgttctctctcatttgcactccgacggctgtctcgcaccgtttccactctactgcgactcacgaattgctgacctctgaattatcgaagaacagccaaaatgtctcgaaaaggactgatggagcaggacctgagtaagttggatgtaacacagctgcatccactttctcctgaagtgatttctcgtcaggctacgatcaacattggtaccattggccatgtggctcacggaaagtcaacagttgtaaaagctatatctggtgtacagactgttcgttttaagaatgagctagagcgtaacattaccatcaagcttggatatgctaatgcgaagatttacaaatgtgaagaagagcgctgccctagacccatgtgctataaggcatatggaagtggaaaagaagacagtcccatgtgtgatgtccctggttttgagagctgcaagatgaaactgctgagacacgtgtcctttgttgattgtcctggtcatgatattctcatggctaccatgcttaatggagcagccattatggatggagcattacttctaattgctgccaatgagagctgtccccaacctcagacttctgaacatttagccgcagtcgaaattatgagactccaacatataataattcttcaaaataaggttgatcttgttcaggaaaatgttgccatcaatcagcatgaagctattcagaaatttattcagggaactgtagcagatggtgccccagttgtaccaatctctgctcaattgaagtataacattgatgttgtttgtgaatatattgtgaaacgaatcccaattcctgtgagggatttcacttcaccaccaaatatgatcgttattcggtcatttgacgttaataaacctggttttgaagttgatgagatcagaggtggcgttgctggtggcagtattttaaagttacatatttggtgtcagcaattcaattctttgtgcagggtgtgttgaaggtaaatcagttgatcgaggttcgtccaggtattgttgtcaaggatgaaagtggcaacattaaatgtacccccatatattcaagaattgtgtcactgtttgccgagcaaaatgaactacaatttgccgtgcctggaggccttattggagttggatcaaccatggatccaacactgacacgtgctgatcgattggtgggacaagttctcggggaggttggatcacttcctgaagttttcgtcgaactagaggtgaatttctttttgctccgtcgtcttttgggtgtgaggacaaaggacacagaaaggcagggtaaagtttcaaagttggcaaagggagaaatccttatgttaaatatagggtctatgtcaactggggctcgcgttgtagctgttaaaaatgtatttgcaaaactgcaattgacgtccccagtgtgtaccagcaaaggcgaaaaaattgctctaagccggagaattgagaagcactggcgtcttattggttggggtcaaatccaagctggtattactcttgatgttccaccgtgccccatctaagtgaatcgaaatagtcagttactgaaagaacagagattaagtagtgaaacagcacaagacagtgtcagatgtgggaaggcaggcagttgctgggaacaatttttgtcaggtggaggagaaaacaaaacattatttggagttttcggaactttatgatctgcaatattttactttccttgcttgtgacatttttctttctacctctcattttctttgccttgttggaatggtgttgtaccttgtgtaattcactagttggggtggatgttaaaatgagttccatcagaaatattgagcttgcggcagaaaatttgaaccaccttgtatc

SEQ ID NO: 2573 - DNA, 1666 bp, Panax ginseng
gcaaaacctctattttttctcgtctctcttcttcactaaggtgttggactgctcgcgacggctaccctagatttcttaaaaactgaatttagttctgttgaagcgcaaagtctacaagaagagccaaaatggcgcgaaaaggtttgatggagcaggatttgagcaagctggatgtgacaaaactacatcctctctcgcctgaagttatatctcggcaggctacaataaatattggcactattggccacgtggcacatggaaaatcgacagttgtaaaagctatatctggtgtgcagactgttcgtttccaaaaatgagctggaacgcaacatcactattaagcttgggtatgcaaatgcaaaaaatatacaaatgtgaagatgaacgttgccctcgacctatgtgttacaaggcatatggaagtgggaaagaagatgctcctctttgtgatgtgccggggtttgagaacgccaggatgaattttactgagacatgtgtcgtttgttgattgcccaggtcatgatattctcatggctacaatgcttaatggagcagcaattatggatggggcattacttctcattgctgccaatggaaagtttgtcccccaacctcagacttcagagcacttggctgctgttgaaattatgcgccttcagcatataataattcttcaaaataaggtcgatctaattcaggaaaatgtggccattcaaccagcatgaagctatccagaaatttatccagggaaccgttgcagatggtgctccagtgataccagtttctgcacagctgaagtataacattgatgtcgtgtgtgaatatattgtgaaaaaggattcccattccagagaggaatttcatctcaccgccaaatatgattgtgatccggtcttttgacgttaacaagcctggctttgaagttgatgaaattagaggtggtgttgctggtggaagcatcctcaaaggggggtttttgaaggttaatcaatacatagaggttcgtcctgggatttgtagttaaagatgaaagtggcaacattaagtgcaccccaatatactctagaatagtttcattatatgcagagcaaaaatgaattacaatttgctgtgccaggaggcctgattggtgttggcacaaccatcggaccccaccttaactcgtgctgatcgtttggtgggacaggtccttggggaggtcggatcacttcctgaggtgtatgttgaactagaggtgaactttttcttgcttcgacgtcttctgggtgtaaggacaaagggacagagaggcagggaaaggtctcaaagcttgcaaagggagagatacttatgctgaatattggatctatgtcaacaggtgctcgagttcttgctgtaaggaacgatttagcaaaattacaacttacatctccggtatgcaccagcaaaggggagaaaatttcactgagctggcgggttaaaaaacattggcatcttattggttggggccagattaaagcgggtatattggtgataaggaacattgattggatattcaagtgattgaagaatttttcttactaggaaaaccaactgttggtgaagttattggcatatttgagaagaaaggttttactttgaaaggtttgaagcttattactatggatcagtcttttgctgagaagca

SEQ ID NO: 2574 - DNA, 1785 bp, Ceratodon purpureus
ctctcgcttgctccacttccagctccaccttcgtctcctgctcatccttctcctccacgtccccgtcctcgtcgttgtcctcttcctctgcgggttactgctgtggcctgcagccatggcgaagcggggcttgatggagcaggatctcagtaagctggatgtcaccaccttgcatccgctgtcgccggaggttatctcccggcaggcgaccatcaatatcggtacaattggtcatgtggcgcacgggaagtccacggtggtgaaggctatctctggtgtgcagactgtcagattcaagaacgagttggagaggaacattactatcaagcttggttatgcgaatgccaaaatctacaagtgtgaggatgagcgatgccctcgccccatgagcttcaaagcatatggaagtgggaaagaagacagtccactttgtgatgttcctggatttgaaaccgcgcgcatgaagttgttgagacacgtttcatttgttgactgtcctggccacgatattctcatggctactatgctcaatggagctgctatcatggatggcgcattgcttttgattgctagcaacgagagttgtccccaaccgcaaacgtcggagcatttggctgctgttgagatcatgcggttgaagcacattatcattctgcagaataaaattgatcttattcaagaaagtgtggctatcaaccagcacgagtcgattcagaaatttattcagggaactattgccgatggagctcccgttgtgccaatttctgctcaacttaaatacaacgtcgatgtggtttgtgaatacatcgtgaataaaattcctattccagtgcgggattttgttgctccaccaaacatgattgtaattcggtctttcgatgtcaacaaacctggtgctgaagtcgatgacatcaaaggtggcgtggctggtggcagtattctgaggggagtgctacgtgtggggcaaaagattgaagtccgtcctggcattactaccaaggatgagaatggtggtgtcaagtgcactcccatcttctcgcgaatcgtgtctttgtttactgaggcaaacgagctgcagtttgcagtccctggcggccttattggagttggaacaaccattgatcctacgcttactcgtgctgatagattggttggacaggtgcttggtgaggtcggggagcttcctgatgtctttgtggagctggaggtcaactttttccttctccggaggctgttgggtgtgcgaaccaagggttcagagaagcaaggcaaagtatccaagctgaccaagagtgaggtcctcatgttgaacattggatccatgtctacgggggctcgtgtgattgctgtaaagaacgatcttgccaagttgcaactcacaaccccagtatgcactagcaagggagagaaggtagccctcagcaggagggtcgaaaagcattggcgtttgataggttggggacaaattcaagcaggagtcgttattgatattccacaagcagcatagaagaaaaccttttttatatttagtacttgtaatgaaattttgtggcgtaatgagggcagttaagatatttgtaatcatgtggatcttgatgccaagatttagaagtgtacggtacaccatttctcagttaaaatcgacgggtttttctgctttcaatttgagtgcacccgtctattggttcgttaggttagttcttcctttcctgatacttgtcagcttgagtatgcaacagaaattgcctctaggctctgatatattttttacaacctttatgtgtg

SEQ ID NO: 2575 - DNA, 1598 bp, Festuca arundinacea
ggcacgaggctctcgcgaaactcaccaccaccggcgacacccccatctccggcgacccgctgccgcgcatcctcctcgctcgtccactcggttcacgtcagatctacgcgcgcggcgaccctcttcgtctcgccacacccaacccgccggtcctccctagccaagtttcaatcatggcacgccgaggattgatggagcaggacctgagcaagctcgacgtcacaaagctccacccgttgtcacctgaagtcatctcgcgccaagcgaccatcaacattggaacaattggccacgtggctcatggaaagtctactgtcgtgaaagctatatctggagttcagactgttcgcttcaagaatgagcttgaacgtaacatcactatcaagctgggttatgcaaatgcaaaaatctacaaatgtgaggatgacagatgtccacggccagtgtgctacaaggcttatggaagcggaaaagaagatacacctgcctgtgatgtgcctgggtttgaaaacactagaatgaagctcctgagacatgtctcctttgttgattgcccgggccacgacattctcatggctacaatgcttaatggagcagctatcatggatggagccttgcttttgatagcagcgaatgaaagctgtccacaacctcagacatctgagcatcttgcagctgttgaaattatgcggctccagcatctcataattctgcagaataagatcgaccttatccaggaaagtgcagcaatgaaccagcatgaagcaatccaaaaattcatccagggcacgatagctgaaggtgctcctgtggtgccaatatctgcccagctgaagtacaacattgatgtgatctgtgaatatattgtgaagaaaatccccattccggaaaggaacttcacttcacctcccaacatgattgttatccgctcctttgatgtcaacaagcctggttcagaggtcgatgaaattaggggtggggtagcaggtggcagcatcctcaggggagtccttagggtgaaccagaacattgaagttcgccctggaattgtcatgaaggatgagagtggcaacatcaaatgcaccccaatctactcaaggattgtctcgctctatgctgagcagaatgagctccagtttgctgtgccaagagggcttattggtgtgggaacaaccatggacccaactttgactcgtgctgataggctggttggccaggttctaggagaaattgggtcgcctcctgatgtatttgtggagctggagatcaacttcttccttctgcgaaggctgttgggtgtgagaacaaaaggcacagagaaagcaggaaaggtctccaagctcaccaagggcgagatcctgatgcttaacatcgggtccatgtccactggagcccgtgtggttgctgtcaagaacgatcttgccaagctccagcgacgctcgaggccccacctgcccgctgtgaagcacaccccccgcaatttgcgagagaagagagacgaaatgtggaagggcagagagctcctaggtacaatatttttgaagtggaggagaaacatgagtctggaagtctttgtcgttgcgggttatgatcccgga

SEQ ID NO: 2576 - DNA, 1820 bp, Solanum lycopersicum
aattcttctcaaaccctctctgctgctgctgccgctgccaactcctcgtcgttctacttctccggcggctgatttagttgaaacttgcttttgaagtattgaacatcagccaaaatgtctcggaaaggattgatggagcaggatctaagcaaattggatgtcacgaagctacatcctctttcgcctgaagttattgctcgtcaggcaacaataaacattggtactattggccatgtggctcatgggaagtcaacagttgtaaaagctatatctggtgtgcagactgttcgttttaaaaatgagctagagcgtaatattacaattaagcttggatatgcaaatgctaagatatacaaatgtgaagaagagcgctgtcctagacctgcatgctacaaggcttatggaagtggaaaagaagacaatcccatgtgtgacgtccctggttttgagaactgcaaaatgaaattgctgaggcatgtgtcttttgttgattgcccgggtcatgatattctcatggctactatgcttaatggagccgcaattatggatggcgccttacttctaattgctgccaatgagagctgtccccagcctcaaacttctgaacatttagctgctgtagaaattatgcgtctccaacatataataattcttcaaaataaggttgatctggttcaggaaaatgttgctatcaaccagcatgaggcaattcagaaatttattcagggaactgttgcagatggtgccccagttgtaccaatatctgcacaattgaagtacaacattgatgtcgtctgtgaatatattgtgaaaaagattcccattcctgagaggaatttcatctcaccaccaaatatgattgttatccggtcatttgatgtaaataaacctggttttgaagttgatgatatcagagggggtgttgctggtggcagtattttgaaggcatctttctctatttctgcaatcaatgatatgatgcaaggtgtactgaaggttaatcaacttattgagattcgtcctggaattgttgtgaaagatgagagtggcaacatcaaatgtactccaatatattcaagaatagtatcattgtttgccgagcaaaatgaacttcaatttgccgtgcctggaggcctcattggagttggaacaactatggatccaacattgacacgtgctgatcgattggtgggacaggttcttggggaggtcgggtcacttcctgaagtttatgtggaactggaggtgaatttctttttgctacgacgtcttttgggtgtgaggacaaaggactcagagaggcagggtagagtctcaaagttggcaaagggagaaatcctcatgttaaatatagggtctatgtcaacaggggctcgtgttgtcgctatcaagaatgttttcgcaaaactgcaactgacatcccctgtatgtaccagcaaaggggagaaaattgctcttagccggaggatcgagaagcactggcgtcttattggttggggtgaaatccaagctggtattactcttgatgttccatcttcccccttatgagcaaatcacacaagtagtcactcaacaacaggaaaaactattcaaacaagaagagaatttgaaattctggatactctatatccttacatttttttttgtttatttctttgtccaagtggattgtaacttgtaattcattagtttaggtggttattaaaaagttacacaaccagtctctctctctctctctgatattgcatttagaattattgagttgaaaaattgctgattattcacaaaggaattttcaagtgtgaaaaataagtaactga

SEQ ID NO: 2577 - DNA, 1865 bp, Orobanche aegyptiaca
cgtctgtcattactgcacttcacaaacgaaaccctacccgcaaccctcactcgccgccgccaagagccagccactacactcgccacctcgccgccggtacaggcgctgcttaatcggcgtactgtcttttactgattttgaagagggcttcctcttttttgcatctggaatttgaatttttgatcaagtgaattaacctatcaagactgcaaaaatgtctcggaagggcttgatggagcaggacttaagcaagctggatgtaacacaactacatccactgtcacctgaggttatttcccgtcaggccacaataaacatcggcaccattggtcatgtggctcatggaaagtcaacagttgtcaaggccatatctggtgtccagactgtccgctttaaaaatgaactggagcgtaatattaccattaaacttgggtacgccaatgcgaagatatacaaatgtgaaaatgagaagtgccctcgacccatgtgctacaaggcatatggaagtgggaaagaagatagtccgatgtgtgatgttcctgggtttgaacactgtaggatgagattgcttcgacatgtatcttttgttgattgtccgggacacgatattctcatggctacaatgcttaatggggcagcaattatggatggagctttactcctcattgcggccaatgaaagttgccctcaacctcagacatcagaacatttggctgctattgaaatcatgcgtcttaagcatatcataatacttcaaaataaagtggaccttgttcaggaaaatgttgccgtcaaccagcatgaagccattcaaagatttattcagggaactgtcgcaggtggtgcaccagttatacctatttctgcacagctgaaatataatatcgatgtcgtagccgaatatatcattaagaaaatccctgttccagagaggaacttcatttcaccaccaaatatgattgtaatccggtcctttgatgtcaataagcctggatctgaagttgatgaaatcagaggtggtgttgctggtggaagtattctgaagggtgttttgaaggtaaatcagctgattgaggtccgccctggtattgtggttaaggacgaaaatgatgacatcaggtgcacccctatttactccaggatagtttccttgtatgctgagcagaacgaattacaatttgctgtgccgggtggccttattggagttggaacaacaatggaccccactcttacacgtgctgataggttggttggtcaggtgcttggggaagttggatcactacctgaagtttatgttgaactggaggttaatttctttctgctgcggaggctgttgggtgttagggcaagggacacagagaggcagggcagggtctcgaagctgaccaaggctgaaatcctaatgttgaacataggatccatgtccactggggcccgtgttattggtgtgaagaatgtctttgcgaagctacagctcacctcccccgtttgcaccggcataggagagaaaattgccctgagccgcaggattgataggcactggcgtcttattggctggggtgaaattcgtgccggtactacccttgacatcccacctcgtcccatttaagttaaatcaattattggatttacgtagtaggaaaaactacttagagagttgagatgtgggaaggcagacaatgtttgcgtacgatttttgttcgatggaggagaaaatattatttctttgagatttgggtatttgtaatttttgttgctgatttttgtcatttcttttggagttattagtgttggttcagtacattttgggggtggagtggagttattaagcaaaagtagggatggcaattttggcctgatccgaa

SEQ ID NO: 2578 - DNA, 1508 bp, Flaveria ramosissima
ctccggaggtcatatctcgacaggctacgattaatattggtactattggtcatgtggctcatggcaaatcaacagttgtaaaagcaatatctggtgtgcagactgtccgatttaaaaacgaattggaacgtaacattactattaagcttgggtatgccaatgcaaagatatacaaatgtgaagatgaaaggtgccctcgacccatgtgttacaaggcctatggaagtgggaaagaagataaccctccttgtgatgtgcctggatttgagaatagcaagatgaaattgatgaggcatgtatcctttgttgactgcccgggacatgatattctcatggctactatgcttaatggagctgcaatcatggatggaggcgttacttctcatagcagcaaatgaaagttgtccccaacctcagacatctgagcacttggctgctgttgaaattatgaggctccagcatattataattcttcaaaataaggttgatctaattcaggaaaatgtagccattaatcaacatgaggcaattcagaaattcattcagggaactgttgctgatggtgcaccagtcatcccagtatctgctcagcttaggtataatattgatgtcgtttgcgaatacataattaagcggattcccattccagagagaaacttcatttcacccccaaatatgatagtaatccgttcatttgatgttaacaacctggatctgaggttgatgagattagaggtggtgttgctggtggtagtatccttaagggtgtgttgaaggtcaaccagaatattgaggtccgtcccgggattgttgttaaagatgagagtggcaacatcaagtgcacccccatctactctagaatagtgtcactatatgcagaacagaatgaacttcaatatgctgtacctggaggtcttattggagttggaacaacaatggaccctatgttgacccgtgctgatcgtttggtgggtcaggttcttggggaagttgggtcgcttcctgatgtttatgtcgaactagaggtgaacttttttcttttgcgtcggctgttgggtgtgaaaacaaaaggaacagaaaagcaggggaaggtatcaaagttgtcaaaggctgaaatactgatgctgaacataggttcaatgtcgactggagctcgtgtattggcagttaagaacgacttagcaaaactgcagctgacatcacccgtttgcactagcaaaggcgagaagattgctctaagcaggagagtggagaagcattggcgactaatcggttggggacagattcaagcaggtttaactcttgatatcccaccctgccctatttagacacatttgagttccagttttgccttccctaattcttattgctgttttagctttcgattttcgtatttgcatggtgtttgaagaaatcaacataaggcattgtacctttcacctttaattgttattattggttatttctcttgtgattgagatccaacaagctcgattggtctcgttggg

SEQ ID NO: 2579 - DNA, 1735 bp, Ananas comosus
aaccctcctttccgctcaaccctaaccggcttaaccccgcgagtccccccttatccccgaaagagactggggttttctcccaccgccgaactcctcgtcgtcgtcgtcttcctcctcggattcgctccctcgaagatcgccgccattaacggcgtagcgaagccctcctacccgtagggtttctcgcgtcggattcctgaaccttgcactaactctcttagcggaagcttttcgacgcctctcgatccgtctcttacttgtttagtgcatcaatttctgcaaagatgtcgcgtaaaggtttgatggagcaggatttaagcaagcttgatgtgacaaaactgcatccgttgtctccggaagttatttcacgtcaagcaacgataaatattggtaccattggtcacgtggcccatggaaaatctactgtcgtaaaagccatatccggtgtccagacagttcgcttcaaaaatgagttggagcgtaatatcactattaaattggggtatgccaatgcaaaaatatataaatgtgaagatgaaagatgtcctcgaccaatgtgctacaaggcttacggaagtggaaaagaagacagtcctctctgtgatgtcccaggatttgaaaacaccagaatgaagcttttgagacatgtttcattcgttgactgtccggggcatgatattcttatggctacaatgcttaacggagctgcaattatggatggagcacttcttttgattgctggtaatgaaagctgcccccaacctcagacttctgagcatcttgccgctgttgaaatcatgcgtctccaacacattatcattctacagaataagattgatcttattcaggaaagtgcggcaattaatcaacatgaagctatccagaagtttattcagggtacgattgctgatggggctcctgtggtaccaatatccgcccaattgaaatacaacattgatgttgtttgcgagtatattgtcaagaaaatacctattcctgagaggaatttcacttcgccgccaaacatgattgtgattcgttctttcgatgtgaataagcctggttctgaggttgatgaaataaagggtggcgttgctggtggaagcatactgaggggagtattgaaggtgaaccagttcattgaagtccgtcctggaattgtgatcaaagatgagagcggtaacattaagtgcacccccatatattcaaggattgtttccctatatgctgagcagaatgaactacagtttgctgtgcctggggggcttatcggagtgggtactacaatggatcctacactgacccgtgcagataggcttgttggtcaggttcttggagaagttggatctttgcccgatgttttcgtcgagttggaggtgaacttctttctgctgcgaaggcttttgggtgtaaggacgaagggcacggagaagcaaggaaaggtgtcgaagctagccaagggcgagatcctcatgctcaacatcggatccatgtcaacgggcgcccgtgtggttgccgtgaagaatgatctcgcgaagctgcagctcactgcgcctgtctgcaccagcaaaggcgagaagtggcactcagccgacgagtcgagaagcattggcggcttatcggctggggccagatccaggctggtgtcactcttgaagtcccccctcgcccaatctgataacctcctcccatttcctataaacgagtcattaccagcaaattaaagaaacttgtg

SEQ ID NO: 2580 - DNA, 1456 bp, Elaeis guineensis
ccaatctccgcatccgacgcctcccccacggcctccgagccctcgttctcttcggtcgaaagatcgccgccgctgccgccgtcctccggtctcccctctctggaggatccccgtggcctccgatctcggctttagaggtacattacctgcagcaaaaatgtctcgtaaaggattaatggagcaggacctgagtaagctggatgtgacaaaactgcatccactgtcgccagaagttatttcacgtcaagctacaattaatattggtaccattggtcatgtggcccatggaaagtcaactgttgtaaaagctatttctggtgttcagactgttcgttttaagaatgagctggagagaaatatcactatcaagctgggatatgctaatgcaaaaatatataaatgtgaagatgatagatgtccacgaccaatgtgctacaaggcctatggaagtggaaaggaagatagccctctatgtgatgtgccaggatttgagaacaccaggatgaaactcctaaggcatgtctcatttgtagactgcccgggccatgatattcttatggctacaatgctcaatggagctgcaatcatggatggagcattgcttttgattgctggaaatgaaagctgcccccagcctcagacttctgagcatctggctgctgttgaaatcatgcgacttcagcatattattattctgcagaataagattgatcttattcaggaaagcgtggcaattaatcagcatgaagcaattcagaaatttattcagggtacaattgctgatggggcacctgttgtacctgtctctgctcagttgaagtataatattgacgttgtttgtgagtatcttgttaacaaaatccctatcccggagagggactttacttcaccaccaaacatgatagtcattcgttcttttgatgtaaataagcctggttctgaggttgatgagataaaaggtggtgttgcgggtggcagtatccttaggggagttttgaaggtaaacgagcctattgaagtccgtcctggtattgttgtcaaagatgagaacggcaacatcaagtgcactccaatatattccaggatagtttcactttatgctgagcaaaatgagctccagtttgcagttcctgggggtctcattggagtaggcaccacgatggaccctacactgacacgtgctgataggctggtgggtcaggttcttgggcaagttgggtctctgcctgatgtttttgttgagctcgaggtgaatttttttctcctccggaggcttttgggggtgaggacaaagggcacagaaaaacaagggaaggtatctaagcttgcaaagggtgagatcctgatgttgaacataggatcgatgtcaacaggggcgcgagtgattgctgtgaaaaatgatctagctaagcttcagctcactgcaccagtgtgcacaagcaaaaaaggagaaggt

SEQ ID NO: 2581 - DNA, 1799 bp, Solanum phureja
gctgctgccgctgccaactcctcgttgttctacttctccggcggctgatttagttgaaacttgcttctgaagtatcgaacatcagccaaaatgtctcggaaaggattgatggagcaagatctaagcaaattggatgtgacaaagctacatccgctttcgcctgaagttattgctcgtcaggcaacaataaacattggtactattggccatgtggctcatgggaagtcaacagttgtaaaagctatatctggtgtacagactgttcgttttaaaaatgagctagagcgtaatattacaattaagcttggatatgcaaatgctaagatatacaaatgtgaagaagagcgctgtcctagacctgcatgctacaaggcttatggaagtggaaaagaagacaatcccatgtgtgacgtccctggttttgagaactgcaaaatgaaattgctgaggcatgtgtcttttgttgattgcccgggtcatgatattctcatggctactatgcttaatggagccgcaattatggatggcgccttacttctaattgctgccaatgagagctgtccccaacctcaaacttctgaacatttagctgctgtagaaattatgcgtctccaacatataataattcttcaaaataaggttgatctggttcaggaaaatgttgctatcaaccagcatgaggcaattcaaaaatttattcagggaactgttgcagatggtgccccagttgtaccaatatctgcacaattaaagtacaacatcgatgtcgtctgtgaatatattgtgaaaaaaattcccattcctgagaggaatttcacctcaccaccaaatatgattgttatccggtcatttgatgtaaataaacctggttttgaagttgatgatatcagagggggtgttgctggtggcagtattttgaaggtatctttctctatttctgcaatcaatgatatgatgcaactcatagcttctttaacggtgtactgaaggttaatcaacttattgagattcgtcctggaattgttgtgaaagatgagagtggcaacatcaaatgtactccaatatattcaagaatagtatcattgtttgccgagcaaaatgaactacaatttgctgtgcctggaggcctcattggagttggaacaactatggatccaacattgacacgtgctgatcgattggttggacaggttcttggggaggtcgggtcacttcctgaagtttacgtcgaattagaggtgaatttctttttgcttcgacgtcttttgggtgtgaggacaaaggaatcagagaggcagggtagagtctcaaagttggcaaagggagaaatcctcatgttaaatatagggtctatgtcaacaggcgctcgtgttgtcgctatcaagaatgttttcgcgaaactgcaactgacatcccccgtgtgtaccagcaaaggggagaaaattgctcttagtcgaagaattgagaagcactggcgtcttatcggttggggcgaaatccaagctggtattactcttgatgttccatcttcccccttatgagcaaatcacacaactagtcactcaacagcaggaaaaactattcaaacaagaagagaatttgaaattctggatactctatattcttacattttttttgtttatttctttgtccaagtagattgtaacttgtaattcattaatttaggtggttattaagaagttacactagtctctctctctctgatattgcatttagaactattgagttcaaaaattgctgattattcacaaaagaatttttaagtgtgaaaaataagt

SEQ ID NO: 2582 - DNA, 1491 bp, Flaveria ramosissima
acgtttctacttgataatattatctatcttcttagccaccacaaagcgcccatcgatcacagaatctcgttaacctctcagcgatccggtgcttcttatcgcaaaaagtttgtgtgcttaatctagggtttctacggtttctgatttcgaacagtgcgaaatccgttaagaacagtgaatatggctcgaaagggtttaatggagcaggatttgagcaagctggatgtaacaacgctgcatccgctgtctccggaggttatatctcgtcaggctacgattaatattggtactattggtcatgtggctcatggtaagtccacagttgtaaaagccatatctggtgttcagactgttcgattcaaaaatgagttggagcgtaacattactattaagcttgggtatgctaatgcaaagatatacaaatgtgaagatgataggtgccctcggcccatgtgttacaaggcctatggaagtgggaaagaagataaccctccttgtgatgtgcctggctttgagaacagcaagatgaagttgatgaggcatgtgtcatttgttgactgcccagggcacgatattctcatggctactatgcttaatggagcggctatcatggatggagcattacttctcatagcagcaaatgaaagttgtccccaacctcagacttctgaacacttggctgctgttgagattatgagactccaacatattataattcttcaaaataaggttgatcttattcaagaaaatgtagccattaaccaacacgaggcaattcagaaattcatccagggaacagttgctgatggtgcaccagtgatcccagtgtcagctcagcttaggtataatattgatgtggtgtgcgaatacataataaaacggattcccattccagagaggaacttcatttcaccaccaaatatgatagtaattcgttcatttgatgttaataagcctggatctgaggttgatgagattagaggtggtgttgctggtggaagtattctcaagggtgtgttgaaggtaaatcagcatatcgaggtccgtccagggattgttgttaaagatgagagtggcaacatcaagtgcacaccgatttactcaagaatagtgtcactatatgcagaacaaaatgaacttcagtttgctgtacctggtggtcttattggggttggaacaacaatggaccctatgttaacccgtgctgatcggttggtgggtcaagttcttggggaggttgggtctcttcctgatgtttatgtcgaactagaggtgaactttttccttttgcgtcggctgctgggtgtgaagacaaaaggaacagagaagcaagggaaggtatcaaagttgtcaaaggccgaaatcctaatgcttaacatagggtcaatgtctaccggggcacgtgttctggcagttaagaacgatttagcaaaactgcagctgacatcacccgtgtgcacgagcaaaggcgagaagattgccctgagcagg

SEQ ID NO: 2583 - DNA, 1802 bp, Sequoia sempervirens
aatttagctttttatcaatcgtattgccctcatttctataagcaatttttttcattctttcactacaacactttgcgggaccttatcaatcagcgaaaatgtcgagaagagggttaatggaacaagatctggcaaagttggatgttgccaagctgcatccactttccccagaggtcatttctcgccaggctactataaacattggcacaattgggcatgtggcacatggaaaatcaactgtggttagagccatatctggtgtccagacagtccgtttcaaaaatgaattggaaaggaacatcaccattaagctgggatatgcaaatgcaaaaatatacaaatgtgaagatgatcgctgtccacgaccaatgtgctacaaggcatatggtagtggaaaggaagacagtcccttttgtgatgtccctggatttgaaaatgcacgcatgaagcttttaagacatgtttcatttgttgattgcccgggtcatgatattcttatggctactatgctaaatggtgccgctattatggacggtgcattgcttttgattgcaagtaatgagagctgtcctcagcctcaaacttcagagcaccttgctgctgtagagattatgcgccttcagcatattattattctacagaacaaaattgacctgatccaggagagtgtagctaacaaccagcatgaggcaattcagaaatttattcagggtaccattgctgatggagctccggtggtaccaatatctgcacaactaaagtacaacatcgatgttgtatgtgaatacataacaaacaagattcctattcctgagcgtaattttgttgccccacccaacatgattgtaatcagatcatttgatgtgaataaacctggtgctgaagttgatgaaataaaaggtggcgttgctggtggaagtatactgaggggtgttttgaaggtgaatcaaaaaattgaagttcgtcctggcattgttgttaaagatgagagtggcaatatcaagtgtacacctatcttttcgagaataatttcactttatgctgaacaaaatgagttgcagtttgctgttccaggaggccttattggtgtggggacgacaatagatcccacacttacacgtgctgacaggcttgttgggcaagttcttggagaagttggagaactacctgatgtgtttgttgagcttgaggtaaactttttcctcctccgtcgtcttttgggagtgaggacaaaaggtacagagaaacaagggaaggtatcaaaattggccaagggagaagttttgatgcttaacataggttcaatgtcaactggagctcgagtgcttgctgtgaaaaatgatctcgctaagctccaacttacctctccagtctgcactagtaaaggagaaaaatggcacttagcagacgagtagaaaagcattggcgattgataggatggggtcaaattcaagctggagtgatgctggatattccccaagtggccatatagaacagcaaataagcaagtcacttctgaaaaaaaggggcatcagtcaaggcaaaatgtggataggaagagaattattagggacaatttttgtcaggtggagaagaaaacctatcggttatttataagattttaaggtttatttttggtagctgcaataccatctttacagaagtaagcaattagcttgctagttttttctgtttaattatttgtttatggttcttgatgattgtttccagaactagcttatatgcagaattcatttaattgtgatctcttggtgtattactatgagtattgcttatgttgt

SEQ ID NO: 2584 - DNA, 1545 bp, Taraxacum officinale
gacgtcataccgctttttctactttgctatagaaccctgaaaccctagctacgtttctgctcaatattatcgccttagccaccccaccaccaccaccagtcgtttaacgatcggagaatctgtacaacggctcggcagttctgtgtttcttcactcaaaaggctgggtgttcacttagggtttctacaattttgtgaggttgaatagtgcaaagctcttgaagaactgtgaaaatgtctcgaaaaggtttaatggagcaggatttgagcaaactggatgtgacgaaactacatccgctctcaccggaggtcatttctcgccaggccacaattaatatcggtactatcggtcatgtggcacatggcaagtctacagtcgtgaaagcaatatctggagtgcagactgttcgttttaaaaatgagttggagcgtaacatcaccatcaagcttgggtacgccaatgcaaagatctacaagtgtgaagatgacaggtgtcctcgacctatgtgctacaaggcctatggaagtgggaaagaagacagccctcaatgtgacgtgcctggatttgagaacagcaagatgacattgatgaggcatgtatcatttgttgattgccctggacacgacattctcatggctactatgcttaatggagctgcaatcatggacggagcattacttctcatagctgcaaacgaaagctgtccccaacctcaaacttctgaacacttggctgctgttgaaatcatgaggcttcaacatattataattcttcagaacaaggtcgatttgatccaggaaaatgtcgccattaaccaacacgagtccatccagaaattcatccagggaaccgtggctgatggtgcaccagtcatccctgtgtctgcacaactcaagtacaacatcgatgttgtgtgtgaaaacatcataaagcggattccaattccagaaaggaacttcatttcacctccaaatatgattgtgattcggtcttttgatgttaataagcctggatctgaagtcgatgagattcgaggtggtgttgctggtggaagtatcctcaagggtgtgttgaaggtaaaccagttcattgaggtacgtccaggtattgttgtgaaagatgaaagtggaaacatcaagtgcactccaatctactccagaatagtttcactatacgcagagcaaaacgagcttcagtttgatgtacccgggggtcttatcggagtggggaccacaatggaccccatgttgacccgtgctgaccgtctcgtgggccaggttcttggagaagtcggctcccttcctgatgtttatgtcgaactagaggtgaacttttttctgttacggaggttgttgggagtgaagacgagagggacagagaggcaagggaaggtgtcgaagctttcaaaggcggaaatactgatgcttaatatcgggtcgatgtcgactggggcacgggttttggcggtgaagaatgacctggcgaaactgcagctgacgtcaccggtgtgtactagtaaaggggagaagattgcgctgagtaggc

SEQ ID NO: 2585 - DNA, 1975 bp, Musa acuminata
tgaggtggccttaccttggagcgtgcattaagtcaaaagttctccttttggttttcaccttatttaattttgacctctgatcattatttccttttatctgattgagaaattaatttctttatactgtcagtcacttccatgactctactatctcgtcgaaaacataaattctgttaattggtttctttaatatttaattcttaggtaccattggtcatgtggcccatggaaagtcaactgtggtaaaagcaatatctggtgttcagactgttcgcttcaagaatgagttggagcgcaatatcactatcaagcttggatatgctaatgcaaaaatttacaagtgtgaagatgatagatgcccacggcctatgtgttacaaggcttatgggagcggaaaagaggacagtcctctatgtgatgttccaggatttgagaacaccaggatgaaactcctaagacatgtttcatttgtggattgcccaggtcatgatatccttatggctacaatgctcaatggagctgctattatggatggtgctttacttttaatagctggcaatgaaagctgtccacagcctcaaacatctgagcatcttgccgctgttgaaatcatgcggctccaacatattattatcttacagaataaggtcgatcttatccaggaaagtgcagcaatcaatcaacatgaatcaatccagaagtttattatgggaactgttgctgatggggctcctgtggtgccaatatctgctcaattgaaatacaatattgatgttgtctgcgagtatctagttaagaaaatacctattccagagagaaactttacctcaccgccaaacatgattgtaatccgttcttttgatgtgaacaaacctggctctgaagttgacgagataaagggtggtgtagcaggtggaagcatcctcaggggtgttttgaaggtaaaccaacgaattgaagtccgtcctggaattgtggtcaaagatgaaagtgggaacataaagtgcacccccatatattcgaggattgtttcactatatgctgagcaaaatgagcttcagtttgctgtacctggtggacttattggagtaggcactacgatggacccgactttgacacgtgctgataggctggtgggtcaggttctgggtgaagttggatctctgcctgacgtctttgtcgagcttgaggtcaacttcttccttcttcggaggcttttgggtgtgaggacaaagggcacagagaaacaaggcaaggtgtcaaagctggcaaaaggtgagatcctgatgctcaacatcggatctatgtcaaccggagctcgagttgttgctgtgaagactgacctggccaagctgcagctcactgcaccagtatgcacaggcaaaggggaaaagattgccctaagccggcgggtcgagaagcactggcgtctaattggttggggtcagattcaggctggtgtaacccttgatgtcccaccctgccccatttaaaatgatctcatccaagagccacattaaaatcacgagtttcttgagcaagagattagtgggagtacttttgagaaggtagagagttcctggaaaagatttttgtccggttgaggatacacagtctttttcttcagaaatgtggccatccacagtttctctttctcatatcttgatttttgattcatttgggatatgtaaagccaggtatattgatactgctggtaagtcagaagcgagttataaggcaatgagatgttgtctaagactttaagatcgagtgtttatttttggctatttaattgtatgcaactgaaatgctaaactggtgactagttccagttagagccagcaatcagtatcagcccgccacagtaccaggtgacataaacagcatgacatttagattccaaaaccatcccaaggtcatgttttgactataatatctgttctctaaaaatatgctgctttcattcttctccaaa

SEQ ID NO: 2586 - DNA, 1551 bp, Lotus japonicus
agatcagatactttagcttcaaaaatcacttcattggaagcagccaccatgtcacggaagggtttgatggaacaagacctgagtaagttggatgtgacaaaattgcatccactttctcctgaagtcatatctcggcaagctactattaatattggcaccataggccatgtggcccatggaaagtcaaccgttgtgaaagcaatatcaggtgttcagaccgtgcgttttaaaagtgagttggaacgtaacattacaataaagcttggctatgcaaatgcaaaaatatataaatgtgaagatgcacgatgtccgaggcctatgagctacaaggcttatggaagtgggaaggaagatgctcctatgtgtgaagtaccagagtttgaaaactgcaggatgaaattgttgagacatgtttcttttgtggattgcccgggacatgatattctcatggctacaatgcttaatggagcagcaatcatggatggagctctgctactcattgctgctaatgaaagctgccctcaacctcaaacttctgagcatttagctgcggttgaaattatgcgtctgcagcacattataatccttcagaacaaggtagacctaatcccagaaaacgtggcaatcaatcagcatgaagatattcagaagttcattgcaggaactgttgctgttacggcacctgtggtacctatttcagcacaattgaagtataacattgatgttgtgtttgagaaattggggtgttacattgtgtgtgaatatattgtgaaaaagatcccaatccctgaaaggaacttcatttctccaccaaatatgatattaatttgatcatttgatgtcaataaacctggttatgaggttgatgaaataaaaggaggtgtagttggtggaagcattctgaggggtgttttaaaggtcaaccaattcattgaagttcgacctgggttaattggtaaagatgagaatggaaacattcaatgctcacccatatactccaggatagtttcattgtacgctgaacaaaatgagcttcaatttgctgtgcctggaggccttattggtgttgggaccacgatggatcccactttgacgcgtggtgaccagttggtagggcatattcttggagaggttggatcactgcctgaggtttttgttgaacttgaggttaactttttcttgcttcggcggcttcttggtgtccggacaaaaggctcagagagacaggaaaaggtagctaagctgaccaaaggagagccgctactgttgaacattggatcaatgtcagcaggtggcaaagtaattgctgtgaggaatgaccttgctaaattgcaactcactacccctgtgtgtactagcaagggtgagaagatcgcacttagtcgacgtgtcaagaagctttggcgtcttatcgggtggggtcaaattcaagccggaatcactcttgatgtccctcctgcccctgcactgtgttgaaatacaaacaccagttatagaaacgtgagatgaattgaggtatatggaaagggagacaattatttaactttcata

SEQ ID NO: 2587 - DNA, 1535 bp, Selaginella moellendorffii
gttttgtggttcgggcatttcggacaggcggcgcaagcgcggcagggcacaatgtcgtcgtcgcggcgagcattgacggagcaagatttgtcaaagctggatgcagcgaagctcactccacagtcgccagaggtcatctcgaggcaagccacgatcaatatcggcaccattgggcatgtggcgcacggcaaatccacagtcgtcaaggcgatctctggcgtccagactgtccgcttcaagaatgaattggagcgtaacatcacaatcaagctcggctatgcgaatgcgaagatttacatgtgtgaagacgagcgatgccctcggccgaaatgctacaaagcttacgggagtggcaaggaagatagtcccttttgtgacgttcctggattcgagaactgccggatggtgctcaagaggcatgtgtctttcgtggattgtcctggacatgatattctcatggctacgatgcttaatggtgctgcgatcatggacggcgctttgcttttgattgccagcaacgaaagctgcccgcagccgcaaacttccgagcatcttgcggctgtggagatcatgcgcttaaagcacattatcattctccaaaacaagatcgacttgatccaggaaagcgtggcacttaaccaatatgatgccatcaagaagtttatccagggcaccgtcgccgataacgctccagtggtgcctgtttcagcgcaactcaagtacaacgtcgacgttgtttgtgaatacatcgtgaagaagattcccattccggagcgtgacttcatctccccaccaaacatgattgtcatcagatctttcgacgtgaacaagccgggagcggaggtggacgaaatcaagggcggagtggctggcgggagtattctcaggggtgttctaaagctgggacagaaggtggaagtccgtcccgggatcgtggcaaaggatgacaaaggaaacatcaaatgcacaccgatcttctcccgaatcgtctcgctctttgcggagcagaacgagctccagttcgcggtgcctggaggcctcatcggtgtcggcacgacgatcgatccgacgctcactcgggctgacagactcgtcggtcaggtgcttggagaagtgggagctcttccggacgtgtttgtagagctcgaggtgaacttctttctattgcgtcggctcctgggagtaagaactaaagggtcggagaagcaagagaaggtctccaagctcgccaaaggagagatgttgatgctcaacatcggatcaatgtcgacgggagctcgcgtcctggccgtgaagaacgatctggccaagctccaactcacgtccccggtttgcacgagcaaaggcgagaaagtggcattgagccggagagtggagaagcactggcgtttgatcggctggggacaaatccaagccggcatgaccatcgacatccctgcggtatcagtttaacggaaaaaataagtcaaaagagattaaatgagagagtttcctttaaatatttttgtcaatgagtgttcaacgaatattccaac

SEQ ID NO: 2588 - DNA, 1529 bp, Setaria italica
caagatggctcgctgaggattgatggaacaggacttaagcaagcttgatgtgacgaagcttcacccactgtctcctgaagttatctcacgccaagcgacaattaatatcggtaccattggccatgtggctcatggaaagtctactgttatgaaagctatatctggagttcagactgttcggttcaagaatgaaccagaacataacatcactataaaactgggttacgctaatgcaaaaatctacaaatgtgaggatgacagatgtccccaaccaatggcctatggaagaggaaaggaagatagccctctctgtgatgtgcctggttttgaaaacactaggatgaagctcccgagacatgtttcttttgttgattgcccggggcatgacattctcatggctacaatgcttaatggagctgctatcatggatggagcactgcttttgattgcagcaaatgaaagttgcccacagccccagactttcgagcatcttgcagctaacaagattgaccttatccaggaaagtgcagcgatgaatcagcatgaagcaatccaaaaattcatccaggggactatagctgaaggtgctcctgtggtgcctatatctgcccagctggaatacaacattgatgtgatctgtgaatacattgtgaagaaaatccccatccctgaaaggaacttcacctcacctcctaatatgattgttattcgctcctttgatcagagcaatgcttctttacagggagttctgagggttaaccagaagattgaagttcgccctggcattgtcatgaaagatgaaaatggcaacatcaaatgcaccccaatctactcaaggattgtctcgctatatgctgagcagaatgagctccagtttgctgtgccaggagggctgattggtgtgggaaccacaatggacccaactctaacacgtgctgatagactggtgggccaagttctcggtgaagttggctcgctacctgatgtttatgtagagcttgaggcagggaaggtgtccaagctcaccaagggcgagatcctcatgcttaacataggatccatgtccacaggcgcccgcgtgctcgctgttaagaacgatcttgccaagctacagctcactgcccctgtctgcatgagcagaggagagaaggttgcccttagtcgtcatgttgagaagcattggcgccttatcggatggggccagatccaggccggtatgacacttgaagtaccaccctgcccgctgtgaagcatcatcctcgacggtgagctgaaattcagtgctgaggagagaacatgagtctgttggtagacctgtttccgtgttactgcagattcagtcttagccactagtttgattttgtttcttcgaagtttggaggccactttacattaagtgttaccatgaaatcctgtgaacattagcaggttggagataagtattcttttgtcgacgttgatggtagtgtcatctcgggttgaatgttatcgcaccaaatatttgtacttttcactatttttgggttggc

SEQ ID NO: 2589 - DNA, 2151 bp, Capsicum annuum
ctggtctagagagaacggagagcctctctctctctctctgagtcctaaaaatccacacatgatcccaataggtcgttggttctatttaatttttcttgtgcaggctgcttccttaatatttgtatgttactatggatagattgtaggaagtctagaactaacacaagtacttgcaaaaaaaataatatttcacagtaattgagaagccgagaagatgttgctttgggcggctttacgctattacccttgaaaataaccattaattattccctgcagactgttcgttttaagaatgagctagagcgtaacattaccatcaagcttgggtatgctaatgccaagatatacaaatgtgaagaagagcgctgccctaggcccatgtgctacaaggcatatggaagtggaaaagaagacagtcccatgtgtgatgtccctggttttgagagctgcaagatgaaattgctgagacacgtgtcctttgttgattgtcctggtcatgatattctcatggctaccatgcttaatggagcagccattatggacggagcattacttctgattgctgccaatgagagctgtccccagcctcagacttctgaacatttagctgctgttgaaattatgcgcctccaacatataataattcttcaaaataaggttgatcttgttcaggaaaatgttgccatcaatcagcatgaagccattcagaaatttattcagggaactgtcgctgatggtgccccagttgtaccaatatctgctcaactgaagtataacattgatgttgtttgtgagtatattgtgaaaagaattccgattcctgtgagggatttcacttcaccacccaatatgatcgttattcggtcatttgacgtgaataaacctggttttgaagttgatgagatcagaggtggcgttgctggtggcagtattttaaagggtgtgttgaaggtaaatcaattgatagaggttcgtccaggtattgttgtcaaggatgaaagtggcaacattaaatgtacccccatatattcaagaatcgtgtcattgtttgccgagcaaaatgaactacaatttgctgtgcctggaggacttattggagttggaacaaccatggatccaacactgacacgtgctgatcgattggtgggacaagttcttggggaggttgggtcacttcctgaagtttttgtcgaactagaggtgaatttctttttgctccgtcgtcttttgggtgtgaggacaaaggacacagaaaagcagggtaaagtttcaaagttggcgaagggagaaatccttatgttaaatatagggtctatgtcaactggggctcgggttgttgctgttaaaaatgtgtttgcgaaactgcagttgacatccccagtgtgtaccagcaaaggtgaaaagattgctcttagccggagaattgagaagcactggcgtcttattggttggggtcaaattcaagctggtattactcttgatgttccaccgtgccccatctaagtgaatggttggtgtcaaattcaagctggtattactcttgatgttccaccgtgccccatctaagtgaatcgaattagtcagtttctgaaagaacgggaattaagtagtgaaacagcataagacggtattagatgtgggaaggcaggaagttgctgggaacaatttttgtcaggtggagaagaaaacattatttgaagttctcgatacttttatgatctgcgatattttactttccctctcattttatattctccctctcatttttctttgccttgtcaaaatggtgttgtaccttgtaattcaatagtttggatggataaaatgagttccatcggaaatagtgagcttgcggcagcatttgaaccaccttaaatctcttcttgtttataattgctttgcattatatgccactgaagtgcagagattttcgaagacagatctgggtcggcactgttgattatcgcagaatattaatttctatctaaaactaaggttgtaaatcatatgaagattacacacgtcataagttataagcctactggtttaggtaaatatttgatgtcaagagcttataatgacttcctgattaagataaaggaattagccgtttctctatatttaacgacttgaaatttgatgaaatatgtg

SEQ ID NO: 2590 - DNA, 1496 bp, Eutrema halophilum
tttttggtgaaaataatgtcgcggaacaagggtttagctgaacaagacctaagtaaacttgatgtaagtttgctacatcctctgtctcccgaggtcatttctcgtcagccaaccataaacataggaaccattgggcatgtcgcacacggaaagtcgactgttgtgaaagctatttctggtgttcagaccgtccgttttaagaatgagttggagcgtaacattaccatcaagcttggatacgcaaatgccaagatttacaaatgtgagaatgacaagtgccctagaccaatgtgctacaagtcctatgggagtgggaaagaagacaacccaatttgtgaatttgataacagcaagatgaaactactgaggcatgtctcatttgtcgattgcccgggacatgatattctcatggcgactatgctcaatggagcagcgattatggatggtgctctacttctgattgctgcgaatgagacctgtccacagccacaaactgctgaacaccttgcttctgtcgatatgatgcaccttaagcatataataatccttcagaacaaggttgatctcattcaagaaaccgccgccgtgaaacagcatgaggccattcagaaatttataatgaacacaaatgcggagggtgcacctatagttcctgtctcagcacaactgaaatacaacattgatgttttgtgcgagtacattgtcaagaagattccaatccccaagagggattttgtgtcaccaccaaagatgattgtgattcgttcttttgatgtcaataaacctggctaccaggttgatgatattaaaggtggagtcgcaggtggaagtatcctccggggtgttttgaaagtaaaccagtttattgagatccgacctggtattgttggcaaagacgagcttggaaacccaaaatgcagtcccatttactctcgtatcacctctctgttcgcagaacagaacgagcttcagtttgctgttcctggaggtctgataggagttgggacaacgatggatcctacgctcactcgtgctgataggttggtaggtcaagtccttggtgaaatgggttctctccctgaggtctatgttgagcttgaggtgagtttccagcttctgactcgtctcattggagtgaggacaaaggaaacagagaagcagatcaaagtgtcgaagctaagcaaaggagaggtgctgatggtgaacattgggtccatgtcgacaggagctaaggttcttggagtgaagaaagatatgatgaaagtgcaacttacggttcctgtctgcaccaccataggtgaaaaagtggctctaagccgccgtgtcgaaaggcattggcgtttgattggtcgcggtcagattgaggctggaataaccatcctcgtccctcctcctccaccttgtctctgatcaagaaagtgcatccagattttgctatccatgcaattaaatttcaattctaagaaaactttcatcatattttaatgttgttagat

SEQ ID NO: 2591 - DNA, 1792 bp, Pinus taeda
ttctcctgttattgtacaatctatcttctttgaatcactaaattgacacctgaacgtgtaaaagaacagtttacatgatattcttcttagcttattttgtatgtacttagcttttgtttgagtatgctttcttgattttgtatgcagacagttcgtttcaagaatgaactggagcgtaacatcactattaaactgggatatgccaatgcaaaaatatataaatgtgaagatgagcgctgtcctcgaccaatgtgttacaaggcatatggaagtggcaaggaagacagtcctctgtgtgatgttgctggttttgagaacactcgcatgaagcttttaagacatgtgtcatttgttgattgtccgggtcatgatattctcatggctactatgctcaatggtgcggctatcatggatggagcgctgcttttgattgctggcaatgagagctgtcctcaacctcaaacttcagagcatctggctgctgtggaaatcatgcgtcttaaacatataattattttgcaaaacaaaattgatcttatccaggagagtgtagctatcaaccagcatgaggcaattcagaagtttattcagggtactatcgctgatggagcacctgtagtaccaatatctgcacaactgaaatacaatatcgatgttgtctgcgaatacataacaaacaagattcccattccagagcgtaattttgttgatccacccaatatgatcgttatcagatcttttgatgtaaataagcctggtgctgaagttgatgacataaaaggaggtgttgcaggtggaagtatactgaagggcgttttgaaggtgaatcaaaaaattgaagttcgtccaggcattgttgtcaaagacgagggtggcaacatcaagtgtacgcccatcttttcaagaataatttcactttatgctgagcaaaacgagttgcagtttgctgttcctggcggccttattggtgtgggtaccacaatagatcccatgctgacacgtgctgacaggcttgtggggcaagtccttggagaagttggcgagctaccagatgtgtttgttgaacttgaggttaattttttcctacttcgtcgcctcctgggtgttaggacaaagggtacagaaaaacagggaaaagtttcaaaactggctaagggagaagttctgatgcttaatattggttcaatgtccactggagctcgggtgcttgctgtgaagaatgacctggccaagctccaacttacttctccagtgtgcacaagtaaaggtgaaaagatggcacttagcaggcgagtagaaaagcattggcgattgataggatggggtcaaattcaagctggagcaatgctggacatacccccggcatctgaataagatagtgcacagacaaaacccaattatacttgagaaaataaaaagggtacttgagaaaagggacaatgtggatagggagagagttattaggaacaatttttgttaggtggagaagaaaacctttcaaggtattgtgttctaaagggaagagctagctcatatatttgttctcatcttgatttttttattcagtatttagcatttgttttagaatgagctcagttacagaacccgtatttccaggttactgaatttcactacagcaattgcttatgttgtaatagagtccagacccattgacgaatgaccattgttttcaaattcagttgtaattgtgatttttgttaaatacaagtttattaattgattgtccattaggttctcaatttctgttacctcaattgcacatgttagaatt

SEQ ID NO: 2592 - DNA, 1660 bp, Arabidopsis lyrata
aaagcgagactttacagtacgcagattagtcggaatcgactgagaatcgaaattattgtggtgttttgtgaacagaaaccaagcaggataaaagatggttcaacaatctgtgttaatttcgcgtaacaagggtttggctgagcaagatctaagtaaacttgatgtaacaaagttacatcctctgtctcccgaggtcatttctcgccaagcgaccataaatataggaaccattggccatgtcgcacacggtaaatcgactattgtgaaagctatctctggtgttcagactgtgcgttttaagaatgaactggagcgtaacattaccattaaacttggttatgcaaatgcaaagatttacaaatgtgaggatgacaagtgccctagaccaatgtgttacaagtcttatgggagtggaaaagaagacaacccgaattgtgatgtccctggatttgagaaatgcaagatgaaactactgagacatgtctcatttgtcgattgtccgggacatgatattcttatggcgacaatgctcaatggagcagcaatcatggatggtgctttacttctaattgctgctaatgagacttgtccacaaccacaaactgctgaacatcttgcttctgttgatatgatgcgtcttaagcatatcataatccttcagaacaagattgatctcattaatgagaaagccgccactgaacagcacgaggcgattcagaaatttataacgaacacaaatgccgaggatgcacctatagttcctgtctcagcacaacttaaatacaacattgatgttgtgagtgaatacattgtcaagaagataccaatccctgtgagagactttgtgtcaccgccaaagatgattgtgattcgttctttcgatgtcaataaacctggctctgctggtcatgaaatgaaaggtggagttgctggtggaagtatcctccagggagttttgaaagtgaaccaactgattgaaattagacctggtatcactggcaaagatgaacttggaaactcaaaatgcactccaatttactcccgtataacttcactttacgcggaacagaacgagcttcagttcgctgtcccgggaggtctaattggagttggaacaaccatggaccctacgcttacgcgtgctgataggttggttggtcaagtccttggtgaaatgggaactctccctgatgtctttgttgagcttgaagtaagtttccagcttctgactcgtctcattggagtgaggacaaaggaaaaagagaagcaaatgaaagtgtcaaagctaaccaaagaagagatactaatggttaacatcgggtccatgtctacaggagctaaggttattggagtgaagaaagatatggtgaaacttcaactgacgtctccggtgtgtaccaccataggagagaaggtggctttaagccgccgtgtcgataggcattggcgtcttattggtaagggtcagattcttgctggaaccaccatcgatgttcctcctcctcctttctaatgaggtagtgatgaattttttttttttgcattcaaaaataataaacatgtgaacctttgtatgttcgatcactttctttcgacttcaatataaaactatattcatatttaattaacaacatcgacgaaatttagaaaacaaaatcat

SEQ ID NO: 2593 - DNA, 1584 bp, Arabidopsis lyrata
cgccaatccgcttcaagcctccaaccatccatcaggataaaggcggttccttttttgtcataatggggtggagcaagggtttagctgaacaagatctaagtaagcttgatgtaaatgagctacatcctctgtctcccgaggtcatatctcgccaggcaaccataaacataggaaccattggacatgttgcacacggaaagtctacggttgtgaaagctatttctggtgtgcagactgtccgttttaagaatgaattggagcgtaacattaccattaaacttggatatgcaaatgccaagatttaccaatgtgaggataacaagtgccctagaccaatgtgctacaagtcttatgggagtgggaaagaagacaacccaaattgccatgtccctggatttgagaactgcaagatgaagctactgaggcatgtctcctttgtggattgcccgggacatgatattctcatggccacaatgctcaatggggccgccatcatggatggtgctctacttttaattgctgcgaatgaggtctgtcctcaaccacagacagctgaacatcttgcttccgtcgatatgatgcaccttaagcatattataatccttcagaacaagattgatctcattcaagaaaaagccgccatcgaacagcacacggcaattcagagatttataacgaacacaaatgccgagggtgcccctatagttcctgtctcagcacaactgaaatacaacattgatgctgtgtgcgagtacattgtcaagaagattccaatccctaaaagggattttgtgtcaccgccaaagatgataatcattcgttcttttgatgtcaataaacctggctatgaggttgctgatatgaaaggtggagtggcaggtggaagtatcttccggggtgttttgaaagtaaaccaattgattgagatccgacctggtatcgttagcaaagatgagcttggaaacccaagatgctctcccatttactcccgtatcacttcattgtacgcagaacagaacgagcttcagtttgctgtgccgggaggtctgatcggagttgggacaacgatggaccctacgctcacgcgtgctgataggttggttggtcaagtgcttggtgaaatgggttctctccctgatgtctatgttgagcttgaggtgagtttccagcttctgacccgtcttattggggtgaggacaaaggaaaaagagaagcagatgaaagtggcaaagctaagcaagggagagatactgatggtgaacatcgggtcgatgtcggcgggagctaaggttctaggagtgaagaaagatatgatgaaagtgcaactgacagtgcctgtctgcaccaacataggagagaaggtggctctaagccgccgtgtcgacaggcattggcgtttgattggtcgtggtcagattgaggctggaaccaccgttcccgtccctcctcctcctagtttctgattagctgcttgagaatatcaataatttgcatccaggtttatttgcatcataatatgcatctctgaataagtcacagggggtaactgatagtctctgaatttatttgcaccataatatcaat

SEQ ID NO: 2594 - DNA, 1338 bp, Flaveria ramosissima
agggtttctacggtttctgatttcgaacagtgcgaaatccgttaagaacagtgaatatggctcgaaagggtttaatggagcaggatttgagcaagctggatgtagcaacgctgcatccgttgtctccggaggttatatctcgtcaggctacgattaatattggtactattggtcatgtggctcatggtaagtccacagttgtaaaagccatatctggtgttcagactgttcgattcaaaaatgagttggagcgtaacattactattaaacttgggtatgctaatgcaaagatatacaaatgtgaggatgataggtgccctcggcccatgtgttacaaggcctatggaagtgggaaagaagataaccctccttgtgatgtgcctggctttgagaacagcaagatgaagttgatgaggcatgtgtcatttgttgactgcccagggcatgatattctcatggctactatgcttaatggagcggctatcatggatggagcattacttctcatagcagcaaatgaaagttgtccccaacctcagacttctgaacacttggctgctgttgagattatgaggctccaacatattataattcttcaaaataaggttgatcttattcaagaaaatgtagccattaaccaacacgaggcaattcagaaattcatccagggaacagttgctgatggtgcaccagtgatcccagtgtcagctcagcttaggtataatattgatgtggtgtgcgaatacataataaaacggattcccattccagagaggaacttcatttcaccaccaaatatgattgtaattcgttcatttgatgttaataagcctggatctgaggttgatgagattagaggtggtgttgctggtggaagtattctcaagggtgtgttgaaggtaaatcagcatatcgaggtccgtccagggattgttgttaaagatgagagtggcaacatcaagtgcacaccaatttactcaagaatagtgtcactgtatgcagaacaaaatgaacttcagtttgctgtacctggtggtcttattggggttggaacaacaatggaccctatgttaacccgtgctgatcggttggtgggtcaagttcttggggaggttgggtctcttcctgatgtttatgtcgaactagaggtgaactttttccttttacgtcggctgctgggtgtgaagacaaaaggaacagagaagcaagggaaggtatcaaagttgtcaaaagccgaaattctaatgcttaacatagggtcaatgtcgactggggctcgtgttttggcagttaagacgatttagcaaaactgcagctgacatcacctgtgtgcacaag

SEQ ID NO: 2595 - DNA, 1640 bp, Ostreococcus lucimarinus
ccgcgacgcgctcgacgacgcgcgacggacgcgaccgccgacgcgagacggacgcggtgcagcgcgcgggtcgtctcggcgacgcgcgaagagcgacgcgaggcgcggcgaaggacgcgcgcggggcgacgcgagggtttccgatcggtcgacgcgcgaggacgcgcgagcgcgcgctgaagcgctcgaaagcgcgatggtgtacgcgtgcggtgacgatggattgagcgtgcaagacctggcgacgctggacgtcgggtcgctgacgccgctgtcgccggaggtgatctcgaggcaagccaccatcaacatcggcaccatcggacacgtcgcgcacgggaaatcgacggtggtgaaggcgatctccggcgtgcagacggtgcggtttaagaatgagctggagagaaacattacgattaagctaggatacgcgaacgcgaagatatacaagtgcgaggatgagaaatgcccgagaccggattgctatcgagcgtactcgtcgacgaaggaggacgcgccggcgtgcgaggtgaagggattcgaggataaaaagatgcagttggtgcgacacgtgtcgtttgtggattgccctggacacgatattttgatggcgaccatgttgaacggggcggccgtgatggatggggcgttgttgttgatcgccgggaacgagacgtgtccgcagccgcagacgagcgagcacttggcggcggtggagattatgcgactgaagcacatcatcattttgcaaaataagattgatttggtgcaagagaacgcggcggcgaaccagtacgatacgatctgcaaattcattcaaggcacgatcgcggatggtgcgcccgtgattccgatctcggcgcagttaaagtacaacatcgacgtcgtgtgcgagtacatcatcaaaaagattccggtgccggagaggaatttcatctccccgccgaacatgatcgtcattcgatcgttcgacgtgaacaaacccggcgcagaggttgaagaaattcaaggcggcgtcgccggtggatcgattctccaaggcgtgttgaaggttggtcaagacatcgaggttcgccccggcatcgtcaccaaggacgcggatgggaaaattcagtgcaagcccatcatgactcgcatcgtttcgctgtttgcggagcaaaacctgcttcagtacgccgtcccgggtggtttaatcggcgtcggtacgacgtgcgacccgacgctcacgcgcgccgatcgcctcgtcggtcaagtgctcggcgaagtcggcaagctccccgaggttttcaccgaactcgaagtcaactttttcctcctccgtcgtctcctcggcgttcgcacccaaggcagcgagcgccaagggaaggtatcgaagctcgccaagagcgaagttttgatgttgaacataggttccatgtgcaccggcgcgcgcgtcgtcgccgtcaagtcggatctcgccaagcttcagctcacgtcgcccgtgtgcaccaaggttggcgaaaaagtcgcgttgagtcgtcgcgtcgagaagcattggcgcttgatcggctgggggtccattcaggccggcaccgagctcagcgaataatagcacattaccatcacgcgtctttcgttttgtaatccaaacctccgacgct

SEQ ID NO: 2596 - DNA, 2490 bp, Arabidopsis thaliana
gagactgattaaacaaaatcgagactttatagtactcaggtttgtcggaatcgactgagtatcgaaattattgtggtgttttgtgaacagaaaccaagcaggattaaagatggttcaatctgtgttaatttcgcgtaacaagggtttggcggagcaagatctaactaagcttgatgtaacaaagttacatcctctgtttcctgaagtcatttctcgccaagcaaccataaatatcggaaccattggtcatgtcgctcacggtaaatcgactatagtgaaagctatctctggtgttcagactgtgcgttttaagaatgaattagagcgtaacattaccattaagcttggttatgcaaatgcaaagatttacaagtgtgaggatgacaagtgccctagaccaatgtgctacaagtcatatgggagtggaaaagaagacaacccaacttgtgatgtccccggatttgagaattgcaagatgacactacggagacatgtctcatgtgtcgattgtccgggacatgatattcttatggcgacaatgctcaatggagcagcaatcgtggatggtgctttacttctaattgctgctaacgagagttgtccacaaccacaaaccgctgaacatcttgcttctgttgatatgatgcgccttaagcatatcataatccttcagaacaagattgatctcattaatgagaaagccgccactgaacagcacgaggctattcagaaatttataacgaacacgaatgctgaggatgcacctatagttcctgtctcagcacaactgaaatacaacattgatgttgtgagtgaatacattgtcaagaagattccaatccctgtgagagactttgtgtcaccaccaaagatgattgtgattcgttctttcgatgtcaataaacctggctcggcgggtcatgaaatgaaaggtggtgttgctggtggaagtatcctccagggtgttttgaaagtgaaccaactgattgaaattagacctggtatcactggcaaagatgagcatggaaactcaaaatgcactccaatttactcgcgtataacttcactatacgcggaacagaacgagcttcagtttgctgtaccgggaggtctaatcggagttggaacaaccatggaccctacgcttacgcgtgctgataggttggttggtcaagtccttggtgaaatgggtactctccctgacgtctttgttgagcttgaagtaagttaccagcttctgactcgtctcattggagtgaggacaaaggaaaaagagaagcaaatgaaagtgtcaaagctaaccaaagaagagatattgatggtgaacatcgggtctatgtctacgggagctaaggttattggagtcaagaaagatatggtgaaactccaactgacgtctccggtgtgtaccaccataggagagaaggttgctttaagccgacgtgtcgataggcattggcgtctaattggtaagggtcagattatggctggaaccaccatcgatgttcctcctcctcctttctaatgaagtagtgatgagttttttatattgtttgcattcaaaaataattaacatgtgcctttgtatgtttaatcactttctttcgactacaatataaaactatattcatatttaacacaacattgacgaaaatttaaaaaacaaattcataatttcattaatgatattacttatcactaattaggaattatataattctaattccctcctcgttctgagcttttgtttcatctttacgctctctcttactctcagccaaaaccctatactctctttcaatcccaatggaagatttggttttgatgaaacagagtcttctaaaaagcttcatcgtctctcttattctcactctcgtcttcctcatctcaccatcatcatcatcttcgaatcaagaaacaagagtatcatcaacacaaaaaacggaagcttatctcaacggttacgaatcaccgcaccaactcgtctacatcaagaaaacgacaccgtttatcttgaaccagcggttgcaacgagacaaccaccgtcgtcgtcgttacaatcaccaatactactactactatcgacatactcttcgtcatcgccgtggtcttcatcatcgtgctggctacttcaagatgatggccaagaagaataacggtttaaaccgtccggttcgacaggatactttctcggttatgcttcccaaaggattcgtacctccttccggttcatctccatgccataaccagaaccctaattccgctactactctcttttgcgatctttctacacaaccctagatatcgttgccgatacgtcgtacgtgaaacgattttgttcctctcgtcgcacttttgtatttttcatcttttaaagatttttttttcttttttgttcggaatgaccggtgcattgatcagtgcatttttgacggtcaagtgtatgaaaataatttgcatactaatgtttgattgttcgtgtcctttgat

SEQ ID NO: 2597 - DNA, 1763 bp, Brachypodium distachyon
caccgccgcagcgacgaagcagagcccacagttttcctccacctttcccctcttctcctctccacctcctcctcctcgcccgtcagccatggcggcgctgtcccgcgcggcctccgcgatccggcggcggggtgccctgcacctgctgcccggtggtgcgccgacgagggcgatggcgtcgctcttcgggcacgtcgagccggcccccaaggaccccatcctcggcgtcaccgaggccttcctcgccgacccgtcccccgacaaagtcaacgtcggcgtcggcgcctaccgggacgacaacggcaagcctgtcgtgctcgactgcgtgcgtgaggcggagcgccggatcgccggcaacctcaacatggagtaccttccaatgggaggaagtatcaagatgattgaagagtcactaaagctggcatatggggaggaatctgagttcatcaaagataaaagaattgcagcggtgcaggcgctttcaggtactggtgcatgccggctctttgctgacttccagaagcgtttcttgccagattcacagatctatatacctacaccaacgtggtccaaccatcacaatatttggagggatgctcaagtgccacagaggacattctcatattaccatccagaatcgagagggcttgattttgcaggactaatggatgatatcaagaatgctccaaatggttcgttctttttgcttcatgcatgtgcccacaatcctactggagtagatcctacagaggaacagtggagagagatttcctatcagttcaagttgaagaaccatttcccattctttgacatggcataccaaggatttgctagtggtgatccagagagagatgccaaggcaatccggatcttccttgaagatggacaccagataggatgtgctcaatcatatgcaaagaacatggggctttatggacagagagcaggatgcctgagtattctgtgtgaggatgagatgcaagcagttgctgtcaagagccaattgcagcagatcgcaagaccaatgtacagcaacccacctgttcatggcgcgctggttgtttctataatcctaaatgatccagacttgaaaagcttatggttgaaagaggtcaagggtatggctgatcgtatcattgggatgcggaaggcacttcgggaaaatcttgaaaagttaggttcacctttgtcatgggagcatgtcaccaatcagattggaatgttctgctacagtgggatgacacctgaacaggttgatcgcttgacaaatgaataccacatttacatgacccgcaatgggagaataagcatggctggtgtaacaacaggaaatgttgcttatttggccaatgctattcatgatgtcactaaatcaaattgaggttccttcctcccaccttcagccaatgaagagcaatttttcttcctttctggggctattcactctatactgtcatactgcagaaataagttgtagcattgtagcatgtctgttgcggctgtcaaacggagaattttatctatatggagaatgagagatgtccgacttgcttggaaagagttaaaagctgatcctgttctttcttttcttttgcaaaaaatggctataccttgattttagcaagacagcaaagaacttctttaagaaattgagcatgtggatgtgtctcttgatgacattatacatgttgatatggccatgctaaccttgggtacgacttttggtaccctcaattctataatatttgaaagatttataatca

SEQ ID NO: 2598 - DNA, 1460 bp, Echinochloa colona
tcctacgcatctctcccggcatggcggcgctgtcccgcgcggcctcttccgcgatccggcggcggccggcgctgccgaggctgctggcggcgagggcgatggcgtcgtcgctgttcggccacgtcgagccggcggccaaggaccccatcctcggcgtcaccgaggccttcctcgccgacccctcgcccgagaaagtcaacgtcggcgtcggcgcctaccgggatgacaacggccagcccgtcgtgctcagctgcgtgcgcgaggccgagcgccggatcgccggcaacctcaacatggagtaccttccaatgggaggcagtataaagatgatcgaagaatcgctgaagctggcgtacggagaggattccgagttcatcaaagataagaggattgctgctgtgcaggcgctttcaggcactggtgcctgccgactctttgctgatttccagaagcgtttcttgccagattcacagatctacatacctacaccaacgtggtccaaccatcacaacatttggagggatgctcaagtgccacagaagacattcacatactaccatccagagtcaagagggcttgattttgcaggattgatgaatgacatcaagaatgctccagatggttcgttctttttgctccacgcatgtgctcataatcctaccggagtagatcctacagaggaacagtggagagaaatatcccatcagttcaaggtaaagaaacattttccattctttgatatggcataccaagggtttgccagcggtgatccagagagagatgccaaggcaatccggattttccttgaagacggacatcaaattggatgtgctcagtcatacgcaaagaacatgggactttatgggcagagagcaggatgcctgagtattttatgtgaggatgaaatgcaagcagtttctgtcaagagccaactgcaacagatcgcaagaccaatgtacagcaacccacctgttcatggtgccctggttgtttctataatcctcaatgatccagaattgaagagtttatggttgaaagaggtcaagggtatggctgatcgtatcattggaatgcggaaggcacttaaggaaaatcttgaaaagctaggttcacctttgtcatgggaccatatcactaatcagattggaatgttctgctacagtgggatgacacctgaacaagttgaccgtttgacaaatgaataccatatttacatgacccgcaatgggaggataagcatggctggtgtaacgacaggaaatgttgcttacttggcaaatgctattcacgaggttaccaaacccaattaagtttggtcctccccccgccggcagatgaaatgaggcttccaagcggcgtttttggttcctgacatattagcattgccattatcgagaaataagttcagcctgttggggctatcaagcggcgaatttcacctgtagatgtgaaaattcagt

SEQ ID NO: 2599 - DNA, 1464 bp, Avena sativa
cagcaacggcatggccatgtctcgcgccgccgcagcgatcagccaacggcggagcgggccgctcctgccaccgtcgaggtccatgtcgtcgttgttcggccacgtggagccggccgccaaggaccccatcctcggcgtcaccgaggccttcctcgccgatccgtcccccgacaaagtgaacgtcggcgtcggcgcctaccgggacgacaacggcaagcccgtcgtgctggactgcgtgcgtgaggcggagcgccggatcgccggcaacctcaacatggagtaccttccaatgggaggaagtatcaagatgattgaagagtcactaaagctggcatacggagaggactccgagttcatcaaagataagagaattgcagcagtgcaggccctttcaggtactggtgcatgccggctcttcgctgatttccagaagcatttcttgcccgattcacagatctacatacctacaccaacatggtccaaccaccataatatttggagggatgctcaagtgccacaaaggacattctcatattaccatccggaatcgagagggcttgattttgcaggattaatggatgatatcaagaatgctccaaatggttcgttctttttgcttcatgcatgtgcccataatcctacaggggtagatcctacagaggaacaatggagagagatatcctatcagttcaagttgaagaaccatttcccattctttgacatggcataccaagggtttgctagtggtgatccagagagagatgccaaggcaatccgtatattccttgaagatggacaccaaattggatgtgctcagtcatatgcaaagaacatgggtctttatggacagagagcaggatgcctgagtattctatgtgaggatgagatgcaagcagttgctgttaagagccaattacaacagattgcgagaccaatgtacagcaacccacctgttcatggtgcgttggttgtttctattatccttaatgatccagaattgaagagcttatggttgacagaggtcaagggtatggctgatcgtatcattgggatgcggaaggcacttcgagagaatcttgaaagcttaggttcacctttatcttgggagcatgttaccaatcagattggaatgttctgctacagtgggatgacacctgaacaagttgatcgattgacaaacgaataccatatttacatgacccgcaatgggagaataagcatggctggtgtaacaacaggaaacgttgtctacttggctaatgctattcatgatgtcactaaatcaaactgaggctccttaattctcaccttcttcagccagtgaaacaagagggtttttcctttccttctggctattcactctatactgtcatactagaggaataagttgtagcaaacctgttgcggctgtctaaacggagaattgtgtctggatatttttaagagagctgtagtcgggatcct

SEQ ID NO: 2600 - DNA, 1694 bp, Avena sativa
tcgtgcaaaaccaccgccgcaacgaagaggcagacagaacccacagatttccacctttcctctccgccccttctcaagctcaccaccacctcctcctccccgcccgtccggcatggcgctgcaccgcgcggcctccgcgatccggcggcgcggggccctgcccctgccgctactggcgggtgcgccggcgagggcgatggcgtcgctcttcgggcacgtcgagccggcgcccaaggaccccatcctcggcgtcaccgaggccttcctcgccgacccgtcccccgacaaagtgaacgtcggcgtcggcgcctaccgggacgaaaacggcaagcccgtcgtgctcgactgcgtgcgcgaggcggagcgccggatcgccggcaacctcaacatggagtaccttccaatgggaggaagtatcaagatgattgaagagtcgctaaagctggcatacggagaggactccgagttcatcaaagataagagaattgcagcagtgcaggccctttcaggtactggtgcatgccggctcttcgctgatttccagaagcgtttcttgccggattcacagatctacatacctacaccaacatggtccaaccaccataatatttggagggatgctcaagtgccacaaaggacattctcatattaccatccagaatcgagagggcttgattttgcaggattaatggatgatatcaagaatgctccaaatggttcgttctttttgcttcatgcatgtgcccataatcctacaggggtagatcctaccgaggaacaatggagagagatatcctatcagttcaagttgaagaaccatttcccgttctttgacatggcataccaaggatttgctagcggtgacccagagagagatgccaaggcaatccgtatattccttgaagatggacaccaaattggatgtgctcagtcatatgcaaagaacatgggtctttatggacagagagcaggatgcctgagtattctatgtgaggatgagatgcaagcagttgctgttaagagccaattacaacagattgcgagaccaatgtacagcaacccacctgttcatggtgcgttggttgtttctattatccttaatgatccagaattgaagagcttatggttgacagaggtcaagggtatggctgatcgtatcattgggatgcggaaggcacttcgagagaatcttgaaagcttaggttcacctttatcttgggagcatgttaccaatcagattggaatgttctgctacagtgggatgacacctgaacaagttgatcggttgacaaacgaataccatatttacatgacccgcaatgggagaataagcatggctggtgtaacaacaggaaacgttgtctacttggctaatgctattcatgatgtcactaaatcaaactgaggctccttaattcttaccttcttcagccagtgaaacaagagggtttttcctttccttctggctattcactctatactgtcatactagaggaataagttgtagcaaacctgttgcggctgtctaaacggagaattgtgtctggatatttttaagagagctgtagtcgggatcctatttttgactgttcctctcgtggtaaatgtaacgccagtgaaaaatggccgtcctttattttaacgagcacttgcggatttttttttcgagagtaggcaactgcataacttacttt

SEQ ID NO: 2601 - DNA, 1665 bp, Secale cereale
cccgcaccgcaccgagcccacagatttccttccccctttcccctcccctcctccggccggcgaagaatctcaccgccgccgccccctccccgccggcccgccatggcgctgtaccgccgcgcggcctccgcgatccggcggcgcggggcagggcccctgcccctgctcccggcgcgggcgatggcgtcgctcttcggccacgtcgagccggcgcccaaggaccccatcctcggcgtcaccgaggccttcctcgccgacccctcccccgacaaagtcaacgtcggcgtcggcgcctaccgggacgacaacggcaagcccgtcgtgctcgactgcgtgcgcgaggccgagcgccggatcgccggcaacctcaacatggagtaccttccaatgggagggagtatccacatgattgaagagtcgctaaagctggcgtatggcgaggactccgagttcatcaaagataaaagaattgctgcggtgcaggcactttcaggaactggtgcatgccggctcttcgctgatttccagaagcgtttcttgccggattcgcagatctacatacctacaccaacttggtccaaccatcataatatttggagggatgctcaagtgccacagaggacgttctcatattaccatccggaatcgagagggcttgactttgcaggattgatggatgatatcaagaatgctccaaatggttcgttctttttgcttcatgcatgtgcccataatcctactggagtagatcctactgaggaacaatggcgagaaatatcctatcagttcaagttgaagaaccatttcccattttttgacatggcataccaaggatttgctagcggtgatccagagagagatgccaaggcaattcgtatattccttgaagatggacaccaaattggatgtgctcagtcatatgcaaagaacatgggtctttatggacaaagagcgggatgtctaagtattctctgcgaggatgagatgcaagcagttgctgttaagagccaattgcagcagattgcgagaccaatgtacagcaacccacctgttcatggtgcgctggttgtttctattatccttagtgatccagaattgaagaacttatggttgggagaggtcaagggtatggctgatcgtatcattggaatgaggaaggcacttcgggagaatcttgaaaatttaggttcgcctttatcatgggagcatgtcaccaatcagattggaatgttttgctacagtgggatgacaccggagcaagtcgaccgcctgacaagtgaataccatatctacatgacacgcaacgggagaataagcatggccggcgtaacgacgggcaacgtcgcctacttggctaacgccattcatgatgttaccaagtaaaattgaggacccatcttcagcgaatggagcgagagcgttcaccctttgttactatagggctattcactctatactgtcgtgctagagaaataagttctaggaagtaaacctgttgcggctgtccaacaacggaaaacaattccacctgtgtgtatggagaagcagagacgtcctgacttacttttgcgagatcatcctatttttgattctggtcgcattcgaatgtaacgccggtggaaaacgggtggttatgccttgattttaacaagatgccggaggact

SEQ ID NO: 2602 - DNA, 1692 bp, Sorghum bicolor
gcagggcagtgacaaaatcccacagccacagccttcgccccccaactttcttgccccgtccgtttccctctctgacgccgccgcccgccgccgcgcccctgcctgtcccgtcccggcatggcgatgctctcccgcgcggcctcctccgcggcccggcgcccggcactgctgccgccgagcctgctggcggcgagggcgatggcgtcgtcgctcttcggccacgtcgagccggcgcccaaggacccaatcctcggcgtcaccgaggctttcctcgccgacccctcgcccgacaaagtcaacgtcggcgtcggcgcctaccgggacgacaacggccagcccgtcgtgctcagctgcgtgcgcgaggccgagcgccggatcgcgggcaacctcaacatggagtaccttccgatgggaggcagtatcaagatgattgaagagtcactgaagctggcgtacggtgaggattctggcttcatcaaagataagaggatagcagcggtgcaggctctttcaggcactggtgcctgccggctctttgctgatttccagaagcgttttttgccggattcgcagatctacataccaacaccaacgtggtccaaccatcacaatatctggagggatgctcacgtgccacagaagacattcacatactaccatccagagtcaagagggcttgatttttcaggattgatgaatgacatcaagaatgctccagacggttcattctttttgcttcatgcatgtgcccataatcctactggtgtagatcctacagaggaacaatggagagaaatatcccatcagttcaaggtgaaaaaacatttcccattctttgacatggcataccaagggtttgccagtggtgatccagagagagatgccaaggcaatccgaattttccttgaagatggacaccaaattggatgtgctcagtcatacgcaaagaacatgggactttatggacagagagcgggatgcctgagtattctgtgtgaggatgagatgcaagcagttgctgtcaagagccaactgcaacagatcgcgagaccaatgtacagcaacccacctgttcatggtgcactggttgtttctataatcctcaatgatccagaattgaagagtttatggttaaaagaagtcaagggtatggctgatcgtatcattggcatgcggaaggcacttaaggaaaatcttataaagctaggttcacctttgtcatgggatcatatcactaatcagattggaatgttctgctacagtggtatgacacctgaacaagttgaccgtttaacaaatgaataccatatttacatgacccgcaatgggaggataagcatggctggtgtaacaacaggaaatgttgcttacttggcaaatgcgattcatgaggttaccaaaccaaactgagttacggtcctacctttggcggatgaaatgaggctttgaggcaccttttttttttctttcctgacataataacatggtcgttctggtgaaataagtgaagcctgcggtcccacatgcatggagactcagagatgtaaaacttcagttttgagagctatatacatgttgatcctattcctcgtattttctgtttcccggtcttgtcatgacaaattgttaccccagctgcaaaaggctatagcataatttaaaaacttcagttttgagagctacatgctgatc

SEQ ID NO: 2603 - DNA, 1750 bp, Saccharum officinarum
caactttcctcccccgcccgtttccctctctgctgccgccgccgctcgccgccgcacaaccctgcctgcggcatggcgacgctctcccgcgcggcctcctccgcggcccggcgcccggcactgctgccgccgaggctgctggcggcgagggcgatggcgtcgtcgctcttcggccacgtcgagccggcgcccaaggaccccatcctcggcgtcaccgaggctttcctcgccgacccctcgcccgacaaagtcaacgtcggcgtcggcgcctaccgggacgacaacggccagcccgtcgtgctcagctgcgtgcgcgaggccgagcgccggatcgcgggcaacctcaacatggagtaccttccgatgggaggcagtatcaagatgattgaagagtcactgaagctggcgtacggagaggattctggcttcatcaaagataagaggatagcagccgtgcaggctctttcaggcactggtgcctgccggctctttgctgatttccagaagcgctttttgcctgattcgcagatctacataccaacaccaacgtggtccaaccatcacaatatttggagggatgctcaagtgccacagaagacattcacatactaccatccagagtcaagagggcttgatttttcaggattgatgaatgacatcaagaatgctccagacggttcattctttttgcttcatgcgtgtgctcataatcctactggtgtagatcctacagaggaacaatggagagaaatatcccatcaattcagggtgaaaaagcattttccattctttgacatggcataccaagggtttgccagtggtgatccagagagagatgccaaggcaatccgaattttccttgaagatggacaccaaattggatgtgctcagtcatacgcaaagaatatgggactttatggacagagagcaggatgcctgagtattctgtgtgaggatgagatgcaagcagttgctgtcaagagccaactgcaacagatcgcaagaccaatgtacagcaacccacctgttcatggtgcattggttgtttctataatcctcaatgatccagaattgaagagtttatggttaaaggaagtcaagggtatggctgatcgtatcattggcatgcggaaggcacttaaggaaaatcttgaaaagctaggttcacctttgtcatgggatcatatcactaatcagattggaatgttctgctacagtgggatgacacctgaacaagttgaccgtttaacaaatgaataccatatttacatgacccgcaatgggaggataagcatggcgggtgtaacaacaggaaatgttgcttacttggcaaatgcgattcatgaggttaccaaaccaaactgagttatacggtcctaccttcggccgatgaaacgggggctttgaagcgccttttttctttcctgacataataacatggtcgttctggagaaataagttgagcctgctggtcccacacatgcatggagactcagagatgtcaaactccagttttgagagctacatgctgatcctgtttcttctattttctgttttccggtctttgtcatgacaattgttacaccagctgcaaaaggctatagcataaagtaaaacttcagttttgagagttacatactgatcctgtttcttctattttgtgtttttcggtattgtcatgacaattgttacaccactagaccagctgcaaaaaggctgtagcataattatagtgcaaaattaagaactt

SEQ ID NO: 2604 - DNA, 1846 bp, Setaria italica
ggcgcagcgaccacacccaaagcccacagctttcctccccctcccctcctccccggcgcggcggcgccacccagcaagccaccagacttagctcccaccaccaccgtcccggcatggcggcgctgtcccgcgcggcctcctccgcgatccggcgcccgctgccgaggctgcagctgcaggcgagggcgatggcgtcgtcgctgttcggccacgtcgagccggcgcccaaggaccccatcctcggcgtcaccgaggccttcctcgccgacccctcgcccgacaaggtcaacgtcggcgtcggcgcctaccgggacgacaacggccagcccgtcgtgctcgactgcgtgcgcgaggccgagcgccggatcgccggcaacctcaacatggagtaccttccaatgggaggtagtataaagatgatcgaagaatcgctgaagctggcgtacggagaggactctgagttcatcaaagataagaggatcgctgcagtgcaggcgctttcgggcactggtgcctgccggctctttgctgattttcagaagcgtttcttgccggattcgcagatctacatacctacaccaacgtggtccaaccatcacaatatttggagggatgctcaagtgccacagaagacattcacatactaccatccagagtcgagagggcttgatttttcaggattgatgaatgatatcaagaatgctccagatggttcattctttttgctccatgcatgtgctcataaccctactggtgtagatcctacagaggaacaatggagagaaatatcgcatcagttcaaggtgaagaaacattttccattctttgacatggcttaccaagggtttgccagcggtgatccagagagagatgccaaggcaatccgaattttccttgaagatggacaccaaattggatgtgctcagtcatatgcaaagaacatggggctttatggacagagagcaggatgcctcagtattttgtgtgaggatgagatgcaagcagttgctgtcaagagccagctgcaacagattgcaagaccaatgtacagcaacccacctgttcatggtgcactggttgtttctataatcctcaatgatccagagctgaagagtttatggttaaaagaggtcaagggtatggctgatcgtatcattggaatgcggaaggcacttaaggaaaatcttgaaaacctaggttcacctttgtcgtgggagcacattactaatcagattggaatgttctgctacagtgggatgacacctgaacaagttgaccgtttgacagatgaatatcatatttatatgacccgcaatgggaggataagcatggctggtgtgacgacaggaaatgtttcgtacttggcaaatgctattcatgaggttaccaaagcaaattgagtatcgtcctactaccctcatcagccaacgaaatgaggcttccaagcagcttttttggttcctgacatattaacattatcattctcgagaataagttgagcctgttggggctgtccaacggagaatttcacaagaatgagaaccatagagttcgatctgattttgttcatttcttttccttttatccatcttctcatgacaattcttaaactagctgcaaatggctgtagcatgatttaaggtgttaataaaataaaagcggtggaattgagaactatgggttttctttcgttcagcttgataccataggatgggaccatcctgtcccggtgtttcagctactttggttggggcgtttcagctagtcagctactttggttgcgaaaggcttgccctaagcatttttgtaatttgtattctactcgtaattgctatactaatcagct

SEQ ID NO: 2605 - DNA, 1619 bp, Festuca arundinacea
ggcacgagggccacatcctcctccccgcccgcccggcatggcgctgcaccgcgcggcctccgcgatccggcgccgcgggcccctgcccatgcccctgctgccgggcagcgcgccggcgagggcgatggcgtcgctcttcggccacgtcgagccggcgcccaaggaccccatcctcggcgtcaccgaggccttcctcgccgacccctcccccgacaaagtgaacgtcggcgtcggcgcctaccgggacgacaacggcaagcccgtcgtgctcgactgcgtgcgccaggcggagagccggatcgccggcaacctcaacatggagtaccttccaatgggaggaagtatcaagatgattgaagagtcgctaaagctggcgtatggagaggaatctgagttcatcaaagataagaggattgcagcggtgcaggcgctttcaggtactggtgcatgccggctcttcgctgatttccagaagcgtttcttgccggattcacagatctacatacctacgccaacatggtccaaccaccataatatttggagggatgctcaagtgccacagaggacatactcatattaccatccagaatcaagagggcttgatttcgcgggattgatggatgatatcaagaatgctccaaatggctcattctttttgcttcatgcatgtgcccataatcctactggggtagatcctacagaggaacaatggagagagatatcctatcagttcaagttgaagaaccatttcccattctttgacatggcgtaccaaggatttgctagcggtgatccagagagagatgccaaggcaatccgtatattccttgaagatgggcaccaaattggatgcgctcagtcgtatgcaaagaacatgggtctttatggacagagagctggatgcctgagtgttctatgcgaggatgagttgcaagcagttgctgttaaaagccaattgcaacagattgcgagaccaatgtacagcaacccacctgtccatggcgcattggttgtatctattatccttaatgatccagaattgaaaagcctatggttgaaagaggtcaagggtatggctgatcgtatcattggaatgcggaaggcacttcgggagaatctcgaaaacttaggttcacctttatcatgggagcatgttaccaatcagattggaatgttctgctacagtgggatgacacctgaacaagttgatcgcttgacaaatgaataccatatttacatgacacgcaacgggagaataagcatggctggtgtaacaacaggaaatgttgcctacttggctaatgccattcatgatgtcactaaataaaactgaggcttcttactctcacctccttcagccaatgaaacaagagcgttttttatttcttttgacggctattcactatataccatgatactagagaaataagttgtagcaaacctgttgcggctgtctaaatgaagaattgtacctggatgtctttgagagaactgtagtctggatcctatttttgactgttcctttagtggtaaatgtaacgagccagtggaaaatggttatacctttattttaatgagaactccaggaatttgaacttcaaaaaaaaaaaaaaaaaaaa

SEQ ID NO: 2606 - DNA, 1650 bp, Zea mays
agcttcttctccctactcctccagtcctccgtcatccgtttcgctctctgccgccgccaccgcacaagaagctagctcctgcctgtaccgccccgtcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcactgaagctggcgtacggagaagattctgacttcatcaaagataagaggatagcagcggtgcaggcgctttcaggcactggtgcctgccggctctttgctgatttccaaaagcgttttttgccggattcgcagatctacataccaacaccaacgtggtccaaccatcacaatatttggagggatgctcaagtgccacagaagacattcacatactaccatccagagtcaagagggcttgatttctcaggattgatgaatgaaatcaagaatgctccagatggttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggaggataagcatggctggtgttacgacaggaaatgttggttacctagcaaatgcaattcatgaggttaccaaaccaaattgagttagggtcctaccttctttggtcgatggaagctgatggaatgagactgtgaagcggcgtttccccccctctgttcctgacagaaataagtttagcctgctgctaccatatacatggacacagactcagatgtagacactcaagttttgagagctgtgatcctgtttcatttaatcaaaaacaattttgtttttttttcatcttgtcatggcaaatgttacaccagctgcaaaataattacaataattgatcttgatcca

SEQ ID NO: 2607 - DNA, 1611 bp, Secale cereale
cgcgcgtaccgccgcccggcctccgcgatccgcggcgcggggcaggggccctgcccctgctcccggcgcgggcgatggcgtcgctcttcggccacgtcgagccggcgcccaaggaccccatcctcggcgtcaccgaggccttcctcgccgacccctcccccgacaaagtcaacgtcggcgtcggcgcctaccgggacgacaacggcaagcccgtcgtgctcgactgcgtgcgcgaggccgagcgccggatcgccggcaacctcaacatggagtaccttccaatgggagggagtatccacatgattgaagagtcactaaagctagcgtatggcgaggactccgagttcatcaaggataaaagaattgcagcggtgcaagcactttcaggaactggcgcatgccggctcttcgctgatttccagaagcgtttcttgccggattcgcagatctacatacctacaccaacatggtccaaccatcataatatttggagggatgctcaagtgccacagaggacattctcatattaccatccggaatcgagagggcttgactttgcaggattgatggatgatatcaagaatgctccaaatggttcgttctttttgcttcatgcatgtgcccataatcctactggagtagatcctaccgaggaacaatggcgagaaatatcctatcagttcaagttgaagaaccatttcccattctttgacatggcataccaaggatttgctagcggtgatccagagagagatgccaaggcaatccgtatattccttgaagatggacaccaaattggatgtgctcagtcatatgcaaagaacatgggtctttatggacagagagcaggatgcctgagtattctctgcgaggatgagatgcaagcagttgctgttaagagccaattgcaacagattgcgagaccaatgtacagcaacccacctgttcatggtgcgctggttgtttcaattatccttagtgatccagaattgaagaacttatggttgggagaggtcaagggtatggctgatcgtatcattggaatgaggaaggcacttcgggagaatcttgaaaagttaggttcacctttatcatgggagcatgtcaccaatcagattggaatgttttgctacagtgggatgacaccggagcaagtcgaccgcctgacaagtgaataccatatctacatgacacgcaacgggagaataagcatggccggcgtaacgacgggcaacgtctcctacttggctaatgccattcatgatgttaccaagtcaaattgagggacccatcttcagcgaatggagcgagagcgttttccctttgttaccagggcttttcactctgtactgtcgtgctagagaaataagttctaggaagtaaacctgttgcggctgtccaacaacggaaaattccacctgtgtgtaggaagtaaaccttttgcgagattatcctatttttgattctggtcacattcggtggaaaacgggtggttatgccttgatttgaacaagatgccggaggagttcagactcgacgaaatcgaacattttgacgtgtgtctcttgcagttgtagatccaagcgaaagctcggtttgtgatactgagat

SEQ ID NO: 2608 - DNA, 1774 bp, Hordeum vulgare
accgccgcgcggcctccgcgatccggcggcgcggggccccgtccacgcccctgccgctgctcccggcgcgggccatggcgtcgctcctcggccacgtcgagccggcgcccaaggaccccatcctcggcgtcaccgaggccttcctcgccgacccctcccccgacaaagtcaacgtcggcgtcggcgcctaccgggacgacgacggcaggcccgtcgtgctcgactgcgtgcgcgaggcggagcgccggatcgccggcaacctcaacatggagtaccttcccatgggagggagtatccacatgattgaagagtcgctaaagctggcgtatggtgaggactccgagttcatcaaagataaaagaattgcagcggtgcaggcactttcaggaactggcgcatgccggctcttcgctgatttccagaagcgtttcctgccggattcgcagatctacatacctacaccaacgtggtccaaccatcataatatttggagggatgctcaagtgccgcagaggacattctcatattaccacccggaatcgagagggcttgactttgcaggattgatggatgatatcaagaatgctccaaatggttctttctttttgcttcatgcatgtgcccataatcctactggagtagatcccactgaggaacaatggcgagaaatatcctatcagttcaagttgaagaaccatttcccattctttgacatggcataccaaggatttgctagcggtgatccagagagggatgccaaggcaatccgtatattccttgaagatggacaccaaattggatgtgctcagtcatatgcaaagaacatgggtctttatggacagagagcgggatgcctgagtattctctgcgaggatgagatgcaagcagttgctgttaagagccaattgcaacagattgcgagaccaatgtacagcaacccacctgttcatggtgcgctggttgtttctattatccttaatgatccagaattgaagaacttatggttgggagaggtcaagggtatggctgatcgtatcattggaatgcggaaggcacttcgggagaatcttgaaaagttaggttcacctttatcatgggagcatgtcaccaatcagattggaatgttttgctacagtgggatgacgcctgaacaagtcgaccgcttgacaagtgaataccatatctacatgacacgcaacgggagaataagcatggccggcgtaacgacgggcaacgtctcctacttggctaatgccattcatgatgttaccaagtgaaatcgaggaccatcttcagcgaatggagcgaaaggggttttccctttgttactggggctattcattctatactgtcatgctagagaaataagttctaggaagtaaacctgttgcggctgtccaacaacggaaaattctacctgtatgtatggagaagcagagacgtcccgacttatttttgccagattatcttattgtgattctagtcacattcgaatgaaacgccagtggaaaatgcttggttataccttgattttaacaagatgctggaggacttcaaactcgacgaaatcaaacatttggatactctcttgcagttctagctccaagcatatgcttttttcttcaccattcgagatgtttggcttgggtctaagcagaataatgtgctccactatcttcccagtgtagtatgatatgcaggattctaaagttttttgtttcttttctgaaatggataggattctaaagtttcaagtatgatattaccacacctg

SEQ ID NO: 2609 - DNA, 1670 bp, Pennisetum glaucum
cagcgaccccacccaaagcccacagcttttcctccccctcccctcatcctcggtgcggcggcgccgcccagcaagccaccagctagctcccaccacctccgtctcagcatggcggggctgtaccgcgcggccacctcggcgatccggcgcccgctgccgaggctgcagctgcaggcgagaacgatggcgtcgtcgctgttcggccacgtcgagccggcgcccaaggaccccatcctcggcgtcaccgaggccttcctcgccgacccctcgcccgaaaaggtcaacgtcggcgtcggcgcctaccgggacgacaacggccagcccgtcgtcctcgactgcgtgcgcgaggccgagcgccggatcgccggcaacctcaacatggagtaccttccaatgggaggcagcataaagatgatcgaagaatcgctgaagctggcgtacggagaggactctgagttcatcaaagataagaggatagctgcagtgcaggcgctttcgggcactggtgcttgtcggctctttgctgattttcagaagcgtttcttgccggattcacagatctacatacccacaccaacgtggtccaaccatcacaatatttggagggatgctcaagtgccacaaaagacattcacatactaccatccagagtcgagagggcttgatttttcaggattgatgaatgatatcaagaatgctccagatggttcgttctttttgctccatgcatgtgctcataaccctactggtgtagatcctacagaggaacaatggagagaaatatcgcatcagttcaaggtgaagaaacattttccgttctttgacatggcataccaagggtttgccagcggtgacccggagagagatgtcaaggcaatccgaattttccttgaagatggacaccaaattggctgtgctcagtcatacgcaaagaacatggggctttatggacagagagcaggatgcctaagtattttgtgtgaggatgagatgcaagcagttgctgtcaagagccagctgcaacagattgcaagaccaatgtacagcaacccacctgttcatggtgcactggttgtttctattatcctcaatgatccagagctgaagagtttatggttaaaagaggtcaagggtatggctgatcgtatcattgggatgcggaaggcgcttaaggaaaatcttgaaaagctaggttcacctttatcatgggagcacattaccaatcagattggaatgttctgctacagtgggataacacctgaacaagttgaccgtttgacaaatgaatatcatatttatatgacccgcaatgggaggataagcatggctggtgtgacgacaggaaacgttccttacttggcaaatgctattcatgaggttaccaaaccaaattgagtaccggcccacaaccatcatcaaacgaaatgaggattccaagtggcttttttttgttcctgacaaattaacattatgattctcgagaataagttgagcctgtttgggctgtctaatggagagtttcacatgaatgagaaccatagagttacatctgattttgtttattttcttttccgtaatatccatcttgtcatgacaattcttaaactagctgcaaatggctaaagcgtgatttaaagtgttaataaaacaaaagcggcaaaattgagaac

SEQ ID NO: 2610 - DNA, 1585 bp, Avena sativa
ccccacgacccaagccaccttcgcatctcttctccagcaaagctctcactctcaccccacgcgccctccgcgttcagtaacggcatggcgatgtctctcgccgccgcagcgatcaggcaacggcggagtgggccgctccttccaccgtcgaggtccatggcgtccttgttcggccacgtggagccggccgccaaggaccccatcctcggcgtcaccgaggccttcctcgccgatccctcgccggacaaagtgaacgtcggcgtcggcgcgtatcgggacgacaacgggaagccggtggtgctggagtgcgtgcgcgaggcggagcggcgcatcgccgggaacgccaacatggagtaccttcccatgggaggaagtgtcaagatgattcaggaatcgctgaagctggcttatggggaggattctgagttcatcaaggacaagaggattgctgcagtgcaggctctttcagggacgggtgcatgtcgcctctttgccgatttccagaaacgtttcttgccagattcgcagatatacatacctaccccgacatggtcaaaccatcacaatatttggagggatgcccaggtaccacaaagaacatttgcctactaccatccagagtcgaaaggattggattttgcaggcctgatggatgatatcaagaaagcgccagatggttccttctttttgcttcatgcatgtgctcacaatcccactggggtagatccttctgaggagcaatggagagagatatctcatcaattcaagttgaagaaccatttcccattcttcgacatggcataccaaggatttgccagtggtgaccctgagagagatgccaaggcaattcggatctttcttgaagatgggcatcaaattggatgtgcacagtcctatgcgaaaaacatgggactctatggccaaagagcaggatgccttagtattctatgtgacgatgagatgcaagcagttgcggtgaagagccaactgcaacagattgccagacctatgtacagcaacccaccacttcatggggcactagttgtttccacaatccttggtgatccagcactgaaaacattatggctgaaagaagtcaagggtatggctgatcgcattattggaatgcggaaagcacttaaggaaagtcttgaaaagttgggttcaccattatcatgggaacatattactaatcagattggcatgttttgctacagcgggatgacacctgaacaagttgatcgtttaacaaaagaattccacatatacatgactcgtaatggcaggataagcatggctggtgtaacgacaggaaatgtcgcctacttggcaaacgctattcatgaggtcaccaagcaaaattaagatccctttgtcatgtcatcttgggaaataagaggagcctttcagcttcaagtttcaagcggcagcttgtaatcgtttaaacctttgctgaccacgacatggtcagatacagagaaaaaatactgttatttctctcaaacaacgtcccatattgccgtgacctattgggtgtactgattattgatttcttttactggatacactgcacaggcactcaggc

SEQ ID NO: 2611 - DNA, 2088 bp, Triticum aestivum
cctaagtgtgccattgctgaattttgtgtagactcgtattcgcgagagttccatccaacggaacaaccgccacacttacaaccatgttccacgtggcacgtgcggccgcgcatgatatcattgaagtactggcacagcaaactccggaagagcacaaggccccagtacagaacaacatagcggcacgcaacacgccagccgcagcaaagcgccgtgccgcgccgcttccccaggacccaagtcacctgccatctcctctctcctccagctgcagcaacctcgccacgcgccgggcgcagcagcgacatggcgatgtctcgcgccgccgcggcggtcgggcagcggaggtgcgggccgctcctgcccgcggcgaggtccatggcgtcgtggttcggccacgtggagccggccgccaaggaccccatcctcggcgtcagcgaggccttcctcgccgacccctcgccggacaaagtgaacgtcggcgtcggtgcgtaccgggacgacgacgggaagcccgtggtgctcgagtgcgtgcgcgaggcggagcggcgcatcgccgggagcaccaacatggagtaccttccgatgggaggaagcgtgaagatgattgaggaatcgctgaagctggcatacggggaggattctgagttcatcaaggacaagaggatcgcggcagtgcaggctctttcagggactggtgcatgtcgcctctttgcagatttccagaaacgcttcttgccggattcacagatctacatacctacgcctacatggtcaaaccatcacaacatttggagggatgcccaggtaccacaaagaacatttgcctactaccatccagagtcaagaggactggactttgcaggcctaatggatgatatcaagaatgctccagagggttccttctttttgcttcatgcgtgtgctcacaatcccactggggttgatccttctgaggaacaatggagagagatatctcaccagtttaaggtgaagaaccatttcccatttttcgacatggcgtaccaaggatttgccagtggtgacccagagagagatgccaaggctattaggatctttcttgaagatggacatcaaattggatgtgcacagtcgtatgcaaagaacatgggactttatggccaaagagcaggatgccttagtattctctgtgacgatgaaatacaagcagttgctgtgaagagccaattacaacagattgccagacctatgtacagcaacccaccccttcatggcgcactaattgtttccactatccttggtgatccagcactgaaaagcttatggctgaaggaggtcaagggtatggctgatcgcattattggaatgcgaaaagcacttaaggagagtcttgaaaagttgggttcaccattatcatgggaacatattactaatcagattggcatgttttgctacagcgggatgacacctgaacaagttgatcgcttgacaaatgaattccacatatacatgactcgtaatggcaggataagcatggctggtgtaacaacaggaaatgtcgcctatttggctaacgctattcatgaggtcactaagccaatttaagaccccttcctcctcctgccattttgagaaataagaggagcctttcaacttcaagttgcagtttgcttttaatttccttaaaccttttatgttccaacaatgttgtttttatcaaacaatgtcccatattgttgtgacctatgggtgtgcaaatattgatttgtttcatcggagacacagaaaggaacactttattagtaagaactaaactgatcctgtattacagttgcagaggatgccctaacactgaaaatgtcatcgtttaagaaaaattaggaggagctgagctcctgtgacgcatatgaagaaatgcagttggcatctccaagtgcacagtgttttgttatagtattcgaaataattggaactatcatatccacaatcagaagataggactaggtagtccaacataacacgtctaactgttatgtcaaaatcataattgaatttgtgttaaaactgtcaatgcacaaatacagacatgcagcgatgcatatatat

SEQ ID NO: 2612 - DNA, 1583 bp, Avena sativa
gacccaactcaccttcttcttcccatctcttcacttcacttctccagcaacaaactccagctaagctctcaccccacgtaggcgccgcgagcagcaacggcatggccatgtctcgcgccgccgcagcgatcaggcgacaacacccgagcgggccgctcctgccgccgtcgaggtccatggcgtccttgttcggccacgtggagccggccgccaaggaccccatcctcggcgtcaccgaggccttcctcgccgatccctcgccggacaaagtgaacgtcggcgtcggcgcgtatcgggacgacaacgggaagccggtggtgctggagtgcgtgcgcgaggcggagcggcgcatcgccgggaacgccaacatggagtacctcccaatgggaggaagtgtgaagatgattcaggaatcgctgaagttggcctatggggaggattctgagttcatcaaggacaagaggattgctgcagtgcaggctctttcagggacgggtgcatgtcgcctctttgccgatttccagaaacgtttcttgccagattcgcagatatacatacctaccccgacatggtcaaaccatcacaatatttggagggatgcccaggtaccacaaagaacatttgcctactaccatccagagtcgaaaggattggattttgcaggcctgatggatgatatcaagaaagcgccagatggttccttctttttgcttcatgcatgtgctcacaatcccactggggtagatccttctgaggagcaatggagagagatatctcatcaattcaagttgaagaaccatttcccattcttcgacatggcataccaaggatttgccagtggtgaccctgagagagatgccaaggcaattcggatctttcttgaagatgggcatcaaattggatgtgcacagtcctatgcgaaaaacatgggactctatggccaaagagcaggatgccttagtattctatgtgacgatgagatgcaagcagttgcggtaaagagccaactgcaacagattgccagacctatgtacagcaacccaccacttcatggggcactagttgtttccacaatccttggtgatccagcactgaaaacattatggctgaaagaagtcaagggtatggctgatcgcattattggaatgcggaaagcacttaaggaaagtcttgaaaagttgggttcaccattatcatgggaacatattactaatcagattggcatgttttgctacagcgggatgacacctgaacaggttgatcgtctaacaaaagaattccacatatacatgactcgtaatggaagaataagcatggccggtgtaacaacaggaaatgtcgcctacttggcaaacgctattcatgaggtcaccaagcaaaattaagatccctttgtcatgtcatcttgggaaataagaggagcctttcagcttcaagcttcaagcggcagcttgtaatcgtttaaacctttgctgaccacgacatggtcagatacagagaaaaaatactgttatttttctcaaacaacgtcccatattgctgtgacctatttggtgtacgaattattgatttcttttactgga

SEQ ID NO: 2613 - DNA, 1567 bp, Avena sativa
gcgctcagcaacagcaacggcatggccatgtcacgcgccgccgcagcgatcaggcgacaacggccgagcgggccgctcctgccaccgtcgaggtccatggcgtccttgttcggccacgtggagccggccgccaaggaccccatcctcggcgtcaccgaggccttcctcgccgacccctcgccggacaaagtgaacgtcggcgtcggcgcatatcgggacgacaacgggaagccggtggtgctggagtgcgtgcgcgaggcggagcggcgcatcgccgggaacgccaacatggagtaccttcccatgggaggaagtgtcaagatgattcaggaatcgctgaagctggcttatggggaggattctgagttcatcaaggacaagaggattgcggcagtgcaggctctttcaggaactggtgcatgtcgcctctttgccgatttccagaaacgcttcttgccagattcacagatatacatacctacccctacatggtcaaaccatcacaatatttggagggatgcccaggtaccacaaagaacatttgcctactaccatccagagtcgaaaggattggattttgtaggcctgatggatgatatcaagaaagctccagatggttccttctttttgcttcatgcatgtgctcacaatcccactggggtagatccttctgaggagcaatggagagagatatctcatcaattcaagttgaagaaccatttcccattcttcgacatggcataccaaggatttgccagtggtgaccctgagagagatgccaaggcaattcggatctttcttgaagatgggcatcaaattggatgtgcacagtcctatgcgaaaaacatgggactctatggccaaagagcaggatgccttagtattctatgtgacgatgagatgcaagcagttgcggtaaagagccaactgcaacagattgccagacctatgtacagcaacccaccacttcatggggcactagttgtttccacaatccttggtgatccagcactgaaaacattatggctgaaagaggtcaagggtatggctgatcgcattattggaatgcggaaagcacttaaggaaagtcttgaaaagttgggttcaccattatcatgggaacatattactaatcagattggcatgttttgctacagcgggatgacacctgaacaggttgatcgtctaacaaaagaattccacatatacatgactcgtaatggaagaataagcatggccggtgtaacaacaggaaatgtcgcctacttggcaaacgctattcatgaggtcaccaagcaaaattaagatccctttgtcctgtcatcttgggaaataagaggagccttttcagcttcaagtttcaagcggcggcttgtaattgttttaacctttgctgaccaggacatggtcagatagagagagaaagtattgttatgctctcaaacaacgtcccatattgctgtgacctatttgggtacacaggcagcaccaccttagttttgggaattagactgatcatgtattgcagttacagagaacgtgttaacactgcaatgtcatccttttt

SEQ ID NO: 2614 - DNA, 1602 bp, Secale cereale
tagagaacaacatagcggcacgcaacacgccagccgcagcaaagcgccgtgccgcgccgcttccccaggacctcaagtcacctgccatctcctctctcctgcagcaggagcaacctcgccacgcgccggcgccgcgcgcagcaacggcatggcgatgtctcgcgccgcggcggcggtcggccagcgccggtgcgggccgctcctgcccgcagcgaggtccatggcgtcgtggttcggccacgtggagccggccgccaaggaccccatcctcggcgtcaccgaggccttcctcgccgacccctcgccggacaaagtgaacgtcggcgtcggtgcgtatcgggacgacggcgggaagcccgtggtgctcgagtgcgtgcgcgaggcggagcggcgcatcgccgggagcaccaacatggagtaccttccgatgggaggaagcgtgaagatgattgaggaatcgctgaagctggcatacggggaggattctgagttcatcaaggacaagaggatcgcggcagtgcaggctctttcagggactggtgcatgccgcctctttgcagatttccagaagcgcttcttgccggattcacagatctacatacctacgcctacatggtcaaaccatcacaacatctggagggatgcccaggtaccacaaaaaacatttgcctactaccatccagagtcaagaggactggactttgcaggcctgatggatgatatcaagaacgctccagagggttccttctttttgcttcatgcatgtgcgcacaatcccactggggttgatccttctgaggaacagtggagggagatatctcaccagtttaaggtgaagaaccatttcccatttttcgacatggcataccaaggatttgccagtggtgacccagagagagatgccaaggctattaggatctttcttgaagatggacatcaaattggatgtgcacagtcgtatgcaaagaacatgggactttatggccaaagagcaggatgccttagtattctctgtgacgatgaaatacaagcagttgctgtgaagagccaattacaacagattgctagacctatgtacagcaacccaccccttcatggcgcactaattgtttccactatccttggtgatccagcactgaaagaattatggctgaaagaggtcaagggtatggctgatcgcattattggaatgcgacaagcactcaaggagagtcttgaaaagttgggttcaccattatcatgggaacatattactaatcagattggcatgttttgctacagcgggatgacacctgaacaagttgatcgcttaacaaatgaattccacatatacatgactcgtaatggcaggataagcatggctggtgtaacaacaggaaatgtcgcctatttggctaacgctattcatgaggtcactaagacaaactaagacccctccctcctgccattttgagaaataagaggagcctttcaacttcaatttgcattttgcttttaatttcctttagacttttatgtttcaacactgttgtttttatcaaacaatgtcgatattgttgatttgttgtgacctatgggtgtgcaaatataaatttgtttcat

SEQ ID NO: 2615 - DNA, 1737 bp, Hordeum vulgare
accgccgcgcggcctccgcgatccggcggcgcggggccccgtccatgcccctgccgctgctcccggcgcgggccatggcgtcgctcttcggccacgtcgagccggcgcccaaggaccccatcctcggcgtcaccgaggccttcctcgccgacccctcccccgacaaagtcaacgtcggcgtcggcgcctaccgggacgacgacggcaggcccgtcgtgctcgactgcgtgcgcgaggcggagcgccggatcgccggcaacctcaacatggagtaccttcccatgggagggagtatccacatgattgaagagtcgctaaagctggcgtatggtgaggactccgagttcatcaaagataaaagaattgcagcggtgcaggcactttcaggaactggcgcatgccggctcttcgctgatttccagaagcgtttcctgccggattcgcagatctacatacctacaccaacgtggtccaaccatcataatatttggagggatgctcaagtgccgcagaggacattctcatattaccacccggaatcgagagggcttgactttgcaggattgatggatgatatcaagaatgctccaaatggttctttctttttgcttcatgcatgtgcccataatcctactggagtagatcccactgaggaacaatggcgagaaatatcctatcagttcaagttgaagaaccatttcccattctttgacatggcataccaaggatttgctagcggtgatccagagagggatggcaatgcaatccgtatattccttgaagatggacaccaaattggatgtgctcagtcatatgcaaagaacatgggtctttatggacagagagcgggatgcctgagtattctctgcgaggatgagatgcaagcagttgctgttaagagccaattgcaacagattgcgagaccaatgtacagcaacccacctgttcatggtgcgctggttgtttctattatccttaatgatccagaattgaagaacttatggttgggagaggtcaagggtatggctgatcgtatcattggaatgcggaaggcacttcgggagaatcttgaaaagttaggttcacctttatcatgggagcatgtcaccaatcagattggaatgttttgctacagtgggatgacgcctgaacaagtcgaccgcttgacaagtgaataccatatctacatgacacgcaacgggagaataagcatggccggcgtaacgacgggcaacgtctcctacttggctaatgccattcatgatgttaccaagtgaaatcgaggaccatcttcagcgaatggagcgaaaggggttttccctttgttactggggctattcattctatactgtcatgctagagaaataagttctaggaagtaaacctgttgcggctgtccaacaacggaaaattctacctgtatgtatggagaagcagagacgtcccgacttatttttgccagattatcttattgtgattctagtcacattcgaatgaaacgccagtggaaaatgcttggttataccttgattttaacaagatgctggaggacttcaaactcgacgaaatcaaacatttggatgctctcttgcagtactagctccaagcatatgcttttttcttcaccattcgagatgtttggcttgggtctaagcagaataatgtgctccactatcttcccagtgtattaggatatgcaggattctgaagttttttttcttttctgaaatggatagg

SEQ ID NO: 2616 - DNA, 1627 bp, Setaria italica
cgagccgcgaccctgaagctccacgccccaacgccgacgcgcgcgaccaccgcctccgtctccgagcgcccgcatggcgatgacgcgcgcagccgccgccgcgaacgggcggcaccgccggtgggggcctgcggcggcagcgacgacgagggccatggcgtcgtggttcgggcacgtggagcccgcggccaaggaccccatcctcggcgtcaccgaggccttcctcgccgacccttccccggacaaagtgaacgtcggcgtcggcgcgtaccgggacgacaacggccggcccgtggtgctggagtgcgtgcgcgaggcggagcgtcgcatcgccgggagcatgaacatggagtacctacctatgggaggaagtgtgaagatgatcgaggaatcactgaagctggcatatggggaggattcagagttcatcaaggacaagagaattgcagcagtgcaagctctttcagggactggggcatgtcgtctctttgcagatttccagaagcgtttcttgcctgatacacagatctatataccgacaccaacatgggccaaccatcacaatatttggagggatgcccatgtaccacaaagaacatttacctattaccatccagagtcaagaggacttgacttttcaggcctaatggatgatataaagaatgccccagatggttcattctttttgcttcatgcttgtgctcataatcccactggtgttgatccttcggaggaacagtggagagagatatctcaacagttcaaggtgaagaaacattttccattctttgacatggcatatcaaggatttgccagtggtgacccagaaagagatgcaaaggcaattcgcatctttcttgaagatggacaccaaattggatgtgcgcagtcatatgccaaaaacatgggactttacggacaaagagcaggatgccttagtattctgtgtgacgatgagatgcaagcagttgctgttaagagccaattgcaacaacttgccagacctatgtacagcaacccgccacttcatggtgcactaattgtttcaactatcctgtctgatccagaattgaaaactttatggcttaaagaggtcaagggtatggctgatcgcatcattggaatgcggaaatcactcaaggagaaccttgaaaggttgggttcgccattgtcatgggaacatgtcactaatcagattggaatgttctgctacagtggtatgacgcctgaacaagttgatcgattgacaagtgaattccatatctacatgactcgcaatgggaggataagtatggctggtgtaactacagggaatgtcgcctatttggccaatgctattcatgaggttaccaagccaaactgaggcctcttctaccatcttcatgataggaaaaggaattgagccattctgattgactttttcgttttttggttactgacggcgaaatggtccaatgaagaaataagtttcgccttggacatgtgggcgtccaaattttgatttatttggcgggagcgataatagaattactccaattggagaaacatatgttgtattgcagttgcatcaaatattgttgtttgcaaaatctgaataaagtaaatctgaaggaactttcaacaacca

SEQ ID NO: 2617 - DNA, 1606 bp, Avena sativa
cttctacccatcccttcacttctccagcaacaaactccagctaagctcagcaacggcatggccatgtctcgcgccgccgcagcgatcagccaacggcggagcgggccgctcctgccaccgtcgaggtccatgtcgtcgttgttcggccacgtggagccgtccgccaaggaccccatcctcggcgtcaccgaggccttcctcgccgacccctcgccggacaaagtgaacgtcggcgtcggtgcgtatcgggacgacaacgggaaacccgtcgtgttggagtgcgtgcgcgaggcggagcggcgcatcgcggggaacgccaacatggagtaccttcccatgggaggaagtgtgaagatgattcaggaatcgctgaggctagcttatggggaggattctgagttcatcaaggacaagaggattgcggcagtgcaggctctttcaggaactggtgcatgtcgcctctttgccgatttccagaaacgcttcttgccagattcacagatatacatacctacccctacatggtcaaaccatcacaatatttggagggatgcccaggtaccacaaagaacatttgcctactaccatctagagtcgaaaggattggattttgtaggcctgatggatgatatcaagaaagctccagatggttccttctttttgcttcatgcatgtgctcacaatcccactggggtagatccttctgaggagcaatggagagagatatctcatcaattcaagttgaagaaccatttcccattcttcgacatggcataccaaggatttgccagtggtgaccctgagagagatgccaaggcaattcggatctttcttgaagatgggcatcaaattggatgtgcacagtcctatgcgaaaaacatgggactttatggccaaagagcaggatgccttagtattctatgtgacgatgagatgcaagcagttgcggtaaagagccaactgcaacagattgccagacctatgtacagcaacccaccacttcatggggcactagttgtttccacaatccttggtgatccagcactgaaaacattatggctgaaagaagtcaagggtatggctgatcgcattattggaatgcggaaagcacttaaggaaagtcttgaaaagttgggttcaccattatcatgggaacatattactaatcagattggcatgttttgctacagcgggatgacacctgaacaggtcgatcgtctaacaaaagaattccacatatacatgactcgcaatggaagaataagcatggccggtgtaacaacaggaaatgtcgcctacttggcaaacgctattcatgaggtcaccaagcaaaattaagatccctttgtcatgtcatcttgggaaataagaggagcctttcagcttcaagcttcaagcggcagcttgtaatcgtttaaacctttgctgaccacgacatggtcagatacagagaaaaaatactgttatttttctcaaacaacgtcccatattgccgtgacctatttggtgtactgattattgatttcttttactggacacactatacaggcagggccacctttcttttgaggattagactgatcttgtattgcagttacagagaatg

SEQ ID NO: 2618 - DNA, 1753 bp, Musa acuminata
ttcccctcttctcgcttcgccatccttcccctcttccgccgctgacgcgccgctctacttgtcggttcctgacctcctcccttctcctccactctccttttcgatacgtagggagaagactgcatagaggtccatggccgcgatcagccgagagatcctgaaaaggagagggatccttcggtcgccggtgatggcgacgatcggtactcgatccatggcttcctggtttgggcacgtggagcccgcggccaaggaccccatcctcggggtcaccgaggcgttccttgccgatcccagccccgacaaagtcaatgtcggagtgggagcttaccgtgatgacaacgggaagccggtggttcttgaatgcgtcagggaagccgaacgaaggattgccggaaaccttaacatggaatatcttccaatgggaggaagcattaagatgattgaggagtcattgaagcttgcttatggagaggattctgagcttataaaagagaaaaggatcgcagctgttcaggctctttccggaacaggtgcctgccggctttttgctgacttccagaagcgtttcttaccagacacacagatttatataccaataccaacttgggctaaccaccataacatatggagagatgcttgtgtacctcaaaggactttccgttactaccatcctgaaacaaagggactcgactttgcatccatgatggatgacatcaagaatgcaccaaatggttcgttctttttgcttcatgcatgtgcacataatccaacaggggtggatccctctgaagaacagtggagagagatatcttatcagttcaaggttaagaaccacttccccttctttgacatggcataccaaggttttgctagtggcgatccaaatagagatgctaaagcaattcgaattttccttgaagatggacacctcattggttgtgctcagtcgtatgcaaaaaatatgggactgtatgggcaaagagttgggtgccttagtatcctttgtgaagatgaattgcaagcagtagctgtgaagagtcagttgcaacagctagctaggcctatgtatagtaaccctcctgttcatggtgcactagttgtttccataatcctaggtgatccagagctgaaatctctgtggctgaaggaggttaagggtatggctgaccgtatcattggaatgcgtaaagcacttcgagaaaaccttgagaagttgggttcgcctttgtcttgggagcatataacaaaccagattgggatgttctgctacagtggaatgacgcctgaacaagttgatcgcttgacagacgagttccatatatatatgacccgcaatggacgaatcagtatggctggtgtcacgactggcaatgttggctacttggcaaatgctatccacgaggtgacaaaatcctcttaagcctcatctttgctgtgtttttcgaacaatgaaaaccgacgtctcaacaaaatatcacgaggccttttcttttcccacttggaattcagaaataagtcccttcagagagagaatggatttttgacagtccaacttgctgcatatttaactggagtatatccattgttgatcaaaattggagcatatacttgctcatctctttttgctttgcaacaaatcattctatagcatcttagcaattttaatgcattatggatttacatttagctgagatgaaacagtgaatatacatgaattattgacaattcctttgtcattgaaggtgcgccc

SEQ ID NO: 2619 - DNA, 1706 bp, Triticum aestivum
gtcgctcttcggccacgtcgagccggcgcccaaggaccccatcctcggcgtcaccgaggccttcctcgccgacccctcccccgacaaagtcaacgtcggcgtcggcgcctaccgggacgacagcggcaagcccgtcgtgctcgactgcgtgcgcgaggcggagcgccggatcgccggcaacctcaacatggagtaccttccaatgggagggagtatccacatgattgaagagtcgctaaagctggcgtatggcgaggactccgagttcatcaaagataaaagaattgcagcggtgcaggcactttcaggaactggcgcatgccggctcttcgctgatttccagaagcgtttcttgccggattcgcagatctacatacctacaccaacgtggtccaaccatcataatatttggagggatgctcaagtgccacagaggacattctcatattaccatccggaatcgagagggcttgactttgcaggattgatggatgatatcaagaatgctccaaatggttcgttctttttgcttcatgcatgtgcccataatcctactggagtagatcctactgaggaacaatggcgagaaatatcctatcagttcaagttgaagaatcatttcccattttttgacatggcataccaaggatttgctagcggtgatccagagagagatgccaaggcaatccgtatattccttgaagatggacaccaaattggatgtgctcagtcatatgcaaagaacatgggtctttatggccagagagcgggatgtctgagtatcctctgcgaggatgagatgcaagcagttgctgttaagagccaattgcaacagattgcgagaccaatgtacagcaacccacctgttcatggtgcgctggttgtttcaattatccttagtgatccagaattgaagaacgtatggttaggagaggtcaagggcatggctgatcgtatcattggaatgcggaaggcacttcgggagaatcttgaaaagttaggttcacctttatcatgggagcatgtcaccaatcagattggaatgttttgctacagtgggatgacacctgaacaagtcgatcgcctgacaagtgaataccatatctacatgacacgcaacgggagaataagcatggccggcgtaacgacgggcaacgtcgcctacttagctaacgccattcatgatgttaccaagtgaaattgaggaccgtcttcagcgaatggagcgagagcgttttccctttgttactagggctgttcactctatactgtcatgctagagaaataagttctaggaagtaaacctgttgcggctgtccaacaacggaaaattctacctgtatgtatggagaagcagagacgtcctgacttatttttgcgagattatcctatttttgattctggtcacattcggatgtaacgccagtggaaaaatgagtggttataccttgattttaacaagatgctggaggtcttcaaactcgaagaaatcgaacatttggatgtgtgtcttgcagttctagccttgcagttgtagatccaagcgaaagctcggtttgcgatactgagatgtatgcaagcaatcaagcatgccctgttcttcagcttgggtctaagcagagcaatgtgctccgctacctttctgccagcgcgtatatgcagtgtactacattcaggcaatgaaatggtggtctgcaggattctaa

SEQ ID NO: 2620 - DNA, 2466 bp, Panicum virgatum
gctgagcggcgacggagcgctacgcgcggtataagatgagccaggggtgcccggctgcaactcatacctttctcggccttttggctaagatcaagtgtagtatctgttcttatcagtttaatatctgatatgtgggctatgtgcctattttgatattaaatttattttttgtggggaagggctcatcacagtggcttgctgctggagcccttgagcgtcgcccagccgttgcactgctggccgggcctggcgcaccccaaccaaagctaatttaaatgtttcttctgaatagtttttatcattagcaacagctttggtcaaaattctcactgagaagtagaaacaaaattgattagtgcttcaacgtcgtcattagcaacagctttgcgtcaaaactctcattagcaaaggctgtttacagaatatgcatttcactaatccgcaactgaagcgccgggcatgctgctgtaagtatgaaacacataagttctcaatttcgctatatttattttcttcagaactgtagatcatgccacaacgatttgcggctaagtgtaaaaattgccatgataagcttggggaaaaaagaaagaaaaaagaaaagaaacaggattaatgtaggtctcaagactgaagtttcacatctatagttctcgtccatgtgaaattcgcccttggacagcccaaataggcttaacttatttctcgagaatgataatgttgatatgtcaggcaccaaaaaaagccacttgaaagcctcatttcatcgctgacagagggccaacctcatttcgatttggtaacctcgtgaatagcatttgccaagtattcaacgtttcctgtcgttacaccagccatgcttatcctcccgttgcgggtcatgtaaatatggaattcatttgtcaaccggtcaacttgttccggtgtcatcccgctgtagcagaacattccaatctgattagtaatgtgctcccatgacaaaggtgaacctagcttttcaagattttccttaagcgctgtccgcattccaatgatacgatcagccatacccttgacctcttttaaccataaactcttcaattctggatcactgaggattatagaaacaacaagtgcaccatgaacaggtgggttgctgtacattggtcttgcaatctgttgcagttggctcttgacagcaactgcttgcatctcatcctcacacaaaatactcaggcatcctactctctgtccataaagtcccatgttctttgcgtatgactgagcacatccaatttggtgtccatcttcaaggaaaattcggattgccttagcatctctctctggatcaccactggcaaacccttggtatgccatgtcaaagaatggaaaatgtttcttcaccttgaacagatgggatatttccctccattgttcttctgtaggatctactccagtaggattatgagcacatgcatggagcaaaaagaacgaaccatctggagcattcttgatgtcattcattaaccctgaaaaatcaagccctcttgactctggatggtagtatgtgaatgatttctgtggcacttgagcatccctccaaatattgtgatggttggaccacgttggtgtaggtatgtagatttgtgaatcaggcaagaatcgcttttggaaatcagcaaagagccgacaggcaccagtgcccgaaagcgcctgcactgccgcgatcctcttgtctttgatgagttcggaatcctctccgtacgccagcttcagcgattcttcaatcgtctttatactgcctcccattgggaggtactccatgttgaggttgccggcaatccggcgctcggcctcgcgcacgcaatcgagcacgaggggcttgccgttgtcgtcccggtaggcgccgacgccgacgttgaccttgtcgggcgaggggtcggcgaggaaggcctcggtgacgccgaggatggggtccttgggcgccggctcgacgtggccgaacagcgacgacgccatcgccctcgccgcctgcagcctcgacggctgcgcctgcggccgccgggtcaggcaggaggccgcgcgggacagcgccgccatgcggggccggacggaggtggtggaggagctgggcggcgccgcggaggggggagggggaggaaagctggggtctttgcgccgctggttttgcttagcactcaactagctggtggtaataaataaaggcgactagatttggattgctgcgacggttcgctgctgcggcggtcactcggctccgccgccgctctcgccacatgcctcaaacaaacagaccaggtgaggccaagcggaacggagccacctcgaatcgggagagccatttggcccaatggcggctgatcctctcttatccctttgttctaacagaaaggtggctgctgagcaggctcggctccactgcaacatcagctgaggatctgctgtttcagtgttggaactggaact

SEQ ID NO: 2621 - DNA, 1673 bp, Brachypodium distachyon
cactgacacagcagcagcagaacagaaggcaccgcaccgcgccgcttccccagtatccaagccatcttggcttcccttaaggcccttaactctcttctctaccgacaaacgccaagctctcacgcggtcacgccacgcgccccgatcagcgccggtcgggtgcggtgcagctagcacggcatggcgatgcctcgagccaccgcagcgatctgcaggcaacggcgggccggcgcctcctacctccagctgccagtggcgaggtccatggcttcgtggttcggtcacgtggagacggccgccaaggaccccatcctcggcgtcaccgaggccttcctcgccgacccttcgcccgacaaagtgaacgtcggcgtcggtgcgtatcgagacgacaacgggaagcccgtcgtgctacagtgcgtgcgcgaggcggagcggcgcatcgccgggaacatgaacatggagtaccttccgatgggaggaagtgtgaacatgattgaggaatcactgaggctcgcttatggggaagattctgagttcatcaaagataagaggattgcggcagtgcagactctttcagggactggtgcatgtcgcctgtttgcagattttcagaaaagattcttgccggattcacatatctacatacctacccctacatgggccaaccatcacaacatttggagggatgcccaggtaccacaaagaacatttgcctattaccatccagagtcaagaggactggactttgcaggcctgatgaatgatatcaagaatgctccagatggttccttctttctgcttcatgcttgcgctcacaatcccactggggtagatccttcagaggaacaatggagggagatttcgtatcagttcaaggtgaagaaccatttccccttcttcgacatggcataccaaggatttgccagtggtgacccagagagagatgccaaggcaattcggatctttcttggaaatggacaccaaattggatgcgcacagtcatatgcaaaaaacatgggactttatggacaaagagcaggttgcctcagtattctctgtgacgatgagatgcaagcagttgctgtgaagagccaattacaacagattgccagacctatgtacagcaaccctcccgttcatggtgcagtaattgtttccaccatccttggtgatccggcactgaaaagcttatggctgaaagaggtcaaggttatggccgatcgcatcattggaatgcggaattcacttaaagagagccttgaaaagttgggttcaccattatcatgggaacatatcactaatcagattggcatgttttgctacagtgggatgacacctgaacaagttgatcgtttaacaaatgaattccacatatacatgactcgtaatgggaggataagcatggctggcgtaacaacaggcaatgttacctatttggctaacgctattcatgaggtcaccaagtcaaattaagatcccctttttcctgccgaaataagtttcaggtggcttgtaattaatctgttttaaacaaattttctgaccatgacaatgtcagatggtgaaataaatctgtcccatatggccatatgctatgaactatgggcatctaaatattgatttgttttattggaatgtattttttttggaaaaaggaggatatgctatgaact

SEQ ID NO: 2622 - DNA, 1445 bp, Avena sativa
ccgccaaggaccccatcctcggcgtcaccgaggccttcctcgccgacccgtcccccgacaaagtgaacgtcggcgtcggcgcctaccgggacgacaacggcaagcccgtcgtgctggactgcgtgcgtgaggcggagcgccggatcgccggcaacctcaacatggagtaccttccaatgggaggaagtatcaagatgattgaagagtcactaaagctggcatacggagaggactccgagttcatcaaagataagagaattgcagcagtgcaggccctttcaggtactggtgcatgccggctcttcgctgatttccagaagcatttcttgcccgattcacagatctacatacctacaccaacatggtccaaccaccataatatttggagggatgctcaagtgccacagaggacattctcatattatcatccggaatcgagagggcttgactttgcaggattgatggatgatatcaagaatgctccaaatggttcgttctttttgcttcatgcatgtgcccataatcctacaggggtagatcctacagaggaacaatggagagagatatcctatcagttcaagttgaagaaccatttcccgttctttgacatggcataccaaggatttgctagcggtgacccagagagagatgccaaggcaatccgtatattccttgaagatggacaccaaattggatgtgctcagtcatatgcaaagaacatgggtctttatggacagagagcaggatgcctgagtattctatgtgaggatgagatgcaagcagttgctgttaagagccaattacaacagattgcgagaccaatgtacagcaacccacctgttcatggtgcgttggttgtttctattatccttaatgatccagaattgaagagcttatggttgacagaggtcaagggtatggctgatcgtatcattggaatgcggaaggcacttcgggggaatctcgaaagcttaggttcacctttatcttgggagcatgttaccaatcagattggaatgttctgctacagtgggatgacacttgaacaagttgatcggttgacaaatgaataccatatttacatgacccgcaacgggagaataagcatggctggtgtaacaacaggaaacgttgcctacttggctaatgctattcatgatgtcactaaatcaaactgaggctccttaattctcaccttcttcagccagtgaaacaagagggtttttcctttccttctggctattcactctatactgtcatactagaggaataagttgtagcaaacctgttgcggctgtctaaacggagaattgtgtctggatatttttaagagagctgtagtcaggatcctatttttgactgttcctctcgtggtatatgtaacgccagtggaaaatggctggaccttcattttaacaagcacccgaggaatttatttagtagaa

SEQ ID NO: 2623 - DNA, 1425 bp, Avena sativa
ccaaggaccccatcctcggcgtcaccgaggccttcctcgccgatccgtcccccgacaaagtgaacgtcggcgtcggcgcctaccgggacgacaacggcaagcccgtcgtgctcgactgcgtgcgcgaggcagagcgccggatcgccggcaacctcaacatggagtaccttccaatgggaggaagtatcaagatgattgaagagtcactaaagctggcatacggagaggactccgagttcatcaaagataagagaattgcagcagtgcaggccctttcaggtactggtgcatgccggctcttcgctgatttccagaagcatttcttgcccgattcacagatctacatacctacaccaacatggtccaaccaccataatatttggagggatgctcaagtgccacagaggacattctcatattaccatccagaatcgagagggcttgattttgcaggattaatggatgatatcaagaatgctccaaatggttcgttctttttgcttcatgcatgtgcccataatcctacaggggtagatcctacagaggaacaatggagagagatatcctatcagttcaagttgaagaaccatttcccgttctttgacatggcataccaaggatttgctagcggtgacccagagagagatgccaaggcaatccgtatattccttgaagatggacaccaaattggatgtgctcagtcatatgcaaagaacatgggtctttatggacagagagcaggatgcctgagtattctatgtgaggatgagatgcaagcagttgctgttaagagccaattacaacagattgcgagaccaatgtacagcaacccacctgttcatggtgcgttggttgtttctattatccttaatgatccagaattgaagagcttatggttgacagaggtcaagggtatggctgatcgtatcattggaatgcggaaggcacttcgggggaatctcgaaagcttaggttcacctttatcttgggagcatgttaccaatcagattggaatgttctgctacagtgggatgacacttgaacaagttgatcggttgacaaatgaataccatatttacatgacccgcaacgggagaataagcatggctggtgtaacaacaggaaacgttgcctacttggctaatgctattcatgatgtcactaaatcaaactgaggctccttaattctcaccttcttcagccagtgaaacaagagggtttttcctttccttctggctattcactctatactgtcatactagaggaataagttgtagcaaacctgttgcggctgtctaaacggagaattgtgtctggatatttttaagagagctgtagtcaggatcctatttttgactgttcctctcgtggtaaatgtaacgccagtgaaaaatggccgtcctttattttaacgagcacttgcgg

SEQ ID NO: 2624 - DNA, 5308 bp, Ananas comosus
gcgtcggtggtggtgttgtggaggagcgagaagaagacgatcgggagcgactcatgcttagccgtagccaatgccacgccattacagccaggaccctttttctactcaggatggggaagaaaaggtgagttgatcataattgtagtgttttaattgcctttcgcattcaattgatgagctttgtttaattgaactcatccttttgtgttcagtcagtggatttccggttgaatcaccggttgaatcagtgacgggggggggggggggggggggggggggggggttttcaccaagaccaacatcatccggtgatgtaagaaacatcttacatttccggctagcaatccggctctaataccgaatataacaatctaacccactagcattagtaactcatttccactagcactagtaaagtaactcattccaaattattattagtagagctcttgattcttaaattttcattcttaagcactttagaatttagagagtggctaatgtgatgattttatagtttatcaaggagctgtagtttatcttttttcagcctagattaatacttttttattaaataagaatctctttaattaatttaaccttatcattattatattattatacgtaccgagtcgccgaattatgtctacgctcaacggaatcgacagcaaatagcagttactgcgaacggctcagattgctcgggaaggtgggccctcaatcctaaacctctccgataccccacacctcaccacctacgtgcaagtcacaccaacctgtataaagtataaacggcgtacgtcatcaccgtcccacgattcctttctaacaatcagagggaaaatttctaaaatgcaacagaatttcgcccatcagaggcgtgcacttccgtgtaacggcgatgaacatcacggttacctcaccgacaggtgggcccccacacaattgccgccatggtgacgtcactcgcgcttcccgagaacgccgccgctaaatattactcgtcgcttgtacctttccccattctcctcgtccgccgctcccgcgccgcaccgcttcctccgccgcgcttttttccaccctctgcttcccctggagcgctacgatggcgttgggcgccgcgatttctcgggcgatccctaggagggctctatcatcggccgccacgtcagcgcgatccgcgtcatcctggtggggccacgtggagccagccccgaaggacccgatcctcggcgtcaccgaggcgttcctcgccgatccgagccccgacaaagttaatgtcggcgttggcgcgtaccgcgacgacaatggcaaaccagtggtgcttgaatgtgttcgagaagctgagaggaggatcgccgggacccaaaacatggagtatcttccaatgggaggaagtgttaagatgattgaggagacactgaagctggcgtatggagaggactctgagttcataaaagacaaaaggatcgcagctgtgcaagctctatcagggaccggtgcatgtcggctctttgcagactttcaaaaacgtttcttgcctgactcccagatttatatacccataccaacatgggcgaaccatcataacatttggagagatgctcgagtgccacagagaacactccgatattatcatccggaatcgaagggactggactttgcatcaatgatggatgatattaggaatgctccgaatggttcgttctttctgcttcatgcatgtgcacataatcccactggggtagatccttctgaagaacaatggagggagatatcatatcagttcaaggtcaagaatcatttcccgttctttgacatggcgtaccaaggttttgctagtggtgacccagaaagagatgccaaggcaatccgaatctttcttgaggatggacatccaatcggctgtgcccaatcatatgcaaagaacatgggactttatgggcagagaataggatgcctaagtattctctgtgaagatgagatgcaagcagtcgctgtgaagagtcaattgcaacagcttgctaggcctatgtacagcaacccgcccgttcatggtgcattaatagtttcaacaatccttggtgatacagaactaaagaatttatggctgaaggaggtcaagggcatggctgatcgtataataggaatgagaaaagcacttcgtgagaatcttgaaaagcttgggtcacctttatcttgggagcacataactaaccagattgggatgttctgctacagtggattgactcctgaacaagtcgatcgattgacaagtgaatttcacatatacatgacgcgaaatggtcgaattagtatggcaggtgtgactaccggcaacatcggctatctagctaatgctattcatgaggtcaccacatcctcataaggtttatactctcttgccttaatatgaagaaaacgaggctttcactaaaattttatgaggcttttttgtccatagaccttctatgcggtcctcttaaaaaataaattacatttatttatcagaagatctgaagggaaaggaaataactgctctggttcatttttgagcgtgtaaaatgcttgttctgtttggcttttgagacgagtcgtacatttgtgacattatcatgaggtgcaagtgcttatgaaaattaattactaaagagacaaagcaattgttgatgtggcttggtgaattggaatgcttaatgctgtgaggtgcccatgctgtgggctttttctactgattttgtgtttaatattgccatgatggagctgcagttttgtacggcgtattctgaccgtaagttttcattcgctacccgagcattaagtcgcttgggattttcattccccgtgtagtgaagatgttcctgatgagatctttagcacattctgtctctttgtctctatgaattgtagtacttgatgagacatttgagtaacttctcggtcaatgcttagaccactgctttaaagagaaacaaacgtcaatttgagaaattagtgcagagcgcatgggagcaaggcaatcctctgccagtatttttcttaatgcatgttccatgtgagctagctaatccctagaatctcaattcaagagcgttcaatctacataaggctatgggaacatcatgagagttgcggctgcaatgataacatcgcagcaaaaacaaggaatacttcagtaactatgcagctactgtagatggagcatctaagaaaactatataatcaaagacaatttacataatcaaaagtcacctaggatgtgaaacattttaacaggctcacagcctaattacaaacattagagagttagagagccaatcgagacatagttactccaaaagagccgaaacctcgtacatcatctcttttctcgtctaactattacttctcatcacaatgatatctggtttccaaaacaaaatataaatactatacatattttaggtattcgttatcttggacctgaaagttcaatagcttcgattatgaaggatgaagcttcattagtatcttcaagcctcctagagaagctctgcgaactcccaccacagagcactcgaccttgcgactcttctgcatgttctgatggtctgatcacagcttctagtgtcttcacaacatctgacatcttaggccgtaaactagggttggactgagtgcacagcagaaccacttctgctgcagtctccagctcggccgtattgaaagaaccgttgagatctttgtcaaccaacatatggggtttcttttcctcatgaagttccttcacccagtcaaggatcattcccttctgaatttgcccatttccattattcaaagtcttttgtcctgttatcaactccaacaatagaataccaaatccatacacatctgtcttttccgaggactggccagtagagagatactcaggcgcgatatgtccaatggtgccccggactgcagtagtaacatgtgattcatgtcgatctaaaagttttgccaacccaaaatctccaacaattgcttcaaagctttcatcgagcaatatgtttgctgctttaacgtccctatgaatgatcttagggttgcattgttcatgcaaatacaacagtcccctagctgctccaagagctatccacattcgtttgttccaatctagatatgatctcccaagatgacaatctcttaaacgatcagcaacgctcccgtttggcataaaaggatatactagtaatctctcattggatgtcatgcaaaacccatacaagcgtaagagattcctgtgcaaagccaagccaatcatctctacttccgtctggaactggacttccccagtaatgtctggatcttttaaccttttaactgccacgacagtcccgtttcttagatggcctttatatacaatcccaaacccaccatgacctaatatgttcttcgaattaaaattattggttgcgatttgaagctcacgaaatgagaaccgcctcaaatgtcccatttcgaaatcataatcttgatcatcagaagcaaaaggcaaacgccatctgcaatagtgcagccaacatccgaaaagcagcacagagatcattatggtacacccgatgcttaaagagacggcaagtgctaattgatggttgttagtttggtcaaatgtgtttgtttcgttaactgctaatgcaacatctgagcaaccttgcaagacggtggagttacaaagaaacctgtttcccgcaacacgatagtcactcgcgaggatcttcggaattggaccgctcagattattggacgacaagtctaagaatataagaccggcaagattggcaacagcttgaggtatctgaccagataggttattctcgttaagacgcaggtaacctagttgagtcaagtgccccaacgaactcgggattttgccaataaactggttaccggaaagatcaagggttttgagctgggacaatttcccaatctcaggaggaatagggcctgataatttgttgttctgcagtaacctgtaaaacagagatggaaaaatacaatgtatattgttaagaagtcgagaaaactctcaacttttcttttgttaagctgataacgcttttccgaaaacatcatttatcacattgtctgaaggtggctgaggttgccgatgctcggagaaagcgttcccgacaagccgttgctcgccatctccaaggagatgacgaagccatcggaggagcagccgaccatggaccaggtgcaggggtccacggagttgatgtcccacccgcccatcactctggcctcgtccctcatcttgctcttcaccgacattaaagcagccact

SEQ ID NO: 2625 - DNA, 2203 bp, Cocos nucifera
taagcgctggccatctaccctccgtctctccccttcctctggtcaggtccccttacctctccttctgactaaagccctccaatcccttccgtcttcttgaaagcttttctcttttctttctttttgcctttgatacataaaattaaacagagggagggcgagagagagctcgctctcatggcgtcgagggccgcaatctaccgagggacgatgtggaggggccgctcgtgggcggttggagctcgatcgatgtcgtcgtggtggagcaacgtagaaccggcgcccaaggacccgatcctcggagtcacggaagcgtacctcgccgatcccagccccgataaagtcaatgtcggcgttggagcttatcgtgatgacaacgggaagcctgtcgtcctcgaatgcgttagagaggccgaaaggaggattgccgggaatctgaacatggagtatcttccaatgggaggaagcaataagatgattgaagagtcattgaagctagcatatggggaggattctgagttcataaaagacagaaggattgcagcagttcaatctctttcagggactggtgcatgtcggctttttgcagatttccagaagcgattcttgcccgattctcaaatttatataccggtccctacttgggccaaccatcataatatttggagagatgctcgggttccacagcagacatttcattattaccatcctgaatcaaggggacttgattttgctgcattgatggaagatattaagaatgctccaaatggatcattcttcttgcttcatgcatgtgcacataatccaactggagtggatccttctgaggaacagtggagggagatatctcatctgtttagggttaagaatcatttcccattctttgacatggcataccaaggttttgccagtggtgatccagaaagagatgcaaaggcaattagaatttttcttgaggatgggcacttgattggctgtgcccagtcatatgcaaaaaatatggggctttatggacaacgagttggatgcctcagtattctctgtgaagatgaaatgcaagcagtagctgtgaagagtcagttgcaacagattgctaggcctatgtatagcaaccctcctgttcatggctcactgattgttttgataatactcagtgatccagaccttaaaagcttgtggctgaaggaagtgaaggttatggctgaccgtatcattggaatgcgtaaggcacttagggaaaaccttgagaagttgggttcaccattatcttgggaacatataactaatcagattggcatgttttgctacagcggaatgacccccgagcaggttgatcgcttgacaaatgagttccatatctacatgacgcgcaatgggagaatcagtatggcgggtgtgactacgggcaatgttacctacttggcaaatgctatccatgaggtcactaaatctacatgaggaatcacttatccttactatagaaataaagctatcaacaggttgaggccaatatgtttgaggcttttgcaattcagcttcctcgcatgtttgacagagaaaataaatgccctcgtgcaattcaaattttgaacatctgaattgcttgtccttttttctctctgctcataatcattctcgtgtaacatcaatgctaagtacaggtgcatctgaaactaaattacacccaacatacaacaactgttacaggaagcatatttaccaccggtttgtcataaacatccttttcaactaatcaacttcttgtcctcttcaaaccatataaactgctggtgcctccctggtggaatattgttcaagatacctgttttatatatatatcccccccccccccccccccccccccccccccccccccccccccccccccccccccccccatatatatgtatattttccttagagcctcgatgtcttgtagctcatgtaaatgaaggtcgtcaacgttttactgatggacattttctttgaaagctcggtaggtgcaaatattcttttaaatcaatatgttctttttactaaaagtaaaaagatcgataggttcttggagatttaaattatatttggggctgagatgataattctgtcattctcgtgagcaatgcttgttatggttttttaggatttaattgcaggattatttggtccctttttatttattatgctctctggcagaaggatgctg

SEQ ID NO: 2626 - DNA, 1499 bp, Amorphophallus konjac
gggggcgatggcgtcgagggctgctctgcgcgggcggggctccggtttctccgccgccgccgtcgcctctggtgcccgatccatgtcctcgtggtggggcagcgtcgagccggccgccaaggaccccatcctcggcgtcaccgaggccttcctcgccgaccccagccccggcaaagttaacgtcggagttggagcttatcgtgacgacaacgggaagcccgtcgtgctggagtgcgtgagggaggcggagaggaggatcgccgggagccacaacatggaatatcttccgatgggtggaagtgtgagaatgattgaagaaacattgaagctggcatatggggaaaactctgaatttataaaagacaaaaagattgcagccatccaagctctttcaggaacaggtgcatgccgagtttttgcagatttccagaggcgcttccaacctaactcccaaatatacatacctgtgccaacctgggccaatcatcataacatctggagggatgcccatgtgcctcaaaggaccttccactactaccaccctgagtcaagaggactagactttgctgcattaatggacgatgtaaagaatgctccaaatggttcattcttcctgcttcatgcatgtgcccataaccctactggtgtggatcccacagaggaacaatggagggaaatctcatatcagttcaaggttaagaatcattttgcattctttgacatggcataccaaggatttgccagtggtgatcctgaaagagatgcaaaggcaatcagaatctttctagaggatggacatctgattggatgtgcccagtcctatgctaaaaatatggggttgtatggtcagagagtaggttgcctcagtatcctatgtgaagatgaacttcaagctgtttctgtgaagagtcagttgcaacagattgcccggccgatgtatagcaacccaccagttcatggtgcccttattgtatccactatactaggtgatccggagctaaaaaatttgtggttgaaggaggtgaagggtatggctgatcggataattgggatgcgaactgcactcagggagaatctcgaaaagttgggttcacctctttcttgggagcatgtaacaaaccagattgggatgttctgctacagtggcttgacaccagtgcaggttgaccgtttaacaaatgagtaccacatttacatgactcgtaatggtcgaatcagcttggcgggtgttacaacgggaaatgttggctatttggccaacgcaatacatgaagttacaaaatccagttgacctttttgcatctggaaggcgatgaacaactcggaggtgataccaagcttcatgaggcaccttttatcggtctagaaataagcggcttgatggttcccatccctcaacattttttatttcttctttgctgagggaaatgagtaaaataaatttggaacggattgcgtcctttactctatttgtccctctttttcattgggacgaattt

SEQ ID NO: 2627 - DNA, 4452 bp, Cannabis sativa
cgtcttgttagacaacaacaacataaaagactctagaacagtctcacgcagttcaaggccgcgttttatcaaaatctcaaacatataaaaacccaaaatttgccattcataaatttgcgcttccgtctttcactcctctttctctctcttcaaccaaccttagttttactgctccattaaatttttagacagaatcaaagttgtaacgataatcttttcatggcgtttcgcactgcgatctccaacaacgtgatctctcccgtccgtacctccgtcgccggagcgagatccatctcatcgtggtggcaacacgtcgatccggcacccaaggatccgattctcggtgtcaccgaagcttttcttgcggatcccagtcctgataaagtcaatgttggagttggcgcttaccgtgatgataacgggaagcctgttgttcttgattgcgttagagaagcagagcgtcggattgcgggtaacttgaacatggagtatcttccaatgggagggagcatgaagatggtggaagagacactaaagctggcctatggagagaactctgagttcatcaaagacaaaaggatagctgctgtgcaatctctctctggaacaggtgcatgcaggatttttgcagacttccagaaacggtttcatcctgattcccaaatctatataccaattccaacatggtccaaccatcataacatttggagagatgcccaggttcctgagaggactttccattactatcacccagaatctaaggggttagactttgctggactgatggatgacattaagaatgctccaaatggttcattctttctacttcatgcttgtgctcacaacccaacaggagtggatcctacagaagaacaatggagagaaatctcatatcagttcaaggtaaaaggtcatttccccttttttgacatggcatatcaaggttttgctagtggtgacccagagagagatgcaaagtccatcaggatttttcttgaagatggccatcttctcggccttgcccagtcatatgcaaaaaatatgggtctctatggtcagagagtaggatgccttagtttactatgtgacgatgaaaagcaagccgtggctgtaaaaagccaattgcagcagcttgctagacccatgtatagtaacccgcctgtgcatggagcactcgtagtctcaatcattcttgatgatccagacttgaagaaattgtggctcaaagaagtcaagggcatggccgaccgcatcattggaatgcgaactgctttaagagaaaaccttgagaagttgggctcgcctttatcgtgggagcatataaccaatcagattggcatgttctgctacagtgggatgacacctgaacaggtggaccgtttgaccaatgaatatcatatctatatgactcgcaatggccgtataagcatggcgggtgttacgactggaaatgttggatatctggctaatgctatacacgaagtgaccaagtagggctaattgagaggttgcaaggttgcaaatgtctctacatttttgttaatttcttggctataattccctctaattgttaaagggatagcaataaatattatttttttccttttgaaaaaaaaggaaaacaatataatttcttggtcacatcaactgttcttcctccattttccgttgggggattttgtagtgttattcagaattgcacttcataccaaactatgaagagcgcaacattacttattggaaaataaaatggtgcatttaaatattataatttcagtcataacattcccatttttaatcaaattttattaatcagaaatgtgatctccacgcctagaatgcgaggaaattctaattccaatttcttttccttttctctaggaatgtacaattttttgccgaggcagaggcttaaagaacgaaaaattagaccaaattaaattaaagaagagcaagagagaaacacagctgaatttaaaacaataccaatttatagttcttgaaaggaattgcaacaaacagcaaagaaattaaaagcttgaaggaaataaatttaaaaaaaaaacaatgacgaaacagtatttgcttacctagatagatagacaatgaacagaatcaccttcttatactctgccattttttggggggtagggttcttcaggaattcttaagatcaaaacaatttacagatgaaggaaaatactatgtttaatactaaatgacattttgtcgacagtttcccaaagttaagccgaacaacagcaagtatttgtgtacatctttagaggaagaggagaaacagctgctgatcgatcaaaatgctcttggttcggatatacagaccacacagaggcccttttggcttcccatacacatatatatatatctaccaccagaaaaggacagtgatgatttccatgttttgtatcatcacattttttttaagtacctaccaagtgtgggaagttctgactagcctgccgccgtatatgttcgggtataagcctgttaatgagttcaggcgaagctgctgacaactgcaatacgaagttcaggcaataagaggaaacaccaagtaagattgcaagccatgctaaatagatgcatatattacttaaatttacaagtaacaacaataatcaatgttcaaacaaaaactcacttcatgcttgaagttgaatagaggtggcaatgggcgaccatttggcagacgagcattgggttcacgaagttcatcaaagaacggatgagaacatgcttctaactcagtacagcgaagactcggagaatattgcaaaagtcgcgatgcaaggtcaattgcttcaggaggcatccgtttgtggaagaccttgaagaatttggtgagagttgtaatgttagagagatataagacaacaattaatattggcttttcgagaacaaaacataggagaaaaataacaagacgacatgttcaggacgcagagggcaataatatttccattgcacaaacactcgtaacattcacacttgcatgcatattatgtaataccttgtgccaaggatgagctttaatctgagggaacctaaaatctgtgtagctaggattcatgcatcgaatttcttctcgagttggagtgccaagaacctgcataaatgtctaatataagcacacttgattctaatcaagtaatctagtaattttgacataactgtgaaagtcaaccttgattatctctacaagttggtccactttattctctcctggaaacagaggctgtaaaagagtttaaagattagaagccataaatattctattattttccaactaataaaatcaacaggaaaatcctaacctggcctagaaggagctcagcaaggacacacccagctgaccaaatatcaatagatgttgtgtattctgttgcaccgaagatcagttctggagctcgatagtaacgagagcatatgtatgatatatttgcttcacccctcacctacagagtcccaaccatgatacataaaatcattattgaaaatttaatttaatgtcatatctgtgtccatggcacaaacgtgacatcccttttattgcatatgtaactatgttcacgagattggtctactgatacaactattgagagactcatgtcatgcccactttacaattcttatatataattaattatacatatatatagagtaatataaaaggggaaaacaacgaggtaagcataccaaaacttttgcacttccaaaatcacaaagcttaacttggtgagtaagaggatcaacctgcagtatatatgcagcataataggttagacaaacagtccattatataaaagaacaaaacccacctagaaacataccaaaaggttctgtggtttcacatccctatggcaaactccaggaacagtatggatgtaagccaggcctctgaaaatctgaaaagttgtgtttcagtttttattaatatacattcttgataattccaacaaaattggaactgagaaagataatgtcgtacttgatatgtataaagtttcacatatatgagtggcatcctctggttcatactgctatagtgcttcagaaccctatacatggtttctggtacgtattccatgactaaattcagaaaaagctcatctttacttgttgtggagaagaaacaatgcttcagtgaaaccacatttggatgatccatcaaacgcattaactgcagttcacgatttttgtatcgtctgtcctgcaaaactttctttatggccactgtttctccagtttccagacattttgcctgaaatagaatagattagagaagggtagaaaaaatactaatagattagagaagggtagaaaaaatactagcaagtttcttttctaatgagacagatatttatacctggaaaacaattccaaatgatcccgtaccaacaacacgttcagccatgtaactaattgtctgtc

SEQ ID NO: 2628 - DNA, 1740 bp, Elaeis guineensis
gtccccttgcgtctccttccgactaaaaccctccattcccttccatcttattgaaagcctttttttttccctttgatacataaaatcaaacagagggagggcgagagagagcttgctcccatggcgtcgagggccgcgatctaccaagggatgatgtggaggggccgctcgtgggcggttggagctcgatcgatgtcgtcgtggtggagcaacgtagaaccggcgcccaaggacccgatcctcggagtcacggaagcctacctcgccgatcccagccccgataaagtaaatgtcggcgttggagcttatcgtgatgacaatgggaagcctgtcgtcctcgaatgcgttagagaggctgaaaggacgattgccgggaatctgaacatggagtatcttccaatgggaggaagcaataagatgattgaagagtcattgaagctagcatatggggaggattctgagttcataaaagacagaaggattgcagcagttcaatctctttcagggactggtgcatgtcggctttttgcagatttccagaagcggttcttgcccgattctcaaatttatatacccgtacctacatgggccaaccatcataatatttggagagatgctcgggttccacagcagacatttcattattaccatcctgatacaaggggacttgattttgcttcattgatggaagatattaagaaagctccaaatggatcattcttcttgcttcatgcatgtgcacacaatccaactggggtggatccttctgaggaacagtggagggagatatctcatctgtttaaggttaagaatcatttcccattctttgacatggcataccaaggttttgccagtggtgatccagagagagatgcaaaggcaattagaatttttctcgaggatgggcacttgattggctgtgcccagtcatatgcgaaaaatatgggtctttatggacaacgagttggatgcctcagtattctctgtgaagatgaaatgcaagcagtagctgtgaagagtcagttgcaacagattgctaggcctatgtatagcaaccctcctgttcatggtgcactcattgtttcgataatactcagtgatccagaccttaaaagcttgtggctgaaggaagtgaaggttatggctgatcgtatcattggaatgcgaaaggcacttagggaaaaccttgagaagttgggttctccactatcttgggaacatgtaactaatcagatcggcatgttttgctacagcggaatgacccctgagcaggttgatcgcttgacaaatgagttccatatctacatgacgcgcaatggcagaatcagtatggcgggtgtgactacgggcaatgttacatacttggctaatgccatccatgaggtcactaaatctgcatgaggaatcactactcagacaaagaaaacttaggcttatactacatttcatgatgctttttctggactttctctgatccttattatagaaataagttatcaacaggttgaggtcaatatgttgaggcttgtgcaattcagcttccttgcatgttggacagagaaaataaatgccctcacgcaatccaattttgaacatcagaattgcttgtacttttttttttttccttgggtcataatcatactggtgtaacatcaatgctaagttcagatgcatctgaaactaaattacagccaacataccgcaactgttataggaagcatataaataaattaaatcttg

SEQ ID NO: 2629 - DNA, 1404 bp, Avena sativa
tggcgtcgtggttcggccacgtggagcggccgccaacggatcccatcctcggcgtcaccgaggccttcctcgccgacccctcgccggacaaagtgaacgtcggcgtcggtgcgtaccgggacgacgacgggaagcccgtggtgctcgagtgcgtgcgcgaggcggagcggcgcgtccccgggagcaccaacatggagtaccttccgatgggaggaagcgtgaagatgattgaggaatcgctgaagctggcatacggggaggattctgagttcatcaaggacaagaggattgcggcagtgcaggctctttcaggaactggtgcatgtcgcctctttgccgatttccagaaacgcttcttgccagattcacagatatacatacctacccctacatggtcaaaccatcacaatatttggagggatgcccaggtaccacaaagaacatttgcctactaccatccagagtcgaaaggattggattttgtaggcctgatggatgatatcaagaaagctccagatggttccttctttttgcttcatgcatgtgctcacaatcccactggggtagatccttctgaggagcaatggagagagatatctcatcaattcaagttgaagaaccatttcccattcttcgacatggcataccaaggatttgccagtggtgaccctgagagagatgccaaggcaattcggatctttcttgaagatgggcatcaaattggatgtgcacagtcctatgcgaaaaacatgggactctatggccaaagagcaggatgccttagtattctatgtgacgatgagatgcaagcagttgcggtgaagagccaactgcaacagattgccagacctatgtacagcaacccaccacttcatggggcactagttgtttccacaatccttggtgatccagcactgaaaacattatggctgaaagaagtcaagggtatggctgatcgcattattggaatgcggaaagcacttaaggaaagtcttgaaaagttgggttcaccattatcatgggaacatattactaatcagattggcatgttttgctacagcgggatgacacctgaacaagttgatcgtttaacaaaagaattccacatatacatgactcgtaatggcaggataagcatggctggtgtaacaacaggaaatgtcgcctacttggcaaacgctattcatgaggtcaccaagcaaaattaagatccctttgtcatgtcatcttgggaaataagaggagcctttcagcttcaagtttcaagcggcagcttgtaattgtttaaacctttgctgacaacgacatggtcagatacagatcgagaaaaaatactgttatttctctcaaacaacgtcccatattgccgtgacctatttggtgtactgattattgatttctttt

SEQ ID NO: 2630 - DNA, 1690 bp, Aristolochia fimbriata
gtaacgcccgattcacggcaccgcttctctcctcgccgcggccgtttcgtacttcaattcatcctcgacgacaccgagtaggagtgaaggaacgaggaggcggaacagcgtattcgcatggctgcgagaaccgcgatctgcagaggtatttttcggcagggatcgtcgactggatgccgatccatgtcgtcgtggtggcggagtgtcgaaccggcgccgaaggatcctattctcggagtcaccgaggcttttcttgctgatccgagtcctgataaagttaacgttggagtcggagcttatcgcgatgacaatgggaagccggtcgttctggagtgcgtcagagaagcggaaaggagaattgccggaaatttgaacatggaatatcttcccatgggaggtagtataaaaatggttgaggaaactctgaagctagcatacggagagaattctgacctgatcaaggagaaacgcattgcttctgttcaagcactttctggtactggtgcatgccgactctttgcagattttcagaaacgttttcttcctgattctcagatttatattccagtgcctacatgggccaaccatcataatatatggagagatgcccatgttcctcaaaggactttccattactaccatccagaaacaaagggactggactttgcatcacttatggacgatgtcaagaatgctccaaatggttccttctttttgcttcacgcatgtgctcacaaccccactggagtagacccttcagaggagcaatggagagagatatcttaccagtttaaggttaaaaatcatttccccttctttgacatggcataccaaggttttgcaagtggtgaccctgaaagagatgcaaaggctattcgaatttttcttgaagatggacatctgattggatgtgcccaatcatatgctaaaaatatgggactctatgggcagcgagtaggttgcctcagtgttgtctgtgaagatgaaaaacaggctgtggctgtgaagagtcaattgcagcagcttgcaagaccaatgtatagcaatccacccgttcatggtgcccttattgtatcgataattctcaatgatccagacttgaagaagctttggctcaaggaagttaagggcatggctgaccgcattattggcatgcggactgcgctaagggaaaaccttgagaagttgggttcatctctttcttggcaacacataaccgatcagattggcatgttctgctacagtggcatgactcctgaacaagtggatcgtctaacaaaggaatatcatatttatatgactcgaaatggtcgtatcagcatggctggtgtcaccacgggtaatgttggctacctggcaaacgccattcacgaggtgacaaaatcctcatgaagggtttaatttcgtggttctaataaaaatgaggccgtgattgggttgtcatcaattcttttcttcgctaatggtataccgagatcagttttcacccccaattttttcttcaaatagtggaatggcgggtattcgaccggcaataaaacccatcagtctgtactgcactaatacatatatatacactgtcgacaatgcttatttcagaacaagagatcacctgtaattttatttttgactcattgaagcttacccctttcttgatatggttgcaagttttaccccgtttcccattcta

SEQ ID NO: 2631 - DNA, 1398 bp, Phalaenopsis aphrodite
aagcgtgtaaggtcactcatggcttcatcgatgtgccaaggaatcataaggaatcgccggcgagcggcggcgttggggagatttatgtcgacggcgtcttggtggggtcacgttgagccggctgcgaaggatccaatcctcggagtaacggaggctttcctcgccgatgcgagccctgataaagttaatgtcggagttggagcttatcgagataacaatggaaagccggtggttctggaatgtgttcgggaagcagagaagaggattgcgggaaacctaaatatggagtatcttcccatgggaggcagcatcaagatgattgaagagtcattgaagttagcatatggggatgattccgagttaataaaagaaaaacgcattgcagcagttcaaacactatcaggaactggggcatgtcggctttttgcagattttcagaaacgtttcttgcctgattcacaaatttatatacccatacctacctgggcaaatcatcataacatttggagggatgcccatgttcctcagaggacatttcactactaccatccagaaacaaagggacttgattttgcggccatgctggatgatattaagaatgcacccaacggttcgttctttttgcttcatgcatgtgcgcataatcctactggggttgatccatctgaagatcaatggagagagatatcacatctgttcaagattaagaatcatttcccattctttgacatggcataccaaggctttgctagtggtgaccccgagagagatgccaaagcgattcgaattttcctcgaggacgggcatatgattggttgcgcccagtcttttgcgaaaaatatgggactctatgggcagagagttggatgcctcagcattctttgtgaagatgatatacaagcagttgcagttaagagtcaattgcagcagattgctaggcctatgtatagcaatccaccaattcatggcgcacttgttgtttccatcatccttagtgatgccgagctaaaaagcttatggctcaaggaagttaagggtatggctgatcgtatcatcggaatgcgaagtgcgctacgtgaaaacattgaaaatttgggatccaacttgtcatgggagcatataactaatcagattggaatgttctgctacagtggattgactccagaacaagtagatcgcctgactaatgatttccatatttatatgaccagaaacggtcgaatcagcatggcaggagttaccacaggcaatttgggttacttggctgctgctattcatgaggtcaccaaagcttcatcaagctaaagagtctatttatgaagattgaaaaataatttaatttagacgggtaaaaagaaaacaattagccttactctatttttctctatgtattgtgta

SEQ ID NO: 2632 - DNA, 1397 bp, Cirsium arvense
atcgccggcaatcctcaaccttttcatccatggctctccggtcagcaatcaccagaagatcaatcctcatcagctcaacctcaagctcacgatccatgtcgtcgtggtggaaaagcgttgagcctgcaccaaaggatcctatcctcggcgtaactgaagcttttctagcagatccgaatcctgataaagttaatgttggagttggagcttatcgtgatgataacgggaagccggtggtgcttgattgtgtcagagaagccgagagacggattgccggaaacttgaacatggagtatcttccaatgggaggaagcaacaagatggttgaggaaacactgaagttggcctatggggaggattctgacttgatcaaagacaagcgaattgcagcagtacaagctctgtctggcactggtgcatgccgactgtttgcggacttccagaaacgcttttcccctgattcgcagatctatattccagtccctacgtggtctaaccaccataacatttggagagatgctaatgtaccacaaaggacattccattattaccatccagaatcaaaaggtcttgatttcgcctcactgatggatgatgttaagaatgcaccaaatggatcattctttttgctgcatgcttgtgctcataatcctaccggagttgatcctacagaggaacaatggaaagaaatatcttatcagtttaaggtcaaaggtcattttgctttcttcgacatggcttatcaaggctttgcaagtggagatccagagagggatgcgaaatccatcaggattttccttgaagatggtcacttaattggatgctctcaatcctatgctaagaatatgggtctttatggccagagagttggctgccttagtttggtatgtgaagatgaaaaacaagctgtggctgtgaaaagtcaattgcagcaacttgcgagacccatgtacagtaatccacccgttcatggtgctcttatcgtttcaactatccttggtgatccagagctaaaacaattgtggctcaaagaagtcaagggtatggctgaccgaatcatcggaatgagaactgctctcaaggaaaacatagaaaagttgggttctcctctatcgtgggagcacataactaaacagatcggtatgttctgttatagcgggatgacccctgaacaagttgatcgcttgacaaacgaatatcatatttatatgacccgcaatggccgtatcagtatggcgggggtgacaacgggcaatgtggagtatttggcgaaagcgatccatgaagttacaaaaggtgcttaaatgagacattatagaaatagatattgcaattgaagttgagattattccttctgagattattaggcattctccctttttgaaagaaaataaaga

SEQ ID NO: 2633 - DNA, 1335 bp, Rosmarinus officinalis
gcatctcccattcttagctggctctctttcgcttctcctccgccgcagtccaatctccaatggcgcacctcgttcgggccgggtcatcgggtcgtctggccaaatccggcttgcttggagctgcgcgatccatgtccacggcgtggtggcgccacgtggagcctgctgccaaggatccgatcctcggcgttaccgaagctttcctcgccgatcctagtcccgaaaaagtcaatgtcggcgtcggtgcttatcgtgatgataacggaaagccggtggtgctggaatgtgtcagagaagccgagaggagaattgccggcaatttgaacatggaatatcttcccatggggggaagtatgaacatggttgaggagactctaaagctggcttatggggagaactccgacttgattaaagataggagaattgcagcagtacaagctctttcaggaaccggtgcatgcaggctctttgcggacttccaaaagcgcttttcccccaattcccaaatttacattccagttcccacctggtccaatcatcacaatatctggagagatgcgcatgtacctcagagaacattccattactaccatccagaatcaaagggtttggactttgctggattgatggatgatgtgaagaatgcaccaaatgggtctttctttctccttcatgcttgtgctcataatccaacgggagtggatcctacggaagaacagtggaaagagatctcataccaatttaaggttaaaggacatttggccttcttcgacatggcatatcaaggttttgccagtggtgatccagaaagggatgccaagtcgattcggatttttcttgaggatggccatctaataggatgtgcgcaatcatatgcaaaaaatatgggactttatggtcaaagagtgggttgtctcagtctggtttgtgaggacgagaaacaagctgtggcagtgaaaagtcagttgcagcagatagcaagacccatgtacagtaatccccctcttcatggtgccctcattgtttccaccattctaggtgatccagatttgaaaaagttgtggctgaaagaagtaaaggggatggctgatcgaatcattggaatgagaactgctctacgagaaaatcttgaaaagttgggttcacctctttcgtgggagcacataaccaagcagattggcatgttctgctatagtggcatgacgcctgagcaagtagatcgcttgaccaacgaatttcacatttacatgactcgcaatgggcgtattagtatggccggagtcactactggcaatgtcggttacttggcgaatgctatacatgaggtcaccaagt

SEQ ID NO: 2634 - DNA, 1852 bp, Eucalyptus grandis
ccatttcctctctccgccgctcctccgctcgatcgctctctccaccctccatggcggcggcggttcgcgccggcgtttccggccggatcctgggccggggctccgctgtcggggcgaggtccatgtcgtcgtggtggcggagcgtggagccagcgcccaaggacccgatcctcggcgtcaccgaggccttccttgccgaccccagccccgacaaagtgaacgtcggcgttggtgcttaccgtgatgataatgggaagccggtcgttcttgagtgcgttagagaagcagagcggagaattgccgggaaccagaacatggaataccttccaatgggtggcagtgtgaagatggtggaggaaacattgaagttggcatatggtgaggactctgagttcatcaaagacaaaagaatagcagcagtgcaagctctttctgggacaggtgcatgccgcctttttgctgacttccagaagcgctttagtcctgattcccagatttatatacctgtcccaacctgggctaaccaccataacatctggagagatgcccatgttcctcagaggacttatcattactaccaccctgaatctaagggtttagattttgcggcactaatggatgatgtcaagaatgcaccgaatggttccttctttctacttcatgcatgtgctcataatcctactggggtggatccctcagaggaccagtggagagagatttcttatcaaattaaggtgaaaggtcattttcctttctttgacatggcatatcaaggatttgctagtggtgatccagaaagagatgcaaaggccatcaggatctttcttgaggatggtcatgcaattggaattgctcaatcttatgcaaagaacatgggactgtatggtcagagagtgggttgcctcagtgttctttgtgaagatgaaaaacaagcgatagctgtgaaaagtcagttgcagcagcttgccagacccatgtacagcaatccacctgtgcatggtgccctggtagtgtcaactattcttggcgatccagaattgaagagtttgtggctcaaggaagttaaggtaatggctgaccgaataatcgggatgcgtactgccttgcgagaaaaccttgaaaagcttgggtcgccgttatcgtggaaacacataaccgaacagattggtatgttctgctacagtgggatgactccagagcaggttgatcagttgacaaaagaatatcacatttacttgactcgtaatggccgtataagtatggcaggtgtaaccactggtaacgttggatacctcgctaatgccatcaacgaggtcacgaaatcttcttagtacctaatcgaggaggcgtcaaaccttgaataaagctactctcgatttgcattttccatgaagtaggtcgctgtgtcgtcatgagggtcatgagattttctttcagttcccatctcgttgcagctaggaagatgggcaataacatgcgcgtgatttagagcgccccctgttgtttcttgacttgttccattcttttccccgtgagaaattggggattgcaactttaacagttacaggtgacccatcaaataaaatccatatgtttccaactgttgctgggaatgcttctccccggtcaggttcagaggtccaagctgtgtactaaagcacgtgtttcgccggtgtgaaagcgtacgtggtaaggtcttggcaaatgattgtctactgcatgctgtaactttgtgtcggggatatttattctttggtttggtggaatttgagcccgtgattagggaactcgatgttggcctgctgatgtactacagattacccaacaaggtgtcgaaataattaaagttctc

SEQ ID NO: 2635 - DNA, 1728 bp, Humulus lupulus
cccattcatatataagtacccaatttgaggttccgtcactttactcggctgccccagtttctctctcttaaaggaacgttcgtagtttttctgctccattaaatttagagagagaaaaactttgacaaagttgtgaacgggataatcttttcatggcgtttcgcactgcgatctcgaacaaggtgatctctcccgctcggagctccgtcaccggagcgagatccatgtcatcttggtggcagaacgtcgatccggcacccaaggatccgattctcggtgtcaccgaggcttttcttgcggatcccagtcctgataaagtcaatgttggagttggcgcgtaccgggatgataacggaaagcctgttgttcttgattgcgttagagaagcagagcgtcggattgcggggaacttgaacatggaatatcttcctatgggagggagcataaagatggtggaagagacactaaagctggcatatggggagaactctcagttcatcaaagacaaaaggatagcggctgtgcaatctctttctggaacaggtgcatgcaggatttttgcagacttccagaaacgttttcatcctgattcccaaatctatataccaattccaacatggtccaaccatcataacatttggagagatgcccaggttcctcagaggactttccattactatcacccagaatctaaggggttagattttgctggactgatggatgacattaagaatgctccaaatggttcattctttttacttcacgcttgtgctcacaacccaacaggagtggatcctactgaagaacaatggagagaaatctcataccagttcaaggtaaaaggtcattttcccttttttgacatggcatatcaaggttttgctagtggcgacccagagaaagatgcaaagtccatcaggattttcctcgaggatggccacctcctcggccttgcccagtcatatgcaaaaaatatgggtctctacggtcagagagtaggatgccttagcttactatgtgacgatgaaaagcaagcagtggctgtaaaaagccagttgcagcagcttgccagacccatgtatagtaacccacctgtgcatggagcactcgtagtctcaatcattcttgatgatccagacttgaagaaattgtggctcaaagaagtccagggcatggccgaccgcattattggaatgcgaactgctttaagagaaaaccttgagaagttgggttcgactttatcgtgggagcacataaccaatcagattggcatgttctgctacagtgggatgacacctgaacaggtcgatcgtttgaccaatgaatttcatatctatatgactcgcaatggtcgtataagcatggcgggtgttacgactggcaatgttgggtgtctggcaaatgctatacatgaagtgaccaaatccaaatagagctcgtagaggctaacaggttcaacacaactgcaaatgtcacatacattttttattaattatttggctataatccccctgtaattgttaaggggggcaataaattataaaaaggaaatcaagataatttcttggctacatattcaattgttcttcctccatttttgtttggaggatattgtagttcttgtttagaatctcacttctttatacagaaactatgaagagagcaacatttttacatgaacaaaacaaatatctattgagaataaaataggtgattttattattataa

SEQ ID NO: 2636 - DNA, 1654 bp, Allium cepa
acaaatttcacttttaaacccccctttcctttcttctttcttcaccctcagacatggcttcaaccgcagcaatcagtagcaaaatactgaaaaaaggaggcgtttttggtaaatatggagctcgggccatgtccagttcatggtggtcaagtgttgagccggcttctaaagatccaattcttggtgttaccgaggcctttttagctgatcctagtcctgataaagttaatgttggagttggagcttatcgcgatgataatgggaagccagtggttcttgactgtgtaagggaagctgagaggagggtggctggaaatctcaacatggaatacctgccaatgggaggaagcatgcacatggttcaagagtcgctgaagctagcatatggcgaagattcagaatttataaaagataaacgcattgctgcagtacaatccctttcaggaactggtgcatgtcgccttttcgctgactttcagaaacgttttttgcccgactctcaaatatatatacccataccaacatggtcaaaccaccataatatttggagagatgcacatgtaccacagaagaccttccactactatcatcctgaaacgaagggtctggattttgcagcactcatcgaagatgttaagaatgcaccaaatggatcgtttttcttgctccatgcatgcgcccataatcctactggagtagatccatcagaagaacaatggagggagatatcacaccaatttaagattaaaaatcactttccattctttgatatggcataccaaggattcgctagtggcgacccagagagagatgctaaagctattcgcatatttcttgaagatggacatatgattggatgcgcacaatcttatgcaaaaaatatggggctctatgggcaaagagttggatgcctcagcattctttgtgaaaacgaactacaagcagtagctgtaaagagtcaactgcaacaaatagctaggcctatgtacagtaatccaccagttcatggtgctctgatcacttcaataatcttaagtgacccagaattgaagagtttgtggttgaaggaagtgaagggtatggccgatcgaatcattggaatgagagcttctcttcgcatgaaccttgaaaagttgggttctcctctatcttgggagcatgtaactaatcagattggaatgttctgctacagtggaatgacaccagagcaagttgatcgcctcactgatgagtatcacatctacatgactcgtaatggccgaatcagcatggcaggagtaacgtccaaaaacgtagaatatctggccaacgcaatccatgaggtgacaaaatctggatgaatacataatataaattcgttaataatataatgaaagagtataatatttcatttggaggattttgaagaataagttgatgttatggatcatcagtctgtgctaaggagggactcttataatggcatcataacatatgcccgagttttttatttatgtgctgtatgttgtgtaggttacattgaaaacaacattaacaaatattaccatagtccataaagaatatgtcggttgatgaaatattccaacatcgatgtcactgaaatttgattttgttcgttcttggagcaaataatgattattagtgtcattttgta

SEQ ID NO: 2637 - DNA, 2051 bp, Zostera marina
ggagtacgcgggaagccacaagcgaatagatgtaactggggggaccacatcgtcgtctcatccttctaaaaactaaaacaaatctcctctattcatttcacacctgcagccgattttacctcactctccacacattttctagggttgcggcgatggcttcgaggactgcaatttcttgtggaatcgcgcggagactgagctccgggtatggtttcgccactcgttctatgtcctcgtggtggactgatgtcgagccagcggcgaaggatcctatacttggagttacggaggcttttcttgccgatacgcaccctgataaagttaatgtcggagttggagcttatagagatgacgacgggaaaccggtggtgctcgagtgtgtgcgtgaagctgaaaggagaattgctggaagtgaaaatatggagtatcttcccatggggggcagtgtcaaaatggttgacgaaactttgaagctagcatatggagagaactctgagttcattaaggagaagagaattgcagcagtgcaagcattatcaggaacaggggcgtgcagactttttgctgaatttcagaaacgtttccagcctgactcacagatatatattcctatcccaacttggtcgaatcatcataatatctggagagatgctcaagttcctcaaagaactttccattattaccatgccgagacgaggggattagactttgcatcattgatggatgatgtcaagaatgctcccaatggatcatttttcatgcttcatgcatgtgcccataatcccaccggagtggatcccactgaggagcagtggagagagatctcttatcagttcaaggttaaaaatcattttgcatttttcgacatggcataccaaggttttgctagtggtgatccagaacgtgatgcaaaagctatcaggatatttctcgaggatggtcatcttatcggatgtgcccagtcatatgcaaagaacatgggactctatggacagagagtaggctgtctcagcattctctgcgaagatgagttgcaagctgttgcggtgaagagccagttgcaacaaattgcgaggcccatgtattctaacccacctgttcacggtgcccttgtcgtttctacaattctaagtgatccaactttaaagaacctatggttgaaggaagtgaagggaatggccgaccgaattattggaatgcgaactaaacttcgggaaaaccttgaaaatcttggttcgccgcttccatgggagcatgtaaccaaacagattgggatgttctgctatagtggaatgacccctgagcaggttgatcgtttgacaaatgagtaccatatctacatgacaaggaatggaagaataagcatggccggtgttactactggaaacgttggttatctagctaaagcaatccatgaagtcacaaagtctagttgattgttccttctcccgtggcattcacaaaggagattttaattttattctgaggaataattccccatcttgagaaataagtgtatgttgtcattatgttcttcgagaatcgcaatgtgaacaacttaattttgttgtatatgaataaaattatacaaacaattgaatggattttttgtaaatgcataaaatgcaaagcattaaaaacatatgtgcttcacccgtttaaacaggaagccgtcttatatctttcaaaacacccacgatttggttcatacttggtcgtttctgaacaagttcagcagtgcataaatacgcaacacgtttcgactccatgatttccttctcttctaaatcggattctattcggattctaggatccaaatctaccaacccggtttcatctctaactgaatcacggaaactttttacggcggtttcggatccaatctgtcccgttaaaagttccatcagtacaacaccgaatccgtacacgtcggactcggcacacgcatttccatcctcatcggcatcgtttccgttaatccctgcccacgttatcgccggaacgagatcttcgttcagaagacgtttgacgattccactcttccgtgtacg

SEQ ID NO: 2638 - DNA, 1370 bp, Sesamum indicum
agatcgcacatctcagacaccaagctctctcatacgagcaccagcgccgtttccttctcgactctgtcctccatacacctatccaaatggcgcagctgcttcggagtggatgttcgggtcgcgttctctgctccggcgccgttggtgcagcgcgatcaatgtctacggcgtggtggcgccacgtggagcctgctgccaaggacccgatcctcggtgttaccgaagctttcctcgctgatcctagtccgaacaaagtcaacgtcggagtcggagcatatcgtgatgacaatggaaagccggtggtgctggagtgcgtcagagaagcggagcggaggatcgctggaaatttgaacatggaatatcttcccatggggggaagtgtaaacatggttgaggagactttgaagctggcttatggagagaattctgacttgcttaaagataagcgaatcgctgcggtgcaggctctctctgggactggtgcatgcaggctctttgctgacttccaaaagcgtttttcccctgattcacaaatctatattcctgttcccacctgggccaatcatcacaacatctggagagatgctcatgttcctcagaggacattccattactatcatccacaatctaggggattggactttgcttcaatgatggatgacataaagaatgcaccaaatgggtcattctttctgcttcatgcttgtgctcataacccaactggagtggatccttcagaagaacagtggagggagatctcacaccaattcaaggttaaaggacattttgccttctttgacatggcatatcaaggttttgctagtggtgatccagaaagggatgctaagtccattcggatttttcttgaggatggccatctgattgggtgtgcccaatcctatgcaaagaatatgggactttatggtcagagagttggttgcctgagtgtggtctgtgaggatgagaaacaagccgtagcagtgaaaagtcagttgcagcagcttgcaagacccatgtacagtaatccaccagttcacggtgccctcattgtttccacaattcttggtgatccagacttgaagaagttatggctgaaggaagtgaaaggaatggctgatcgcatcataggaatgagaactgcactacgagaaaatcttgagaagttgggctcacctctttcatgggagcacgtaaccaagcagattggcatgttctgctacagtgggatgacgcctgaacaagtggatcgcttgacgaaggagtatcacatttacatgactcgtaatggccgtatcagcatggctggggtcactacgggaaatgttggatacttggcaaatgctatacacgaggtcaccaaatcgggctag

SEQ ID NO: 2639 - DNA, 1630 bp, Triphysaria pusilla
ccatttcctcctcctgcaaattttagctccggcttttactttatccatggcgcatctgcttcgggccggatattcaggtcatttatccaagtctggagctgcaaggtccatctccacgtcgctgtggcgccacgtagagcctgctcccaaggaccctatcctcggcgtcacggaagcttttctcgctgaccttagtcctcacaaagtcaatgttggcgtcggtgcatatcgtgatgataatggaaaaccggtggtattggattgcgtcagagaagcggaaaggagaatcgccggcaatttaaacatggaatatcttcccatgggaggaagtgtgaaaatggttggggagacgctaaagctggcttatggggagaattcagatttgataaaggataaacgtattgcagcagtgcaagctctttccggaactggcgcatgcaggctctttgctgacttccaaaagcgcttttcccctgactcgcaaatctacattccagctccaacctggtccaatcaccacaatatctggagagatgcccatgtccctgagaaaacattcagttattatcatccagagactaggggtttggactttgcctcgttgatgaatgacataaagaatgcaccaaatgggtcattctttctgcttcatgcttgtgctcataatccaactggagtcgatcctacagaagagcagtggaaggagatctcacaccaattcaaggttaaaggacattttgccttctttgacatggcttatcaaggttttgcaagtggtgatccagaaagggatgccaagtctatccggatttttcttgaggacggccatcagataggctgtgcccaatcatatgcaaagaatatgggactttatggacaaagagttggttgcctcagtgtagtttgcgaggatgagaaacaggctgtggcggtgaaaagtcagttacagcagattgcaaggcctatgtacagtaatccacctgtccatggtgccctcgttgtctcaatcattcttagtgacccagaattgaaaagcttatggctgaaggaagtaaaaggaatggctggccggataattggaatgagaaccgctctacgagaaaatcttgaaaagttgggttcacctctttcatgggagcacgtaaccaagcagattggcatgttttgctacagtgggatgacacctgaacaagtagatcgcttgacaaaagaatttcacatttacatgactcgcaatgggcgtattagtatggctggagtcacgacgggcaatgtgggttacttagctaatgcgatacacgaggtgactaaatctgcttagagatttgttgcttgtagcaaatcgaactttggagaccacatgaaatcgaccgagaggatttacagactcattctttaaatccacaaaaaataaatgaaggatttttatgcaatacatttttgtcatataattcgttgttatccccttcaataaattgaggatgactcgtgaatcaagagattgcaaaatctcttgattactggacatttaagttcaaattgtcttctttaagagatacgcgtttcggggagtaatacatgtttcaaattattatggatacatattgcagggtttgttaaaatattaaag

SEQ ID NO: 2640 - DNA, 1556 bp, Cleome gynandra
aggtagttcagatcaggtttgcggctccttcgtcctttccctaccacaacgctccctataaaagcctcacgtctccttttcttatcttttatacatctcagagagggaaagagagatggctatggctatggcgaacgctgcttcttcggcgagtaaggggcggagcacggctggtgtcggcctcagatccatgtcctcatggtggcgaagcgtcgagcctgcccctaaggacccgatccttggagttaccgaagctttcctcgctgatcctagtcctgacaaggttaatgttggtgtgggggcatatcgtgatgacaatggaaagcctgttgtcttggaatgtgtgagagaagctgaacggaggattgccggcggctcgtacatggagtatcttcctatgggagggagtgtcaaaatggtggaggaaacattgaagctggcatatggagagaattccgagttcatcaaggacaaaagaatagctgcagttcaagctctgtcaggaactggcgcttgccgtctattcgcagactttcagaaacgtttttgccctgagtcacagatctacattccagtgccaacctggtccaaccaccacaatatttggagagatgctcaagtccctcaaaagacgtatcattactatcatccagaaaccaggggtttggatttctcagcgttgatggatgatgtaaagaatgcgccaaacgggtcattctttctgctccatgcttgtgctcataatcctaccggggtagacccaacagaggaacaatggaaagagatatcacagctcttcaaggctaaaggtcattttgccttctttgatatggcatatcaaggttttgcaagtggtgatccagagagagatgccaagtccatcagaatctttctcgaggatggtcatcaaattggaattgctcaatcgtatgcaaaaaacatgggactctatggccagagagtaggatgcctcagcgtgctctgcgaagatgagaagcaggcagtgactgtgaaaagtcagctgcagcagctcgcaagaccaatgtacagtaaccctcctttacatggtgctctcatagtctcaaccattcttggagacccagagttgaaaagcctgtggctcaaggaagttaagggcatggctgatcggatcataggaatgcggacagccctgagagagaaccttgagaagttaggatcacctctctcatgggagcatattaccaaacagatcggaatgttctgcttcagtggtctaacaccagaacaggtggaccgcttgacaaacgaataccatatctacatgactcgcaatggccgcataagtatggcaggcgttacaacaggcaacgtaggttacctggcaaatgcgatccatgaggtctctaagtcttgaactattaaacatgttttcgcagctacataataaagggagtatttatatttttctgctattttgttggtgggaattggcagtcccacatttcacctgaacttttctcatacactgactctgttcagcgaagcttttagacttcaaataacaattccatttc

SEQ ID NO: 2641 - DNA, 1881 bp, Triphysaria pusilla
gctactgctacctctcttccatttcttccttctgcaaattttagctccgcctttttcctttatccaaatggcgcatctgtttcgggccggatattcgggtcatttgtccaagtctggagctgcaaggtccatctccacgtcgttgtggcgccacgtagagcctgctcccaaagacccgatcctcggcgtcaccgaagcttttctcgctgaccctagtcctcacaaagtcaatgttggcgtcggtgcatatcgtgatgataatggaaaaccggtggtattggattgcgtcagagaagcggaaaggagaatcgccggcaatttaaacatggaatatcttcccatgggaggaagtgtgaaaatggttgaggagactctaaagctggcttatggggagaattcggatttgatcaaggataaacgtattgcagcagtgcaagctctttccggaactggcgcatgcaggctctttgcggacttccaaaagcgcttttcccctgactcgcaaatctacattccagctccaacctggtccaatcaccacaacatctggagagatgcccatgtccctgagaaaacattcagttattatcatccagaaacgaggggtttggactttacctccttgatgaatgacataaagaatgcaccgaatgggtcattctttttgcttcatgcttgtgctcataatccaactggagtcgatcctacggaagagcagtggaaggagatctcacatcaattcaaggttaaaggacattttgccttctttgacatggcttatcaaggttttgcaagtggtgatccagaaagggatgccaagtctatccggatttttcttgaggacggccatcagataggatgtgcccaatcatatgcaaagaatatgggactttatggccaaagagtaggttgtctcagtgtagtttgcgaggatgagaaacaggctatagcggtgaaaagtcagttacagcagattgcaaggcctatgtacagtaatccacctgtccatggtgccctcgttgtctccatcattcttagtgacccagatttgaaaagcttatggctgaaggaagtaaaaggaatggctggtcggataattggaatgagaactgctctacgagaaaatcttgaaaagttgggttcacctctttcatgggagcacgtaaccaagcagattggcatgttttgctacagtgggatgacacctgaacaagtagatcgcttgacaaaagaatttcacatttacatgactcgcaatgggcgtattagtatggctggagtcacgacgggcaatgtcggttacttagcgaatgcgatacacgaggtgactaaatcctcttagagatttattgcttgtagcaaatcgacctttggagaccacataaaatcgaccgagatgatttacggactcaatctttagatccccaaaaaataaatgatggatttttttatgcaatacatttttgtcatacaattcgttggtgttatccccttcaataaattgaggatgacttgtgaatcaagaatattgcaaaatctcttgattactggacatttaagttcaaattgtcttctttaagagatacgcgtttcggggagtaatacatgtttcaaattattatggatacacattgcagggtttgttaaaatattaaagctccaatttttccaaaaattacattcgtagccctacattttacactatttcggaaacccaaagttgtgatatgctcgcagaaagagatccaccatgaatgcaattcaagttcttgactatttgtagacattgaatgctgattttattaatgtggatagaatacaaaatatctttagaaaaaatatattttgtattctatgtttcaagttccaaaaaaaaaaaaa

SEQ ID NO: 2642 - DNA, 1626 bp, Triphysaria pusilla
gctactgctacctctcttccatttcttccttcggcaaactctagctccggctttttgctttatccaaatggcgcatctgtttcgggccggatattcgggtcatttatccaagtctggagctgcaaggtccatctccacgtcgctgtggcgccacgtagagcctgctcccaaagacccgatcctcggcgtcaccgaagcttttctcgctgaccctagtcctcacaaagtcaatgttggcgtcggtgcatatcgtgatgataatggaaaaccggtggtattggattgcgtcagagaagcggaaaggagaatcgccggcaatttaaacatggaatatcttcccatgggaggaagtgtgaaaatggttgaggagactctaaagctggcttatggggagaattcggatttgatcaaggataaacgtattgcagcagtgcaagctctttccggaactggcgcatgcaggctctttgcggacttccaaaagcgcttttcccctgactcgcaaatctacattccagctccaacctggtccaatcaccacaacatctggagagatgcccatgtccctgagaaaacattcagttattatcatccagaaacaaggggtttggactttacctccttgatgaatgacataaagaatgcaccgaatgggtcattctttttgcttcatgcttgtgctcataatccaactggagtcgatcctacagaagagcagtggaaggagatctcacaccaattcaaggttaaaggacattttgccttctttgacatggcttatcaaggttttgcaagtggtgatccagaaagggatgccaagtctatccggatttttcttgaggacggccatcagataggatgtgcccaatcatatgcaaagaatatgggactttatggccaaagagtaggttgtctcagtgtagtttgcgaggatgagaaacaggctatagcggtgaaaagtcagttacagcagattgcaaggcctatgtacagtaatccacctgtccatggtgccctcgttgtctccatcattcttagtgacccagatttgaaaagcttatggctgaaggaagtaaaaggaatggctggccggataattggaatgagaaccgctctacgagaaaatcttgaaaagttgggttcacctctttcatgggagcacgtaaccaagcagattggcatgttttgctacagtgggatgacacctgaacaagtagatcgcttgacaaaagaatttcacatttacatgactcgcaatgggcgtattagtatggctggagtcacgacgggcaatgtcggttacttagcgaatgcgatacacgaggtgactaaatcctcttagagatttattgcttgtagcaaatcgacctttggagaccacataaaatcgaccgagatgatttacggactcaatctttagatccccaaaaaataaatgacggatttttttatgcaatacatttttgtcatacaattcgttggtgttatccccttcaataaattgaggatgactcgtgaatcaagagattgcaaaatctcttgattactggacattgaagttcaaattgtcttctttaagagatacgcgtttcggggagtaatacatgtttcaaattattatggata

SEQ ID NO: 2643 - DNA, 2305 bp, Oryza sativa
ctaatctgacccccgtgacctcccaacctggctcaattaacaaggcaaatgccccttaaacagtcaaacaaccgaggtcacgaaaacaaaaaagcctaaacagaaatgggattacgagagcagaaagacgcggcttctcgagagttccaagttccaacgaaccaaaaagctcaaaccccccccctggaccccacatgcagtggcacgtgagcgactcacccgcggacccgcctcgcccgcaacaacaagtagaccagagaaagtgaacagagcgatgcacacacgcagccgtcggcttggtttcccccccctgaatccaagtcacctcctcctcacacctcaccttccccctctctcctccgatcgcgcgcgcatggcgatgtcacgagccgccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcggagcggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaggaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctatgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtgagagtgttggagacattcctatcatcattttcagtacctttttaccgaccgcaaaatgggtcaaatggtgaaataaaattgtagtccgatatgatgtgaaataaaatggctggtaagctagaaaagggcaagtttattttttgaggacaagacttttgctgtaccagtgaaaacattttttaggacaagactttacagttagaacgaacgttctaactgtgacagtgtcatgctttgtaaaggaagtgtacctttccaccgatgggcatttttgattgctcgagtgtcatcaggaagtccacatactgtattaaacaggcccaatttacacccacagacgtctttagatggttctaaattgagcctaatgggctgatggcctttgttagttcggcccacatagacacccgacagtttatgggctaaaattaggcttgtccaaaatttcgattccgaaaggaaaaagtttacctgagatccctcgtcttgtcatcgagtttcaaaattgtccttgaaccgaaatactagatataacgcatccctaatcttgcaaaaacagatcacattgggttccaaaacagtattgctcccggttttggccgacgtggtggctgagtcagtgtgggacccacatgtcaac

SEQ ID NO: 2644 - DNA, 1753 bp, Oryza sativa
acaagtagaccagagaaagtgaacagagcgatgcacacacgcagccgtcggcttggtttcccccccctgaatccaagtcacctcctcctcacacctcaccttccccctctctcctccgatcgcgcgcgcatggcgatgtcacgagccgccgccgctgccgcggggactcccgtggcgcggcggcgattgatgggggccgtggcggcgaggtcgatggcgtcgtggttcggccacgtggagccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcggagcggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaggaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctatgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtgagagtgttggagacattcctatcatcattttcagtacctttttaccgaccgcaaaatgggtcaaatggtgaaataaaattgtagtccgatatgatgtgaaataaaatggctggtaagctagaaaagggcaagtttattttttgaggacaagacttttgctgtaccagtgaaaacattttttaggacaagactttacagttagaacgaacgttctaactgtgacagtgtcatgctttgtaaaggaagtgtacctttccaccgatgggcatttttgattgctcgagtgtcatcaggaagtccacatactgtattaaacaggcccaatttacacc

SEQ ID NO: 2645 - DNA, 1663 bp, Tripterygium wilfordii
ataaatctcagtgccttcgaatttattcgctcctctctcgctcgcttgatcttctgcttcttgttgctctcgttcgcagcgataaagtgcttcctagtaaggagagagctaccatggcgtttcgaagtgctctatcaggccagatcatgaggcggagctccctggtaggagagcgatctatgtcttcctggtggagcagcgtagagccagctccgaaggatccgattctcggcgttacagaagctttcctggctgattcgaatccaagcaaagtcaatgttggagttggggcttatcgcgatgataatgggaagcctgttgttcttgaatgcgtcagggaagctgagcgaaggattgctggcaactcaaatatggagtatctccccatgggaggaagcataaagatggtggaagaaactctgaagctggcctatggagagaattctgagttcatcaaagataaaaggatagcagctgtgcaatctctttctgggactggtgcatgcagactttttgcagacttccagaagcgtttccttcctgattcccaaatctacataccggtcccaacctgggccaaccaccataacatctggagagatgcccaggttcctcagaggacattccactactatcaccccgaaactaaagggttagattttgcagctctgatggatgacataaagaatgctccaaatggctcattctttctacttcatgcctgtgctcataatcctaccggagtagatccatcagaggatcaatggagggagatatcttatcatttcaaggtaaagggacattttgccttctttgacatggcctatcaaggttttgccagtggtgatccggagagagatgcaaagtccattagaatttttcttgaggatggtcatttgattggccttgcacagtcatttgcgaaaaatatgggactttatggccagagagtcggatgcctcagtgtgctttgcgaggatagaaaaacaagccattgctagtaaaaagtcagctgcagcaacttgctaggccaatgtatagcaacccacccgtccatggtgcactcatagtttcaaccatacttggagatccagacctgaagaaattgtggctcaaggaagttaaggtcatggctgatcgtattattgggatgcgaaaagctctacgggaaaaccttgaaaagttgggatcgcctttatcatgggaacacattactaaccagattggcatgttctgctacagtgggatgaaccctgagcaagtagacaagcttacaaatgagtatcatatctatatgacgcgaaatggtcgaatcagtatggcaggtgttaccaccggcaatgttggatacttggcaaatgctatacatgaagtcaccaaatctgcataacctcctgatttcctttaggaggccacagatatactgagatacttcaacggaatatttttgttttcttcctgcctgcctcaataagagggcgattacttgctcttcactaaccattgaatagtccctacttattcaatttgtccagtttgttggaatatttcttctcaagtaaaaataataaataagtgacggattacgtcaacaagtttgttaaactgtaatcaagggcaatagatgttgagtgtcacttcaatgtgctatatggtttgtctt

SEQ ID NO: 2646 - DNA, 1460 bp, Valeriana officinalis
tgatcattcgtctcgctttctctctctacaggcgacgatacaaccccaattatccatagcagcatctcgcatggccctccgaacctcgctatctcgtcgaattctgagccccagttacgttactggagttcgatccgtgtcttcctggtggaaaagcgtggagccagcacccaaggatcccattctcggtgtaactgaagcttttctagctgatcctagccctagtaaagttaatgttggagttggcgcttatcgagatgataatggaaaaccggtagtcctggagtgcgtgagagaggcagagcggaggatcgctggcagtatgaacatggaatatcttccaatgggaggaagtgcgaatatggttgaagaaacacttaagttggcttatggagagaattctgagcttatcaaagataagaaaattgcagcagttcaagctctttcgggaactggtgcatgccgtctttttgcagactttcaaagacgattttcccctgattcccaaatctacattccagttcccacctggtccaatcatcacaacatatggagagatgctaatgtaccacagagaactttccattattaccatccagaatcaaaaggattggattttgcttctcttatggacgacgtaaagaatgcaccaaatggatccttttttctgcttcatgcttgtgcacataatcctactggagttgatcctactgaagaacaatggagagaaatctcttaccagttcaaggtaaaagggcattttgctttctttgacatggcttatcaaggttttgcaagtggtgatcctgaaagagatgcaaaatcaatcaggtatttttctagaagacggtcatctaattggatgttcacagtcatatgccaaaaatatgggactttatggtcagagagtcggctgcctcagtttggtttgtgacgatgagaagcaagccgtggcggtaaaaagtcaactgcagcaactcgcaagaccgatgtatagtaatccacctcttcacggtgccttagttgtttcgacaatccttggtgctcccgaacttaaaaatttgtggctgaaggaagttaagggcatggctgaacgtatcattggaatgagaaccgctcttagggagaaccttgagaatctggggtcaccattgtcatgggagcacataactaatcagattggtatgttctgctttagcggaatgacaccagaacaagttgatcgcctgactcaagaatttcacatttacatgactcgaaatggccgtataagtatggcaggggtgactaccggtaatgtaggatacttagcaaatgcgatacatgaggtcacaaaatcgggataggggactgactcatcatacctacgggggatgggatgtacgttatatcaaaaaaggaatttatttctaattgcttatggatgctcgctagctccatttttattttctcgcaaatgt

SEQ ID NO: 2647 - DNA, 1578 bp, Centaurea maculosa
aacttattccggcgactgcaaatctccaatagagagagacatcgccggcaatcctcaacctcttcatccatggctctccggtcagcaatcaccagaagaatcctcatcagctcaacctcaagctcacgatccatgtcgtcgtggtggaaaagcgtcgagcctgcaccaaaggatcctattctcggcgtaactgaagcttttctagcagatccgaatcctgataaagttaatgttggagttggagcttatcgtgatgataacgggaagccggtggtgcttgattgtgtcagagaagccgagagacggattgccggaaacttgaacatggagtatcttccaatgggaggaagcaacaagatggttgaggaaacactgaagttggcctatggggaggattctgacttgatcaaagacaagcgaattgcagcagtacaagctctgtctggcactggtgcatgccgactgtttgcggacttccagaaacgcttttcccctgattcgcagatctatattccagtccctacgtggtctaaccaccataacatttggagagatgctaatgtaccacaaaggacattccattattaccatccagaatcaaaaggtcttgatttcgcctcactgatggatgatgttaagaatgcaccaaatggatcattctttttgctgcatgcttgtgctcataatcctaccggagttgatcctacagaggaacaatggaaagaaatatcttatcagtttaaggtcaaaggtcattttgctttcttcgacatggcttatcaaggctttgcaagtggagatccagagagggatgcgaaatccatcaggattttccttgaagatggtcacttaattggatgctctcaatcatatgctaagaatatgggtctttatggccagagagttggctgccttagtttggtatgtgaagatgaaaaacaagctgtggctgtgaaaagtcaattgcagcaacttgcgagacccatgtacagtaatccacccgttcatggtgctcttatcgtttcaactatccttggtgatccagagctaaaacaattgtggctcaaagaagtcaagggtatggctgagcgtatcatcggaatgagaactgctcttaaggaaaacatcgaaaagttgggttctcccctatcatgggagcacataactaaacagatcggtatgttctgttatagcgggatgacccctgaacaagttgatcgcttgacaaacgaatatcatatttatatgacccgcaatggccgtatcagtatggcaggggtgacaaccggcaatgtggagtatttggcgaaagcgatccatgaagttacaaaaggtgcttaaatgagacacattacagaaatagatattgcaattgaagttgagattattccttctgagattttagttgggtatatcaggtattctccctttttgaaagaaataaagaggccatgagttatggctgtttgtagtttgttatgatagaagaggatttttggcaagtttatttcttggaagcacctaatttgttgtaataaatcacattcatttattgaaagcgtctttttacaataaggt

SEQ ID NO: 2648 - DNA, 1780 bp, Cucumis melo
atttcgaggatttctccacttgggcctaaatcactctcttttcgcgcctcttcaaatctcctctccccttctttctcgttggaatttcatagaggaacagtgaaagagagttctaccactatactgtttacgttccatggcgttgcaagctacgatttccaggaaggttttaaaccagaaaagcctgagatgcttcggaatcggagctagattcatttcgtcttggtggaagagcgtagaaccggctcccaaagacccgattctaggcgttactgaagctttcttggccgatccgagtcctaacaaagtcaatgttggagtaggtgcatatcgagatgataacggaaagccggtggtcctcgaatgtgtgagggaagctgaacggaggattgcaggaaatctgaatatggagtatcttccaatgggagggagtattaagatggtggaagaaacactgaagctggcttatggagagaattctgacttgatcaaagataagaggatagcagctatacaatctctctctggaactggagcatgtcgaatttttgctgactttcaaaaacgtttccttcccgaatcccaaatttatatacctgtcccgacatgggccaaccaccataacatctggagagatgcacaagttcctcaaaggacatatcattattatcatccagagtctaagggattagacttttctgcactcatggatgacattaagaatgctccaaatggttcattctttctgcttcacgcatgtgctcataatcctactggagtggatcccacggaggaacaatggagagagatatcgtaccagtttaaggtaaaaggtcattttgccttttttgacatggcataccaaggttttgctagtggtgatcccgaaagagatgcaaagtccatcaggatctttctcgaggatggccatcatattggaattgctcaatcatatgctaaaaatatgggactctatggccagagagtaggatgtcttagtgtggtctgcgaagatgaaaatcaagcagtagctgttaaaagtcagctgcagcagcttgctcgaccgatgtacagtaatccacctattcacggtgcgttggtagtttcaatcatccttggggatccagacttgaagaagttatggctgaaggaagttaaggtcatggcagatcgaatcattggtatgcgaactgctcttcgagaaagccttgaaaagttgggatcaccactgtcatgggaacatataaccaaacagattgggatgttctgttacagtggattaacacccgaacaggttgaccgtttgacaagtgaatatcacatttacatgactagaaatggccgcataagcatggcaggtgtgacaaccgggaatgtatcatatctggcaaacgccattcatgaggttacaaaatctgtttgaatgatgattacggcttagaaattccctgtgcaaaaaatgatacactacagggagagccccctggcgaataaaaaaggtacctattactacaaccaattttaagagttccttccatcttcccttttagttaaaatataaatagggaaggggtcttacctcacagattaaacatttatttttgtcctcataaattatgtttcctcctttatattttttttgtggattttcaagatgtaaaacttgcatgagcgagtcttcgagtatgataatgtcagtgtgcattgtcaaattgatcggattatacgttcgtcttctattgccagctaaataattaataattttattcatttgctttgc

SEQ ID NO: 2649 - DNA, 1639 bp, Papaver somniferum
tttttctagtactaaagtaacattttaagtacacaggttgttgaacttgtaagagagatctaaagagagagatggcgtcaagaacaatgatttctagaggaagagttgttcatcagacaagaagcttaggtgctagattcatgtcatcatggtggaaccatgttgaaccagctcctaaagatcctattcttggtgttactgaagcttttctggctgatcctagtcctaacaaagtcaatgttggagttggagcttatagggatgataatggaaaaccagttgttcttgaatgtgttagggaagcagagaggattattgctgggaataagaacatggaatatcttccaatgggaggaagtatgcacatggttgaggagacattgaagctagcatatggagagaaatctgatttaattaaagacaaaaaaattgctgcaattcaagctctttcaggaacaggtgcttgccgagtgtttgctgattttcagaagcgttttaagccagattctcacatttatatacctgtgccaacatggtccaaccatcataacatatggagagatgcccaggtcccacaacaaacattccgttactaccatcctgagacgaaagggttggactttgcatccctgatggaagacctaaagaatgcgccaagtgggtcattctttttgctgcatgcatgcgctcataatccaactggagtggatcctacagaggagcaatggaaggagatttcgcagcagatgaaggttaaaggtcatttcccttctttgatatggcatatcaagggtttgcaagtggtgatcctgagagggatgcaaaagccatcaggatttttcttgaggatggccacttgattggatgtgctcagtcatatgctaagaacatggggctttacggtcaaagagttgggtgtctcagtttggtttgtgacgacgataaacaagcaattgcggtgaagagtcagttgcagcagattgccagacccatgtacagcaacccacctgttcatggtgctcttgttgtttcaactgtcctcagtgatccgaatttgaagaacttgtggctcaaggaagtgaagggtatggctgaccgcattattggcatgcgaactgcactcagggaaaaccttgaaaatttaggctcacctctatcctgggagcatataactaatcagattggcatgttttgctacagcggcatgacacccgaacaagtagatcgcttgacaagtgaatatcacatatacatgacccgtaacggtcgtattagtatggctggtgttacgacgggcaatgtaggatacttggctaacgccatccatgaggttacgaaatcctcttagagacgggtcaataaccttgaagtgatgaaatttgcttgcaaggctatacaaaaatatacttgataatctatatgtaacttagttattgtgggttcaaggaataatttgcactcaagtgatctgaggggcatatttcaaacatccgttttttttcgggatgatttttttccttctttcttggtctcaattacgctttcaattctgagcgtaataggctgatcttgttgtatcatgagaactaaagcttaaatcatagctgatatggtaaacataattttaaaaaaaaaaaaa

SEQ ID NO: 2650 - DNA, 1637 bp, Helianthus annuus
gatgagattttgcgcattccatgtcggcagcacgctatctggattccgttgtctcctttataaacctcaaaattccatttcatttcatttcattctccacccacccccacctgaactccagtactccggcgatcactcaccaatctccgcccaatggcgctccgtacagcgatcaccaaacgaatgataacatcacacggctcacgatccatatcatcgtggtggaaacacgttgagcctgcgcccaaagaccctatcctcggtgtcaccgaagcttttctagcggatcctcatcctgacaaagttaatgttggcgtcggagcttatcgtgatgataacgggaagccggttgttcttgattgtgttagagaagctgagagacgaattgctggaaacttgaacatggaatatcttccaatgggaggaagcaacaaaatggttgaggaaacactgaaattggcctacggtgacgattctgatttaatcaaagataaacgaattgcagcaatacaagctctatctggcactggtgcatgccgaattttcgcagattttcaaaagcggttttcgcctgattctcagatctatattccagtccctacctggtccaatcaccataacatctggagagatgctaatgtaccacaaagaacattccattattatcatccggaatcaaaaggtcttgatttcgcctcgctgatggatgatgttaagaatgcaccaaacgggtcgttctttttgctgcatgcttgtgctcataatcctactggagttgaccccacagtagaacaatggaaagaaatatcttaccagtttaaggtgaaaggtcattttgctttctttgacatggcctatcaaggatttgcaagtggtgatccagaaagagatgcaaaatccattagaatttttcttgaagatggtcatttaattggatgttctcagtcatacgctaaaaaatatgggtctttatggccaaagagttggctgccttagtttggtatgtgaagatgagaaacaagctgtggctgtgaaaagtcaactacagcaacttgcaagaccgatgtacagtaatccaccagttcatggtgcactgattgtttcgactattcttggtgatccagatttgaagcagttgtggctcaaagaagtcaagggtatggctgaccgtataatcgggatgagaacttcacttagggaaaacatcgagaagttgggctctccgttatcatgggaacacataactaatcagattggcatgttctgctacagtgggatgactcctgaacaagttgatcgcttgacaaaagagtttcacatttacatgacccgcaatggtcgtattagtatggcaggggtcacaagtggcaatgttgaatacttggcaaaagccatccatgaagttacaaaagctgcttaaagttcagataatactttctggggatttggctaaaacgcgcatcctcgtattttcctttgaattatttaaactataaagaaaataaatagattaagttctaattgttgtagcgagtcgtgcttcttgttttgctaattgttatgataggacttaaaaaactgtatacgggtagctgttaaagctgctcacattgtttgaataatacaaaattgttttt

SEQ ID NO: 2651 - DNA, 1647 bp, Citrullus lanatus
gctgagcatttcgaggtactcatatctatttctccagttgcagcctgaagcccgaaaccgctctgttttcgcgcctccacaaaatctcgtccgctcctttccctctcgcatttccgtcggattttgtagagagaatagtgagagagagctagcagtgtattgttgatgttcatggcgttgcaagcagcgatttcgaggaaggttttagaccagagcggcctgagatgcttcggcgtcggagctagatccatgtcgtcttggtggaagagcttagaaccggctccaaaattctaggcgttactgaagctttcttggccgatccgagtcctaacaaagtcaatgttggagtaggtgcatatcgagacgataacggaaagccggtggtcctcgaatgtgtgagggaagctgaacggaggatcgcaggaaacctgaatatggagtatcttccaatgggagggagtataaagatggtggaagagacactgaagctggcttatggggagaattctgatttcatcaaagataagaggatagcagctatacaatctctatctggaactggagcatgtcgaatttttgctgactttcaaaagcgtttccgtcctgaatcccaaatctatataccagtccctacatgggccaaccaccataacatctggagagatgcacaagttcctcaaaggacataccattactatcatccagagtctaagggattagacttttctgcattcatggatgacattaagaatgctccaaatggttcattctttctacttcacgcatgtgctcacaatcctactggagtggaccccacggaggaacaatggagagagatatcataccagtttaaggtcaaaggccattttgccttttttgacatggcataccaaggttttgctagtggtgatccagaaaaagatgcaaagtccatcaggatctttctcgaggatggccaccatatcgggattgctcaatcatatgctaaaaatatgggactctatggccagagagtaggatgtcttagtgtggtctgcgaagatgaaaaacaagcagttgctgttaaaagtcagctgcagcagcttgcccgaccgatgtacagtaatccacctgttcatggtgcattggtagtttcaatcatacttggggatccaaacttgaagaagttatggctgaaggaagttaaggtcatggcagatcgaatcattggtatgcgaactgctctacgagaaaaccttgaaaagttgggatcaccattgtcgtgggaacatataaccaaacagattgggatgttctgttacagtggattgacccccgaacaggtcgaccgtttgacaaatgaatatcacatttacatgactagaaatggccgcataagcatggcaggtgttacaaccgggaacgtaccatatctggcaaacgccattcatgaagttacaaaatctgtttgattgactgcggcttacaaccaattttctttttaaggatacgctacaggagagttctctgcttggtgaataaaaggtacctatttaccaattccttccatcctcccttttaagtttagggaagaggcaacacacatcaaacattgatttttgtcctcctaaatcatgatcccccctctttttcctggattttcaagat

SEQ ID NO: 2652 - DNA, 1703 bp, Malus domestica
caaagttaggcttgctttgctgcttcggcttcccgcatcccctccagttccgatggcgctttcccggaaacttgttcagcagcggagctccgtattcggaagccgatccatgtcgtggtggcggagcgtcgagccggctcctaaggatccgattctcggtgtcaccgaggctttcctcgccgatccaagtcccgataaagtcaatgttggagtgggtgcgtatcgagatgataatggaaagccagttgttctgcaatgcgttagagaagccgagcggaggattgccggaaacttaaacatggagtatcttcctatggggggaagtgtgaagatggtggaagaaacattgaagctagcatatggggagaattcggagcacatcaaagataaaaggatagcagcagtgcaagctctctctggaacgggtgcatgccgtctttttgcagactttcaaaagcgttttcgtcccgagtctcaaatctatataccagtgccaacatgggccaaccatcataacatctggagagatgctcacgtcccccaaaagacattccattactatcatccggaaactaaggggttggactttgcaggactggttgatgacataaagaatgctccaaacggctcattctttctacttcatgcctgtgctcacaatcccactggagtggatccttcagaggaacagtggaaagagatttcaaaactgatcaaggaaaagggacatttccccttcttcgacatggcatatcaaggctttgctagtggtgacccagagagagacgcaaaagccatcaggattttccttgaggatggtcatctaattggaattgcccaatcatatgccaaaaacatgggactctatggccagagagtaggatgtcttagcgtgctttgtgaggatgaaaaacaagccgtggcagtaaaaagccagttgcagatgcttgccaggcccatgtatagtaacccacctgttcatggagcgcttgtagtttcaactatccttggtgatcaagaattgaaaactttatggctgaaggaagttaagggcatggcagatcgcatcattggaatgagaactgctctacgagaaaatcttgagaaagtggggtcacccttatcgtgggagcacgtaactaatcagataggtatgttttgctacagcgggatgacacctgaacaggttgatcgcttgactaatgaatttcatatctatatgactcgcaatggtcgtataagcatggccggtgttacaacgggcaatgttggatatctagcaaatgctatacatgaagtcacaaaatcaacatagagaattcaatcgtaggtcagttagtccccaagggaccttaggaactgtatcagacattgatttgcttgtcgtcctcatcttcttatgatagagaaggaaggatcaataaactacaaccgccattggtgcgctcttctcagtttcttcccccatttttcgattctgcaagggcgagctgtcatctatacaagtagtcctaaaagaagagtgacatgtatctcgatagtttgtagtaaaatactttgggttttgccttcagcaataaaattaggtttgaagtattttgttgcatcaaatcatcataaagtacaaccatgatttagacgattacgatatttgcatggacaaattgaaatctaaatggtgggtaataatttctgcaatgaaa

SEQ ID NO: 2653 - DNA, 1632 bp, Cucumis sativus
atttcgaggatttctccacttggacctaaatcctctgttttcgcgccccttcaaattctcctctcccctgccttctccttccaatttcatatacaacagtgaaagacagagctaccggtttactgttcacgttccatggcgttgcaagctactatttcgaggaagcttttaaaccagaacaacctgagatgcttcggaatcggcgctagatccatttcttcttggtggaagagcgtagaaccggctcccaaagatccgattctaggcgttactgaagctttcttggccgatccgagtcctaacaaagtcaatgttggagtaggtgcctatcgagatgataacggaaagccggtggtcctcgattgtgtgagggaagctgaacggaggattgcaggaaacctgaatatggagtatcttccaatgggagggagtataaagatggtggaagaaacactgaagctggcttatggagagaattctgacttgatcaaagataagaagatagcaagtatacaatctctctctggaactggagcatgtcgaatttttgctgactttcaaaaacgtttccttcccgaatcccaaatttatataccagtccctacatgggccaaccaccataacatctggagagatgcacaagttcctcaaaggacataccattattatcatccagagtctaagggattagacttttctgcactcatggatgacattaagaatgctccaaatggttcattctttctgcttcacgcatgtgctcacaatcctactggagtggatcccacggaggaacaatggagagagatatcataccagtttaaggtaaaaggtcattttgccttttttgacatggcataccaaggttttgctagtggtgatccagaaaaagatgcaaagtcgatcaggatctttctcgaggatggccatcatattggaattgcacaatcatatgctaaaaatatgggactctatggccagagagtaggatgtcttagtgtggtctgcgaagatgaaaaacaagcagtagctgttaaaagtcagctgcagcagcttgctcgaccgatgtacagtaatccacctattcacggtgcattggtagtttcaattatccttggggatccagacttgaagaagttatggctgaaggaagttaaggtcatggcagatcgaatcattggtatgcgaactgctcttcgagaaaaccttgaaaagttgggatcaccattgtcatgggaacatataaccaaacagattgggatgttctgttacagtggattgacacccgaacaggttgaccgtttgacaaatgaatatcacatttacatgactagaaatggccgtataagcatggcaggtgtgacaacggggaatgtaccatatctggcaaacgccattcacgaggttacaaaatctatttgactgattacggcttacaaaaagaaaattaaaaaaaaaaaatgatacaccacagggagaacccctggctggtgaataaaaaaggtacctattactaccacctatttcaaaaattccttccaccttcccttttagttaaaatataaatagggaaggggccttacctcacagattaaacattgatttttgtcctcataaattatgttccttcct

SEQ ID NO: 2654 - DNA, 1649 bp, Flaveria ramosissima
tcatcattatcatctcaccctcaacgaaccaccaccacaaccacctatccccaccggaatccacctccggcggccgccggacgtcgtacggaagctccgacaacactcatcaatcatcaactcatggcgttacgaacagcaatcaccacacgaatcacgagctcgagctcgatcttaaatggctcgcgattcatgtcgtcgtggtggagaaacgttgagcctgcacccaaagaccctattcttggtgttactgaagcttatctagcggatcctagccctgataaagttaatgttggagttggagcttatcgtgatgataacgggaagcctgttgtgcttgattgtgttagagaagcagaaaggcgtattgcaggaaacctgaacatggagtatcttccaatgggaggaagcaacaaaatggttgaggaaacattgaagttggcatatggtgaagattctgacttgattaaggataaacgaattgcagcaatacaagctctttctggcactggtgcatgcagaattttcgctgatttccagaaacggttttcacctgattctcagatctatattccagtccctacctggtccaaccaccataacatttggagagatgctaatgtgccccaaagaacattccactattatcatccagaatcaaaaggtcttgatttcgcctcactaatggatgatgttaagaatgcaccaaatgggtctttctttttgctgcatgcttgtgctcataatcctactggagttgatcctacagctgaacaatggaaagaaatatcttaccagtttaaggtcaaaggccattttgctttctttgacatggcctatcaaggctttgcaagtggtgacccagaaagagatgccaaatccattaggattttccttgaagatggtcatttaattggatgttcacaatcatatgcgaaaaatatgggtctttatggccaaagagttggctgcctcagtctggtatgtgaagatgaaaaacaagctgtggctgtgaaaagtcaactgcagcaactagcaagacctatgtacagtaatccacctgttcatggtgcacttattgtttcaactatccttggtgatccagatttaaaacaattgtggctcaaggaagtgaagggtatggctgatcgtatcatcggaatgagaacttctcttagggaaaacattgaaaaattgggatctcccctatcatgggaacacataactaatcaaattggcatgttctgctatagcgggatgactcctgaacaagttgatcgtttgacgaaagaatttcatatttacatgacccgcaatggtcgtatcagtatggcaggggtcacaagtggcaatgttgaatacttggcaaaagcgatccatgaagttacaaaagctgcttaaagctcgtattattttgaggtttttggttgaaactagttttcgggtatatttccctgagaataatttagaaaataaaaaggtaaaggtacttcacctggttatgagttttgattgtttgtagcgaatagcaattgttgtaattgttatggaagaagactttgataaattaaattcttgtaaggacatcaaaagctcggttctggtagcctgttaaagctaccgtcttatcgtttgaataatacacattt

SEQ ID NO: 2655 - DNA, 1771 bp, Nicotiana benthamiana
gcttctcgaggcaaaagctgttagtaacattgacggctcgctcagtccactctccgtcttccctctcctatataaagactaacttcgacaaacacgccattttcctcgctccgattctctaaatcctctctccagatagccatggcgatccgagccgcgatttccggtcgttccctcaagcttagctcgtcggtaggagcgcgatctttgtcgtcgttgtggcgaaacgtcgagccggctcctaaagatcctatcctcggcgttaccgaagctttcctcgccgatcctactcctcataaagtcaatgttggcgttggagcttacagggacgacaatggaaaacccgtggtactggagtgtgtcagagaagcagagcggaggatcgctggtagtttcaacatggaatatcttcctatgggaggtagtgtcaacatgatcgaggagtcactgaagttagcctatggggagaactcagacttgataaaagataagcgcattgcagcaattcaagctttatctgggactggagcgtgccgaatttttgcagacttccaaaggcgcttttgtcccgattcacagatttatattcctgttcctacatggtctaatcatcataacatttggaaagatgctcacgtccctcagaaaacgtaccattattatcatcctgaaacaaaggggttagactttgctgcactaatggatgatataaagaatgccccaaatggatccttctttctgcttcatgcttgtgctcacaatcctactggggtggatcctacagaggaacaatggagggagatctcacaccagttcaaggtgaagggacattttgctttctttgacatggcctatcaaggatttgctagtgggaatccagagaaggatgctaagtctatcaggatatttcttgaagatggtcatccgataggatgtgctcaatcatatgcaaaaaatatgggactatatggccagcgagttggttgcctaagtgtggtttgtgaggatgaaaaacaagcagtggcagtgaaaagtcagttgcagcagcttgctaggcccatgtatagtaatccacctgttcatggcgcacttgttgttgctaccatccttggagatccaaacttgaaaaagatatggcttggggaagtgaagggcatggctgatcgcattatcgggatgagaactgctttaagagaaaaccttgagaagttggggtcacctctatcttgggagcacataaccaatcagattggcatgttctgctatagtgggatgacacccgaacaagtcgaccgtttgacaaaagagtatcacatctacatgactcgtaatggtcgtatcagtatggcaggagttactactggaaatgttggttacttggcaaacgctattcatgaggttaccaaatcagcttaatgtctgaaatcatggattcattttaaataaccagcagcggaaggctgtggaaaagacatcaaatgtcagaatatcaagattcctttttccccctaccattttgtctccttgtggatggactgttgaattcctttttttatgatgggtgagggaaattgtaatagctaagttaaaataatcatactgacagaggaatgaataggatctgggagaattgaggtgtagaagcagtgtctaaacatgttgaggtggagaagtttctctgttgtattatgtcattctaggatacatccagtcatataattagccgaacccggcaccatttgccagcccatgaggcactggattaaactca

SEQ ID NO: 2656 - DNA, 1540 bp, Quercus alba
gtacatggggaaaatcgcagctagctcttcttcaaaacacttctgctccgtacacctttctttcactatttcagacgcaaagtgtgagaaacgatggcgtttcgggcggtgatgtcgaggcgggtcacgaatcggagctccgacattggagcgaggtggatgtcaacgtggtgggggaacgtggagcctgcagcgaaggatccgattctcggcgttacggaggctttcttggctgatcccagccccagtaaagtcaatgtcggagttggcgcttaccgcgatgataatggaaaacccgttgttctcgaatgcgttagagaagcagagaggaggattgctggacactcaaacatggagtatcttcctatgggaggaagtgtcaagatggtggaagaaacactaaaactggcctatggggagaattctgagtttatcaaagataaaagaatagcagcagtacaatctctatctggtactggtgcatgccgactttttgcagactttcaaaagcgttttcgtcctgattcccaaatttacataccagtccctacctgggccaaccaccataacatctggagagatgcacaagtacctcaaaggaccttccattactatcacccagagactcgagggttagattttgcatcactgatggatgacataaagaatgctccaaatggctcatttttcctccttcatgcttgtgctcacaatcctactggagtggatcctacagaggaacaatggagagagatgtcataccagttcaaggcaaagggtcattttgctttctttgacatggcatatcaaggttttgctagtggtgatccagagagagatgcaaagtctatcaggatttttctcgaggatggacatctaattggaattgctcaatcatatgcaaaaaatatgggactgtatggccagagagtgggatgccttagtgtgctttgtcaagatgaaaaacaagctgtggctgttaaaagtcaattgcagcagcttgccagacctatgtatagtaacccacctcttcatggtgcactcgtagtttcaaccattcttggtgatccggatttgaagaatttatggcttaaagaagttaaggtcatggcagatcgcatcatcggaatgcgaacagctctacgagaaaatcttgaaaagttgggatcacccttatcatgggagcacataactaatcagattggtatgttttgttatagtgggttgacccctgaacaagtggatcgtttgacgagcgaatttcatatttaccttactagaaatggtcgtatcagtatggcgggtgtcactacaggtaatgttggatacttagctaatgccatcaacgaggtctcgaaatctgcttagtggcttgttccagaagtcaaattcttagagggtgccctagatataaagtcgaagacatcacaaatttcattgggatttttgtaatcttccttcccatccataaatgaattggaaggatgtaataaaagagacatcattatatgctcatcctaattttttccaccaataatgg

SEQ ID NO: 2657 - DNA, 1604 bp, Manihot esculenta
ggaatggcgtttaaaaccgctatggcgtgccgcttaattaaccgaaagtccgtgatcggagcgagatccatgtcttcttggtggcggagcgttgatcctgcccccaaagatccgattcttggcgtaaccgaggcttttctcgccgatcctagtcctgacaaagttaatgttggagttggtgcttaccgagatgataatggaaagccagttgtactggaatgcgttagagaagcagagcggaggattgctggaaagttaaacatggagtatcttccaatgggagggagtgtaaaaatggtggaagaaacattgaaattggcctatggagagaactctgagttcattaaagataaacggatagcagcagtgcaatcgctctctgggactggtgcatgtagactttttgctgattttcagaagcgattttctcctgattcccaaatctatataccagtgccaacatgggctaatcaccacaatatctggagagatgctcaggtccctcaaagaacttatcattactatcatccagagtccagaggcttaaattttgcagcgatgatggatgacgttaagaatgctccaaatggctcattctttctacttcatgcttgtgctcataatcctactggggttgatccaacagaggaagaatggagagagatatctcacctgttcaaggataaaaatcattttgccttttttgacatggcatatcaaggctttgctagtggtgatccggaaagagatgcaaagtctatcaggatttttcttgaggatggtcatcatattggcattgcccaatcatatgcaaaaaatatggggctctatggccagagagtaggatgcctcagtgtgctttgtgaagatgagaaacaagctgtagcagtaaaaagtcagttgcagcaacttgcaagaccgatgtacagcaatccacctgttcatggtgcactcatagtttcaactatccttggagatccagacttaaagaagttatggctgaaggaagttaaggtaatggcggatcgcatcatttccatgcgaacagctttgcgagaaaaccttgaaaagttggggtcaccattatcatggaagcatgttaccaagcagattgggatgttttgctatagcgggatgacaccagaacaagttgatcgtttgacaaaagaatatcacatctatatgacccgtaatggtcgaatcagtatggccggcgttactacacacaatgtgggatatttggcaaatgctattcatgaggtcactaaatcagcttagcttcatttgcagaaaattatcagcctttaggaagtcatagcataagcccaagttagacatgggaaacaaatttttccctcgccctcttcctctttaattactacggaaggggcaataaattggtttattatagtttctcaaaatttatgctcccatggtgttctttgaggaagtataattttaggaccatacttgcctagttgggaatttttcccctttgaaggttgaacaatatgttcaattttgcttagaaataaattggcagaacatttttgttgttatcccccaaggaatacaaattatcaagttatgaatgttaaattgct

SEQ ID NO: 2658 - DNA, 1817 bp, Vitis vinifera
gttgcaacaaatttgataagcggcgaggccaaggcgaggcgattaaattaaactcgcgattttctagtgtctctttgtttcttggctcagagtcgtagaggtctacaccagctctgtccatggcgtttagaacgggaatttccagaaggatgatgattaggtcggggtttggacttcgatcgatgtcttcgtggtgggggagcgtggagcccgctgccaaagatccgatccttggtgttactgaagctttcttggcagatcccagtcctgataaagtcaatgttggagttggtgcctaccgcgatgataatgggaagcctgttgttcttgaatgcgttagagaagcagagcggaggatcgccgggaaattaaacatggaatatcttcccatgggaggaagtgtgaacatggtcgaagaaacactgaagttggcatatggagagaactctgaattcatcaaagataagcggattgcagcagtgcaggctctctctggaactggtgcttgccgacttttcgcagacttccaaaagcgttttcggcctgactcccaaatttatataccagtcccaacctgggctaaccatcataacatctggagagatgcccaggtccctcaaaggactttccattactatcatccagagacaaagggtttagattttgcatcactgatggatgatgtaaagaatgctccaaatggatcattctttctacttcatgcttgtgctcataaccctactggagtggatccttcagaggaacaatggaaagagatctcataccagttcaaggtcaaaggtcattttgccttctttgacatggcatatcaaggttttgctagtggtgacccagagagggatgccaagtccatcaagattttccttgaggatggtcatctaattggcattgcccaatcgtatgcaaaaaacatgggactctatggccagagagtgggatgcctaagtctgctctgtgaagatgaaaagcaagcagtggctgtcaagagtcagttgcagcagattgctagacccatgtacagtaatccacctgttcaaggtgctctcattgtgtcaactattcttggtgatccagaattgaagaaattatggctcaaggaagttaaggttatggcagatcgcattattggaatgcgaactgctttacgagaaaacctagagaagttggggtcccccctgtcttgggagcacattactaaccagattggcatgttctgctacagtggtttgacacctgaacaggttgatcgaatgacaaatgaatttcatatctacatgactcgcaatggtcgcatcagtatggcaggtattacaactggaaatgtctcatatttggctaatgccatccatgaagtgtcaaaatctgcttagagaagcattacaggaaatatacctcaactaagaaatgatctaggagccatagaaaggtaaccagtcattacaattagcctaagttttttcatacccgttcaaccattcccttttctaccaaggagcaataaattggacttgagttatgcgctcttcacattttttctctctttctgttggttattgtaaaatgcaagttgaatttcgggtggtgtcctgattctcttgtatgtgaaccattggggggagcaaatgtattacatttgtccagttttcttgggacaataatttggttagcaataagttgaggcagaggatgaaattgtcatacgggagcattgaaaacaaaagaatcattggatgtttggattccaagaacatttgttgtgtcttttaataaattgaaatcaaaggaaatttgattta

SEQ ID NO: 2659 - DNA, 1592 bp, Tabernaemontana elegans
gccgtttctcacccgcccgagtcgcccccggattcgtcgcgcactcccaagccccctctgccatattaatattctcacgcagtcacacactgaacatcagaaaacacacacacagcgaactctctttctctctctgcttcggctccgagcttcgtattcttatctgatatggcgaacaggacgaggatttcaggtcgaatcatcaagtccggagctgtatttggagcgcgatccatgtcgtcttggtggggaatggtcgaaccagctccaaaggatccgattcttggagttaccgaagcgtttctggcggatcccagtcccaccaaagtcaatgttggagttggagcttatcgagacgacaacgggaagccagtggttttgaattgtgtcagagaagcagagcgaagaattgccgggaacatgaacatggaatatctttctatgggaggaagtgtaaaaatggtagaggaaacattgaagttggcttatggagagaattctgacttgattaaagataagaggattgcagcagtgcaagctctctctgggactggtgcatgccgactttttgcagatttccaaaaacgcttttgtcctgattcacaaatttatattccagtccctacttggtccaatcatcataacatctggagagatgctcatgtccctcagaacacatttcactattatcatccagggactaaagggttggattttgctacaatgatggatgacataaagaatgcaccaaatggatcatttttcctgcttcatgcttgtgctcataatcctactggagttgatccatcagaagagcaatggagagaaatatcacaacagtttaaggtcaaagggcattttgccttctttgacatggcatatcaaggttttgccagtggtgatcctgaaagagatgctaagtctatcaggattttccttgacgatggtcatctaattgggtgtgcccaatcttatgcaaaaaatatgggactttatggccagagaataggctgcctgagtgtggtttgtgaagatgagaagcaagctgttgccgtgaagagtcagttacagcaacttgccagacccatgtacagtaacccacctgttcatggtgctcttattgtttctatcattctcagtgacccagacttgaagaagttgtggcttaaagaagtgaagggaatggctgatcgcatcattggaatgagaactgctctacgagagaaccttgagaagttgggttcacctttgtcttgggagcacataaccaaccagattgggatgttctgctttagcggcttgactcctgaacaagttgatcagttgacaaatgaatatcatatatacatgactcgcaatggtcgtatcagcatggcaggagttacaaccggaaatgttggttatttggcaaatgctattcatgaagtcacaaaatctggttagggcttcttttactgaagtattcagcaataatcagatgaagccaacaaaattaactggtttataaaattatttagaagatatcatcttcttctgaacaagagatcctgcaattagaggggagagtgcgtgttgcaacctcatttttggaa

SEQ ID NO: 2660 - DNA, 1687 bp, Amsonia hubrichtii
caatcccaattcccattcccatcctcctctatatattaatattctcacgcagtcacacactgaacattacggaaaacactcaaataccgagcgagctctatctctctctctctctcgcgcgcgcgctttctctgctccggcttgaaacttcgtattcttccttcatatggcgcttaggacgaggatttcgtgtcgaatcatcaggtccggagctgtgtttggaacgcgatccatgtcgtcggggtggcgaaacgtggagccagctccgaaggatccgattcttggagttaccgaagcgtttctggcggatcccagtcccaacaaagtcaatgtcggagttggagcttatcgagacgacaatgggaagccggtggttttggagtgtgtcagagaagcagaggggagaatctccggaaacctgaacatggaatatcttcctatgggaggaagcataagaatggttgaggaaacactgaagttggcttatggggagaattctgacttgattaaagataagcggattgcagcagtgcaagccctctctgggactggtgcatgccgactttttgcagatttccaaaaacgtttttgtcctgattcacaaatttatattccagtccctacctgggccaatcatcataatatctggagagatgctcatgtccctcagaacacatttcattattatcatcccgtgactaaaggcttggactttgcttcaatgatggatgatataaagaatgcaccaaatgggtcatttttcctgcttcatgcttgcgctcataatcctactggagttgatccatcagaagaacaatggaaagaaatctcacaacagtttaaggcgaaagggcattttgccttctttgacatggcatatcaaggctttgccagtggtgatccaggaagggatgctaagtctatcaggattttccttgaggatggtcatctaattggatgtgcccaatcttatgcaaaaaatatgggactttatggccagagagtaggctgcctgagtgtggtttgtgaagatgagaagcaagctgcagctgttaagagccagttgcagcaacttgcccgacccatgtatagtaatccacctgttcatggtgctcttattgtttctatcattctcagtgacccagacttgaaaaaagtgtggcttaacgaagtgaagggaatggctgatcgcatcattggaatgagaactgctctacgggaaaacctcgagaagttgggatcacctttatcttgggagcacataacaaatcagattggaatgttctgctttagcagcttgactcctgaacaagtcgatcgtttgacaaatgaatatcatatttacatgactcgcaatggtcgtatcagcatggcaggagttacaacagggaatgttggttatttggcaaatgcaattcatgaagtcacaaaatctggttaggacttcttttactgaagtattcatcaataatcaactgagaggccgagaaatttagaggtccataaaattattttgaagattttctgttcctgaacaagatattctccagttagaggggagggggatgtatgttgcatcctcattttttaggaaaaactaaaagaagatattaggtgaggacttgaaagtccattatttggtttgaataagtgctcgtgacttcaattataggtaactgattcaatg

SEQ ID NO: 2661 - DNA, 1548 bp, Castanea mollissima
atttctcagcctagctagctctctctttcttcaaaacacttgtgcaccgtacacctttctttctctatttcagacacaaagtgcgaaaaacgatggcgtttcgggcggtgatgtcgaggcggggcacgaatcggagctccgatattggagcgaggtggatgtcaacgtggtgggggaacgtggagcctgcagcgaaggatccgattctcggcgttacggaggctttcttggctgatcccagtcccagtaaagtcaatgtcggagttggcgcttaccgcgatgataatggaaaacccgttgttctcgaatgcgttagagaagcagagaggaggattgctggacactcaaacatggagtatcttcctatgggaggaagtgtcaagatggtggaagaaacactaaaactggcctatggggagaattctgagtttatcaaagataaaagaatagcagcagtacaatctctatctggtactggtgcatgccgactttttgctgactttcaaaagcgttttcgtcccgattcccaaatttacatacctgtccctacctgggccaaccaccataacatctggagggatgcacaagtacctcaaaggaccttccattactatctcccagagactcgagggttagattttgcatcactgatggatgacattaagaatgctccaaatggctcatttttcctccttcatgcttgtgctcacaatcctactggagtggatcctacagaggaacaatggagagagatgtcataccaattcaaggcaaagggtcattttgctttctttgacatggcatatcaaggttttgctagtggtgatccagagagagatgcaaagtctatcaggatttttcttgaggatggacatctaattggaattgctcaatcatatgcaaaaaatatgggactgtatggccagagagtgggatgccttagtgtgctttgtgaagatgaaaaacaagctgtggctgtcaaaagtcaattgcagcagcttgccagacctatgtatagtaacccacctcttcatggtgcactcatagtttcaactattcttggtgatccggagttgaagaatttatggcttaaagaagttaaggtcatggcagatcgcatcatcggaatgcgaacagctctacgagaaaatcttgaaaagttggggtcacccttatcatgggagcacataactaatcagattggtatgttttgttatagcgggttgacccctgaacaagttgatcgtttgacgagcgaatttcatatttaccttactagaaatggtcgtatcagtatggcgggtatcactacaggtaatgttggatacttggctaatgccatcaacgaggtctcgaaatctgcttagtggcttgttacagaagtcaaattcttaaagggtgccttagatataaagtccaagacatcacaaatttcattgggatttttgtaatcttccttcccatccataaatgaattggaaaggatgtaataaaagagacatcattatatgctcatcctaattttttccaccaataatggttaagggg

SEQ ID NO: 2662 - DNA, 1750 bp, Echinacea purpurea
atctggattccgttggctatttcatcaccatcaccattaattccatctcatcctcatcctcacccaccggaattcaactccggtgaccacaacacctaccacaaatcaatcgtcttcatcaatctccgatcaatggctatacgagcagtcataaccagacggatcataagctcgatcccagtccaacatggctcgcgatccatatcttcctggtggaaaaacgttgaacctgcacccaaagatccgattcttggtgttaccgaagcctttttagcagatcctagtcctgataaagttaatgttggcgttggagcttatcgtgatgataacgggaagcctgttgttttggattgtgttagagaagcagaaagacgagttgcaggaaacctcaacatggagtatcttccaatgggtggaagcaacaaaatggttgaggaaacattgaagttggcatatggtgaagattccgacttgattaaagataaacgaattgcagcaatacaagctctttctggcaccggtgcttgcagaatttttgctgatttccagaagcggttttcgcctgattctcagatttacattccagtccctacctggtccaaccaccataacatttggagagatgctaatgtaccacaaagaacattccattattatcacccagaatcaaaaggtcttgattttgcctcactgatggatgatgttaagaatgcaccaaacgggtcattctttttgctgcatgcttgtgcgcataatcctacaggagtcgatcctacgattgaacaatggaaagaaatatcttaccagtttaaggtcaaaggtcattttgctttctttgacatggcgtatcaaggctttgcaagcggtgatccagaaagagatgcgaaatccattaggatttttcttgaagatggtcatttaattggatgttcacaatcatatgctaaaaatatgggtctttatggccaaagagttggctgccttagtttggtatgtgaagatgaaaaacaagctgtggctgtgaaaagtcaacttcagcaacttgcaagacctatgtacagtaatccacctgttcacggtgcgcttattgtgtcgatcatccttagtgatccagaattaaagcaattgtggcttaaggaagtcaagggtatggctgaccgtataatcggagtgagaacttctcttagggaaaacattgaaaagttgggctctcccctgtcatgggaacacataactaaccagattggcatgttctgctatagcgggatgactcctgaacaagttgatcgtttgacaaaagaatttcatatttacatgacccgcaatggccgcattagtatggcaggggtcacaagtggcaatgttgaatacttggcaaaggctatccatgaagttacaaaatcttcttaaattcatatacttcctgagtttttggttaaaactagttttcgggtatttttcccgagaataatttagagaaaataaaaaggtgaaaaatacttcacctggttatgagttttaattgtttgtagctgatagtgattattgtcttgttaattgttatgaaacatgaccttgacaagtcaaactcttgataagggcataaattgctcgataccagtagccgttaaaggctgcattgtttgaataacacatttgtttcatcagtacatgttattagtaaaaagatgggtagacctgacgggttagataacgggttagatgtacatttgtttcatcagtacatgct

SEQ ID NO: 2663 - DNA, 1763 bp, Solanum tuberosum
aaaagccgttgataaaccattcgttcgcactgacggctcgctcagtccactactcttacgtctcctatatataaagtccatctctatcaaccacttcgacaaacacgccattttcctctccgatttctctaaatactctctccgctccggccatggcgatccgtgccgcgatttccggtagtcatctcaagcttagctcgtcgtcgctcggagcgcgatccttgtcgtcgtggtggcggaacgttgagccggcacctaaagatcctatcctcggcgttactgaagctttcctcgccgatcctagccctgataaagtcaatgttggcgttggagcttacagggatgacaatggaaaacccgtggtactggagtgtgtcagagaagcagagcgaaggatcgctggcggtttcaacatggaatatcttcctatgggaggtagtgtcaacatgatccaggagtcgctgaagttagcctatggggagaactcagacttgataaaagataaacgcattgctgcaattcaagcattatctggaactggcgcatgccgaatttttgcggacttccaaaagcgcttttgtcctgattcacagatttatattccagttcctacatggtctaatcatcataacatttggagagatgctcatgtccctgagagaacatatcactattatcatgctgaatcaaagggcttggactttgctgcaatgatggatgatataaagaatgccccaaaaggatcattctttctgcttcatgcttgtgctcataatcctactggggtggatccgacagaggaacaatggagggagatctcgcaccagttcaaggtgaagggacattttgctttgtttgatatggcctatcaaggatttgcaagtgggtatccagagaaggatgctaaggcaatcaggatatttcttgaggatggtcatccgatagcgtgtgcccaatcatatgcaaaaaatatggggctatatggccagagagttggttgcctaagtgttgtctgtgaggatgaaaaacaagcagtggcagtgaaaagtcagttgcagcaacttgccaggcccatgtacagtaatccacctgttcatggtgctcttgttgtttctaccatccttggagatccaaacttgaaaaatctatggctcggggaagtgaagggcatggctgatcgtatcatcgggatgagaactgctttaagggaaaatcttgagaagttgggctcacctctatcttgggaacacataaccaaccagattggcatgttctgctacagtgggatgacaccggaacaagtagaccgattgacaaaagagtatcacatctacatgactcgtaatggtcgtatcagtatggcaggagttactactggaaatgttggttacttggcaaacgctattcatgaggttactaaatctgcttaagctttaacatcatggattcaataatcagttacggaaaggctgtggaaattcattttttgtgatcggaaagatcacaacatgttgtaatagttgagttaaaacaatcgtactgaggggaggggggaataaatagaaccattttaagggatagaagtcattagcagccgtcgaggtggagttgtagttattttagggtacattacagacattaatcatctctagtgtcaaggaactgctgtttttcatatacaacagcgtagttacatgatatatatgccaacattttgaagtattgttactgttttatggcgtcatggatggaagtaattattg

SEQ ID NO: 2664 - DNA, 1770 bp, Solanum phureja
aaaagccgttaataaaccattcactcgcactgacggctcgctcagtccactgctcttacgtctcctatatatgaagtccatctctatcaagtatcagccacttcgacaaacacgccattttcctctcccatttctctaaatactctctccgctccggccatggcgatccgtgccgcgatttccggtagtcatctcaagcttagctcgtcgtcgctcggagcgcgatccttgtcgtcgtggtggcggaacgttgagccggcacctaaagatcctatcctcggcgttactgaagctttcctcgccgatcctagccctgataaagtcaatgttggcgttggagcttacagggatgacaatggaaaacccgtggtactggagtgtgtcagagaagcagagcgaaggatcgctggcggtttcaacatggaatatcttcctatgggaggtagtgtcaacatgatccaggagtcgctgaagttagcctatggggagaactcagacttgataaaagataaacgcattgctgcaattcaagcattatctggaactggcgcatgccgaatttttgcggacttccaaaagcgcttttgtcctgattcacagatttatattcctgttcctacatggtctaatcatcataacatttggagagatgctcatgtcccagagagaacatatcactattatcatgctgaatcaaagggcttggactttgctgcaatgatggatgatataaagaatgccccaaaaggatcattctttctgcttcatgcttgtgctcataatcctactggggtggatccgacagaggaacaatggagggagatctcgcaccagttcaaggtgaagggacattttgctttgtttgatatggcctatcaaggatttgcaagtgggtatccagagaaggatgctaaggcaatcaggatatttcttgaggatggtcatccgatagcgtgtgcccaatcatatgcaaaaaatatggggctatatggccagagagttggttgcctaagtgttgtctgtgaggatgaaaaacaagcagtggcagtgaaaagtcagttgcagcaacttgccaggcccatgtacagtaatccacctgttcatggtgctcttgttgtttctaccatccttggagatccaaacttgaaaaatctatggctcggggaagtgaagggcatggctgatcgtatcatcgggatgagaactgctttaagggaaaatcttgagaagttgggctcacctctatcttgggaacacataaccaaccagattggcatgttctgctacagtgggatgacaccggaacaagtagaccgattgacaaaagagtatcacatctacatgactcgtaatggtcgtatcagtatggcaggagttactactggaaatgttggttacttggcaaacgctattcatgaggttactaaatctgcttaagctttaacatcatggattcaataatcagttacggaaaggctgtggaaattcattttttgtgatcggaaagatcacaacatgttgtaatagttgagttaaaacaatcgtactgaggggaggggggaataaatagaaccattttaagggatagaagtcattagcagccgtcgaggtggagttgtagttattttagggtacattacagacattaatcatctctagtgtcaaggaactgctgtttttcatatacaacagcgtagttacatgatatatatgccaacattttgaagtattgttactgttttatggcgtcatggatggaagtaattattg

SEQ ID NO: 2665 - DNA, 1708 bp, Fragaria vesca
gaaatctagaaacaaaacaacttcacgcacttcaatgcaaataaccaacatttatatcatctcaatcccccgtttcctaagtcctctccatttctctagctctctccgcctctctcaaaccaattaagtcaagtccccatggcgctctcctccaagctttttcgacggagctcctcctccaccacagccttggccgcgcgatccatgtcctggtggcggactgtccaaccagctcccaaagaccccatcctcggcgtcaccgaagcctttctcgccgatccctctcctcacaaagtcaatgtcggagtcggtgcctaccgtgacgacaatgggaagccggttgttctggaatgcgttagagaagcagagcgcagaattgccggaaatttgaacatggaatatcttcctatggggggcagtgtgaagatggtggaagaaacattgaagttggcttatggagagacttctgaatgcctcaaagataaaaggatagcagcagtgcaatctctctctgggaccggtgcatgtcgtctttttgcagactttcagaaacgttttcgtccagattctcatatctatattccagtgccaacatggtccaaccaccataacatctggagagatgcccaggtcccagaaaggacttatcattactatcatccagagactaagggattggactttgcaggactgattgatgacataaagaatgctccaagtggctcattctttcttcttcatgcatgtgctcacaatcccactggagttgatccttcagaggaacaatggaaagagatctcataccaaatgaagggtaaaggtcattttcccttctttgacatggcatatcaagggtttgctagtggtgacccagagaatgatgcaaaagccatcaggatttttctcgaggatggtcatctaattggaatttctcaatcttatgcaaaaaatatgggactctatggccagagagttggatgccttagcttgctttgtgaggatgaaaaacaagctgtggctgtaaaaagtcagttgcagcagcttgccagacccatgtatagtaatccacctgttcatggaccccttatagtgtcaactattcttggtgatccagacttgaagaatttgtggctccgagaagttgagggcatggcagatcgcattatcggaatgcgaactgctctacgagaaaatcttgagaaattgggatcacccttatcttgggagcacataacaaatcagattggcatgttttgctatagtggaatgacacctgaacaggttgatcgtttgacaaacgaatttcatatttatatgactcgcaatggtcgaataagtatggcgggtattactacgggcaatgttggatatctggcaaatgctatacatgaagtaacaaaatctgcatagagataaggccaggttacattctcattgggccttaggaattgtaccagatagtgattctgttagcttaatcatgttcttgtttgatacaaggagaaaaaaaaactagaaccatcattcagtgcgctcttattatttttctccatttttgttattcaactggggacctgtcatcttggtcaaaaaccaagtcctgtaatacaagaaccacaaatagtgacattgtccaacatcaaatgttgtgaatttgacgataaattcggattttctagattttgttacctgggagtatttcatccaa

SEQ ID NO: 2666 - DNA, 1717 bp, Amborella trichopoda
gcttgtcaactctgcaaatattaataagggaggactcttttactcgttctttcaacgcttttgtaactgtcaaattcgtttcttgtgcggtgcttgctttttcctcgcttttctgccggaaaaagcagtaaacatggccggaaaaatggtattttcctgcacgatttgcaggaaaagtgcagggaatgacctgagattcatgtcttcgtggtggaaccatgtggagccggcacctaaggaccccattcttggtgttactgaagctttcttggctgatacttctcccaacaaagttaatgttggagtaggagcttaccgtgatgataaagggaaaccggtggtgctggaatgcgttagacaggcggagaggagaatttcaggaaacgaaaagatggaatatcttccaatggggggaagtgtgaagatggttgaggagacattgaagctagcgtatggtgagaattctgatctcatcaaagacaaaaggattgctggagtgcaggctctttcagggactggtgcttgccgcctctttgcagattttcagaaacgtttcaggccagagtcacagatctatatacccactcccacttgggccaaccacctcaacatttggagagatgcccaagttcctcagaggactttccattactaccatcctgaatccaggggattagattttgctgcattaatggatgatgtgaagaatgcaccaaatggttctttctttttgctgcacgcatgtgctcataatccaactggagtggatccatctgaggagcaatggaaggaaatctcttatcaatttaaggcgaaaaaccactttgccttctttgatatggcatatcaaggttttgcaagtggtgatccagagagagatgctcgagcaattcgcattttcctagaagacggccatatgattggctgtgcccaatcctatgcaaaaaacatggggctttatggacagagagttggatgtctcagtattgtctgtgaagatgaaaaacaagcagtggctgtgaagagtcagttgcaacagatcgctaggcccatgtatagcaacccacctgttcatggtgcccttcttgtttctaccattctcagtgatccagacctgaagaaactctggttgaaagaagtgaaggttatggctgacaggatcattggcatgcgaactgcactaagggaaagtcttgaaaagttgggttctcctctatcttgggaacatataaccaatcagattggaatgttttgctacagtgggatgagtcctgagcaagttgaccgcttgacacaggagttccatatttatatgactcgcaacggtcgcatcagtatggcaggtgtgactacgggcaatgtcggctacctagcaaatgcaattcatgaggtcacaaaatctacttaaaaggagtttcttatttttacaacatctttgaactatttccttaaaaaaggatgaaagcaagagttaaaaaaagccatttgaggctttccccatgattcatatggggagtctaccaaataaagaggttttaagttatacaccctttttgcctgtgtttttcaggtctcctttgtgggaggtcagaaattgtatcttgcaataaaagtaacctctttgttttcatttttgtaagggttccttggaaggtgaaatgcatggaatgatatgaggctgtgattttttaatcttagtatctgaccccattgcact

SEQ ID NO: 2667 - DNA, 1439 bp, Cirsium arvense
ggggcgtccatttaagccgcccaactctctctacgaagcgcccaccaccgccaccggaattcaacttcggcgacttcagaacacacatacacacacacacaaagagagagagaacgacagcatcgtgaatccttgatcgatggctctccggacagcaatcactaaacgaatcctgagctcgagctcggctgtacatggttcgcgatccatgtcgtcgtggtggaaaaacgttgagcctgcgccgaaggatcctattcttggcgtcactgaagcttttctcgcggatccgaatcctgataaagttaatgttggagttggagcttatcgtgatgataacgggaagccggtagttcttgattgtgttagagaagcagagagacggattgccggaaacatgaacatggagtatcttcctatgggaggaagcaacaagatggttgaggaaacactgaaattagcctatggggatgattctgatttgatcaaagacaagcgaattgcggcagtacaagctctgtctggcaccggtgcatgccgacttttctcagacttccagaaacgcttttcccctgattctcagatctatattccagtccctacgtggtccaatcaccataacatttggagagatgctaatgtaccacaaaggacattccattattaccatccagaatcaaaaggtcttgattttgcctcactgatggatgatgttaagaatgcaccaaatggatcattttttttgctgcatgcttgtgctcataatcctaccggagttgatcctacagtggaacaatggaaagaaatctcttaccaatttaaggttaaaggtcattttgctttcttcgacatggcctatcaaggctttgcaagtggagatccagagagggatgcaaaatccatcaggattttccttgaagatggtcatttaattggatgctctcaatcttatgccaagaatatgggtctttatggccagagagttggttgccttagtttggtatgtgaagatgaaaaacaagctgtggctgtgaaaagtcaattacagcaacttgcgagacccatgtacagtaatccacctgttcatggtgctcttgttgtttcaactatccttggtgatccagagctaaagcaattgtggctgaaggaagtcaagggtatggctgaccgtatcatcgggatgagaactgctctcaaggaaaacattgaaaagttgggttctcccctatcatgggagcacgtaactaaacagattggtatgttctgctatagcgggatgaccccagaacaagttgatcgtttgacaaatgaattccatatttatatgacccgcaatggccgtatcagtatggcaggggtgacaaccggtaacgttgagtatttggctaaagctatccatgaagttacaaaaagtgcttaatgagacattacagacatacaca

SEQ ID NO: 2668 - DNA, 1637 bp, Echinacea purpurea
tggctatttcatcaccatcaccattaattccatctcatcctcatcctccccctcacccaccggaattcaactccggtgaccacaacacctaccacaaattaatcattctcgtcttcatcaatctccgatcaatggctatacgagcaaccgtaaccagacggatcataagctcgatcccagtccaacatggctcgcgatccatatcctcctggtggaaaaacgttgaacctgcacccaaagatccgattcttggtgttactgaagcttttttagcagatcctagtcctgataaagttaatgttggcgttggagcttatcgtgatgataacgggaagcctgttgttctggattgtgttagagaagcagaaagacgagttgcaggaaacctcgacatggagtatcttccaatgggtggaagcaacaaaatggttgaggaaacattgaagttggcatatggtgaagattccgacttgattaaagataaacgaattgcagcaatacaagctctttctggcaccggtgcttgcagaatttttgctgatttccaaaagcggttttcgcctgattctcagatttacattccagtccctacctggtccaaccaccataacatttggagagatgctaatgtaccacaaagaacattccattattatcacccagaatcaaaaggtcttgattttgcctcactgatggatgatgttaagaatgcaccaaatgggtcattctttttgctgcatgcttgtgcgcataatcctacaggagtcgatcctacgattgaacaatggaaagaaatatcttaccagtttaaggtcaaaggtcattttgctttctttgacatggcgtatcaaggctttgcaagtggtgatccagaaagagatgcgaaatccattaggatttttcttgaagatggtcatttaattggatgttcacaatcatatgctaaaaatatgggtctttatggccaaagagttggctgccttagtttggtatgtgaagatgaaaaacaagctgtggctgtgaaaagtcaacttcagcaacttgcaagacctatgtacagtaatccacctgttcacggtgcgcttattgtgtcgatcatccttagtgatccagaattaaagcaattgtggcttaaggaagtcaagggtatggctgaccgtataatcggaatgagaacttctcttagggaaaacattgaaaagttgggctctcccctatcatgggaacacataactaaccagattggcatgttctgctatagcgggatgactcctgaacaagttgatcgtttgacaaaagaatttcatatttacatgacccgcaatggccgcattagtatggcaggggtcacaagtggcaatgttgaatacttggcaaaggctatccatgaagttacaaaatcttcttaaattcatatacttcctgagtttttggttaaaactagttttcgggtatttttccccgagaataatttagagaaaataaaaaggttaaggaacttcacctggttatgagttttagttgtttgtagcggatagtgattattgtcttgttaatcgttatgaaacatgaccttgacaagtcaaactcttgataagggcataaattgctcgataccggtagccgttaaaggctgc

SEQ ID NO: 2669 - DNA, 1474 bp, Ambrosia trifida
cactacagagtcatcagtcactaacaatcttcaatcaatggctatacgagcagcactcaccaaacggatcataaccaggagcttacacggctcgcgatccatgtcctcgtggtggaaaaacgttgaacctgcacctaaagatcctattcttggtgtcactgaagcttttttagcagatcctagtccagataaagttaatgttggcgttggagcttatcgtgatgataacgggcagcctgttgtacttgattgtgttagagaagctgaaagacgagttgctggtaacctcaacatggagtatctaccaatgggaggaagcaacaacatggttgaggaaacattgaagttggcatatggtgaagattctgacttgattaaagataaacgaattgcagcaatacaagctctttccggcaccggtgcatgcagaattttcgctgatttccaaaaacggttttcccctgattctcagatctatataccagtccctacctggtccaatcaccataacatttggagagatgctaatgtaccacaaagaacattccattattatcatccagaatcaaaaggtcttgatttcgcctcactgatggatgatgttaagaatgcaccaaatgggtcattctttttgctgcatgcttgtgctcataatcctactggagtcgatcctacggttgaacaatggaaagaaatatcttaccagtttaaggtcaaaggtcattttgctttctttgacatggcctatcaaggttttgcaagtggtgatcctgaaagagatgcgaaatccattaggatttttcttgaagatggtcatttaattggatgctcacaatcatatgctaaaaatatgggtctttatggccaaagagttggctgcctcagtgtggtatgcgaagatgaaaaacaagccgtggctgtgaaaagtcagctgcagcaactcgcaagacctatgtatagtaatccacctgttcatggtgcgcttattgtttcgattatccttggtgatccagatttaaagcaattgtggctcaaggaagtcaagggtatggctgatcgcataatcggaatgagaacttctcttagggaaaacattgaaaagttgggatctcccttatcatgggagcacataactaaccaaattggcatgttctgctatagcgggatgactcctgaacaagttgatcgtttaacaaaagaatttcatatttatatgacccgcaatggccgtattagtatggcaggggtcacaagtggcaatgttgaatacttggcgaaagctatccatgaagttacaaaagctgcttaaagctcatacatttttcgaggtttttggttaaaactagttttgtgttgagaattaatttagaagaaaataaagaggttaaagacacttgacctggtgatgagttttaattgtttgtagcggatagttattgtcgtcttgttaattgttatgtaacaagaccttggc

SEQ ID NO: 2670 - DNA, 1783 bp, Aquilegia formosa
aaaaaaaaactctgtttctttctctctcttcagtcctcgtaattccaaaaaaaaaatccagagagattttagagagagaaagtttgaaaatggcagcaagaacaacaatctacaataaaattcttcaaaaaagttgtaattttggaactcgatctatgtcatcatggtggacacatgttgaaccagctcctaaagatccaatcttaggtgttactgaagcttttttagctgatactaatccagaaaaagttaatgttggagttggagcttatagagatgataatggaaaaccagttgttcttgaatgtgttagagaatctgaaagaagaattgctggaaatcaaaacatggagtatcttccaatgggaggaagtgtgaaaatggttgatgagactttgaagttagcctacggagagaactcggatttcataaaagaaaaacgtattgcagcagtgcaagctctttctgggactggtgcttgccgactctttgcagattttcagaagcgttttcggcctgagtcccaaatttatattcctgtgccaacctggtcaaaccatcacaacatttggagagatgccctggtccctcagagaacgttccattactatcatcctgaaacaaaggggctagattttgcgtccttgatggatgatattaagaatgctccaaatggttcgttctttttgcttcacgcatgtgctcataatcctactggcgtggatcctacggaagagcaatggaaggagatatcatatcaaatgaagtcgaaaggccatttccccttctttgatatggcatatcaaggttttgcaagtggtgaccctgagagggatgcaaaatccatcagaattttccttgaggatggccatctgattggatgcgcccaatcttatgccaaaaatatggggctatatggccagagagttgggtgtctaagtgtcctctgtgacgatgaaaaacaagcggttgctgtgaagagtcagttgcaacagattgccagacccatgtacagcaatccacccgttcacggtgcacttattgtttcaaccatccttagcagtccagacttgaaggagctgtggctgaaggaagtcaaggtcatggctgatcgcatcattggaatgcgaactgccctgaaggaaaaccttgaaaaacttggttctcctctatcatgggagcatataactgagcagattggaatgttttgctacagtggcatgacacccgaacaggtggatcgcttaagaagtgaatatcacatttacatgacccgtaatggtcgcatcagtatggctggagttactacaggcaatgttggatacttagcaaatgccatcaatgaagttactaaatctgcataggaggctttgattatagcagaagtttaaggtagagatgtagttagaagaggcgacataaaacaaagagtaactttttaaaaagtttatattcttcgaagaggttgatgaataaatttcaacttgttttattattggtgggggtatatgaatattggagggatggttgaagaataaattccctcgacattttgatcatagaattacttgtgtacttttttcatcatttcatccccttttgtgtggaatgattatatgactcatttttcttcaagctcacatttggattattgtctgtcgtgaagttgaaagtttattaattttgtatttccatattaggaacttggtatggatattttttagattggagaaagaaagcaaagattgattaaattacctgctatctatacttccttccttcc

SEQ ID NO: 2671 - DNA, 2053 bp, Theobroma cacao
ctcacgcatttcaaggtcgttgcaacaaatttctcagccggattcgattcgcttcctcccaacatgtccaccattttactcgtatataaacactagcaaaacttttcaactgcactactagcagttgttttggtatatttatttcgtttcatcggtaaacgtaaaacctcttgctttctcactctgttccaattacgagcgtctttgtttgtggcgatatggctatccgaagagcgatgtcaggggggctcatggggcggacggcggtccttggagagagatccatgtcgtcttggtggcgtagcgtggagcctgctccgaaggatccgattcttggtgttacggaggcttttttggccgatcccaatcccgataaagtcaatgttggagtcggtgcttaccgtgatgataatggaaagccggtcgttttggaatgtgttagggaagccgagcgaaggattgctggatatttgaacatggaatatcttcctatgggaggaagtgtgaagatggtggaagaaacactaaagttggcctatggagagaattctgagttgataaaagacagaaggatagcagcagtccaagctctgtctgggactggcgcatgccgacttttcgcggacttccaaaagcgttttcgtcctgattcccaaatctatataccagtcccaacttgggccaaccaccacaacatctggagagatgctcaggtcccgcagaaaacttaccattattatcaccctgaatctaggggtttagattttgcaacaatgatggatgacatcaagaatgctccaaatggttcattctttctacttcatgcttgtgctcataaccctactggtgtggatcctacagaggagcagtggagagaaatctcacaccagttcaaagtgaaaggtcattttgccttctttgacatggcatatcaaggttttgctagtggtgatccagagaaagatgcaaagtccatcaggatttttcttgaggatggtcactatattggaattgcccaatcgtatgcaaagaatatgggactctatggccagcgggtaggatgccttagtatgctttgcaaagatgaaaaacaagcagtagctgtgaaaagtcaattgcagcagcttgcaagacccacgtacagcaacccacctcttcatggtgcactcatagtttcaaccattcttggtgatccagacttgaagaaactatggctcaaagaagttaaggtcatggcagatcgcataatcggaatgcgaacagctttacgagggaaccttgaaaagctagggtcaccattatcatggcagcacatcactaatcagatagggatgttttgctatagcgggttgacaccggaacaggtggatcgcttgacaaatgaatttcacatctatatgactcgcaatggtagaatcagtatggctggcgttacaacgggcaatgttgaatatttggctaatgcgattcatgaagtcacaaaatccgcatagaattgctgaacaagaaggacgagtgagcgagcatcacgcatgccgtacttggagtattctgcagcatcatttctccattgaactgttcttagaatagaaagagggaaaacatttgatctcaaatctgattgtcaagaaagggcaacgacagtcggtggcgctatttaattagcctttttctagttagaaataaaacggtgcaccaagtatttttgaaagcatagttacaacgctgaataattacaatgtaacgaattggtggcagctaaagttgatgccaaaggatgtatggtgttctaatttttactgatcaaatatctttatgacatggccaagtccattaagataaaataaaagtggaaatttagtgatgaaaaatggatgggatctttcaactttttgttagtacaaactgagtagcaagtaatataacaaaaactaatgtcttctctctgtagagccactacggaaacaaatgcaatcagtaataatgggcattgccacgaggaggcccaaacagctggctggttgccggttaacttccccactttcagcatcac

SEQ ID NO: 2672 - DNA, 1752 bp, Citrus clementina
ggaaatgaaatgaaaagaaggagatagtcacgcaattcgaggtccgttgcaacaacttggaacgccgcccaataaacacctgacttggcagttggcacatcctcaaagccaagtatattaccaaaatctttcttcgcttattcttttaagattagagcgaaagaagaagaaaaatccaattcatttacatggcgatgcggagcttgatatcggagcgggtctcgtgtcggagctctgttttaggagctagatggatgtcgtcgtggtggcggaacgtggagcccgctcctaaggatccgattctcggcgtcactgaagctttcttggcagatcccagtcctgataaagtcaatgttggagtcggagcttatcgagatgataatggaaagccagttgttcttgaatgcgtcagagaagcagagcggagaattgctggaaccgccaacatggagtatcttcctatgggagggagtgtgaaaatggtggaggaaactctgaagctcgcctatggagataattctgagttcatcaaggataaaaggatagcagctgtacaatctctctcagggactggtgcatgccgactttttgcagactttcagaagcgttttcatcctgattctcaaatctacatacctgtcccaacatggtccaaccaccataacatctggagagatgcccatgtcactcaaaggacttttcattactatcaccctgggactaagggtttagattttgcagcactgatggatgacattaagaatgcaccaaatggttcattctttctacttcatgcttgtgctcacaatcccactggagtggatccttcagaggaacaatggaaagagatctcataccaaattaaggcaaaaggtcacttcccattctttgacatggcgtatcagggttttgccagtggtgatccggagagagatgccaaggccatccgaatttttctcaaggatggtcacctacttggattagcccagtcatatgcaaaaaatatgggactctatggccaaagagtaggatgccttagtgtgctatgtgaagatgaaaagcaagcagtggctgttaaaagtcagttgcagcagcttgccaggcccatgtacagcaatcctcctgttcatggtgcactcatagtctcaaccatccttggagatgcagaattgaagaaattatggctcaaggaagttcagggcatggcagatcgcatcattggaatgcgaactgcgcttcgagaaaacctcgaggaattgggatcacccttatcatggaaacacataactaatcagattggtatgttttgctatagtgggttgacacccgaacaggtggatcgtctaaccaatgaatatcacatctacatgacgcgaaatggtcgtatcagcatggccggagtaactacaggcaatgtcggatatcttgcaaacgctgttcatgaggtcacaaaatctacttagtttgtttataaaagttgcatatcaattttgtaggcagccatatatacacaggggcacaatgcaatacaataaatttttgaaatattcttgccattcccttcatgactgggggaaggacaattataacggacataatttatttttgctctttcacaggagctgctttccctctttttaagtttgttttgtttaggagggaggagagagcctttgaattatctcattcttgtataataaacttctggtcgctactatctatgataccggggcaaaatttttgcagttacat

SEQ ID NO: 2673 - DNA, 1910 bp, Panax ginseng
caaaaattaatttcatagcagcagtaccatggtgaatggtgttcgtttgtttttacagcagtctcacgcatttcaatgtcagttgtaacaatttgcaacctcacgcctctttcgcatttggtagtataaatatataaacacacgcatacacgagaaacactctttcgtttctctctcttccataacagtcaagaggcttcttctgtacctcgatttcacaccatacagatggcgctcccaactgcaatttccaaacgattcctcagtcctagctcggcctatggagcgcgatcgatgtcctcatggtggcgaagcgtggagccctccccgaaagacccaattctcggtgtcaccgaagcttttcttgcagatcccagcccggataaagtcaatgtcggagttggagcttaccgtgacgataatggaaagccggttgttctcgagtgtgtcagagaagctgaacggagaatcgccggaaatctgaatatggagtatctcccaatgggaggaagcttgaagatggttgacgaaacactgaagcttgcctatggggagaattctgatttaatcaaagataaacagatagcagcggtgcaagctctctctggaactggtgcatgccgactttttgcagattttcagaagcggttttgccctgattcccaaatctacattccagtccctacctggtccaatcatcataacatatggagagatgcccgcgtcccacaaaggacattccattattatcatccagaaaccaaagggttggattttgcttccctgatggatgacgtaaagaatgcaccaaatggatcattctttctgcttcatgcttgcgcacataatcctacaggggtggatcctacagaggaacaatggaaagagatatcttaccaattcaaggtcaaaggacattttgctttcttcgacatggcatatcaaggttttgctagtggtgatccagagaaggatgcaaagtctatcaggatttttcttgaggatggccatctaattggatgctcccaatcttacgcaaaaaatatgggactttatggccaaagagtcggctgcctcagtgtggtttgcgaagatgaaaaacaagccgtggcagtgaaaagtcagttgcagcagcttgccagaccaatgtacagtaatccaccggttcatggtgctctaattatttcaactatccttggtgatccagacttgaagaaattgtggctcaaggaagttaaggacatggctgaccgcatcattgggatgcgaactactcttcgagaaaatcttgaaaaattggactccccactttcatgggaacatataactaatcagattggcatgttttgctatagtgggatgacacctgaacaagttgatcgcttgacaaatgaatttcatatttacatgactcgtaacggtcggattagtatggcagggattactacaggcaatgttggatacttggcgaatgctatccatgaggtcacaaaatctaactagtttcttgttgcagaaacatcaactatagagaagaataatgtaacaggcgggcggccattgaaatttactgaggttatatggcgagatttttaccttttttttcttctgttctctcttcaactgagaatgatcaatgctaataaacccatcatattttctttctttcctaatttcaaagaaaatagaaataacatattgtcgtggggaactccaagatttgaattttggaaaatatactgtgattgtttaagaatggaacttgattcctttggctttgacaactagccttcagcttggctatatgtaattggtaccaagttggagatgtaatgggttcaagttgttgcatgagacgattgaggattgtgattaatatttgatgaatgatggtttacattcattttcaa

SEQ ID NO: 2674 - DNA, 2112 bp, Mimulus guttatus
aaaaagaagtattaaagtaagatttccgcattccgccgagttgctccttcacattttgttccccagaccaacacacacacacacacacacacacacacaaaaacacctttgcttttatttttctctatcaattaatggcgcaccttattcgggtcggttgttcgggtcgactatctaagtactcctccgtggtcggagcaacgagatccatgtccacggcgtggtggcgacacgtggagcctgctcccaaggatccgatcctcggcgtcagcgaagctttcctcgccgatcctagtccccacaaagtcaatgtcggcgttggtgcgtatcgtgatgataatggaaaaccggtggtgctgaattgcgtcagagaagccgagagaagaatcggcggcaatttgaacatggaatatcttcccatgggaggaagtgtgaaaatggtcgaggagaccttaaagctggcttatggtgataattctgatttgattaaagataagagaattgcagcagtgcaagctctatcgggaaccggtgcatgcaggctctttgcagacttccaaaagcgtttttcccccgattctcatgtctacattccagttcccacctggtccaaccatcacaacatctggagagatgccaatgtcccccagagaacattccactactatcatccagaaacgaagggtttggactttgcttcgatgatggatgacataaagaatgcaccaaatggatctttctttctgcttcatgcttgtgctcataatccaactggagtggatcctacggaagaacagtggaaggagatctcataccagttcaaggtaaaagggcattttgcattctttgacatggcatatcaaggttttgctagtggtgatccagaaagggatgccaaatcgattcgcatttttcttgaggacggacatcagataggatgttctcagtcgtatgcaaagaatatgggactttatggccagagagttggttgcctcagtgtggtttgcgaggatgagaaacaggctgtggcagtgaaaagtcagttacagcagcttgcaagaccaatgtacagtaatccacctgttcatggtgccctcatagtatccaccattcttggtgatcctgagttgaaaaacttgtggctcaaggaagtaaaaggaatggctgatcgcatcattggaatgagaaccgctctacgagaaaatcttgaaaacttgggttcgcctctttcatgggagcacgtaacaaagcagattggcatgttttgctatagtggaatgacacctgaacaagtagatcgactgactaatgaatttcacatttacatgactcgcaacggacgcattagtatggctggagtgactacaggcaatgtcggttacttggcaaaagctatacatgaagtcaccaaatcatcttagaaactcgttgcttgtgtagggaggcccaaaaaagaatacagaatacaccattcttggaggctttatatattcctagagacgtacttcggttgaattttgaatcccaataaaaaaaaataacatattcatgaagaacaatatataataagtccttggttgttgaccgagtatcgaagaggtattagaccttcaataaggtgacgacgaatcgtgactctcttgatttagtgcacaattattaagattggcttctgcttttgcagttgaagagtttgttggactactagatgcttaagaaattgggagtggtgaagttgcattgatattgtcacagaacactccatttattacaattgtaacagaaagttgcatttgaaaatatggtcaagaaatattaccatcatgtccttgatattgtttgattggccacttttccttgtgatggctaatgagtctatttcatcatcatggttttcctgggaaatgttagcaaacataatcaactccatattatttcataataacgacccctctcgcatattaattagtgcaggagtgagttttcttgataattaaaatgtgtttttagattatattgccaataaagtcgtcctacgtcatattctttgaaattgttatctcctcctaaatattatctatgatatcatgaactttaaatggtatcaaagtc

SEQ ID NO: 2675 - DNA, 1427 bp, Ambrosia trifida
cctggattccgttggccatttcttcaccatcattaaattccattcccattccaccctcaaccttcctcaccggaatccaactccggcgatccaaacacaccctacatagtcatcagtcaccaacaatcttcaatcaatggctatacgatcagcactcaccaaacgaatcataaccacgaccttacacggatcgcgatccatgtcctcgtggtggaaaacgtcgaacctgcacccaaagaccctattcttggtgtcactgaagcttttttagcagatcctagtccagataaagttaatgttggcgttggagcttatcgtgatgataacgggcagcctgttgtacttgattgtgttagggaagctgaaagacgagttgctggtaacctcaacatggagtatcttccaatgggaggaagcaacaatatggttgaggagacattgaagttggcatatggtgaagactctgacttgattaaagataaaagaattgcagcaatacaagctctttctggcaccggtgcatgcagaattttcgctgatttccaaaacggttctcccctgattctcagatctatattccagtccctacctggtccaaccaccataacatttggagagatgctaatgtaccacagagaacattccattattatcatccagaatcaaaaggtcttgattttgcctcactgatggatgatgttaagaatgcaccaaatgggtcattctttttgctgcatgcttgtgctcataatcctactggagtcgatcctacagttgaacaatggaaagaaatatcttaccagtttaaggtcaaaggtcattttgctttctttgacatggcctatcaaggctttgcaagtggtgatcctgaaagagatgcgaaatccattaggatttttcttgaagatggtcatttaattggatgctcacaatcatatgctaaaaatatgggtctttatggccaaagagttggctgcctcagtttggtatgcgaagatgaaaaacaagctgtggctgtgaaaagtcagctgcagcaacttgcaagacctatgtacagtaatccacctgttcatggtgcgcttattgtttcgattatccttggtgatccagaattaaagcaattgtggctcaaggaagtcaagggtatggctgaccgtataatcggaatgagaacttctcttagggaaaacattgaaaagttgggttctcccctatcatgggaacacataaccaaccaaattggcatgttctgctatagcgggatgactcctgaacaagttgatcgtttgacaaaagaatttcatatttatatgacccgcaatggccgtattagtatggcaggggtaacaagtggcaatgttgaatacttggcaaaagctatacatgaagttaacaaaagctgcttaaagttcatatatttcttgagg

SEQ ID NO: 2676 - DNA, 1655 bp, Flaveria ramosissima
agtaataagctatctgtattccgttggctatatcaccatcaatatcatctcaccctcaacgaaccaccaccacaaccacctatccccaccggaatccacctccggcggccgccggacgtcgtacggaagctccgacaacactcatcaatccatcaactcatggcgctacgagcagcaatcaccaaacgaatcacgagctcgagctcgatcttacacggctcgcgattcatgtcgtcgtggtggagaaacgttgagcctgcacccaaagaccctatccttggtgttactgaagcttatctagcggatcctagccctgataaagttaatgttggagttggagcttatcgtgatgataacgggaagcctgttgtgcttgagtgtgttagagaagcagaaaggcgtattgcaggaaacctgaacatggagtatcttccaatgggaggaagcaacaaaatggttgaggaaacattgaagttggcatatggtgaagattctgacttgattaaggataaacgaattgcagcaatacaagctctttctggcactggtgcatgcagaatttttgctgatttccagaaacggttttcccctgattctcagatctatattccagtccctacctggtccaaccaccataacatttggagagatgctaatgtgcctcaaagaacattccactattatcatccagaatcaaaaggtcttgatttcgcctcactaatggatgatgttaagaatgcaccaaatgggtctttctttttgctgcatgcttgtgctcataatcccactggagttgatcctacagttgaacaatggaaagaaatatcttaccagtttaaggtcaaaggccattttgctttctttgacatggcctatcaaggctttgcaagtggtgacccagaaagagatgccaaatccattaggattttccttgaagatggtcatttaattggatgttcacaatcatatgcgaaaaatatgggtctttatggccaaagagttggctgccttagtttggtatgtgaagatgaaaaacaagctgtggctgtgaaaagtcaactgcagcaactagcaagacctatgtacagtaatccacctgttcatggtgcacttattgtttcaactatccttggtgatccagatttaaaacaattgtggctcaaggaagtgaagggtatggctgatcgtatcatcggaatgagaacttctcttagggaaaacattgaaaaattgggatctcccctatcatgggaacacataactaatcaaattggcatgttctgctatagcgggatgactcctgaacaagttgatcgtttgacgaaagaatttcatatttatatgactcgcaatggtcgtatcagtatggcaggggtcacaagtggtaatgttgaatacttggcaaaagcgatccatgaagttacaaaagctgcttaaagctgatattattttgaggtttttggttgaaactagttttcgggtatatctccctgagaataatttagaaaataaaaaggtaaaggtacttcacctggttgagttttgattgtttagcgaatagcaattgttgtaattgttatggaagaagactttgataaattaaattcttgtaaggacatcaaaagctcggttctggtagcctgttaaagctaccg

SEQ ID NO: 2677 - DNA, 1622 bp, Flaveria ramosissima
caccaccacaaccacctacgccccaccggaatccacctccggcggccgccggacgtcgtacggaagctccgacaacactcatcaatccatcaactcatggcgctacgagcagcaatcaccaaacgaatcacgagctcgagctcgatcttacacggctcgcgattcatgtcgtcgtggtggagaaacgttgagcctgcacccaaagaccctatccttggtgttactgaagcttatctagcggatcctagccctgataaagttaatgttggagttggagcttatcgtgatgataacgggaagcctgttgtgcttgagtgtgttagagaagcagaaaggcgtattgcaggaaacctgaacatggagtatcttccaatgggaggaagcaacaaaatggttgaggaaacattgaagttggcatatggtgaagattctgacttgattaaggataaacgaattgcagcaatacaagctctttctggcactggtgcatgcagaatttttgctgatttccagaaacggttttcccctgattctcagatctatattccagtccctacctggtccaaccaccataacatttggagagatgctaatgtgccgcaaagaacattccactattatcatccagaatcaaaaggtcttgatttcgcctcactgatggatgatgttaagaatgcaccaaatgggtctttctttttgctgcatgcttgtgctcataatcctactggagttgatcctacagttgaacaatggaaagaaatatcttaccagtttaaggtcaaaggccattttgctttctttgacatggcctatcaaggctttgcaagtggtgatccagaaagagatgcaaaatccattaggattttccttgaagatggtcatttaattggatgttcacaatcatatgcgaaaaatatgggtctttatggccaaagagttggctgcctcagtttggtatgtgaagatgaaaaacaagctgtggctgtgaaaagtcaactgcagcaacttgcaagacctatgtacagtaatccacctgttcatggtgcacttattgtttcaactatccttggtgatccaggtttaaaacaattgtggctcaaggaagtgaagggtatggctgatcgtataatcggaatgagaacttctcttagggaaaacattgaaaaattgggatctcccctatcatgggaacacattactaatcaaattggcatgttctgctatagcgggatgactcctgaacaggttgatcgtttgacgaaagaatttcatatttatatgacccgcaatggtcgtattagtatggcaggggtcacaagtggcaatgttgaatacttggcaaaagcgatccatgaagttacaaaagctgcttaaagctcgtattatcttgaggtttttggttgaaactagttttcgggtatatttccctgagaataatttagaaaataaaaaggtaaaggtacttcacctggttatgagttttgattgtttgtagcgaatagcaattgttgtaattgttatggaagaagactttaataaattaaattcttgtaaggacatcaaaagctcggttctggtagcccgttaaagctaccaccttatcgtttgaataatacacattt

SEQ ID NO: 2678 - DNA, 1561 bp, Flaveria ramosissima
taccctcaccggaatccacctccggctgccgccggacgtcgtacagaagctccgacaacactcatcaaccttcaacccatggcgttacgggcagcaatcaccacacgaatcacgagctcgagctcgatcttaaatggctcgcgatttatgtcttcgtggtggagaaacgttgagcctgcaccaaaagaccctattcttggtgttactgaagcttttctagcggatcctagtcctgataaagttaatgttggagttggagcttatcgtgatgataacgggaagcctgttgtgcttgagtgtgttagagaagcagagaggcgaattgcaggaaacctgaacatggagtatcttccaatgggaggaagcaacaaaatggttgaggaaacattgaagttggcatacggtgaagattctgacttaattaaagataaacgtattgcagcaatacaagcactttctggcactggtgcatgcagaatttttgctgatttccagaaacggttttcccctgattctcagatctatattccagtccctacctggtccaaccaccataacatttggagagacgctaatgtgccacaaagaacattccactattatcatccagaatcaaaaggtcttgatttcgcctcactgatggatgatgttaagaatgcaccaaatgggtcattctttttgctgcatgcttgtgcccataatcctactggagtcgatcctacagttgaacaatggaaagaaatatcttaccagtttaaggtcaaaggccattttgctttctttgacatggcctatcaaggctttgctagtggtgatccagaaagagatgcaaaatccattagaattttccttgaagatggtcatttaattgggtgttcacaatcatatgctaaaaatatgggtctttatggccaaagagttggctgcctcagtttggtatgtgaagatgaaaaacaagctgtggctgtgaaaagtcaactgcaacaacttgcgagacctatgtacagtaatccacctgttcatggtgcacttattgtttcaactatccttggtgatccagatttaaagcaattgtggctcaaggaagtgaagggtatggccgaccgtataatcggaatgagaacttctcttagggaaaacattgaaaagttgggctctcccctatcatgggaacacataactaatcaaattggcatgttctgctatagcgggatgactcctgaacaagttgatcgtttgacgaaagaatttcatatttatatgacccgcaatggccgtatcagtatggcaggggtcacaagtggcaatgttgaatacttggcaaaagcaatccatgaagttacaaaagctgcttaaagctcatatattattttgaggtttttggttgaaactagttttcgggtatatctccctgggaataatttagagaaaataaaaggtttaaggcacttcacctggttacgagttttaattgtttgtagcagatagcaattgttgtaattgttatggaagaagactttgacaaattaaattcttgtaaggacataaagtgctcggttct

SEQ ID NO: 2679 - DNA, 1483 bp, Lolium multiflorum
ttcctcgccgacccttcgccggagaaagtgaacgtcggcgtcggcgcgtaccgggacgacaacgggaagcccgtcgtgctggagtgcgtgcgcgaggcggagcggcgcatcgccgggagcaccaacatggagtaccttccgatgggaggaagcgtgaagatgatcgatgaatcactcaagttggcttatggggaggattccgagttcatcaaggacaagaggattgcagccgtgcagactctttcagggactggtgcatgtcgcctctttgcagattttcagaaacggttcttgccagattcacagatatacatacctacccctacatgggcaaatcatcacaatatttggagggacgcccaggtaccgcaaagaacatttggctactactatccagacacaaaaggattggattttgcaggcctcatgaatgatatcaagaatgctccagatggttccttctttttgcttcatgcatgtgctcacaatcccactggggtggatccttctgaggagcaatggagagagatatctcatcaattcaagttgaagaaccatttcccattctttgacatggcataccaaggatttgccagtggtgaccctgagagagatgccaaggcaattcggatctttcttgaagatgggcatcaaattggatgcgctcagtcgtatgcaaagaacatgggactttatggacagagagcgggatgccttagtattctctgtgacgatgagatgcaagcagttgccgtgaagagccaactgcaacagattgccagacctatgtacagtaacccacctgtccatggtgcattggttgtatctattatccttaatgatccagaattgaaaagcctatggttgagagaggtcaagggtatggctgatcgtatcattggaatgcggaaggcacttcgggagaatctcgaaaacttaggttcacctttatcatgggagcatgttaccaatcagattggaatgttctgctacagtgggatgacacctgaacaagttgatcgcttgacaaatgaataccatatttacatgacacgcaacgggagaataagcatggctggtgtaacaacaggaaatgttgcctacttggctaatgccattcatgatgtgactaaataaaactgaggcttcttactctcacctccttcagccaatgaaacaagagcggtttttatttcttttgacggctattcactatataccatgatactagagaaataagttatagcaaacctgttgcagctatctaaatgaagaattgtacctggatgtctttgagagagctgtagtctggatcctgtttttgactgttcctttagtggtaaatgtaacgagccagttgaaactggctctacctttattttaacgagaactccaggaatttgaacttcaaaaattgagcattcggatgtatctcaaaaaaaaaaaaaacaaaaaaaagtacctcggcccgggcggccgctcg

SEQ ID NO: 2680 - DNA, 1874 bp, Populus trichocarpa
acgactccgttctcacgcagttcaaggtaagcgtaaccatttaggcaacttgtctttctacctgcactcctttcatttcaccatttaaatttgccaaccacttgataaccagcagcagcagcagcacgatcgaagagatccaaagatcgagagaaaatggcagggtttggaaaagcgatggcttgtcgccagcatgtgcgaattagattaggaacgagattcatgtcttcttcttcgtcgtcatggtggcaaagcgttgagcctgctcccaaggatcctattcttggtgtaacggaagcttttctcgccgatcccagtcctgacaaagtcaatgttggagttggtgcgtatcgagatgacaatggaaaaccagttgttctccaatgcgtcagagaagctgagaggaggatcgccggcaacttgaacatggagtatcttccaatgggaggtagtgtgaacatggtggaagaaacactgaagttggcatatggagagaattctgagttcattaaagacaaaaggatagcagcagtgcaatctctatctggtaccggtgcatgtagacttttcgcagactttcagaagcgctttcgtcctgattcccagatctacataccggtcccgacatgggccaaccatcataacatttggagagatgctcaggtccctcaaaggacctatcattactatcatccagaatctaagggtttagatttttctgccctgatggatgacattaagaatgctcccaatggctcattctttctacttcatgcctgtgctcataatcctacaggagttgatccatcagaagaacaatggagagagatctcacaccaattcaaggttaaaggtcattttgccttctttgatatggcttatcaaggttttgctagtggtgatccagacagagatgcaaagtccatcaggatttttctccaggacggtcatcatattggtatttcccaatcatatgcaaaaaatatgggactctatggccagagagtaggatgcctcagtgtgctttgtgaagatgagaaacaagcggtggctgtaaagagtcaattgcagcagcttgctagacccatgtacagcaatcctcctgttcatggtgcacttgttgtgtcaactatccttggggatcctgagttgaagaagttgtggctcaaggaagtgaaggtaatggctgatcgcatcattggaatgcgatctgcgctaagagaaaaccttgagaaattgggttcacctttgtcatggaagcacatcactgatcagattggcatgttttgctatagtgggatgacacctgaacaagttgaccgattgacaaaagaatttcatatctatatgacccgcaatggtcggataagcatggcgggcattactactggcaatgttggatatctggcaaatgctatcaacgaggtcacgagctctgcctaggctcatcctgaagcaaaacctcaaatcatcattgaagaggtcatacttacatggtcagaagagcaaataaattcctagtttttctccctcgtgctattttgtgaccagggagaggacaataaaacggtcactccaagggtggcttaatattcttactgcgatgaggttctcacaacaactgttgaggagactaatggtggacaacatcaggtctgtaacgaagcaacattgaattgcatatgatctgttacattgatttatgaaaatttacatatttacaagtttagttttaccgaaccgaataccttggtggtggttaaactttagaaaccgagagtacagggttgaggtgaaaatggttttaataataacaatcttaatgatcaggacatcttaaattcatctgagatagctgcgtagtttcttttttg

SEQ ID NO: 2681 - DNA, 1694 bp, Papaver somniferum
ttttctagtactagtattaactttcttagtacaggttgttgaacttgtaagagaaagagagagatctaaaaagagagatggcgtcaagaacaatgatttctagaggaatagttgttcatcagacaagaagcttaggtgctagattcatgtcatcatggtggaaccatgttgaaccagctcctaaagatcctattcttggtgttactgaagcttttctgactgatcctagtccacataaagtcaatgttggagttggagcttacagggatgataatggaaagccagttgttcttgaatgtgttagggaagcagagaggattattgctggaaataagaacatggaatatcttccaatgggaggaagtatgcacatggttgaggagacattgaagctagcatatggagagaattctgatttaattaaagacaaaaaaattgctgcaattcaagctctttcaggaacaggtgcttgccgagtgtttgctgattttcagaagcgttttaagccagattctcacatttatatacctgtgccaacatggtccaaccatcataacatatggagagatgcccaggtcccacaacaaacattccgttactaccatcctgagacgaaagggttggactttgcatccctgatggaagacctaaagaatgcgccaagtgggtcattctttttgctgcatgcatgcgctcataatccaactggagtggatcctacagaggagcaatggaaggagatttcgcagcagatgaaggttaaaggtcatttccccttctttgatatggcgtatcaagggtttgcaagtggtgatcctgagagggacgcaaaagccatcaggatttttcttgaggatggccacttgattggatgtgctcagtcatacgctaagaacatgggactctacggtcaaagagttgggtgtctcagtttggtttgtgacgacgataaacaagcaattgccgtgaagagtcagttgcaacagattgccagacccatgtacagcaacccacctgttcatggtgctcttgttgtttcaactatcctcagtgatccaaatttgaagaacttgtggctcaaggaagtgaagggtatggctgaccgcattattggcatgcgaactgcactcagggaaaaccttgaaaatttaggctcacctctatcctgggagcatataactaatcagattggcatgttttgctacagcggcatgaccccccaacaagtagatcgcttgacaagtgaatatcacatatacatgacccgtaacggtcgtattagtatggctggtgttacgacgggcaatgtaggatacttggctaacgccatccatgaggttacaaaatcctcttagagaacgtgccatcaataaccttgaagtgatgaaattttcttgcaaggctatacaaaaatatacctgagttttctataatctaaatgtaacttagttattgtgggttcaaggaataatttgcactcaagtgatctggggcatatttcaagcatccctttttgttcgggatgatttttttcttcttctctctcggtctcaattacgcgttcgattctgagcgtcataggctgatcttgttgtatcatgagaactcaagcttaaatcatactccttataggagttaattttaaactttctttgtcaggtctccttatatttaatcagatatcttcacttctc

SEQ ID NO: 2682 - DNA, 1831 bp, Solanum lycopersicum
agtccactactactcttacgtctcctatttataaagtcccatctctatcaaccgcctctacaaacacgccattttcctctcctatttggccatttctctatatcctctctccgttccggccatggcgatccgtgccgctatttccggtcgtcacctaaaacttagctcgtcgtcgttcggagcgcgatccctgtcgtcgtggtggcgaaatgttgaaccggctcctaaagatcctatactaggcgttactgaagcttttctcgccgatcctagccctgacaaagtcaatgttggcgttggagcttacagggatgacaatggaaaacccgtggtactggagtgtgttagagaagcagagcgaaggatagctggtggtttcaatatggaatatcttcctatgggaggtagtgtcaacatgatccaggagtcgctgaagttagcctatggggagaactcagacttgataaaagataaacgcattgctgcaattcaagcattatcaggaacaggcgcatgcagaatttttgcggacttccaaaagcgcttttgtcctgattcacagatttatattcctgttcctacatggtctaatcatcataacatttggagagatgctcatgtccctgagaaaacatatcactattatcatgctgaatcaaagggcttggactttgctgcaatgatggatgatataaagaatgccccaaaaggatcattctttctgcttcatgcttgtgctcataatcctactggggtggatccgacagaggaacaatggagggagatctcgcaccagttcaaggtgaagggacattttgctttgtttgacatggcatatcaaggatttgcaagtgggtatccagagaaggatgctaaggcaatcaggatatttcttgaggatggtcatccgatagcatgtgcccaatcatatgcaaaaaatatggggctatatggtcagagagttggttgcctaagtgttgtctgtgaggatgaaaaacaagcagtggcagtgaaaagtcagttgcagcaacttgccaggcccatgtacagtaatccacctcttcatggtgctcttgttgtttctaccatccttggagatccaaacttgaaaactctatggctcggggaagtgaagggcatggctgatcgtatcatcgggatgagaactgctttaagggaaaatcttgagaagttgggctcacctctatcttgggaacacataaccaaccagattggcatgttctgctacagtgggatgacaccggaacaagtagaccgattgacaaaagagtatcacatctacatgactcgtaatggtcgtatcagtatggcaggagttactactggaaatgttggttacttggcaaacgctattcatgaggttactaaatctgcttaagcgttaacatcatggattcaataatcagctacataaaggctgtggaaattcattttttgtgatcggaaagatcacaacatgttgtaaacttgtaatagttgagttaaaactatcgtactgaggggaggggtaataaatagagccattttaaggtgtagaagtcattagcaacgttgaggtggagttgtagttattttagggtacagtgcagacattaatcatctctagtgtcaagtagctcctgtttttcatatacaacagcgtagttacatgatatttatgccagcattttgaagtattgttgctgttttacagcgtcacggatgccaaccatactcgttacatatttacatgtattgagctagcacaatatatatttttaactacataggagttaatcaaatattcactctattgagttttactcctcaa

SEQ ID NO: 2683 - DNA, 1756 bp, Prunus mume
taccattttagttttagaaaccaaatagcttccttgttgattggtcttccgaattccaatggcgctttccagaaaactttttcagcaccggagctccgtatccgtcttcggagcccgatccatgtcgtggtggcggagcgtggagccagctccaaaggatccgattctcggcgtcaccgaggccttcctcgccgatcccagtcccgacaaaatcaatgttggagttggtgcttaccgagatgataagggcaagccagttgttctcaaatgcgtcagagaagcagagcggagaattgcgggaaacttgaacatggagtatcttcctatgggaggaagtgtgaacatggttgaagaaacattgaagctggcctatggggagaattctgagctcattaaagataaaaggatagcagccgtgcaagctctctcggggacaggtgcatgccgtctttttgcagactttcaaaagcgtttttgtccagattctcaaatctatataccagtgcctacatgggccaaccatcataacatctggagagatgctcatgtccctcaaaagactttccattactatcacccagagtctaaggggttggactttgcaggactggttgatgacataaagaatgctccgaatggctcgttctttctacttcatgcgtgtgctcacaatcctactggagtggatccttcagaggaacaatggaaagagatctcaaacaagattaaggaaaagggccattttcctttctttgacatggcatatcaaggttttgctagtggtgacccagagagagatgcgaaagccatcaggatttttcttgaggatggccatctacttggaattgcccaatcatatgccaaaaatatgggactttatggccagagagtaggatgtcttagcgtgctttgtgaggatgaaaaacaggcagtggctgtaaaaagccagttgcagatgcttgccagacccatgtatagtaatccacctgttcatggagcgcttatagtttcaacgatccttggtgatccggacttgaagaagttatggctcaaggaagttaagggcatggcagatcgcatcattggaatgcgaactgctctacgagagaaccttgagaaacttgggtcacccttatcatgggagcacataactaatcagattggtatgttttgctatagtggaatgacacctgaacaggttgatcgcttgacaaatgaatttcatatctatatgactcgcaatggtcgaataagtatggcaggtgttacaaccggtaatgttggatatttggcaaatgctatacatgaagtcacaaaatcagcatagagatccagtcataggtcacatactcctcaacaggatatacgaactttagcagatactgattttcttatcttcctcatctccttattgtagagataaggaaggagcaataaaccacaaccaccattgatgcactcttctcagtttcttcctccattttttgattgtaccggagaggagtttttatctgggttacatattaagtcctgtaattcaagaagcacaaaataaagagtgacattttatccatatcatttgtagtctgattcctggattttgccttcaccaataaattaggtctgaagcattttgttgcaacaaaatatcacaaggaataaagatttataagctatttacgtgcttttgtcatcaaattgacaaattaatatatgaatggtggctaatcatttctccaatacaagttaattaatc

SEQ ID NO: 2684 - DNA, 1293 bp, Prunus persica
gcttggtctaccgaattccaatggcgctttccagaaaactttttcagcaccggagctccgtatccttcttcggagcccgatccatgtcgtggtggaggagcgtggagccagctccaaaggatccgattctcggcgtcacagaggccttcctcgccgatccaagtcccgacaaaatcaatgttggagttggtgcgtaccgagatgataagggcaagccagttgttctcgaatgcgtcagagaagcagagcggagaattgcgggaaacttgaacatggagtatcttcctatgggaggaagtgtgaacatggttgaagaaacattgaagctggcctatggggagaattctgagctcattaaagataaaaggatagcagcagtgcaagctctctcggggacaggtgcatgccgtctttttgcagattttcaaaagcgtttttgtccagattctcaaatctatataccagtgcctacatgggccaaccatcataacatctggagagatgctcatgtccctcaaaagactttccattactatcacccacagtctaaggggttggactttgcaggactggttgacgacataaagaatgctccaaatggctcgttctttctacttcatgcgtgtgctcacaatcctactggagtggatccctcagaggaacaatggaaagagatctcaaaaaagattaaggaaaagggccattttcctttctttgacatggcatatcaaggttttgctagtggtgacccggagagagatgcgaaagccatcaggatttttcttgaggatggccatctacttggaattgcccaatcatatgccaaaaatatgggactttatggccagagagtaggatgtcttagcgtgctttgtgaggatgaaaaacaggcagtggctgtaaaaagccagttgcagatgcttgccagacccatgtatagtaatccacctgttcatggagcgcttatagtttcaacgatccttggtgatccaggcttgaagaagttatggctcaaggaagttaagggcatggcagatcgcatcattggaatgcgaactgctctacgagagaaccttgagaaacttgggtcccccttatcatgggagcacataactaatcagattggtatgttttgctatagtggaatgacacctgaacaggttgatcgcttgacaaatgaatttcatatctatatgactcgcaatggtcgaataagtatggcgggtgttacaaccggtaatgttggatatttggcaaatgctatacatgaagtcacaaaatcagcatagagat

SEQ ID NO: 2685 - DNA, 1795 bp, Flaveria ramosissima
gtggggaagctatctgtattccgttggctatatcaccatcatcatcatcaatatcatctcaccctcaacgaatcaccaccacaaccacctatccccaccggaatccacctccggcggcagccggacgtcgtacggaagctccgacaacactcatcaatcatcaactcatggcgttacgaacagcaatcaccaaacgaatcacgagctcgagctcgatcttacacggctcgcgattcatgtcgtcgtggtggagaaacgttgagcctgcacccaaagaccctattcttggtgttactgaagcttatctagcggatcctagccctgataaagttaatgttggagttggagcttatcgtgatgataacgggaagcctgttgtgcttgattgtgttagagaagcagaaaggcgaattgcaggaaatctgaacatggagtatcttccaatgggaggaagcaacaaaatggttgaggaaacattgaagttggcatatggtgaagattctgacttgattaaggataaacgaattgcagcaatacaagctctttctggcactggtgcatgcagaatttttgctgatttccagaaacggttttcccctgattctcagatctatattccagtccctacctggtccaaccaccataacatttggagagatgctaatgtgccccaaagaacattccactattatcatccagaatcaaaaggtcttgatttcgcctcactaatggatgatgttaagaatgcaccaaatgggtctttctttttgctgcatgcttgtgctcataatcctactggagttgatcctacagctgaacaatggaaagaaatatcttaccagtttaaggtcaaaggccattttgctttctttgacatggcctatcaaggctttgcaagtggtgacccagaaagagatgccaaatccattaggattttccttgaagatggtcatttaattggatgttcacaatcatatgcgaaaaatatgggtctttatggccaaagagttggctgcctcagtttggtatgtgaagatgaaaaacaagctgtggctgtgaaaagtcaactgcagcaactagcaagacctatgtacagtaatccacctgttcatggtgcacttattgtttcaactatccttggtgatccagatttaaaacaattgtggctcaaggaagtgaagggtatggctgatcgtatcatcggaatgagaacttctcttagggaaaacattgaaaaattgggatctcccctatcatgggaacacataactaatcaaattggcatgttctgctatagcgggatgactcctgaacaagttgatcgtttgacgaaagaatttcatatttacatgacccgcaatggtcgtatcagtatggcaggggtcacaagtggcaatgttgaatacttggcaaaagcgatccatgaagttacaaaagctgcttaaagctcgtattatcttgaggtttttggttgaaactagttttcgggtatatttccctgagaataatttagaaaataaaaaggtaaaggtacttcacctggttatgagttttgattgtttgtagcgaatagcaattgttgtaattgttatggaagaagactttgataaattaaattcttgtaaggacatcaaaagctcggttctggtagcccgttaaagctaccgccttatcgtttgaatatacacatttgttttctagggaacaaaaaaaaaaaaaaaaaaaagtaataactcgtacgttcgtagtactaacctagtagacgtacgtcacgtacgacacaggaggagtagga

SEQ ID NO: 2686 - DNA, 1432 bp, Panax ginseng
caagaggcttcttctctacctcgatttcacaccatacagatggcgctcccaactgcaatttccaaacgattcctcagtccgagctcggcctacggagcgcgatcgatgtcctcatggtggcgaagcgtgaacccctccccgaaagacccaattctcggtgtcaccgaagcttttcttgcagatcccagccctgataaagtcaatgtcggagttggagcttaccgtgacgataatggaaagtcggttgttctcgagtgtgtcagagaaactgaacggagaatcgccggaaatctgaatatggagtatctcccaatgggaggaagcttgaagatggttgacgaaacactgaagcttgcctatggggagaattctgatttaatcaaagataaacagatagcagcggtgcaagctctctctggaaccggtgcatgccgactttttgcagactttcagaagcgcttttgccctgattcccaaatctacattccagtccctacctggtccaatcatcataacatatggagagatgcccgcgtcccacaaaggacattccattattatcatccagaaaccaaagggttggattttgcttccctgatggatgacgtaaagaatgcaccaaatggatcattctttctgcttcatgcttgcgcacataatcctacaggggtggatcctacagaggaacaatggaaagagatatcttaccaattcaaggtcaaaggacattttgctttcttcgatatggcatatcaaggttttgctagtggtgatccagagaaggatgcgaagtctatcaggatttttcttgaggatggccatctaattggatgctcccaatcttacgcaaaaaatatgggactttatggccagagagtcggctgcctcagtgtggtttgcgaagatgaaaaacaagccgtggcagtgaaaagtcagttgcagcagcttgccagaccaatgtacagtaatccaccggttcatggtgctctaattatttcaactatccttggtgatccagacttgaagaaattgtggctcaaggaagttaaggacatggctgaccgcatcattgggatgcgaactactcttcgagaaaatcttgaaaaattggactccccactttcttgggaacatataactaatcagattggcatgttttgctatagtgggatgacacctgaacaagttgatcgcttgacaaatgaatttcatatttacatgactcgtaacggtcggattagtatggcagggattactacaggcaatgttggatactaggcgaatgctatccatgaagtcacaaaatctaactagtttcttgttgcagaaacatcaactatagagaataatgtaacaggcgggcggccattgaaatttactgaggttatatggcgagattttttactcttttttttttttttttttttttttt

SEQ ID NO: 2687 - DNA, 1644 bp, Cichorium intybus
tcatcattaacttcaccctcaacaaaatcaagcaacaagcaacctgcccggacttcagctccggcaatcgcaagccacatagagagagcgacagcgtcaatcttagatcgatggcgctccggacagcaattaccagacgaatcctgagctcgagctcggcggtacatggctcgcgatccatgtcttcgtggtggaaaaatgttgagcctgcgccaaaagatcccattcttggcgtgaccgaagcttttcttgcagatcctagtcctgacaaagttaacgtcggcgtcggagcttatcgtgatgatcacgggaaaccggtggttctcgagtgtgtcagagaagcagagagacgaattgctggaagcatgaacatggaatatcttccaatgggaggaagcaacaagatggttgatgaaactctaaagttagcctatggggaaaattctgatttaatcaaagataaaagaattgcagcagtacaagctctttctggtactggtgcatgtagactttttgcagactttcagaaacgtttttcccctgattcccatatctatattcctgtccccacatggtcaaaccaccataacatatggagagatgctaatgtaccacaaagaacattccattattaccatccagaaacaaaaggtcttgactttgcctctctcatggatgatgttaagaatgcaccaaaaggttcattctttttgctgcatgcttgtgctcataaccctacaggagttgaccctacagtagaacaatggaaggaaatgtcctaccagtttaaggtaaaaggacattttgctttctttgacatggcatatcaaggatttgcaagtggtgatccagagagagatgttcaatccattaggatttttcttgaagatggtcatttgattggatgttctcaatcatatgctaagaatatgggtctttatggccaaagagtaggatgcctcagtttggtatgtgaagatgaaaagcaagctgtggctgtgaaaagtcaactgcagcaaattgcaagacccatgtacagtaatccacctgttcatggtgcacttattgtttcaactgttcttggtgatccagatttaaagcaattgtggctcaaggaagtcaagggtatggcagaccggatcattggaatgagaagtgctctcagggaaaacattgaaaaattgggttcccctctctcatgggagcacataactaatcagatcggcatgttctgctatagtggaatgactcctgaacaagttgatcgtttgacaaatgaatttcatatttatatgacccgtaatgggcgtattagtatggcaggggtaacaactggcaatgttgagtatttggccaaagctatccatgaagttacaaaaacttaaaaaggaccttcatggagatgctttgtgatttattatgaggttttggttttaaattgagtcaggtattttattatatgctgagaataaatgataatcatcccttttttttaaagaaaataaagaacttcacctagttatgggttgtgattggttgtagtggatagtgattgttgtattgttattgtagaattactttaatacatggatgcagatcagtgttgatcaagtctatcataatttataatacttgaggttttcc

SEQ ID NO: 2688 - DNA, 1617 bp, Cichorium intybus
tcatcaacattaacttcaccctcaacaaaatcaagcaacaagcaacctgcccggacttcagctccggcaatcgcaagccacatagagagagcgacagcgtcaatcttagatcgatggcgctccggacagcaattaccagacgaatcctgagctcgagctcggcggtacatggctcgcgatccatgtcttcgtggtggaaaaatgttgagcctgcgccaaaagatcccattcttggcgtgaccgaagcttttcttgcagatcctagtcctgacaaagttaacgtcggcgtcggagcttatcgtgatgatcacgggaaaccggtggttctcgagtgtgtcagagaagcagagagacgaattgctggaagcatgaacatggaatatcttccaatgggaggaagcaacaagatggttgatgaaactctaaagttagcctatggggaaaattctgatttaatcaaagataaaagaattgcagcagtacaagctctttctggtactggtgcatgtagactttttgcagacttccagaaacgcttttcccctgattctcatatctatattccagtccccacatggtcaaaccaccataacatatggagagatgctaatgtaccacaaagaacattccattattaccatccagaaacaaaaggtcttgactttgcctctctcatggatgatgttaagaatgcaccaaaaggttcattctttttgctgcatgcttgtgctcataaccctacaggagttgaccctacagtagaacaatggaaagaaatatcctaccagtttaaggtaaaaggtcattttgctttctttgacatggcatatcaaggatttgcaagtggtgatccagagagagatgttcaatccattaggatttttcttgaagatggtcatttgattggatgttctcaatcatatgctaagaatatgggtctttatggccaaagagtaggatgcctcagtttggtatgtgaagatgaaaagcaagctgtggctgtgaaaagtcaactgcagcaaattgcaagacccatgtacagtaatccacctgttcatggtgcacttattgtttcaactgttcttggtgatccagatttaaagcaattgtggctcaaggaagtcaagggtatggcagaccggatcattggaatgagaagtgctctcagggaaaacattgaaaaattgggttcccctctctcatgggagcacataactaatcagatcggcatgttctgctatagtggaatgactcctgaacaagttgatcgtttgacaaatgaatttcatatttatatgacccgtaatgggcgtattagtatggcaggggtaacaactggcaatgttgagtacttggccaaagctatccatgaagttacaagaacttaaaaggagacgcttttttatttattatgaggttgtggttttaaattgtatcgggtattttatttcttgttgagaataatcatcccttgctttcgaaaagaaaataaagaaagccaaaggacttcacctagttatgagttgtgattggttgtagtggatagtgattattgtattgttattgtagaattactttaattgatggatccagatcagtgttgatcaagtctatcat

SEQ ID NO: 2689 - DNA, 1572 bp, Chrysanthemum coronarium
gaacacaaacacatagataaagaagaacaataaaaacagacgatggcatcgatgatgacgagaaaatcaatgttcatgatgaagtcgaggtcgatgattcatgggtcatcacgattgatgtctacatcctggtggaaacacgtggaaccagctcctaaggatccgatacttggtgttactgaagcttttttagcagatcctagtccaaacaaagttaacgttggcgttggagcttatcgtgatgataacgggaagccggtggttctggattgtgttagagaagcagagagacgggttgctggaaacctgaacatggagtatcttccaatggggggaagcaaccagatggttgacgagacactaaagttagcatacggggagaattctgatttgatcaaagataagcgaattgcagcaatacaagctttgtctggcactggtgcatgccgaatttttgccgacttccaaaaacgcttttctcctgattctcagatctatattccagtcccaacctggtccaatcaccacaacatttggagagatgctaatgtaccacaacggacatatcattattatcatccagaaacaaaaggtcttgatttcgcctcgctaatggatgatgttaagaatgcaccaaatggctcattctttatgctacatgcttgtgctcataaccccactggagttgatcctacaatagaacaatggaaagaaatatcttaccagtttaaggtcaaaggtcattttgcgttctttgacatggcttatcaaggctttgcaagtggtgatccagagagagatgcaaaatctattaggattttccttgaagatggccatctaattggatgctctcaatcatatgcgaaaaatatgggtctttatggccaaagagtcggttgccttagtttggtatgtgaagatgaaaaacaagcggtggctgtgaagagtcaattgcagcaacttgcaagacccatgtacagtaatccacccgttcatggtgcgcttattgtttcaactatacttggtgatcctgatctaaagcaattgtggctcaaggaagtcaagggtatggctgaccgtattatcggaatgagaagttctcttagggaaaacattgaaaagttgggctctcccctatcatgggaacacataactaatcagattggcatgttctgctatagtgggatgactcctgaacaagttgatcgcttgacacaagaatttcatatttacatgacccgcaatggtcgtattagtatggccggggttacaagtggcaatgttgaatacttggcaaaggctatccatgaagttacaaaagctgcttgagggcccagatttttctgctgtttgggttaaaattagtgtcgggtatttttccctgagaatatactaaagaaaataaaaggtttaaaggcacttgtaccatttcatgagttttgcatgtgctcgtagtggatagtgattgttgttgtagagaactttgataagttctattattgttagcaaagaagttctataccggcagctgttaaagctgcccacatcatttgaataaaacagatttgtttc

SEQ ID NO: 2690 - DNA, 1615 bp, Conyza canadensis
ctggattttgatgcccccacccacattttcgttattattattctaaatttattactcaaccaaccaacccaccgtttttcattttccgttccattttatcatcctgtgaccactgatggcgctcagggcagcattaggcagcagaaagatgaggcaacatggtggttgtgggtggtggccgtcatcaataacaacaagatccatgtcatcatcatggtggaaacatgtagagccagcacctaaagatccgattctcggtgtcaccgaagcttttcttgctgatcctagtccccacaaagttaatgttggcgttggagcttatcgtgatgataacgggaaaccggtggttttggattgtgttagagacgctgagaggcgaattgccggaaacttgaacatggagtatcttccaatgggaggaagcaacaaaatggttgatgaaacactgaagttagcctatggggatgattctgatttgattaaagataaacgaattgcggcaatacaagctctttctggcactggtgcatgcagaatttttgcagatttccagaaacggttttcccctgattctcaaatctatattccagtccctacctggtcgaatcaccataacatttggagagatgctaatgtaccacaaaggacatttcattattatcatccagaatcaaaaggtcttgatttcgcctcgttaatggatgatgttaagaatgcaccaaatggctcattctttttgctgcatgcctgtgctcataatcctaccggagtcgatcctacagtagaacaatggaaagaaatatcttaccagtttaaggtgaaaggtcattttgctttctttgacatggcttatcaaggctttgcaagtggtgatccagagagggatgcaaaatctattaggattttccttgaagatggtcatttaatcggatgctctcaatcatatgctaagaatatgggtctttatggccagagagtcggatgccttagtttggtatgtgaagatgaaaaacaagccgtggctgtgaaaagtcaattgcagcaacttgcaagacctatgtatagtaatccacctgttcatggtgcacttatcgtttcaactatccttagtgaaccagatctaaagcaattgtggctgaaggaagtcaagggtatggctgaacgtataatcggaatgaggagctctcttagggaaaatattgaaaagttaggctctcccctatcatgggagcatattactaatcagattggcatgttctgttatagtgggatgactcctgaacaagttgatcggttgacaaaagagtttcatatttatatgacccgcaatggccgtattagcatggcaggggtcacaagtggcaatgtagaatacctggcaaaggctattcacgaagttacaaaagccggttaaagttcagatatctaccaaggttttggttgaaattagtttcgggcatttctgtgaaagaattcataggaaataaaaggtttacgtacttcacctggttgagtgttggttgtttgtagcggatagtgcttgttgtgttgtaatgttagagaaattaggaaagctcaattcttggaagcagataaaaagttctatactggtagc

SEQ ID NO: 2691 - DNA, 1693 bp, Daucus carota
tcgtgtcttgacaccgactagctttactatataaaccattcggccccattttttctgtgtacatccaacatcatactttgttttccagaaaattcaattacggtgatggcgttacggagtgtaatttccaggcgggtgacgaagatgagttggtgcgggacgcgatcggtgtcgacgtggtggcgaaacgttgagccggctcccaaagatccaatactcggcgtcactgaagcatttttggcagatcctagtcctgataaagtcaatgttggagttggggcttaccgtgacgataacggaaagccggtagttctggagtgtgttagggaagctgaacgtagaattgctggcaatctcaacatggagtatcttccaatggggggaagtgtggatatgatcgataaaacactgaagcttgcctatggggagaattctgacttgattaaaggtaaaaggattgcagcagttcaagcgctttccggaactggtgcatgccgtgtttttgcagagttccagaaacggttttctcctgattcccaaatctacattccagtccctacatggtccaatcatcacaacatttggagagatgcacatgtcccacaaaggacattccattattatcatccagaaaccaaagggctggattttgcttccctgatggatgatgtaaagaatgcgcccagtggatcgttctttctgcttcatgcctgtgcacataatcctactggagtggatcctacagaggaacaatggaaagagatctcataccagttcaaggtcaaaggacattttgctttcttcgacatggcatatcaaggttttgctagcggtgacccagagaaagatgcaaaatctattcgaatttttctcgaggatggccatctaattggatgttcccagtcatatgcaaaaaatatgggcctttatggtcagagagttggctgtctcagtttggtgtgcgaggatgaaaagcaagcagtggctgtgaagagtcagctgcaacagattggtaggcctatgtacagtaatcctcctgttcatggtgcactacttgtttctactattcttggcgaaccagacttgaaggaattgtggctcaaggaagttaagggcatggccgaccgcatcattggaatgagaacttctctgcgtgaaaatcttgaaaatttgggctcaccattgtcatgggagcacataacaaaccagattggcatgttttgctacagtgggatgacacctgaacaagttgaccgtctgactaatgatttccatatatatatgacccgtaatggtcgtataagtatggcaggtgttactacaggcaatgttggatacctggccaatgctatccatgaggtcacgaaaccaacatagattcttgtagcaaacattttagccacagaaaataatatagcaggcggccacagccattaaaggttacctatatggtgagattttttccccccccatttatctatactctcccccctttctttactcagctgaagtgctgaactagtcgaggcttatgtgcccatcagactttaatgtaactaataaattacatgttgtagttagtggggaaatcatagatttgttatccatcctttgacttggttgtatgagattgtcactggagctgtatggtgacactaagacatttagtcctgtgatgcgcattcaactgata

SEQ ID NO: 2692 - DNA, 1740 bp, Gossypium hirsutum
cagcaaattgctcaactggattggattggattcgattagcttcctcttaaacatatatacccttactcttttaatcttatttcatttcattgatataaccgagagaaaatcctccgataacgccattgtcgcgcttttcttcactttctgtttgaactacgaacttctttgttggtgactaaatggcgatccgaagagctatgtctggtcgcatcatggatcggacggccgtcgttggtgcgcgatacatgtcatcgtggtggcgtagcgttcaacccgctcccaaggatcctattcttggtgttacggaggcttttttggccgatcaaagtcccgataaagttaatgttggagtcggtgcttaccgtgatgataatggaaagccagttgttttggaatgtgttagagaagccgagcgaaggattgctgggaatttgaacatggaatatcttcctatgggaggaagcgtgaagatggtggaagaaacactgaagttggcctatggtgagaattctgagttgataaaagaaaaaaggatagcagcagttcaagctctgtctgggactggtgcatgccgactttttgcagactttcaaaagcgtttttgtcctgactcccaaatctatataccagtccctacttgggccaaccaccacaacatttggagagatgctcaggtccctcagaaaacctaccattattatcacccagagtcgaagggtctagattttgcagcaatgatagatgacattaagaatgctccaaatggctcattctttctacttcatgcatgtgctcataaccccactggtgtggatccttcagaggagcagtggagagaaatctcacaccacatcaaggcaaaaggtcattttgccttctttgacatggcgtatcaaggctttgctagtggtgacccagagaaagatgcaaaggccatcaggatttttcttgaggatggtcatcacataggaattgcacaatcatatgcaaaaaacatgggactctatggccagagggtaggatgcctcagtgtgctttgtgaagatgaaaaacaagcagtagctgtaaaaagtcaactgcaacagcttgcgagacctatgtacagcaacccacctgttcatggtgctctcatagtttcaaccattcttagtgatccagacttgaagaaacaatggctgaaagaagttaaggtcatggctgatcgcataattggaatgcgaactgctttacgagggaaccttgaaaagctcggttctccattatcatggcagcacattactaatcagataggaatgttttgctatagtgggttgacaccagaacaagtggatcgcttgacgaacgaatttcacatctatatgactcgcaatggtcgaatcagtatggctggtgttacaacgggcaatgtcgaatatttggcaaatgcgattcatgaagtcacaaaatgaggttagaatcatagctgatattgatccttcaaaagatttttggtgtgtttgtaaggacaattaaaggagcattgatagaagctgaacttaaggtttctgcattgaataattactatgactagaataggaaagaggtaaagattggatctgtacctgatttggcctacaaaggatggatagttcatttccttactagttacaacttttaataattcaagcaactcgtatgtatctttgcttgagaaacaaaacaatgtaactaattaatgccaattccgttcatttctct

SEQ ID NO: 2693 - DNA, 1744 bp, Gossypium hirsutum
ttacagcaaattgctcaactggattggattcgattagcttcctcttagacatatatacccttactcttttaatcttatttcatttcgttgatataaccgagagaaatcctccgattacgccattgtcacgcttttcttcactttctgtttcaactacgagcttctttgttggtgacttaatggcgatccgaagagctatgtctggtcgcatcatggatcggacggccgtcgttggtgcgcgatacatgtcatcgtggtggcgtagcgttcaacccgctcccaaggatcctattcttggtgttacggaggcttttttggccgatcaaagtcccgataaagttaatgttggagtcggtgcttaccgtgatgataatggaaagccagttgttttggaatgtgttagagaagccgagcgaaggattgctgggaatttgaacatggaatatcttcctatgggaggaagcgtgaagatggtggaagaaacactgaagttggcctatggtgagaattctgagttgataaaagaaaaaaggatagcagcagttcaagctctgtctgggactggtgcatgccgactgtttgcagactttcaaaagcgtttttgtcctgactcccaaatctatataccagtccctacttgggccaaccaccacaacatttggagagatgctcaggtccctcagaaaacctaccattattatcacccagagtcaaagggtctagattttgcagcaatgatagatgacattaagaatgctccaaatggttcattctttctacttcatgcatgtgctcataaccccactggcgtggatccttcagaggagcagtggagagaaatctcacaccacatcaaggcgaaaggtcattttgccttctttgacatggcgtatcaaggctttgctagcggtgacccagagaaagatgcaaaggccatcaggatttttcttgaggatggtcatcacataggaattgcacaatcatatgcaaaaaacatgggactctatggccagagggtaggatgcctcagtgtgctttgtgaagatgaaaaacaagcagtagctgtaaaaagtcaactgcaacagcttgcgagacctatgtacagcaacccacctgttcatggtgctctcatagtttcaaccattcttagtgatccagacttgaagaaacaatggctgaaagaagttaaggtcatggctgatcgcataattggaatgcgaactgctttacgagggaaccttgaaaagctaggttctccattatcatggcagcacattactaatcagataggaatgttttgctatagtgggttgacaccagaacaagtggatcgcttgacgaacgaatttcacatctatatgactcgcaatggtcgaatcagtatggctggtgttacaacgggaaatgttaaatatttggcaaatgcgattcatgaagtcacaaaatgaggttagaatcattgctgatattgttccttcaaaagatttttggtgcgtttgtaaggacaattaaatgagcattgatcgaagctgaacttaaggtttctgcattgaataattactatgactggaataggaaagaggtaaagattggatcggtatctgattttgcctacaaaggatggttggttcattccaataatatgatgaagtccttactagttaaataattcaagcaactcgtatgtatctttgcttgagaaacaaaacaatgtaactaattaatgccaattccattcatttct

SEQ ID NO: 2694 - DNA, 1644 bp, Euonymus alatus
ggattggtattcgattcgctgcctttcttactttttgagttttgacaaatctcatcagtgccttcgaatttatcaatttactggctcctctctcgttagcttcatcttctcctccttgttgcttccgttcgcggcaataaactgcttccttgaaagagagctaccatggcgtttcgaagtgctctagctggccagatcgtgaggcggagctccgttgttggagcgcgatctatgtcttcgtggtggaccagcgtagagccagctcccaaggatccgattctcggcgtcacagaggcttacctggccgattcgaatccaagcaaagtcaatgtcggagttggggcttaccgcgatgataatgggaagcctgttgttcttgaatgcgtcagggaagctgaacgaaggattgctgggaagttagatatggagtatctccccatgggaggaagcatcaagatggtggaagaaacactgaagctggcctatggagagaattctgagttcatcaaagataaaaggatagcagctctgcaatcgctttccgggactggtgcatgtagaatttttgctgacttccagaagcgtttccttcctgattcccaaatctacataccggtcccaacttgggcgaaccaccataacatctggagagacgcccaggttcctcagaggacattccattactatcaccccgaaactaaagggttagattttgcagctctaatggatgacataaagaatgctccaaatggctcattctttctacttcatgcctgtgctcataatcctactggagtagatccatcagaggatcaatggagggagatatcttatcaattcaaggtaaagggacattttgccttctttgacatggcctatcaaggtttcgccagtggtgatccggagagagatgcaaagtccattagaattttccttgaggatggtcatttgattggccttgcacagtcatttgcgaaaaatatgggactttatggccagagagtcggatgcctcagtgtgctttgcgaggatgaaaaacaagccattgctgtaaaaagtcagctgcagcagcttgccaggcccatgtatagcaacccacccagccatggtgcactcatagtttcgaccgtccttggagatccagacttgaagaaactgtggctcaaagaagttaaggtcatggctgatcggattattgggatgcgaaaagctctgcgggaaaaccttgaaaagttgggatcgcctttatcatgggaacacattactaaccagattggcatgttctgctacagtgggatgacccctgagcaagtagacaagcttacaaatgaatatcatatctatttgacgcgaaatggtcgaatcagtatggctggtgttactaccggcaacgttggatacttggcaaatgcgatacatgaggtcaccaagtccgcataacctcgtaattattttaggaggcgacagagatattgagatacttcaacagagaatatttttgttcttttcctggatttggtgaggactgcttaataagagggccactacgtgctcttcgctgacaattgaggactactatttcttcaatttgtccagttttgcaatgatattccttcagttaaaaatagcaagatcaggcatgcg

SEQ ID NO: 2695 - DNA, 1603 bp, Euphorbia peplus
attactataatatctcacccaacattcctgcgcctgcgtgcgatccaaaccaaacactctcagaaatggcgttcggacatgcaattacatgccggctatcagtcgaggggatgatgatcggtgccagatcaatgtcttcatggtggggaagcgttgagcctgccgctaaagatcccatcctcggtgtcaccgaagcttttctttccgatcccagccccgataaagtcaacgtcggagttggtgcttacagggatgataatggcaagcctgtggttttggactgcgttcgagaagctgagcgcaggattgctggaacctcgaatatggagtatcttccaatgggaggcagtgtgaaaatggtggaagaaacattgaagctggcctatggagaggattctcagttcattaaagataaaaggattgcagcaattcaatccctgtctggaactggagcatgccgaatatttgctgattttcaaaagcgttttcgtcctgattcccaaatttacataccagtcccaacatgggccaaccaccataatatctggagagatgctcaggtccctcaaaagacctatcattactatcatgcagagtctaggggcttagatttttctgcattgatggatgatgtaaagaatgctccaaatggatctttctttttgcttcatgcttgtgctcataatcctactggggttgatccaactgaagaacaatggagagagatatcaaagctttttaaggtaaaaaaccattttgccttcttcgacatggcatatcaaggttttgctagtggtgatccagagagggatgcaaagtccatcaggatttttctagaagatggtcaccatattggcattgcccaatcctatgcaaaaaatatggggctgtatggccagagagtaggatgtctcagtgtgctctgtgaagatgataaacaagcagtgtctgtgaagtcgcagttacagcaactagcgaggcccatgtatagcaatcctcctgtccatggtgctctcatagtttcaactatacttggagatccagaattgaagaagttatggcttcgagaagtaaagggaatggctgatcgtatcatttcgatgcgatcatctttaagagaaaaccttgaaaacttgggatccccattgccgtggaagcacattactaatcagattggtatgttttgctatagtggattaacgcctgaacaggttgatcgtttgacaaaggaattccacatctatatgacccgtaacggacgaattagtatggctggcgttacttctgggaatgtgggatatttggcaaatgctatccacgaggtcacaaaatcttcgtaggaccgtttttccagaagtcattattatcctttaggaggtcataggtgaacactaatcaaatcaagtgatatgagaattggctgtaaactaatctttgctgcagccagttaattctttttccgagaaaataattttggaccatttttctgttggagcttagagggtttccttgcaggaaattgcttttagttacaacaaaataatctggagcatatattatatacatgattttaggaggctatttgttccttctcatttataat

SEQ ID NO: 2696 - DNA, 1821 bp, Gossypium raimondii
acagcaaattgctcaactggattggattcgattagcttcctcttagacatatatacccttactcttttaatcttatttcatttcgttgatataaccgagagaaaatcttccgaatacgccattgtcacgcttttcttcactttctgtttcaactacgagcttctttgttggtgacttaatggcgatccgaagagctatgtctggtcgcatcatggatcggacggccgtcgttggtgcgcgatacatgtcatcgtggtggcgtagcgttcaacccgctcccaaggatcctattcttggtgttacggaggcttttttggccgatcaaagtcccgataaagttaatgttggagtcggtgcttaccgtgatgataatggaaagccagttgttttggaatgtgttagagaagccgagcgaaggattgctgggaatttgaacatggaatatcttcctatgggaggaagcgtgaagatggtggaagaaacactgaagttggcctatggtgagaattctgagttgataaaagaaaaaaggatagcagcagttcaagctctgtctgggactggtgcatgccgactgtttgcagactttcaaaagcgtttttgtcctgactcccaaatctatataccagtccctacttgggccaaccaccacaacatttggagagatgctcaggtccctcagaaaacctaccattattatcacccagagtcgaagggtctagattttgcagcaatgatagatgacattaagaatgctccaaatggctcattctttctacttcatgcatgtgctcataaccccactggcgtggatccttcagaggagcagtggagagaaatctcacaccacatcaaggcaaaaggtcattttgccttctttgacatggcgtatcaaggctttgctagtggtgacccagagaaagatgcaaaggccatcaggatttttcttgaggatggtcatcacataggaattgcacaatcatatgcaaaaaacatgggactctatggccagagggtaggatgcctcagtgtgctttgtgaagatgaaaaacaagcagtagctgtaaaaagtcaactgcaacagcttgcgagacctatgtacagcaacccacctgttcatggtgctctcatagtttcaaccattcttagtgatccagacttgaagaaacaatggctgaaagaagttaaggtcatggctgatcgcataattggaatgcgaactgctttacgagggaaccttgaaaagctaggttctccattatcatggcagcacattactaatcagataggaatgttttgctatagtgggttgacaccagaacaagtggatcgcttgacgaacgaatttcacatctatatgactcgcaatggtcgaatcagtatggctggtgttacaacgggcaatgttaaatatttggcaaatgcgattcatgaagtcacaaaatgaggttagaatcattgctgatattgttccttcaaaagatttttggtgcgtttgtaaggacaattaaatgagcattgatcgaagctgaacttaaggtttctgcattgaataattactatgactagaataggaaagaggtaaagattggatctgtatctgatttggcctacaaaggatggatagttcatttccttactagttacaacttttaataattcaagcaactcgtatgtatctttgcttgagaaacaaaacaatgtaactaattaatgccaattccattcatttctctatggtattagcaacatgatagaaattttgtgtgtagcctttgggaactaatgtttcataatttagatttggacttttaaaatagt

SEQ ID NO: 2697 - DNA, 1677 bp, Arachis hypogaea
acacgccgttttttccgttctgttctaactcacgtctctctctctctgtctcctctgtttcatcgatccaagacgccgcgtcatcactgagacatggctgttcgtaactcgctatccggacaactcctccgccgcagctccgtcgtagccggagccagattcatgtcatcgtggttccggagcatcgagcccgctcccaaggatccaatccttggtgtcaccgaagcttttctcgccgatcagagtccaaataaagtcaatgttggagttggtgcatatcgtgatgacaatgggaagcctgtggttctggaatgtgtcagagaagcggagaggaggatcgcaggaagccagttcatggagtatcttccgattggtggaagcataaagatggtggaagaatcactaaagctagcatatggagagaactccgagttcatcaaagataaaagaataggtgcagttcaggctttatccgggactggagcctgtcgacttttcgctgcatttcaacaccgattccatccaaacagccagatctacataccggtgcctacatgggcgaaccaccataacatttggagggatgctggagtgcctatgaagaccttccgttactatcaccctgagactagaggattggatttttcaggactgatggaagacataaagaatgcaccagatggttcattctttctgcttcatgcttgtgctcacaatcctactggagtagatccttcagaagaacaatggcgagagatctcgtccctcatcaagattaaaggtcattttcctttctttgacatggcgtatcaaggttttgcaagcggtgatccagagcgagatgcgaaggccatcaggatttttcttgaggatggtcatttgataggacttgcacagtcatatgcaaaaaatatgggactctatggccagcgagttgggtgccttagcgtgctttgtgaagatgagaaacaagctgtggcagtaaaaagtcaattgcagctacttgctagaccaatgtacagtaatccacctgttcatggagcacttatagtttcaactgttcttggtgacccagaattgaagaatttatggcttaaagaagttaaggttatggcggaccggatcattggaatgcgtgccaccctgcgagaaaacctagaaaaactggggtctcctttgccatggcagcacataaccaaccagattggcatgttctgctatagtgggttgacacctgaacaagttgatcgtatgacaaacgagtttcatatttatatgactcgtaatggtcgaataagtatggctggtcttaatactggcaatgttggatatgtagctaatgccattcacgaggtcacaaaatcagcttagatgattcagctgaacaaagagccaaaagttttttgtcttatggaatgtcaaacaccgaattgtccttttcagagctcaataaaattagaaatttagaaccattcttcttattattgttgacactttcaccgagttaggtagtgataccttcaaggggtggtttatatcaaagaccccctcagcatttatatctccattttttgtagcactatgttgtgcttctcgctatctctccaaatttttctagcaaacaataaatatttgagaagtgggttggaatttaaggctcgcttatttatgatacta

SEQ ID NO: 2698 - DNA, 1606 bp, Helianthus annuus
ggcgatacgagcagtactcaccagacgacccataacctcctcgaccttggcctcgcgatccatatcatcctggtggaaaaacgttgagcctgcacccaaagaccccattctcggtgtcactgaagcttttttagccgataccagtccccataaagttaatgttggcgttggagcttatcgtgatgataacgggaagcctgttgttttggagtgtgttagagaagcagaaagacgagttgccggaaacctgaatatggagtatcttccaatgggaggatgcaacaacatggttgaggaaacactgaagctcgcatacggtgaagattccgacttgattaaagataaacgaatcgcagcaatacaagctctttccggcactggcgcatgcagaatttttgccgattttcaaaaacggttttcccctgattcccagatctatattccagtccctacctggtccaaccaccataacatatggagagatgcaaatgtaccacaaagaacattccattattatcatccagaatcaaaaggtcttgattttgcctcactgatggatgacgttaagaatgcaccaaatgggtcattctttttgctgcatgcttgtgctcataatcccaccggagtcgatcctacagttgaacaatggaaagaaatatcgtaccagtttaaggtcaaaggtcattttgctttctttgacatggcttatcaaggctttgcaagtggtgatccagaaagagatgcgaaatccattaggatttttcttgaggatggtcatttaatcggatgctcgcaatcatatgcaaaaaatatgggtctttatggccaaagagtcggctgcctcagtttggtatgtgaagatgaaaaacaagctgtggccgtgaaaagtcaacttcagcaacttgcaagacctatgtacagtaatccacccgttcatggtgcccttattgtttcaactatccttagtgatccagatttaaagcaattgtggctcaaggaagttaagggtatggctgaccgtataatcggaatgagaacttctcttagggaaaacattgagaagctgggttctcccctatcatgggaacacataactaatcaaatcggcatgttctgctatagcgggatgactcctgaacaagtagatcgtttgacaaaagaattccatatttatatgacccgcaatggccgtatcagtatggcaggtgtgacgagcggcaatgtcgaatacttggcaaaagctatccatgaagtcacaaaagctgcttaaagacgatacaatttatgaggtttttttggttaaaactaagttttcgggtcttttgccctgagaatagtttagaaaaataaaaaggttaaggtacttcacctggttatgagttttaattgtttgtagcggatagtgattgttgtcttgttattaggccatatgtaatggggctttataggggcgtgaaaggttttgatagtgcccttacaccatcccccatgggcatttctagaataatgcccaataaggaggaaaaacaaggaaactaatatatgaaagggcattaagaagccttaaccattactacattacatgaagcattatgatggtgatgtg

SEQ ID NO: 2699 - DNA, 1338 bp, Ambrosia trifida
ttaactcacctccaactaccttcaaccaatggctctccgtacagcaatcaccacgagacgaataataataagaagctcctcacaggggtcacgatccatatcatcttggtggaaacacgttgagcctgcacctaaagaccctattcttggagtcaccgaagcatttcttgctgatactcatcctgacaaagttatgttggcgttggagcttatcgtgatgataatggaaagccggttgttcttgattgtgttagagaagctgagagacgtattgctggcaactttaaccatggaatatcttccaatgggaggaagcaacaaaatggttgaggaaacactgaagttggcctatggtgatgattctgatttgattaaagataaacgaattgcagcaatacaagctctttctggcactggtgcatgccgaatttttgctgattttcagaagcgcttttcccctgattctcagatctatattccagtccctacttggtccaatcaccataacatctggagagatgccaatgtaccacaaagaacattccattattatcatccagaatcaaaaggtcttgattttgcctcgctgatggatgatgttaagaatgctccaaacgggtcgttctttttgctacatgcttgtgcacataatcctactggagtcgaccccacagtagaacaatggaaagaaatatcttaccagtttaaggtcaaaggtcattttgctttctttgacatggcctatcaagggtttgcgagtggtgatccagaaagagatgcaagatccattaggatttttttggaagatggtcatttaattggatgctctcaatcatatgctaaaaatatgggtctttatggccaaagagttggctgccttagtttggtatgtgaagatgaaaacaagctgtggctgtgaaaagtcaactgcagcaacttgcaagacccatgtacagtaatccacccgttcatggtgcacttattgtttcgactattcttggtgatccggatttaaagcagttgtggctcaaagaagtcaagggtatggctgaccgtataatcgggatgagaacttcacttagggaaaacattgagaagttgggttctcccctatcatgggaacacataactaatcagattggcatgttctgctttagtgggatgactcctgaacaagttgatcgcttgacaaaagagtttcacatttacatgacccgtaatggtcgtataagtatggcaggtgtcacaagtgggaacgttgaatacttggcaaaagccattcatgaagttaacaaaagctgcttgaagttgagatattttctgaggatctagttagga

SEQ ID NO: 2700 - DNA, 1354 bp, Ambrosia trifida
ttaactcacctccaactaccttcaaccaatggctctccgtacagcaatcaccagcagacgaacaataataataagctccttacaggggtcacgatccatatcatcttggtggaaacacgttgagcctgcacctaaagaccctatcctcggtgtcaccgaagcttttcttgctgatactcatcctgataaacttaatgttggcgttggagcttatcgtgatgataacgggaagccggttgttcttgattgtgttagagaagctgagagacgcattgctggcaacttaaacatggaatatcttccaatgggaggaagcaacaaaatggttgaggaaacactgaagttggcctatggtgatgattctgatttgattaaggataaacgaattgcagcaatacaagctctttctggcactggtgcatgccgaattttcgctgatttccaaaaacggttttcccctgattctcagatctatattccagtccctacctggtccaatcaccataacatctggagagatgctaatgtaccacaaagaacattccattattatcatccagaatcaaaaggtcttgatttcgcctcgctgatggatgatgttaagaatgcaccaaacgggtcgttctttttgctgcatgctcgtgcacataatcctactggagtcgacccacagtagaacaatggaagaaatatcttaccagtttaaggtcaaaggtcactttgctttctttgacatggcctatcaagggtttgcgagtggtgatccagaaagagatgcaagatccatcaggatttttttggaagatggtcatttaattggatgttctcaatcatatgctaaaaatatgggtctttatggccaaagagttggctgtcttagtttggtatgtgaagatgaaaaacaagctgtagctgtgaaaagtcaactgcagcaacttgcaagacccatgtacagtaatccacccgttcatggtgcacttattgtttcgactattcttggtgatccggttttaaagcagttgtggctcaaagaagtcaagggtatggctgaccgtataatcgggatgagaacttcacttagggaaaacattgagaagttgggctctcccctatcatgggaacacataactaatcagattggcatgttctgctatagtgggatgactcctgaacaagttgatcgcttgacaaaagaacttcacatttatatgacccgcaacggtcgtattagtatggcaggtgtcacaagtggcaacgttgaatacttggcggaagccattcatgaagttacaaaagctagcgtaaagttaagattattttctgaggatctagttaggacgcgaatcatcatatt

SEQ ID NO: 2701 - DNA, 1479 bp, Brassica oleracea
ttctctgtgcgttttgagagttattatggcgatgatggcgacggcaatccgtaactccgcttcacgggggacgatgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgagcgtaggatcgctggcacctccttcatggagtatcttccgatgggagggagtgtcaaaatggtggacgagacattgaagcttgcctatggggacaactctgagtttatcaaagacaaaaggattgctgcagttcagtctctctccggcactggagcttgccggctcttcgcagacttccagaaacgtttccgtcccgattcgcagatctacattcctgtaccaacctggtccaaccaccacaacatctggagagatgcacaagtcactcaaaagacgtaccattactaccatccagaaaccaagggcttggatttctcagggttgatggatgatgtgaagaatgctccgcaaggctccttcttccttctccacgcttgtgctcacaatcctactggagtagaccctacagaggagcaatggagagagatctcacagctattcaaggccaaaaaccatttcgcattcttcgacatggcctatcaaggctttgcaagcggtgacccagcgagagacgccaagtccatcaggatctttctcgaggacggtcatcatattggaatctctcagtcttatgctaagaacatgggactctacggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagcttagagaagttaggatcgcctctatcatgggagcacgtaaccaagcagattggaatgttctgctacagtgggatgacaccagaacaggttgaccgtttaacaagcgaatatcacatctatatgacccgtaatggtcgtatcagtatggccggtgttacaacaggaaacgtgggataccttgcgaatgctatacatgaagtcaccaagtcatcttaaattgttttacatgtctcaagtcgagagataaatttgtttctttttgaaagagttaataagacagaggaagcttacaacatttgttcttcttcaattgttttggtggggactgaaagtcttacccacaaacagtaacttatcagcgcaataaaattttgaaccgc

SEQ ID NO: 2702 - DNA, 1495 bp, Brassica napus
tttttttttctctgtgcgttttgagagttattatggcgatgatggcgacggcaatccgtaactccgcttcacgggggacgatgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgagcgtaggatcgctggcacctccttcatggagtatcttccgatgggagggagtgtcaaaatggtggacgagacattgaagcttgcctatggggacaactctgagtttatcaaagacaaaaggattgctgcagttcagtctctctccggcactggagcttgccggctcttcgcagacttccagaaacgtttccgtcccgattcgcagatctacattcctgtaccaacctggtccaaccaccacaacatctggagagatgcacaagtcactcaaaagacgtaccattactaccatccagaaaccaagggcttggatttctcagggttgatggatgatgtgaagaatgctccgcaaggctccttcttccttctccacgcttgtgctcacaatcctactggagtagaccctacagaggagcaatggagagagatctcacagctattcaaggccaaaaaccatttcgcattcttcgacatggcctatcaaggctttgcaagcggtgaccctgcgagagacgccaagtccatcaggatctttctcgaggacggtcatcatattggaatctctcagtcttatgctaagaacatgggactctacggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagcttagagaagttaggatcgcctctatcatgggagcacgtaaccaagcagattggaatgttctgctacagtgggatgacaccagaacaggttgaccgtttaacaagcgaatatcacatctatatgacccgtaatggtcgtatcagtatggccggtgttacaacaggaaacgtgggataccttgcgaatgctatacatgaagtcaccaagtcatcttaaattgttttacatgtctcaagtcgagagataaatttgtttctttttgaaagagttaataagacagaggaagcttacaacatttgttcttcttcaattgttttggtggggactgaaagtcttacccacaaacagtaacttatcagcgcaataaaattttgaaccgccttttagtt

SEQ ID NO: 2703 - DNA, 1441 bp, Ambrosia trifida
atggctctccgtacagcaatcaccagcagcagacgaataataataacctcacagggctcacgatccatatcatcctggtggaaacacgttgagcctgcacccaaagatcctatcctcggtgtcaccgaagcttttctcgctgatcctcatcctgataaagttaatgttggcgttggagcttatcgtgatgataatgggaagccggttgttcttgattgcgttagagaagctgagagacgtgttgctggcaacttgaacatggaatatcttccaatgggaggaagcaacaaaatggttgaggaaacactgaaattggcctatggtgatgattctgatttgattaaagataaacgaattgcggcaatacaagctctttctggcactggtgcatgccgaatttttgctgatttccaaaaacggttttcccctgattctcatatctatattccagtccctacatggtccaatcaccataacatttggagagatgctaatgtaccacaaagaacattccattattatcatccagaatcaaaaggtcttgatttcgcctcactgatggatgatgttaagaatgctccaaacgggtcgttctttttgctacatgcttgtgcacataatcctactggagtcgaccccacagtagaacaatggaaagaaatatcttaccagtttaaggtcaaaggtcattttgctttctttgacatggcctatcaagggtttgcaagtggtgatccagaaagagatgcaaaatccattaggattttccttgaagatggtcatttgattggatgttctcaatcatatgctaaaaatatgggtctttatggccaaagagttggctgccttagtttggtatgtgaagatgaaaaacaagctgtggctgtgaaaagtcaactgcagcaacttgcaagacccatgtacagtaatccacccgttcatggtgcacttattgtttcgatcattcttggtgatccggatttaaagcagttgtggctcaaagaagtcaagggtatggctgaccgtataatcgggatgagaacttcacttagggaaaacattgagaagttgggctctcccctatcatgggaacacataactaatcagattggcatgttctgctatagtgggatgactcctgaacaagttgatcgcttgacaaaagagtttcacatttacatgacccgcaacggtcgtattagtatggcaggtgtcacaagtggcaacgttgaatacttggcaaaagccattcatgaagttacaaaagctgcttaaagttaagatattttctgaggatctagttaggacgcgaatcgtcatatttctccctgaattatttgaaaatttaaagaaaataaatatattaagatacttcacgcggttataagttctaattgttgtagtaggccgggtcgtgattattgttttgttaattgttatg

SEQ ID NO: 2704 - DNA, 1776 bp, Conyza canadensis
tattctaaatttattactcaaccaaccaacccacccaccgtttttcattttccgttccattttatcatcctgtgaccactgatggcgctcagggcagcattaggcagcagaaacccccccatattccgattaactcaaaaaaccaccctcatggcgctcaggacagcagtaatcagcggaaagatgatgatacaacatggtggtgggtggtggccgtcatcaataacaacaagatccatgtcatcatcatggtggaaacatgtagagccagcacctaaagatccgattctcggtgtcaccgaagcttttcttgctgatcctagtccccacaaagttaatgttggcgttggagcttatcgtgatgataacgggaaaccggtggttttggattgtgttagagacgctgagaggcgaattgccggaaacttgaacatggagtatcttccaatgggaggaagcaacaaaatggttgatgaaacactgaagttagcctatggggatgattctgatttgattaaagataaacgaattgcggcaatacaagctctttctggcactggtgcatgcagaatttttgcagatttccagaaacggttttcccctgattctcaaatctatattccagtccctacctggtcgaatcaccataacatttggagagatgctaatgtaccacaaaggacatttcattattatcatccagaatcaaaaggtcttgatttcgcctcgttaatggatgatgttaagaatgcaccaaatggctcattctttttgctgcatgcctgtgctcataatcctaccggagtcgatcctacagtagaacaatggaaagaaatatcttaccagtttaaggtgaaaggtcattttgctttctttgacatggcttatcaaggctttgcaagtggtgatccagagagggatgcaaaatctattaggattttccttgaagatggtcatttaatcggatgctctcaatcatatgctaagaatatgggtctttatggccagagagtcggatgccttagtttggtatgtgaagatgaaaaacaagccgtggctgtgaaaagtcaattgcagcaacttgcaagacctatgtatagtaatccacctgttcatggtgcacttatcgtttcaactatccttagtgaaccagatctaaagcaattgtggctgaaggaagtcaagggtatggctgaacgtataatcggaatgaggagctctcttagggaaaatattgaaaagttaggctctcccctatcatgggagcatattactaatcagattggcatgttctgttatagtgggatgactcctgaacaagttgatcggttgacaaaagagtttcatatttatatgacccgcaatggccgtattagcatggcaggggtcacaagtggcaatgtagaatacctggcaaaggctattcacgaagttacaagcccccccccccccccctacctggcaaaggctattcacgaagttacaagagctacttaatgtcaaaaattcagatatgtaccaaggttttggttgcaattagttccggatatttctctgtgaaagaattcatagaaaataaaagattaacgcactttagctggttgagcgttggttgtttgtagtggaaagtgcttatcgtgttgtaatgttagagaacttagaaaagttcgattcttggaagcagataaaaagttctatactggtagcttttaaagcaaccctcattgattggataaaacatgtttgttagttgttacttcgaagcagacagatcag

SEQ ID NO: 2705 - DNA, 1649 bp, Rosmarinus officinalis
cggccgggggaccgaacgccacagaaaacactcagacaccccccgagctctctctttctcccttgctttctctgcttcggctcgaaacttctcgtgttcttacctgatatggcgctcaggacgaggatttcgggtcgaatcttcacgtctggagctgtgtttggagctcgatccatgtcgtcgtggtggcggaacgtggaaccagctccgaaggatccaattcttggagttaccgaagcgtttctggctgatcccaatcccaacaaagtcaatgtcggagttggagcttaccgagatgacaatggaaagccagtggttttggagtgtgtcagagaagcagagcagagaattgccggaaacttgaatatggaatatcttcctatgggaggaagcataaaaatggttgaggaaacactgaagttggcttatgggcagaattctggcttgattaaagataagaaaattgcagcagttcaagctctctctgggactggtgcctgccgtctttttgcagatttccagaaacgtttttgtcctgattcacaagtttatattccagtccctacctgggccaatcatcacaatatctggagagatgctcatgtccctcagaacacgtttcactattatcatccagggactaaaggcttggactttgcttccatgatggatgacataaagaatgcaccaaacgggtcatttttcctgctacatgcctgtgctcataaccctactggagttgatccatcggaagaacagtggagagaaatctcacaactgtttaaggtcaaagggcattttgccttctttgacatggcttatcaaggttttgccagtggtgatccagaaagggatgctaagtctattaggattttccttgaggatggtcatcaaattgggtgtgcccaatcttatgcaaaaaatatgggactttatggccagagagtaggctgcctgagtgtggtttgtgaggatgagaagcaatccgtggctgttaagagtcagttgcagcaacttgccagacccatgtacagtaacccacctgttcatggtggtttgattgtttctatcattctcagtgacccagacttgaagaaattgtggcttaaggaagtgaaggggatggctgatcgcatcattggaatgagaactgctctaagagaaaacctggagaagttgggttcacctttgtcttggaatcacataaccaaccagattggtatgttctgctatagtggcttgtctcctgaacaagttgatcgtttgacaaatgactatcatatttacatgactcgcaatggtcgtatcagcatggcaggagttacaacaggaaatgttggttatttggcaactgctatccatgaagtcacaaaatctggttaggacttactttaataacatattcagaaataatcaaccgaaaggcaacaaatttacagttttataacatcatttagatctttttcttcatcttcttctgaacaagagatcctgcaattagattggagagatatatgttgaattctcattttaggcaaaactgagatgagataggttcggacttgagggtccattatttggtttgaataaatgctggtgggttcagttaaaagtaattgatttgttgcctccaattttgggaccgttct

SEQ ID NO: 2706 - DNA, 1472 bp, Chrysanthemum coronarium
acgatggcatcgatgatgacgagaaaatcaatgttcatgatgaagtcgaggtcgatgattcatgggtcatcacgattgatgtctacatcctggtggaaacacgtggaaccagctcctaaggatccgatacttggtgttactgaagcttttttagcagatcctagtccaaacaaagttaacgttggcgttggagcttatcgtgatgataacgggaagccggtggttctggattgtgttagagaagcagagagacgggttgctggaaacctgaacatggagtatcttccaatggggggaagcaaccagatggttgacgagacactaaagttagcatacggggagaattctgatttgatcaaagataagcgaattgcagcaatacaagctttgtctggcactggtgcatgccgaatttttgccgacttccaaaaacgcttttctcctgattctcagatctatattccagtcccaacctggtccaatcaccacaacatttggagagatgctaatgtaccacaacggacatatcattattatcatccagaaacaaaaggtcttgatttcgcctcgctaatggatgatgttaagaatgcaccaaatggctcattctttatgctacatgcttgtgctcataaccccacaggagttgatcctacaatagaacagtggaaagaaatatcttaccagtttaaggtcaaaggtcattttgcgttctttgacatggcttatcaaggctttgcaagtggtgatccagagagagatgcaaaatctattaggattttccttgaagatggccatctaattggatgctctcaatcatatgcgaaaaatatgggtctttatggccaaagagtcggttgccttagtttggtatgtgaagatgaaaaacaagcggtggctgtgaagagtcaattgcagcaacttgctagacccatgtacagtaacccacccgttcacggtgcacttattgtttcaacgatactgggtgatcctgatctaaaacaattatggcttaaggaagtcaagggtatggctgaccgcataatcggaatgagaagttctcttagggaaaacatagaaaagttgggctctcctttatcatgggaacacgtaactaagcagataggcatgttctgctatagtgggatgacacctgaacaagtcgatcgcttgacaagcgaattccatatttacatgacccgcaatggtcgtattagtatggccggggttacgagtggtaacgtcgaatacttagcaaaggctatccatgaagttacaaaagctgcttgagggctcagattttttctgcagtttgggttaaaattagtgtcggctatttttccctgagaatgttctaaataaaataaaaggtttaaaggcacttttaccatttcatgagttttgcatgtgctcgtagtggatagtgattgttgttgtagagaactttgataagttctattattgttagcaaa

SEQ ID NO: 2707 - DNA, 1317 bp, Ambrosia trifida
caccctcaacttttccatcggaatccaactccggcgatccaaacccacactacagagtcatcacttgttcaatcaatggctatacgagcagcactcaccaaacggatcataaccaggagcttacacggctcgcgatccatgtctcgtggtggaaaaacgttgaacctgcacctaaagatcctattcttggtgtcactgaagcttttttagcagatcctagtccagataaagttaatgttggcgttggagcttatcgtgatgacaacgggcagcctgttgtacttgattgtgttagagaagctgaaagacgagttgctggtaacctcaacatggaatatcttccaatgggaggaagcaacaacatggttgaggaaacattgaagttggcatatggtgaagattctgacttgattaaagataaacgaattgcagcaatacaagccctttctggcaccggtgcatgcagaattttcgctgatttccaaaaacggttttcccctgattctcagatctatattccagtccctacctggtctaatcaccataacatttggagagatgctaatgtaccacaaagaacattccattattatcatccagaatcaaaaggtctggatttcgcctcactgatggatgatgttaagaatgcaccaaatgggtcattctttttgttgcatgcttgtgctcataatcctactggagtcgatcctacggttggaacaatggaaagaaatatcttaccagtttaaggtcaaaggtcattttgctttctttgacatggcctatcaaggctttgcaagtggtgatcctgaaagagatgcgaaatccattaggattttcttgaagatggtcatttaattggatgctcacaatcatatgctaaaaatatgggtctttatggccaaagagttggctgcctcagtttggtatgcgaagatgaaaaacaagctgtggctgtgaaaagtcaactgcagcaacttgcaagacctatgtacagtaatccacctgttcatggtgcgcttattgtttcgattatccttggtgatccagatctaaagcaactgtggctcaaggaagtcaagggtatggctgatcgcataatcggaatgagaacttcactcagggaaaacattgaaaagttgggatctcccctatcatgggaacacataactaaccaaattggtatgttctgctatagcgggatgactcctgaacaagttgatcgtttgacaaaagaatttcatatttatatgactcgcaatggtcgtattagtatggcaggggtcacaagtggcaatgttgaatacttggcaaaag

SEQ ID NO: 2708 - DNA, 1652 bp, Brassica juncea
gccatttatctttaagcaacttgcatctctctcattcgtcctcatctgccctctttacttcctacgagtcgccacctcctcccatcatttcatatagtataaaatcccctctcacaacgattctcttttcttctgtgcgtttttagagttatggcggcgatggcgatgacaatccgtaactctgcttcgcgtcgaacgatgacgagcggtccgatctcaggtttgagatccatgtcttcgtggtggaagaacgtggagcctgctcccaaagatccgatcctcggtgtcaccgaggcgtttctcgccgatcctagtcccgacaaagttaacgttggtgtgggagcatatcgtgatgataatgggaagcctgttgtattggagtgtgtcagagaagctgagcgtaggattgctggcacctccttcatggagtatcttcctatgggagggagtgtcaaaatggtggacgaaacattgaagcttgcctatgggaacaactctgaatttatcaaagataaaaggattgctgcagttcagtctctctctggcactggagcttgccggctctttgcagacttccagaaacgttttcgtcccgattctcagatctacattcctgtacctacctggtccaaccaccacaacatctggagagatgcacaagtccctcaaaagacataccattactatcatccagaaaccaagggcttggatttctcaggattgatggatgatgtcaagaatgctcccgaaggctccttcttccttcttcatgcttgcgcgcataatcctactggagtcgaccctacagaagaacaatggagagagatatcacagctattcaaggccaaaaatcattttgcattcttcgatatggcctatcaaggttttgcaagtggtgatccaaagagagatgccaagtccatcaggatctttctcgaggatggtcatcatattggaatttctcagtcttatgcgaagaacatgggactctacggccagagggtcggatgtctcagcgtgctttgtgaagatgaaaagcaagctgtgactgtgaaaagtcagttgcagcaactagctagaccaatgtacagcaacccacctttacatggagctcaaatagtctcaaccattcttggagacccacagttaaagggcctgtggctaaaggaagttaagaccatggctgatcggataattggcatgagaactactttgagagaaagccttgagaagttaggatcgcctctgtcatgggagcacgtaaccaagcagattggaatgttctgctacagtgggctaacaccagaacaggttgaccgcttaactagcgaatatcacatctatatgacccgtaatggccgcatcagtatggccggtgttacaacaggaaatgtgggataccttgcgaatgcaatacatgaagttaccaagtcatcttaaattgctttacatgtctcaagttagagataaatttgtttctttctgaagagttaataagacagaggaagctacaacatttgttcttcttcaattgttttggtggggactgaaagtcttacccacaaacagtatcttatcagcgcaataaattcttgaattatctttaaaccgtcttttagttgatttcacatgtttctgtctgcttggttacg

SEQ ID NO: 2709 - DNA, 1663 bp, Brassica napus
ggcacacacagtccaaagccattatctaagcaacttgtgtctcgttctcccattcgtcctcatctgcccttaacttcgcacgagtcgccacctcctccttctttcatataaaatcacttccaacgattattctctttttttctttctctgtgcgttttgagagttattatggcgatggcagcgatggcaatccgtaactctgcttcacggggaacgatgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgaacgtaggatcgctggcacctccttcatggagtatcttccaatgggagggagtgtcaaaatggtggacgagacattgaagctcgcctatggggacaactctgagtttatcaaagacaaaaggattgctgcagttcagtctctctctggcactggagcttgccggctcttcgcagacttccagaaacgtttccgtcccgattctcagatctacattcccgtaccaacctggtccaaccaccacaacatctggagagatgcacaagtcactcaaaagacgtaccattactaccatccagaaaccaagggcttggatttctcaggattgatggatgatgtgaagaatgctcctgaaggctccttcttccttctccacgcttgtgctcacaatcctactggagttgaccctacagaggaacaatggagagagatctcacagctattcaaggccaaaaaccattttgcattcttcgacatggcctatcaaggctttgctagtggtgatccagcgagagacgccaaatccatcaggatctttctcgaggacggtcatcacattggaatctcccagtcttatgctaagaacatgggactctatggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagccttgagaagttagggtcgcctctatcatgggagcacgtaaccaagcagattggaatgttctgctacagtgggatgacaccagaacaggttgaccgtttaactagcgagtatcacatctatatgacacgtaatggtcgtatcagtatggccggtgttacaacaggaaacgtgggataccttgcgaatgctatacatgaagtcaccaagtcatcttaaattgttttacatgtctcaagtccagagataaatttgtttctttctgaagagttaataagacggaggaagcttacaacatttgttcttcttcaattgttttggtggggactgaaagtcttacccacaaacagtaacttatcagcgcaataaaattttgaaccgcctcttagttgatgacaaatgtttgactgcttaaaaattcgag

SEQ ID NO: 2710 - DNA, 1651 bp, Chrysanthemum coronarium
ctatctggcctgggtgggcatctcttcaaaacccaacaacaacattaaactcaatattccaacctcttttaacattaaactcacctgtgaaatatctatagaaatatggcatcggtgataacgaaaagatcgatgtccatgctaaaatcgagctcaacaacgatttacgggtcatcacgattgatgtccacgacatcatcgtggtggaaaaacgtggaaccagcacctaaggatccgatacttggtgttactgaagcttttttagcagatcctactccccacaaagttaacgttggcgttggagcttatcgtgatgataacgggaagccggtggttctggattgtgttagagaagcagagagacggattgctggaaacctgaacatggagtatcttccaatgggaggaagcaacaagatggtcgacgagacattaaagttggcatatggggagaattctgatttgatcaaagataagcgaattgcagcaatacaagctttgtctggcactggtgcatgccgaatttttgctgacttccaaaaacgtttctctcctgattctcagatctatattccagtcccaacctggtccaatcaccataacatttggagagatgctaatgtaccacaaaggacgtatcattattatcatccagaaacaaaaggtcttgatttcgcctcgctaatggatgatgttaagaatgcacccaatggctcattctttatgctacatgcttgtgctcataaccccacgggagttgatcctacaatagaacaatggaaagaaatatcttaccagtttaaggtcaaaggtcattttgcgttctttgacatggcttatcaaggctttgcaagtggtgacccagagagagatgcaaaatctattaggattttccttgaagatggccatctaattggatgctctcaatcatatgcgaaaaatatgggtctttatggccaaagagtcggttgccttagtttggtatgtgaagatgaaaaacaagcggtggctgtgaagagtcaattgcagcaacttgctagacccatgtacagtaacccacccgttcacggtgcacttattgtttcaactatacttggtgatcctgatctaaaacaattatggcttaaggaagtcaagggtatggctgaccgcataatcggaatgagaagttctcttagggaaaacatagaaaagttgggctctcctttatcatgggaacacgtaactaagcagattggcatgttctgctatagtgggatgacacctgaacaagtcgatcgcttgacaagcgaattccatatttacatgacccgcaatggtcgtattagtatggctggggttacgagtggtaacgtcgaatacttagcaaaggctatccatgaagttacaaaagctgcttgagggctcagattttttctgcagtttgggttaaaattagtgtcggctatttttccctgagaatgttctaaagaaaataaaaggtttaaaggtacttgcaccttgtcatgagttttgattggttgtagtggatagtgattgttgttgtagagaacttcgataagttctataccagtagcggtttaagctgcccaaatctttagaataaacacatttgtttctttggaaatggcttttacatgatattagcatg

SEQ ID NO: 2711 - DNA, 1843 bp, Plantago ovata
tctacatatcagcagcactgttctttttcttgagtcttctttcttcctttattacatctcatctagaacctaccctacaatggcgcaagttattcgggccgggcgttcgggtcggataaccagctctgcttttgcacgatccatctccacagcttggtggcgccacgttgagccggctcccaaggatcccatcctcggagtcaccgaggcttttctagccgatcctagtcccgagaaagttaatgttggagtgggtgcttatcgcgatgataacggaaagccggtggttctggagtgtgttagggaagcggaaaggagaatcgctggcaattcgaacatggaatatcttccaatggggggaagtgtgaaaatggtggaggaaactctgaagcttgcatatggagaaaactctgacttgatcaaagataaacgaattgcagcaatacaggctctatcagggactggtgcatgcaggatctttgctgacttccaaaagcgtttttcccctgactcacaagttttcattcctgttcccacctggtcaaatcatcacaacatctggagagatgccaatgtcccacagaaaacattccgttattatcatccagaaacgaaaggcttggatttcagttcattgatggatgatgtaaagaatgcaccaaatgggtcattttttctgcttcatgcttgtgctcataaccctactggagtggatcctacagaagaacagtggaaggagatctcacaagaattcaaggttaaaggacattttgccttatttgacatggcataccaaggttttgctagtggtgatccggagagggatgctaaatcaattcgaatttttctcgaggacggccacatgattggatgtgctcaatcatatgcaaagaatatgggactttatggccagagagttggttgtctgagtgtggtttgtgaagatgaaaaacaagctgtggctgtgaaaagtcagttgcagcagcttgctagaccaatgtacagtaacccacctgtccacggtgcgcttatagtctctaccattctgggtgatccagacctgaaaaagttgtggctcaaggaagtgaaaggaatggccgaccgtatcattggaatgagaacttctctaagagaaaatctggagaaattgggctcacctctttcatgggagcacataaccaagcagattggcatgttttgttatagtggaatgactcccgaacaagttgataggctgacaaaagaattccatatatacatgactcgaaatggccgtatcagtatggctggagtcacttcgggcaatgttggttacttggcaaatgccatacatgaggtcaccaagtaaggttaagaacgttcatagtgaatcaatcagcattgataggtcagagatcaatatagactgggatctgagtcttcatatttctcaatacacctgaaaataagatgcattattcatgcaccacatttttgtaaccagttgtttactcatctatcgaaggtagagatgacgcattgaacattcaataaagtagaatggattcttgaattgaaagattacaatgttcttctttgattcaatcagagaaatcagtaatttgctgtagtgtaattttgacatttggagcagaaaaccaaattgttgtgatactatacaagcatctacttatttgttgctacaagtcacactgttgaaaagaataactagggtgttacaatattattcccacttccacaggattgttgataattgaacttgcttcaggtttagataacactcacaagactattcacataaggcagaaaactgacaacagtcaacgaagaatccactcctgcc

SEQ ID NO: 2712 - DNA, 1531 bp, Brassica oleracea
cgcaacttctccattaacaaatatcaacgcttcccctacgattctctccctgtgcgtttaaggtggaaagaaaagcgttatggcgatgatggcgatgacaatccgtaactcggcttcacgtcgaacgatgatgagtcgtccgatcttcggttcgagaagtatgtcgtcatggtggaagaacgtggagcctgctcccaaagatccgatcctcggagtaacggaggcttttctcgctgatcctagtcccgacaaagttaacgttggtgtgggagcatatcgtgatgataatgggaagcctgttgtcttggattgtgttagagaagctgaacgaagaattgctggcacctccttcatggagtaccttcctatgggagggagtgtgaaaatggtggaggaaactttgaagcttgcctatggggacaactctgaatttatcaaagacaaacgaatcgctgcagttcagtctctctccggaactggtgcatgccgactctttgctgacttccagacacgtttcagtcccgcttcacagatctacatccctgttccaacctggtccaaccaccacaacatctggagagatgcacaagtccctcaaaagacttatcattactatcatccagaaaccaagggtttagatttcaaaggattgatggatgatgtgaagaatgctccggaaggctcattcttccttcttcatgcctgtgctcataatcccactggagtcgaccctacagaggaacaatggagagagatctcacagctattcaaggccaaaaatcattttgcattcttcgatatggcctatcaaggttttgccagtggtgatccagcaagagatgccaagtccatcaggatctttctcgaggatggtcatcatattggaatttctcagtcctatgccaaaaacatgggactctacggccagagagtcggatgtctcagcgtgctttgtgaagatgaaaagcaagccgtaactgtgaaaagtcagttgcagcaactagctagaccaatgtatagtaacccacctttacatggagctcaaatagtctcaaccattctcggagacccagagttaaagagtctgtggctaaaggaagtcaagatcatggctgatcggataattggcatgagaactactttgagagatagccttgagaagttaggatcgcctttatcgtgggagcacgtaaccaagcagattggaatgttctgctacagtgggctaacaccagaacaggttgaccgcttaacaagcgaatatcacatctatatgacccgtaatggccgtatcagtatggctggtgttacaacgggaaatgtgggataccttgcgaatgctatacatgaagtcaccaagtcatcttaaattattttatttacttatatctccagccaaacatgatttttttcttcttgttgacgagtcaataagacgcaggaagctatgttctccttcaattgttttcgtgggaactgaaggtttatccacaaacagtaaaattctcagcgcattttgttcttagctgcg

SEQ ID NO: 2713 - DNA, 1496 bp, Ricinus communis
agaaagggtttgcacaggaaaagcaagggaatggctttcagaagcgcgatcacacgccggttgatcaggcagaagaagaatgcgatgggagcaagatccatgtcattatggtggcagagcgttgagccagctccaaaagatccgatcctcggagtaaccgaggcttttcttgccgacccaagtcctgctaaagtcaacgttggagttggtgcgtacagagatgataatggaaagccagttgttttggaatgtgttagagaagcagagcgtagaattgctggcaacttaaacatggaatatcttccgatgggagggagtgtgaatatggtagaagaaacattgaaattagcctatggagagaattctgagttcattaaagacaaaaggatagcagcagtgcaatccctctctgggactggagcatgccgactttttgcagattttcaaaagcgttttcgacctgattcccaaatctacataccagttccaacatgggctaatcaccataatatttggagagatgctcaggtccctcaaaacacctatcattactatcatccagagtccaggggcttaaattttgcagcactgatggaagacgttaagagtgctccagatggctcattctttctacttcatgcttgtgctcataatcctactggtgttgatccatctgaggaagaatggagagagatttcacatgtattcaaggtaaaaaatcactttgccttctttgatatggcgtatcaaggttttgctagtggtgatccagagagagatgcaaaatccatcaggattttcctcgaggatggtcatcatattggcattgcccaatcatatgcgaaaaatatggggctttatggccagagagtaggatgcctcagtgtgctctgtgaagatgagaaacaagcagtggctgtaaaaagtcagttgcagcaacttgcaagacccatgtacagcaatccacctgttcatggtgcacttatagtctcgactatccttggggacccagacttgaagaaattatggctcaaggaagtgaaggtaatggctgatcgcatcatctccatgcggatggctctgcgagaaaaccttgaaaaactgggttcacctttgtcatggaagcacattactaatcagattggcatgttttgctatagtgggatggcacctgaacaagttgatcgtttgacaaaagaattccatatctatatgacctgtaatggccgaatcagtatggctggcgttacaacaggcaatgtgggatatttggcaaatgctatacatgaggtcacaaaatctggttaggctcatgagcagaagctagaggttataggtgcatactgcatagggtgacagtgtgaaaggagttaaatatcttcttttcttttctttttttccctcttcccctttaatgatttgggaagggacaataaattatttctgctggagtcaagttcctgcagtgttgagcagagtacaatttacagaccata

SEQ ID NO: 2714 - DNA, 1994 bp, Cicer arietinum
aatttgtataagttatggaattagaattagttatatatatatatagttgaacaatgggtcaaattagaattaaataaaacacggaagtcgattaaaaaaattagaatcccaaatagtaattgaagaaaaagacagaatcacataaacataaaccgttttttgtgtttagtcttttgagttccgacttctctttcaattcttcttctctatctctctactctctttccatttcaaccaacccatgtcaattcgcaattttctcccaatccggagctccgttaccggagctaggttcatgtcatcgtggttccggagcatcgagcaagctcccaaggatccaatcctcggagttaccgaagcttttcttgctgatcagagtccaaacaaagtcaatgttggagtcggtgcatatcgcgatgacaacggaaagccggtggttttggaatgtgttagagaagcagagaggagaattgcaggaaaccaattcatggagtatcttccaatgggtggaagcataaagatggttgaagaatcactgaagctggcatatggagacaactctgagttcatcaacgataaacgaatagctgcagtgcaggctttatctggaactggtgcatgtagactttttgccgcatttcaacagcgttttcatcccaacacccaaatctatataccagtgccaacttgggccaaccaccataacatttggagagattctggagtgcctctgaagacattccgttactatcatcctgaatctagaggattggatttttctggactgatggatgacattaagaatgctccagatggttccttctttctgcttcatgcttgtgctcacaatcctacaggagtggatccttcggaagaacaatggagagagatctcttcccagatgaaggctaaaggtcatttccctttctttgacatggcatatcaaggttttgctagtggcaatccagagagagatgcaaaagccatcaggatttttcttgatgatggtcatttattgggacttgctcaatcatatgcaaaaaatatgggactttatggccagagagtaggatgccttagcttgctttgcgaagatgagaaacaagccgtggctgtaaaaagtcagttgcagttgattgccagacccatgtacagtaatccacctcttcacggagcacttgttgtttcaactgtccttggtgatccagagttgaagacgctatggcttaaagaagtaaaggttatggccgaccgcatcatcggaatgagggctactctacgagagaacttggaaaatctggggtctcctttgccatggcagcacataactaatcagattggcatgttctgctacagcgggatgacaccagaacaggttgatcgtttgacaaacgaatttcatatttacatgacacgtaacggtcgaataagtatggctggtcttaatacgggcaacgttggatatgtggctaacgctatcaacgaggttacaaaatcagcctagatattcatttgtgcagagaccaaatttttgtcctaggaaacaacaaacacctcagaagtagtattattgagaggagcacaaaaaaatttgagcacttataaccatttattatgcagtttcactgtgtttcatttgtgattcgataggctgaataatttgaagagtagattgaataagagatttcatgaatgattattaatgactgtgcttacagttttactatactgtgaaaaggattattcttggctgtgaatctttacgattttgttgatgttagaacggaaatttaaaaacttagggttattttgatagtcgttataagttgtggattgagaccgatgagtgcggctatgtcatgctaacatttctgcctatgttggaaatagaataacaactttgtgaaggtaattctaaaagttatttaatgttgataaaaactttgtgaagataattctaaaaggtaatttgaatgaagataaaaacttgtaac

SEQ ID NO: 2715 - DNA, 1647 bp, Chrysanthemum coronarium
ctatctggcctgggtgggcatctcttcaaaacccaacaacaacattaaactcaatattccaacctcttttaacattaaactcacctgtgaaatatctatagaaatatggcatcggtgataacgaaaagatcgatgtccatgctaaaatcgagctcaacaacgatttacgggtcatcacgattgatgtccacgacatcatcgtggtggaaaaacgtggaaccagcacctaaggatccgatacttggtgttactgaagcttttttagcagatcctactccccacaaagttaacgttggcgttggagcttatcgtgatgataacgggaagccggtggttctggattgtgttagagaagcagagagaaggattgctggaaacctgaacatggagtatcttccaatgggaggaagcaacaagatggtcgacgagacattaaagttggcatatggggagaattctgatttgatcaaagataagcgaattgcagcaatacaagctttgtctggcactggtgcatgccgaatttttgctgacttccaaaaacgtttctctcctgattctcagatctatattccagtcccaacctggtccaatcaccataacatttggagagatgctaatgtaccacaaaggacgtatcattattatcatccagaaacaaaaggtcttgatttcgcctcgctaatggatgatgttaagaatgcaccaaatggctcattctttatgctacatgcttgtgctcataaccccacgggagttgatcctacaatagaacaatggaaagaaatatcttaccagtttaaggtcaaaggtcattttgcgttctttgacatggcttatcaaggctttgcaagtggtgatccagagagagatgcacaatctattaggattttccttgaagatggccatctaattggatgctctcaatcatatgcgaaaaatatgggtctttatggccaaagagtcggttgccttagtttggtatgtgaagatgaaaaacaagcggtggctgtgaagagtcaattgcagcaacttgctagacccatgtacagtaatccacccgttcacggtgcacttattgtttcaactatacttggtgatcctgatctaaaacaattatggcttaaggaagtcaagggtatggctgaccgcataatcggaatgagaagttctcttagggaaaacatagaaaagttgggctctcctttatcatgggaacacgtaactaagcagattggcatgttctgctatagtgggatgacccctgaacaagtcgatcgcttgacaagcgaattccatatttacatgacccgaaatggtcgtattagtatggcgggggttacaagtggcaacgttgaatacttggcgaaggctatccatgaagttacaaaagctgcttgaggtctcagtttttttctgcagtttgggttaaaattagtgtcggctatttttccctgagaatgttctaaagaaaataaaaggtttaaaggtacttgcaccttgtcatgagttttgattggttgtagtggatagtgattgttgttgtagagaacttcgataagttctataccagtagcggtttaagctgcccaaatctttagaataaacacatttgtttctttggaaatggcttttacatgatattag

SEQ ID NO: 2716 - DNA, 1964 bp, Petroselinum crispum
ctaccccctctctcctcctctaccgtgtaaatatatatagagggactattccccatttctttcgtttccgtgtctataatcatatctcgtctcccagtaactttttcaaaacacagctcgatggcgttgcggagtgcaaattccagtgcgatcatcagtcggagctgtttatacggagtgcgatccatgtcttcgtggtggcgtaacgtggagccggctcccaaagatccaattctcggtgtcactgaagcttttttggcagatcctagtcccaataaagtcaatgttggagttggagcttaccgtgacgatgaaggaaagccggtggttttggagtgtgtgagggaagctgaacgtagaattgctggcaatctccacatggagtaccttcctatgggaggaagcgtgaatatgattgataaaacactaaagcttgcctacggggagaattcagacttaatcaaagatagaagaattgcagcaattcaagctctctctggaactggtgcatgccgtgttttcgcagaatttcagaagcgattttcccctgattcccaaatttacattccagtccctacatggtccaatcatcacaacatatggagagatgcccatgtcccacaaaggacattccattattatcatccagaaaccaaagggttggattttgcttccctgatggatgatgtaaagaatgcacccagtggatcgttctttctgcttcatgcctgtgcacataatcctacaggagtggatcctacagaggaacaatggaaggagatctcataccagttcaaggttaaaggacattttgctttcttcgacatggcatatcaagggtttgccagcggagacccagagaaagatgcaaagtctatcagaatttttctcgaggatggccatctcattggatgttcacaatcatatgcaaaaaatatgggactttatggtcaaagggttggctgcctgagtttggtttgcgaggatgaaaagcaagcagtggctgtaaagagtcagttgcaacagattggcagaccaatgtacagtaatcctcctgttcatggtgcactacttgtttcaactattcttggtgaaccagacttgaagaaattgtggctcaaggaagttaagggcatggctgatcgcatcataggaatgagaacttctctgcgagaaaaccttgaaaatttgggctcacctctgtcatgggagcatataacaaatcagattggcatgttctgctacagcgggatgacgcccgaacaagttgatcgtctgacaaatgattttcatatttatatgacccgtaatggtcgcataagtatggcaggtgttactacaggcaatgttggatacttggccaatgctattcatgaggtcacaaaatctacctagattcttgttgcaaacattttagccagagaataatatagcaggcggccgcagccataaagtttattatatggtgagattttttaaatacctttaatcccttttctttttcttttcaactgatatgatcaaggctatgtgccgattatattttaatgaactaataataacatattgtagttagtgcaaactcaaagatttgttaatcagcctttggcttggttatatgtgatccaaggatgcaacatgttcaagttacatgaaaacattttgttctatgaatatttgaccagtagtggtttgcatttcactgtgtttttattttgctcaactgaagatattcttccccaatggatttgattaggacacttgtggcaaatgctggtcatacttctagtaaagttgttctagcaagatgaacttgctgttcagaaatctttgctatatgatttaaaaatattcgcaatgaggatttagagagatggccttttgcaaaagtttcattctatcctctttcccatataatcaccttcttttctccacaaatgaatttagcaaaaaacatatattat

SEQ ID NO: 2717 - DNA, 1773 bp, Cajanus cajan
tcaacggtaagacatgacactcaccgtttcctctgtctcccctgtttccgcctcactcactcatgccgattcctaactcgctcaccgctccaattctccgccggagcaccgtcgccggagttaggtccatctcctcctggttccggagcatcgagcccgctcccaaggacccgatcctcggagtcaccgaagctttcctcgccgatcagagtccaaacaaggtcaacgtcggagtgggtgcgtatcgcgatgacaatggaaagcctgtggttttggaatgtgttagagaagcagagaggagaattgctggaaacgacttcatggagtatcttcctattggtggaagcataaaaatggtagaagaatcactgaagttggcttatggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagactttccgttactattatcctgagtctagaggattggattttgcaggactgatggatgacataaagaatgctccagatggttccttcttcttgcttcatgcttgtgcccataatcctactggagtagatcctacagaagaacaatggagagagatctcttcgcagataaaggccaagggtcatttccctttctttgacatggcatatcaaggttttgcaagtggtgatccagagagagatgcaaaagccatcaggatttttctcgacgatggtcatttaataggacttgctcagtcatatgcaaaaaatatgggactgtatggtcagcgagcaggatgcctgagcttgctttgtgaagatgagaaacaagctgtggccgtaaaaagtcagttgcagctgattgctagacccatgtacagtaacccacctctccatggagcgcttatagtttctactgtccttggtgatccagagttgaagaagttatggcttaaagaagtcaaggttatggcagaccgcatcatcggaatgcgaaccacactacgagagaacttggaaaagagggggtctcctttgtcatggcagcacataaccaatcagattggtatgttctgctacagtggattgacaccggaacaggttgatcgtatgacaagcgagtttcatatttacatgacccgtaatggtcgtatcagtatggctggtcttaatacgggcaacgtcggatatgttgctgacgctatccatgaggttacaaaatcatcctagattattcaattactcaagtgaccaaatttttgtccttggacacaaacacctcagaagtagtcttgtccaggggagcaaaataaactcaataaagctccgaaacattttcaacttgtttcggagttaggtagtcacacccttcgggatttaccttgcatattgaagacccttatggcattgtatccatttttatagacctcgttttaagtactttgatgtgccccaccgcatatcatcatttttttaataaaataatttgagtagtagattgaagtgaattattattgttagtgaacctttgcgattgttgaagctggaatataagctcgaatgagattaatgaccgcggctaattttgtgtttgaatttgttttgacgccatgactatattttggcctatggtgttggaataacaactttttgtatgcaattgttc

SEQ ID NO: 2718 - DNA, 1620 bp, Eutrema parvulum
tgcgtctctccttcgtcctcatctgctaaactttaaacgagtcgctacttctccaacgctcgctatataataaaatcctccaacgattctctctatctgcgtctgtggttttttgacatcaaagaggtagagacgaagaagattcatggcgatggcgatgacaatccggaacgctgcttcgcggcgagcaatgaatccgatctccgccgatttcagcttgagatctatgtcttcatggtggaagaacgtcgagcctgctcctaaagatccgatcctcggagttaccgaggcttttctcgctgatcctagtcccgataaagttaatgttggtgtgggagcatatcgtgatgataatggcaagcctgttgtcttggaatgtgtcagagaagctgagcgaaggattgctgggagctccttcatggagtaccttcctatgggagggagtgtcaaaatggtggaggaaaccttgaagcttgcctatggagacgactctgaatttatcaaagacaaaagaatagctgcagttcaagctctgtctggaactggagcatgccgactgtttgcagacttccagaaacgattttgtcccggttcacagatctacattcctgtaccaacctggtccaaccaccacaacatttggagagatgcagatgtccctcagaagacatatcattactatcatcccgaaacaaaaggcttgaatttctcaggattgatggacgatgtgaagaatgctccggaaggctcgttcttcctccttcatgcttgtgcccataatcctactggagtagaccctacagaggaacaatggagagagatatcacagctattcaaggccaaaaaacattttgcattctttgatatggcctatcaaggttttgctagtggggatccagcgagagatgccaagtccatcaggatctttctcgaggatggccatcatattggaatttctcagtcctatgcgaaaaacatgggactctacggccagagagtcggatgtctcagcgtgctttgtgaagatgaaaaacaagccgttactgtgaaaagtcagttgcagcaactagctagaccaatgtacagcaacccacctttacatggagctcaaatagtctcaaccattcttggagacccagagttaaagagtctgtggctaaaggaagttaagatcatggctgatcggattattggcatgagaactactttgagagaaagccttgagaagttaggatcgcctctatcatgggagcacgtaaccaagcagattggaatgttctgctacagtgggctaacaccaaaacaggttgaccgcttaacaagcgaatatcatatctacatgacccgaaatggccgtatcagtatggctggtgttacgacagggaatgtgggataccttgcgaatgctatacatgaagtcaccaagtcatcttaaactatttatatacatgtctcaagccaaacataatattttttttctcttcttgaagagtcaataagacagaggaagctatgttacttcttcttcaattggtttcgtgggaactgaaagttttattcacaaacagtaaacttatcggcgcatattttttcttagctgcgcaatacagacacaaaagc

SEQ ID NO: 2719 - DNA, 1349 bp, Panax ginseng
aagcagtggtatcaacgcagagtacatggggaacactctttcgtttctctctcttccataacagtcaagaggcttcttctgtacctcgatttcacaccatacagatggcgctcccaactgcaatttccaaacgattcctcagtcctagctcggcctatggagcgcgatcgatgtcctcatggtggcgaagcgtggagccctccccgaaagacccaattctcggtgtcaccgaagcttttcttgcagatcccagcccggataaagtcaatgtcggagttggagcttaccgtgacgataatggaaaaccggttgttctcgagtgtgtcagagaagctgaacggagaatcgccggaaatctgaatatggagtatctcccaatgggaggaagcttgaagatggttgacgaaacactgaagcttgcctatggggagaattctgatttaatcaaagataaacagatagcagcggttcaagctctctctggaactggtgcatgccgactttttgcagattttcagaagcggttttgccctgattcccaaatctacattccagtccctacctggtccaatcatcataacatatggagagatgcccgcgtcccacaaaggacattccattattatcatccagaaaccaaagggttggattttgcttccctgatggatgacgtaaagaatgcaccaaatggatcattctttctgcttcatgcttgtgcacataatcctacaggggtggatcctacagaggaacaatggaaagagatatcttaccaattcaaggtcaaaggacattttgctttcttcgacatggcatatcaaggttttgctagtggtgatccagagaaggatgcaaagtctatcaggatttttcttgaggatggccatctaattggatgctcccaatcttacgcaaaaaatatgggactttatggccaaagagtcggctgcctcagtgtggtttgcgaagatgaaaaacaagccgtggcagtgaaaagtcagttgcagcagcttgccagaccaatgtacagtaatccaccggttcatggtgctctaattatttcaactatccttggtgatccagacttgaagaaattgtggctcaaggaagttaaggacatggctgaccgcatcattgggatgcgaactactcttcgagaaaatcttgaaaaattggactccccactttcatgggaacatataactaatcagattggcatgttttgctatagtgggatgacacctgaacaagttgatcgcttgacaaatgaatttcatatttacatgactcgtaacggtcggattagtatggcagggattactacaggcaatgttggatactaggcgaat

SEQ ID NO: 2720 - DNA, 1048 bp, Oryza sativa
gtttggttcttgcttttttctttcatctgccaattgcttcctaggagttgttatttggggggaaattttcaggagttcttgacatttcctcttcagattgcacatacagaaatggagcggttggatcaaattatcagaccaaagagtcaaatgcttctattcatttcagttctcaactacagcttctgatcaagaacgcaaactttcccaattatacacagcacatccccatacacgcacacaaacacgctaattttctcacaaaatctcgatcccctctgaacagattactaagcttgattattcccttctctacatgctacatccaatccccaacccaaaaaaaaagggaaaagaaactaggcaaaaactacaagtgaagggggcaaattgaggagaaaacaagatgcaagagagattcacaatcgcacaagctgatgacgtgcgggccgcgggcgattgtagccgacatacatgtatccgatcaataggaagaagagaggtgtcaccgggccgggcgtctagcggagggcgcgggcgaggccggagaggatgcgggagaggccgaggcggaagcggaagatggcgccctgggagtacggcgcgcagtcgcggaagacggcctcgatcgcctcgacgaagaggctgaggctccgcaccggcggcacgtacagcgtcagcggcgccgccgagaaggccagcgccatcagcagctgcagcatcgccacacctccaagaccaaaatcaccaccagcttagctccctccccacgaccagatccagggaggcagccggccggagacacggtgtgtctagccagatggaggagtggacgccgcggccgcgcacggtgctttgctaattgctagtagtagccgtggtgatggtggtggacttgatggcgtggtggtggggttttttttttcctttttttggtctcgcgcgacgcgcggtgcggtggtgcgtgtggtggactggttggttttggcctgtgcgtcgggggcggaaacgcgatacggtggcgagggcgaggtgagcggccgtgcgg

SEQ ID NO: 2721 - DNA, 1815 bp, Setaria italica
gccacctcagacctcactcccacagccaaagccgccgaaaacgagacgaaaccaaaccaaacctcccagcctcttcccctgcaccgcgtctccaccagaccagatcaccaccagacgccgcgcgataggagaagaacacgcgcgcgtcccccgccaccagacgctcgccgtgccgcccccgccacaccagtagctagctacctcaccgtccgtcccgtcccggcgggcccgtctcagcaataacaagactccctccgcgccgcacggtgccgaccgaccggccaagtcgccaagacaagatctggttggttcttcgggggcacgaggaggcgcgctcgcccgtcgtcggagccgccgggcggagatgctgcagctgctgatggcgctggccttctcggcggcgccgctgacgctctacgtgccgccggtgcggagcctcagcctcttcgtcgaggccatggaggccgtctgccgcgactgcgcgccatactcccacggcgccgtcctgcggttccgcctcgggctctcgcgaatcctcgccggactcgcgcgcgccctccgctaatcgtcggtcggctcggatcggattcctctcctcctgctcatacacacacgccgcgtatggtactgcatacaacacctcgtgctgcctcttcatcttcttcgtcttcagttcttcttgctccctttctggtagagttctagcgcaatccatggagtagcagttagttttgcaatccttctgttttctcctccttttttttttccttttccttttgatgaggattgggtgtagcatgtagagctggagataaaggttgttaataatctgtccaaaggggagattttgtgagagatgatgagggaatgaatatgaactagtgtgtttgcgtgggatgtgaggtaatccccctaggaatctgatgtcctttgtatagcagttgtgacttgggaatgcatcgcttgagaatttccgcagttcaatttgtcttgccaatgcttgaatttgacaacttgatacggacacggaactctatttgactatctattttgatccaactgtttctgacatgaaacctcatcccctttttggttcgatccatttgttcaattgctgtgttctggaaaccgacaagcaaatgccaaggaacggccgacgcgatgtgctcccccagagttgagttgctagctgcagacacgaggaagagattgggggaaacttattagctctttcgtgggagctgattctccgagagcggttgaaaatgattttcttttattttctaacataaactttaaaattagggtggagaatcatttaataggattaggagaagctattttttaagctcgaatcactttacagagaagctctaaaaaaatatttgtcagctctgaaagctctactaaacgcacccagaaaaattattcggcagagcctccattcggagaatcagccctgggggtctgccaaaacgtatctttacttacacagcagctgttgcgactgattggtcacggcattaggtttgacgagctggtgcagcagagctaccattctaatgcaaacgatgccgacctctcgccgacgcggtgttgaataccagtttctgtagccatctggctacgccaagcatccttagcccctcgcacgttcccgcacaagcgtcagtcagatggtcagtcaggcgaccatttcacacacagcacaatgccagtgtgccagcaatgataaaccccgaatggagtcggtcagggagattagttttctgtcggaggaacggatcgttcgaatatacttattacagtacaccc

SEQ ID NO: 2722 - DNA, 1556 bp, Sorghum bicolor
cgcgctcgcacagccaaaaaaaaccgacagccgccgaaaacgaaacgcgacgaaaccccccttgcaccgcgtggatccgctgccgaacaccacaccatcccaccctgacgagcagagcaaagcttccttttgcctcccccaccccccatctccagttctcctccaccaccaaacccaccagccaccgctcaccagacactggcctttccctccataacacccccccgtcccccgtgtcccgtgccgcccaagccataagctgccagccgcctggatctgatcatctatctgattggattggctcttgtcaccggggggcgaagggaaccaaggtccaacgaggaagaaccagcaccagctagcaggcgttgttcgtccaagaacaccatcagcaagagatgctgcagctgctcatggcgctggccttctcggcggcgccgctgacgctgtacgtgccgccggtgcgcagcctcagcctcttcgtcgaggccatggaggccgtctgccgcgactgcgcgccctactcccacggcgccgtcctccgcttccgcctcggactctcccgcatcctcgccggcctcgcgcgcgccctccgctaggcggccggcgggcccccatcgccgcctccgggttcctccgatcctcctgcccatacatacacacgcacacgcacgtatggtgaccttcttggttcttgctccattctttctctgtcctttccactactagccaacaggtggtttctagcgcagcacagcagtctatatgcaggactagcagttaatttagttccccaaatctttctgctttctttcttccgttttgttctctcttagtcttatcttttccctttttttgaggattgggtgtagcatgtagagtggagaaaaggttaataatctgtccaaaggggagattttgcaagacgagatgctgaggaaatctagtgtgcgtgtgtgtgtgttttgcttgtgatgggagaggtaactcccttaggaattccatgtgatgtgaatattccttggtctgtatattggcaacttcagtttcagttgaggatttgcggtttgattcgtcttcctttccaatgcttccttcgagtgacaagttgggatggatcatcttttcaagaaaacaagttgggatcgaattgtttggtgcaatccaagccaagcgtgcaacctccgtacgtgtcaaaagttcttttgtgcggtttctaactgcaagctgacaaatcaaatgcaacggaacgaccgacgcgacgctctttctccgaagctcctcgcgaaaacacagctaggtcgaggaagaagagacggtcaccggggaacgaactttacaaaacagttgctgcgactgattagtcacggcattagtactagagtaggtttcaagaattggcaggcaggcagccagacacagctccagttctctaataacgcaatgtaagtgatggcgacctttcgccgacgaggaacaacagtagcataattctagtattttctgtaaccatcacttgcattagggcgtgtttagattgggaacgaaaatttttt

SEQ ID NO: 2723 - DNA, 487 bp, Panicum virgatum
ccccctcactgccaaagcaagccgccggaaacgagacgccccggcacctcttcttcccctgcaccgccgcgtctccaccaccagaaaaaaacacgggcccccaccacagcagcctccagccgctactactagctacctaacctcccgtcccgacgggacaccgccgttgccgaccggccggccaagatctggttggctcttggcgcgggcgagggggcgcctcccgtacgccttccgccggagggagatgctgcagctgctcatggcgctggccttctcggcggcgccgctcacgctctacgtgccgccggtgcggagcctcagcctcttcgtcgaggccatggaggccgtctgccgcgactgcgcgccctactcccacggcgccgttctgcgcttccgcctcggcctctcgcgcatcctcgccgggctcgcgcgcgccctccgctaggccgccgcgcttgccccgctcggatcggagtcctctcat

SEQ ID NO: 2724 - DNA, 1625 bp, Panicum virgatum
gctgcgtgcatcggcacactgaattccgccgccccgggaagagaagccttccaagtcctctcgctcccctccagaagacgctggcgttcccgtgcaccgtgcttatcctcccctcccctttggcacgcgcacgctataaaaggccaaatccaacacggcccggccacctcattcactcgcgcagccaagccaaagcaagccgccggaagccgcgagacgagcccctcctccctctacccctgcaccgcgtcacgcgtgtccaccactagaaaaaacacgggcgcatcccccgccaccagacgcgctcgctcgccgtgccactgccgcccccaccacaccagccgctactactagctacctcaccttacccgccgacgggcccccccgtctcgacaacgcgccacacctcctgtacgcctttcgccggagatgctgcagctgctcatggcgctggccttctcggcggcgccgctcacgctctacgtgccgccggtgcggagcctcagcctcttcgtcgaggccatggaggccgtctgccgcgactgcgcgccctactcccacggcgccgtcgcgcgcttccgcctcggcctctcgcgcatcctcgccgggctcgcgcgcgccctccgctaggccggcgcgtccccccccgatcggtcgtcgtctcggatcggagtcccctcatcctgcctagtgcctacccacacacgccgacacgcgtatggtacctgcaagcaagaccttgtgctcttcttccgcttcttcttcctccccttctttgccctttctagtactagcttctaatgcaatccacatggagtagcagttagctttgcaatctttcttctgtttcctccgtttttcccctttcttttttttcccccttttgatgagggattggattgggtgtagcatgtagagctgggacattgaggttgacaataataatctgtccaaagcggagattttgtgagaggtgatgagagggaatggatatgaattagtgtgttctgcgtgggttgtgaggaatctgatgccctttgtacagcatttgtgacttgagtatgatgcatcggttgagaatttgcagtttaattcgtcttgccagtgcttcaatttgagaactttgagatggaaacggaactccttttgactttgattttgatccaagtgttccatttctgacctcaaaagctcctccactttccggctcggagacggcaggcacgacgaagggattggggaaaaactcgcagaacagttgttgcgactgattggtcacggcattaagctcgacgaggctccggtttctctaatgcgaagcgatggcgacctctcgccgacgcggtgcggaataccagtttctgtagccatcgtgctacgcccagcatccatcctagcgtagccccttgcacgttccctcccaaagtgtcagtcagtcagtcaggcgaccatttcccaattcccacacagcgcaatggcagtgcgccagcacaataggccccaaatggtcactggtcagtcagggagattagttttctgtcggaggaaatggaccgtacgaatgaatataaaaataagggctgtgtttagttgtaaaatctttctcagcaaactatactattcac

SEQ ID NO: 2725 - DNA, 885 bp, Panicum virgatum
atgggccactatgcgcgtcatcccgttccgttcaggatcgcctgctttgtgtcgacgtcaatttgcttccgttctccgtacagacgcaaaccgagcgggcagtggaagtttccgatccgcttctcccggcggcgcgcgcgcgagggtctagtgcgaagcaaagaacgttccacgcggaaggaaatgcctttcgcttacataatcaatcggcaactattctctcggagcgcactagaaaagaaaaccagtttctccgaggaaactgtcgggcatgccgccacgcgggtcgccgctgcctgcgtcggcacactgatttgtgatttccgccgcgccgggaggagaaggctcactcgctcgctcccctccagaagacgctggcgttcccgtgcgccgtgcttatccccatggcacgcgcacgctataaaacggccagatccagcacggcaacgccccctcactgccaaagcaagacgccccggcacctcttcttcccctgcaccgccgcgtctccaccaccagaaaaaaaaacacgggcccccaccacagcagcctccagccgctactactagctacctcacctcccgtcccgacgggacaccgtcgttgccgaccggccggccaagatctggttggctcttggcgcgggcgagggggcgcctcccgtacgccttccgccggagggagatgctgcagctgctcatggcgctggccttctcggcggcgccgctcacgctctacgtgccgccggtgcggagcctcagcctcttcgtcgaggccatggaggccgtctgccgcgactgcgcgccctactcccacggcgccgttctgcgcttccgcctcggcctctcgcgcatcctcgccgggctcgcgcgcgccctccgctag

SEQ ID NO: 2726 - DNA, 1783 bp, Zea mays
cagcaggctcgcgttccttgccgtgcttatcttatcccccgcacgcggaatggccagatggaatggaacacggacaccccagcaggctataaaaatggccagatggaatggaacacggacaccacaccccgcacagccaaaaccgcgagccgccgtatacgaaacgcgacgaaacccttacgcgcacggcgcaccgcgtcctgctctgccgaacacacaccacacaccccgacgggcaggcaaagcaagctgctctcgcctcccccaggccccaccccgtctccaccacagagccgcccgcccgctcgccaccagacgccccacgccagacgcccagcccaagagccagccgcgcctgtcgatcgatcgcggggggccaaggcccaagggaacgatcttccaagatgctgcagctgctgatggcgctggccttctcggcggccccgctgacgctgtacgtgccgccggtgcgcagcctcagcctcttcgtcgaggccatggaggccgtctgccgcgactgcgcgccctactcccacggcgccgtcgcccgcttccgcctcggcctctcccgcgtcctcgccggcctagcgcgcgccctccgctaggcgcccccgcgtcaccgccgggtcccttctttcctctgtcctcctttctaccgataccgagagcaggtgggttctagcgcaggcagcacagctagcaatctactatactacatgcaggactagcgcgaaatcttttttttttttgaggtttgggtgtagcatgtagggtgaggaaaggttaataaatcaatccgaatgaaggggagattttgcacgagatgctgaggaaatctagtgtgtgtgggggcgtgagaggtcagaattccatgtggtgttaacataacaaagttcttttgtgcggtctctggctgcaaactggaaaggcacagctaccaactcttcggtctaggtaggtttaacaaaagcacttgttgcttgcggctgactggcacggccacgtaggttttgagaactggcaggcggacaggcacagctccaaccctccgataacgcaagtgaccgacggcgaccctttgccgaacgatcgctacagtagcatagttctagtgttttcgctgtaaccatcaatcaagctggagatgcgcgtctaggtccagccagcgtttgctttagccgttcgttggtacggtcgctaacaagtgtcagccagatggcgacctcccacgcaacggcagacgtactggcagtgtgccagcagtggtcagcacgcatccagatgcgcgtcagcaagatgttactagaaaggaaagaaaaaaaaaaggtctgtctcacgagctactacaaaatccgtcccaagcaaataatcagattcagaggacagtacggtacatctggcgcgcggtactgtgtgctggtacacggtcgcaccgacgccgagtaaacaaaactgaacctctgacaaatcgatccgtttcagccaagacccaaaccccaaaaatggccagcgcaatcacgcaccgattttttttatattgtcatcaaaactactaccgcatccaggtcgttccactcagcagaggacgtgcccaaactttcgcgtgatttcccgcgagatggtcaaatcactgtcatagttgaggtcaactatccaggcacgaagcttctttcatcgttcctctgcaacgcgagtgggcaacacatggcatcatgccatgccactaggtctaggtcgtcgtccttagcttccaagaaccacctggagcttccaactgtggggg

SEQ ID NO: 2727 - DNA, 632 bp, Saccharum officinarum
atctgattgggttgcctcttgtcgcggcctcgcgggagccaagggaaccaagggggaagaaccagcactagcaggcgttgttcgtccaagaaccatcaacaagatgctgcagctgctcatggcgctggccttctcggcggccccgctgacgctgtacgtgccgccggtgcgcagcctcagcctcttcgtcgaggccatggagaccgtctgccgcgactgcgcgccctactcccacggcgccgtcctccgcttccgcctcagactctcccgcatcctcgccggcctcgcgcgcgccctccgctaggcgcgcggcggttggccctgattcgcgacgccgtattccccactcccttctgtctatccactcgctcacaccgtatggtgacgtctttgctcccttcaggcgtctgagcctgcgactactcttgagggatggggtttttagcgctaagagaaccgtctctcgccaacgctctggtgtccggtgaccggaaccttgggtgcccgcttccccctggatgactgctctgaggcgcgatagccggcggggtgtccggagctctagacgggcgctcccgctgcataaatgtcgataaggcgtctggcgcgtgtgccggattagccctcctagc

SEQ ID NO: 2728 - DNA, 1000 bp, Zea mays
tgacttggagggaagcattggatcggaaaggaagacgatgaatttaaaccgcaaatcctcaacttaaactgaagaatcattgccaagttacagacaagggaatattcacaaatcacatggaaattcctagggggagggggagtcgtccctcacatcccataaccccaggcaagcaagcacactagatttactcagcatctcttgcaaaatctccctttttggacagatttattaacctttcctcactctacatgctacacccaatcctcaaaaaaaaaacagaaaagaaagagagagcacaaaaagggagaaacgaagcaggaaagatctcgaaactgaccgccgctagtcctgctcctgcatgtagattgctgtgctgcgctagaaaccacttcctcgctagtaatacaaaaaggacatagaaaccagggagagcacaaggtcaccgaacgtgcgtgtccgtgtagtatactgtatatactcctgtaggcaggaggaaccggcgccggcgatggggtgccggcctgcctagcggagggcgcgcgctaggccggcgaggacgcgggagaagccgaggcggaagcgggcgacggcgccgtgggagtagggcccgcagtcgcggcagacggcctccatggcctccacgaagaggctgaggctgcgcaccggcggcacgtacagcgtcagcggggccgccgagaaggccagcgccatcagcagctgcagcatcttggacgagaacgcacgcctcctggttcttcctccccttccccttcgcccccgcgacgagagccaacccaatcagatccaggcggctcggtcttggcctcttgggcgtatggcgtgggatacgggagtgttatgaggcagtgagatgggatgggagggacagacaccgtgatgcggcgagggaaaggcgagcgtctgatggcggggcgtgccgcgagcggtttggtgctgatgggtattcccatgtcttaaataggcagatatagagatc

SEQ ID NO: 2729 - DNA, 1499 bp, Zea mays
gcaccaaaccgctcgcggcacgccccgccatcagacgctcgcctttccctcgccgcatcacggtgtctgtccctcccatcccatctcactgcctcataacactcccgtatcccacgccatacgcccaagaggccaagaccgagccgcctggatctgattgggttggctctcgtcgcgggggcgaaggggaaggggaggaagaaccaggaggcgtgcgttctcgtccaagatgctgcagctgctgatggcgctggccttctcggcggccccgctgacgctgtacgtgccgccggtgcgcagcctcagcctcttcgtggaggccatggaggccgtctgccgcgactgcgggccctactcccacggcgccgtcgcccgcttccgcctcggcttctcccgcgtcctcgccggcctagcgcgcgccctccgctaggcaggccggcaccccatcgccggcgccggttcctcctgcctacaggagtatatacagtatactacacggacacgcacgttcggtgaccttgtgctctccctggtttctatgtcctttttgtattactagcgaggaagtggtttctagcgcagcacagcaatctacatgcaggagcaggactagcggcggtcagtttcgagatctttcctgcttcgtttctccctttttgtgctctctctttcttttctgttttttttttgaggattgggtgtagcatgtagagtgaggaaaggttaataaatctgtccaaaaagggagattttgcaagagatgctgagtaaatctagtgtgcttgcttgcctggggttatgggatgtgagggacgactccccctccccctaggaatttccatgtgatttgtgaatattcccttgtctgtaacttggcaatgattcttcagtttaagttgaggatttgcggtttaatttcatcgtcttcctttccgatccaatgcttccctccaagtcacgatcgacaagttgggatggaaacggaactcctcttcccttctgtttgtttgggccaggcgtccaacctccgtgcttgaaagttcttctgtgcggtttctctgacagcaaaccgacaaagcaaaagatttggttacattaaatggcacagagcgaccgacgcgacgcgacgcgacgtacttgcgaagctcgatcgctcctcgcgaaaacacaggcagcaagcagagtcgaggaagaagacgacgcgcggggcggggcagcgaatgatttggttacattacagctccagttctataataacacacacaatgaatgcgagtgatgctgtgatggcgacctttcgccgacgatgactacagtagcataattcttaagtgctttccgtaaccatcgcttagccgtgcgtccagcgtgcctagcgccgttggcttggcaccagaagagatcagttggtcagacggcgaccgtttcccggtccccacgcaatggtaggctggcagtggtgagcgtatccagaaaatggtgtcagggagatcacagtc

SEQ ID NO: 2730 - DNA, 1177 bp, Hordeum vulgare
gcccgagtctcccacgtcgagtgaacctacgccgatcttatcgggttatcccctccgccgccgggctggctataaatcacagcccgagaaagacaaggctccctcacaaacccacccaaagccggccgcaccgcaccgaatctctcacgctccctcgccgtggccgcgaaggtgaaggcgaaggcgcacgctccaccaaccaccaactccaatccaccacgcgctcaccgaggggccgaggcagaggcagagcgcgtgatcaccaccaccacaagaggagctcgccgcgccgcaggccatccatataactctcgccttcttggtcgctgctgctcgatcgaccgggcaagaagaagaagaagcggcaggagagcgaggggtggctggatctgcgggtggaaggggtcgaggaggagcgctggcgatgctgcagctgatgatggcgctggccttctcggcggcgccgctgacgctctacgtgccgcccgtgcgcagcctcagcctcttcgtggaggccatggagaccatgtgccgcgagtgcgcgccctactcccagggcgccgtctcccggttccgcctcggcctctcccgcatcttcgccggcctcgcgcgcgccctgcgctagacacccgacgcgtccggcgagcagatcgaccctccttctcgccgtaggtacatgtgcagtacagtgcaggggcacgccgcccccacgccgccgtgccatgcgtgcagcggctgtgctcgtcttggatcttgcttagttgttgtcgttttgagtagcttctacacataatcgctagcttgtttctcgtttggagtagcatttagagaaggaagtgggtaataatctctgcccaaagatgagctttcgtgagagagagatcgtgagaagatgcataccatacagtcttcttcttcttcttcttcttctgtagttgatgccatgcgaggcagtccatccatgagaaagtttgttgtgatctgtacataaatcatgctgctactagttgggaaagtttgcgtgttcttgagatgtcgatccaacttttgacatgtaatggaagaaagaccttgacttgttgatccggtcagtgtcccatctctctgcatctgtacgcgcgaatcaggctgcgtgatttccgctcgggtgacgaggaaatgccaaccactccaccat

SEQ ID NO: 2731 - DNA, 1085 bp, Hordeum vulgare
tcacaaacccacccaaagccggccgcaccgcaccgaatctctcacgctccctcgccgtggccgcgaaggtgaaggcgaaggcgcacgctccaccaaccaccaactccaatccaccacgcgctcaccgaggggccgaggcagaggcagagcgcgtgatcaccaccaccacaagaggagctcaccgcgccgcaggccatccatataactctcgccttcttggtcgctgctgctcgatcgaccgggcaagaagaagaagaagcggcaggagagcgaggggtggctggatctgcgggtggaaggggtcgaggaggagcgctggcgatgctgcagctgatgatggcgctggccttctcggcggcgccgctgacgctctacgtgccgcccgtgcgcagcctcagcctcttcgtggaggccatggagaccatgtgccgcgagtgcgcgccctactcccagggcgccgtctcccggttccgcctcggcctctcccgcatcttcgccggcctcgcgcgcgccctgcgctagacacccgacgcgtccggcgagcagatcgaccctccttctcgccgtaggtacatgtgcagtacagtgcaggggcacgccgcccccacgccgccgtgccatgcgtgcagcggctgtgctcgtcttggatcttgcttagttgttgtcgttttgagtagcttctacacataatcgctagcttgtttctcgtttggagtagcatttagagaaggaagtgggtaataatctctgcccaaagatgagctttcgcgagagagagagatcgtgagaagatgcataccatacagtcttcttcttcttcttcttctgtagttgatgccatgcgaggcagtccatccatgagaaagtttttgtgatctgtacataaatcatgctgttactagttgggaaagtttgcgtgttcttgagatgtcgatccaacttttgagatgtaatggaaaaaagaccttgacttgttgatccggtcagtgtcccatctctctgcatctgtacgcgcgaatcgggttgcgtgatttctgctcgggtgacgaggaaatgccaaccactccaccatcaatcgattttcc

SEQ ID NO: 2732 - DNA, 924 bp, Leymus cinereus x Leymus triticoides
cccctccacctccgcaccgcaccgaatctctccccctccctccccgtggccgcgaaggcgagggcgcacgctccaccaaccaccaatccaccacgcgccgcgaggccgaggccaaggcagagcgcgcgatcaccaccacaagaggagctccctgcgccgacaccaccacctcacagtccgtccgtccctccgtccatataactcgtctcttgtacccgctgctcgatcgatcgggcgggcgtcaggagagagctaccccgatctgctcgtggaagggagggaggcgccagaggaggaggaggagcgctggcgatgctgcagctgatgatggcgctggccttctcggcggcgccgctgacgctctacgtgccgcccgtgcgcagcctcagcctcttcgtggaggccatggagacgctgtgccgcgagtgcgcgccctactcccagggcgccgtctcccgcttccgcctcggcctctcccgcatcttcgccggcctcgcgcgcgccctgcgctaagccggacgcgcccgacgcctgcagatccttcttcttcttcttcttgccataggtacatgtgcgccacaccagggtcagggccacgcccccttgtgcagcgcagcggctgtgctcgtcttggatcttgattacttagcttccacccatagtactagttgctagttttgttctcgttttgagtagcatttatgttaagagaagaagtgggtaataatctctgccaaaagaggagtttttgtgagagatcgtgagaagatgcatacagtcttgttatgtggtggatgcgagctagtccacgagaatttgttgtcatctgtacataatcatactgctactagttgggaaagtttgtgtgttgctgagatgttcatcggttgatccaacttttgatgagatgtaatacatggaaga

SEQ ID NO: 2733 - DNA, 931 bp, Triticum aestivum
ccacgcgtccgcaaagccggccgctttcccctcccccgcaccgcaccgaatctctccccgtggccgcggaggcgaaggcgagggcgcgcgctccaccaactaccaatccaccacaagaggagctccccgcgccgccaccaccacctcacagactcgcagtccgtccatataaccctcgtcttcttggtggccgctgctcgatcgatcgaccgggcaagaagaagcaagaagcggcaggagagagcgagagctagctggatctgctcgtggcggggatcgaacaagaggagcgctggcgatgctgcagctgatgatggcgctggccttctcggcggcgccgctgacgctctacgtgccgccggtgcgcagcctcagcctcttcgtggaggccatggagacgctgtgccgcgagtgcgcgccctactcccagggcgccgtctcccgcttccgcctcggcctctcccgcatcttcgccggcctcgcgcgcgccctgcgctaagccggacgcgtccggcaagcagatcgatccttctccttcttcttctcgccgtaggtacacgtgcgctacaccatggacagggccacgcccccttgcgcagcgaagcggccgtgctcgtcctggatcttgattacttagcttcatatagtactactagttgctagctttgttctcgttttgagtagcatttagataaggaaatgggtaataatctctgcccgaagaggatttttcgtgagaggtcgtgacaagatgcatacggtgttcttatgtggtggatgtgatgcaaggtagtccatgagaaagttcgttgtgatctgtacataaatcatactgctgctaccagttgggaaagtttgtgtgttcttgagatgttgatcgaactgttttgagttgtaatggaagagcttgacttgttgattcggtcagtgt

SEQ ID NO: 2734 - DNA, 1681 bp, Brachypodium distachyon
tcagctcctcttcttcgcctggctataaaactcgagctgaagaaagacaaaggcccgatcacaagtcccaaacccctttcccctcctcctcagctcgtcaccgctcgccgtcgccgcaagggcaagaaggcaaattaagcgcgcgacacgaagccaccgcaagaactttttcaccactgcaccagcaacaattcggcgagccgagcgcttctggtacttttctctcccccacacttcttctggatctgcaccccgggagagcgcgcaaggtggcgatgctgcagctgatgatggcgctggccttctcggcggcgccgctgacgctctacgtgccgccggtgcggagcctcagcctcttcgtggaggccatggagtccatgtgccgcgagtgcgcgccctactcccacggcgccgtcgtccgattccgcctcggcctctcccgcatcttcgccggcctcgcccgcgccctgcgctaggcggacgcaccaccaccagcagcagcagcacggtgacaaacagatccttcctcttcctcctatagacacatgtgtgggctatacaactcgcgaggcacgccctttgttgccgctgtgcagctcgtcttggatctctgcttacttttcttcgcccttccgtagcttccacgacactagttaatgtagtttttctcctcctttttggtgggttggatgtagcatgtagactgtagagaaaaaactgggggaataatctgaccaaaggggagattttgtgagatatcgtgaggagattttagtgttttgacgcgcgtgaatgtgaggcagtacaggagaatttgttctgctgtgtacataatcgatcatgtagtagttggcaagagtttgtgttcttgagatgtttcagtctccaacttgagatgtaatgggtctgcctttgatttgctgatccgatcagtgtttgagatgtaatggatctgcctttgactggttgatccgatcagtatttttccatttctattttgtgcaattgcaaatcaggtttctatgttttctgtatgtgcgaactgcaaaggaaatgccaacaactcctgcagtggacaaaacgaggaagaaggggaacaaaactccaacagggctgattagtttgcggcatcaggtttgacgacttggcagaattgcattctctattgcaaattgatcgcgactgttcgccgacgcggtgccaatcaatcaaatactgtataatttctgtggccattacgcctctggttgttcccacgttcccctacagccaagtgtcacaaatcaaggctactgatttcacagctggacaactcctgccgtgaaactgagccaacacttgtaaagcccagacgctctcatggagataacatacaacagctactattcaatctttggaagaatagactatttaagcgtgccatataatattacacctgggcaatataatccaatactgtgatgctaagttatgcttgtgaaacaactgaactttcgatgtcaacaatgctcccatgccaagtttctagaaggtctacaacacctaaccattttattattccagcgaaacagcagccagatgccggcgtgtgctggtcgctaacttcgacatactctatcgacgatccttccatgtttagcaaccgcatttttcgcgttgactagcacaagtggcacacaga

SEQ ID NO: 2735 - DNA, 2186 bp, Zea mays
gcacgttctgccgccccgcatcccgtccgcctcgccctctggccctccccgcggcaatctcggcgctcgccctccccagcggcaatctcggtgtcccccgcagcaagctcggcctcccctgcggcaatctcggcgtcccccacaatcacggtgtctatccctcccatctcaccgctgcctcataacactcccgtgtcccacgccatacgcccaagaccgagccgcctagatctgattgggttggctctcgtcgcgggggcgaaggggaaggcgaggaagaaccaggaggcatgcgttcgtccaagatgctgcaactcctgatggcgctggccttctcggcgaccccgctgacgctgtatgtgccgccggcgcgcagcctcagcctcttcgtggaggccatggaggccgtctgccgcgactgcgggccctactcccacggcgctgtcgcccgcttccgcctcggcctctcccgcgtcctcgccggcctagcgtgcgccctccgctaggcgggccggcaccccatcgccggcgccggttcctcctgcctacaggagtatactacacatggacacacacacgcacgttcggtgaccttgtgctctccctgctttctatttccttttgtactactagcgaggaagtggtttctagcgcagcacagcaatctacatgctggagcaggactagcggtcagtttcaagatctttcctgcttcgtttctccctttttgtgctcggtgcgacgtcacgcccagatcccgtgctcacctccccgcaatcaaggtcgtcacgcccgacgaggatggccgccagtcgtcgcacatgttcagataggttgatgatactgaagtcatctgttttttgctgcaaactgaaataattcatctgtgcttgcgaaccatggagatgggtagtgagctatccaaaactgcatagaagcaggagctcgcacggcagttggatctcatcgccaggcaggtggaagtgtggttccagaacacacatgttcagataacacacatgttcatgcttatgctgaccccacacaggttcatatcgtcttctgcgtgtatgtagttgtttcttcttcaattctctttgtggggaaaacgttaattgggattttcccagcaatcagcttgataggcgacatcgtcattgtgggggttttggaaggtggtgcagttgtcaggactcttagagatcatagtattccttctaatggggatatcaatgaaagagcaaaggcaaaaagtccaatatatttattatcgggactacgaaggagatcaactttggaccaagtcatcacgagagaaaggaatctattggagcacctataaaattggatgtggaagctcatgctcatattcagaagcataggtatgccaatctataaaattggatgtggaagctcatgctcacattcagaagcatagcgtaatcttacatattcagaaccaaaggctgatgaactggcagcatcagaaatggcagttgcatatagctcctcgaattgggtattattagttgagggatgacatccatctactgctgattccaagaacggaagcatttatctgatgtcctgttaagtgtgtgcaaggtcattggatgactgcattccatttggcttatcgagataatgcatttgcttataccctaacttgtaatcaatactggcaacattgtcatctgggcggcatgaattagtgatccttccagagaaacgaactatgcaaaacaaatgtcatattaataatctagaaacatgtttgagatgggttttatctattgatgaggagcctgttaagaaatgtttggttcgcctgtagctgcaaggaatgctaacttttttttgggttcgtctctgcggaggatgccattgttagttgtaaatattggcggcatattaggaaacaaattatccctatttgagttgcacacacatttcatgttattagtgtgaatttgtgagatattgaggttgatgatatatatgttgttcatttccatatgatcgttatgcactaacagttatcgaataatttatacgccgtcgcaacgcacgggcacatacctagtatttatattaattaagctcaaacgaggtgacaatatttattttcaattcagtttagctctatttaaggataaatcaaatagtatgtttattctgaagcccac

SEQ ID NO: 2736 - DNA, 786 bp, Setaria italica
gaaaccccgaccccatttaaagcctcggatcgcccgatcggacgatgcaagtccacatccagagtccaaaaacgtccgatccaatcttccagttctcagtccaagcgacagttgaagcaaaggtttcccgtccggcaatgattctggtggcgatcgtggcggagctgctggaggagtacacggcgctggtggcccgggtgctggagcagctgctcaacgacgcgcccttcccgcgccggatgcgcttcctcatgctgcggagcctccccttcgtgccgccgcccgggcccccgccgccgccgtcgcacgccctccgcgtcaccacccgaggctgatcagaacctgcaggccttcggtttcagccagcccgccacgaacggcgccatgaccaaccgcatgcccttccgcgcgagagccggctgatcagataggtcgagccacggtgtgttccattcgtttcgactttcaagcagtttgattttgctagctcttcgctagtgctgtaaaggaagagttcatgctgtacttgaggattcatttcgttccttataatattactggtgatatgttcaataaggagactttgacagaaaaatgatgtcgagacatttgcgagctcagtttcttttggataactaggcaggttggcgcgctatgcgcgcccgaccaaagatcttaatctgaattaacaatgaataatgacaaggtatatgattttagaaaaacggtgtccatctccaatttccaaataaatgaagtcatcatacaaaaaggccaaaatggaag

SEQ ID NO: 2737 - DNA, 629 bp, Pennisetum glaucum
ggacgatgcaaagtccacatccatccagaactcccaagtcccaaaacgtccgatccaatcaaccagtcccagcgacagttgaaggtttcctcagctcggctcgctcccgtccggcaatgattctggtggcgatcgtggcggagctgctggaggagtacacggcgctggtggcccgggtgctggagcagctgctcaacgacgcgcccttcccgcgccggatgcgcttcctcatgctgcggagcctccccttcgtaccgccgcccgggctcccgccgccgccgccgcacgccctccgcgtcaccacccgaggctgatcgaccggaacctgcaggctccttcttccggttccggttagcagccagcccgcgcacggagccatggctaacaaccgcacgcccttcttccgtgatccagtgccgactgatcagatagcaggtcgaacaaccacgttgtgtcccaaactccccattcgtttcaacttccaggcagtttgatttcgctagctctttcgctagtgctgtaaagaaaagagttcgtagtgctgtatttgaggattcattttgttcctgtaaatattgctggtgatatgtaccatgaggagacttcgacccaaaaatggtgatcaagag

SEQ ID NO: 2738 - DNA, 1321 bp, Sorghum bicolor
cacgagacaggtgtaccttttttttactaaacggagaaagcatttgtttgaggccaccaaccatgggcagctatctgccgagcggtttctggtgttggggcccgtggaaaccgcggccgtggcgcagtcgtgcaggtgcagccagcagccgcgagagttgagccggcaccggtacatcggatatgttcgcggccacgcgcgacaccgtgcgctgtttctggatcccccaaccaaaccacgggccgacgcgcgaaagcgaaccgagccgagccgtatcttccctcggcttctagcgcataccagcagcgcgtcgcgcgggcgcaacggcagccgccaccgggtcacatcaaaccagggcacgccgctgcccaccggacgcgacacgcagcgagtccagcttccccacctgatctcatcgtcgtcatctcccctccccgaaagccgacgacgccttttaaaagcctcgcatcgcccgctcggacgatgcaagtccacatccagaattccggggtccgctgtccaagaccaaatccaaatcccaattcccaccaatccccagcggagattttgaaagcaggctcatctcgttccttgcagcaatgattctggtggcggtagtggcggagctgctggaggagtacacggcgctggtggcccgggtgctggagcagctgctcaccgacgcgccgttcccgcgccgcatgcgcttcctcatgctgcggagcctccccttcgtgccgccgcctctgcccccgccgccgccgccgcacgccctccacgtcaccacccggggctgatcgatcgatcgatcggcttcatttcagggcggctttcagctggcccgccatggccacccactaggtagcctgtgcttgaggcagctgatgaacacagattaggttgttgatcaatgatccacggtgtgtttcgttcgtttctcgctttccttttatcagctcttggctacacggatttaatactgtctctgtctctttgaagactcatttgtcatttgttctgtaaatattcttggtactatgaaccatgagaagactttctttgacactttcttgagctccatacgtgtctggataatgcgcgataagatactttcgctgtaccatgggcagcaatagcaatacgatgcgtcaccttcactgctggctgagaaatatctagacacttctggacacgctttagggcattgtttagatgcgaattttttttggattttgctactgtagcactttcgtttctttgtgacaaatattatttaattatagacttactagaatcaaaagattcgtatcgtgatttacag

SEQ ID NO: 2739 - DNA, 386 bp, Sorghum bicolor
cctccccgaaagccgacgacgccttttaaaagcctcgcatcgcccgctcggacgatgcaagtccacatccagaattccggggtccgctgtccaagaccaaatccaaatcccaattcccaccaatccccagcggagattttgaaagcaggctcatctcgttccttgcagcaatgattctggtggcggtagtggcggagctgctggaggagtacacggcgctggtggcccgggtgctggagcagctgctcaccgacgcgccgttcccgcgccgcatgcgcttcctcatgctgcggagcctccccttcgtgccgccgcctctgcccccgccgccgccgccgcacgccctccacgtcaccacccggggctgatcgatcgatcgatcggct

SEQ ID NO: 2740 - DNA, 570 bp, Triticum aestivum
aggccagaattccggggtccgctgtccaagaccaaatccaaatcccaattcccaccaatccccagcggagattttgaaagcaggctcatctcgttccttgcagcaatgattctggtggcggtagtggcggagctgctggaggagtacacggcgctggtggcccgggtgctggagcagctgctcaccgacgcgccgttcccgcgccgcatgcgcttcctcatgctgcggagcctccccttcgtgccgccgcctctgcccccgccgccgccgccgcacgccctccacgtcaccacccggggctgatcgatcgatcgatcggcttcatttcagggcggctttcagctggcccgccatggccacccactaggtagcctgtgcttgaggcagctgatgaacacagattaggttgttgatcaatgatccgacggtgtgtttcgttcgtttctcgctttccttttatcagctcttggctacacggatttaatactgtctctgtctctttgaagactcatttgtcatttgttctgtaaatattcttggtactatgaaccatgagaagctttctttgac

SEQ ID NO: 2741 - DNA, 663 bp, Zea mays
cacgcaaggagtccaggttcccccacctcatctcatcttcctccccaatcccgacccccttttaaaagcctcgaccggacgacgatgcaagtccacatccaaaattcccagtccgcgatacaagaccaatccaatccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatggaaaaaactttcctttgacattttctt

SEQ ID NO: 2742 - DNA, 1220 bp, Panicum virgatum
gacagcgacagagcccatcccctgcctaccttccgtacacatgacaccgcatccctcggccgcggcccggaaccccctgaatggccgaattccagatttgtttgacggccgccagcccgctacctgccctcaggccagcccgagcggcttctggtgtcccgggccccgcgcgagtgcaccagacacaacgcgatccagcccgagcccgccgagctggtcgatcggataagtccgcggtgacgcacgcgcccacgccgcaaccgcaacaccggtgcgctgttcctgggttaaccaaaccacgggccggtgcgcgaaggccagcacaaccgttacctttcttccctctgcttccagcggataccagcagcgcgccggcaccgccaccaccgggtcacatccaaaaccagcgcgcggctgcccaccggacgcgacgcggcggcgagtccacgggctcggcggctgcacccgatctatctccctctcctccccactcctccagagaggacgaaacccccgaccccttttaaagccttggaagtcgaccggtcggacgaagcaaagtccacattcagagctccgagtccaacagcgtccgatccgatcccccagcccagcaggcgacagtcagtggaaagcaggttccctcccgtccggcaatgattctggtggcgatcgtggcggagctgctcgaggagtacacggcgctggtggcccgggtgctggagcagctgctcgccgacgcgcccttcccgcgccggatgcgcttcctcatgctgcggagcctccccttcgtgccgccgcccctgcccccgccgccgccgccgcacgccctccgcgtcaccacccgcgcggcctgatcacttccgatccggcttccgccccgcccgccgtggccaatcgcatgcccgtgccggaggcggctgatcgtcagataggttgatctatccacggtgtgtttcgtccgtttctcgcttcgttttgtcgattagctctcctggatactagtacaccggttgctgtaaataacagtcttggagaattcatttgttcctgtaatttcttggtaatatgaagttatgaatcatgaaaagacttctttgtaacccaaaaataattgatgtgaagaggcattttattttagctccgtgcctttggataaggcgcggtacgacttttgctgtaaaaaggcaatacgatgtgtcactttcagcgtttcaccg

SEQ ID NO: 2743 - DNA, 342 bp, Panicum virgatum
atgtgtcgtgcttgtaccatctgcgcccaccttcgcgtgggactatcggtgatgtttcgatcgggacctgcagctggtggaagcgcagccggccagggtcgaagctggtcaggccacgcgggtggtgacgcggagggcgtgctgcggcggcggcgggagcagcggcggcggcacgaaggggaggctccgcagcatgaggaagcgcatccggcgcgggaagggcgcgtcggcgagcagctgctccagcacccgggccacgagcgccgtgtactcctcgagcagctccgccacgatcgccaccaggatcatggccgcacacgggagggagcctgcttccactga

SEQ ID NO: 2744 - DNA, 1032 bp, Panicum virgatum
ggccccgctcgcgcgagcgcgaccccagcccgagcccgccgagccggtcgatcggataagttcgcggtgacgcacgcgcgcccacgccgcaacagcaacacccgggttaaccaaaccacgggccggcgcgcgaaggccagcccaaccgtttcctttcttccctcggcggcttccagttccagcggataccagcagcgcgccgcaaccgccgccaccgggtcacatccaaaaccagcgcgcggctgcccaccggacgcgacgcgacacgcgcggcgagtccacgccaccgcggccaggcggctccacccgacctatctcccctctcgtccccacttctccagagagcacgaaacccccgaccccttttaaagcctcggtggtcgccggtcggacgaggcaagtccacatccagagctccgatcgagtccaacagcgtcccatccgatccccagcaggcgacagtcagtggaagcaggctccctcccgtgtgcggccatgatcctggtggcgatcgtggcggagctgctcgaggagtacacggcgctcgtggcccgggtgctggagcagctgctcgccgacgcgcccttcccgcgccggatgcgcttcctcatgctgcggagcctccccttcgtgccgccgccgctgctcccgccgccgccgcagcacgccctccgcgtcaccacccgcgtggcctgaccagcttcgaccctggccggctgcgcttccaccagctgcagctgccagccagcagcaatcacttcagagcaggcttccgccccgcccgccatggccaatcgcatgcccgtgccggaggcggctgatcgtcacgtaggttgatccacggtgtatttcgtccgtttctcgcttcgttttgtcgattcgatgagctcgctagctagctctcttggaatttggatactagtacacacggttactgtaaataacactgtcttggaggattcatttgttcctgtaaatgttctttttcttggtaatatgaactgtgacggaaccgccaaattaaaactctaa

SEQ ID NO: 2745 - DNA, 1583 bp, Setaria italica
cgcgcgcgggcaccccggcaaaccaccagccgcgcccaccggacggacgccagagcagccaaaattattcggggtcccatttccaggaatcccaacccaatccatcggcggccgttttaaaggccccgagcgccgcccgcgcccaatcactccctcccaccgcaccaccaacactactgttccctttcccgctcccactcccgcgcctctcgcaatctcctcctcatctcgtcttgtcaggcggacaggccacacaccaaatcactagcctgggaggcgggatgatcctggtggcgatcgtggcggagctgatggaggagtacatggtgctggtggcgcgggtgctggagcagctgctccacggcgcgcccttcccgcgccgcatgcgcttcctcatgctccggagcctccccttcgccgcgccgccgctcccgccgccgccgcccgcgcacgcgctccacgtcgccacccgcggctgaagctgaacccgtcggccacgctgataccttgctggtcagtccaaccttgaaaaaaaagctttgctgtagatttccggtggctccgcggcttctcgtcgttgagatgctgaagcgagagcactttctgttccactgatctttgtaaatctgctactactttgtttgtcgaaatcgtggttgatgcagacgagattcgggtggttctgtttttccacttcggattggagtttggatagctcgttgagcagtgtagtacttggtactttagctggttcaggatgtgactagagttcacctttttcccatggcggtcacggtcaggagtggaaggacgtctggatatttcggacagccacgcggcggcggatgctacctgcccggcgttggatcacgatctgacgcctggctgccgaatcgccatcgctggcaaaacagggacagtgggtgggatcgggccccacctctggcttatcggtggcggtccattgctgacgttataggcggcccacatgacgcagttgctaccgatccgtgtcgctcgtccgacggctcagggctcacggctctctagtgctgaagccaatcgaagctcaacgacacgtgtgcggtgtctgcgtgtcacggatccagctccgttgctgacttgctggcgctggtccagtggtccgaccgtgctcaaaagattctcgtgaaggtgaagtcctacatagcgagttttcaagctaggtcaagcgattcctgtgtatagtactgtaaatcgctattgaatcgcaaagttgtttcgtaactacactttcgtacgagcctacgaggcaaaactacagggaaaagggggccatgcatgtttaaaaagggatgaatgggttaggtcagctcgtccagggatgtgcacatccttggtacgcacatttgttatttgtgtcctgcttccaaagtccagacgttcccagctggccgactacttccgactagaagttttggaccttcttttttttttaatcaaccccacaccacaaagatcggcctcgcatcactacagttcgccaccaggaaagtgagcagtggcaactttactccctatccaattatgcatcacgatcatgg

SEQ ID NO: 2746 - DNA, 1056 bp, Pennisetum glaucum
cttcttcccacctcgctgttccctttcctttccctgttccccactccccgcgccctctctcgatcgcaaactcctcgccgtcaccttgtcttgtcaggcggacagacccgcaccatgatcctggtggcgatcgtggcggagctgatggaggagtacacggtgctggtggcgcgggtgctggagcagctgctccacggcgcgcccttcccgcgccgcatgcgcttcctcatgctccggagcctcccgttcgccgcgcccccgctcccgccgccgccgcccgtgcacgcgctccacttcgccacccgcggctgaagctgaagctgaagcctcgcgcgtgcggcgcgtctcctcgctcgctccgtcgctcgtccgtcggccacactctctgattcccctgctggtggtggtcagttcaaccttgaagaaaagctagctttgctgtagatttcctgaagcgagagcactttctgttccactgatctttgtaaatttgttacggagtagtactaccttgtttgtggaaatcgtgattgatgtagaagagatacacgggtggttgtgttttttccactttgtgggttggagtttggatagctcgttgagcagtgtaggagtagctgcttcaggatgtgactagagttcaccctttcccgataatgacggtcaccgtcaggagctggaaggcgtctggacatttcggatagccacgtggcgccggattacttgcccggcgttggatcacgatctgacgcctggctgccgaatcgccatcgctggcaaagcagggacagtgggtaggatccaggcccacctctggcatctcagtgtcggtccattgctgacgttagaggcggcccacatggcgcgatttgttacccatccgtcctacgtgtcgctcgtccgacggctcagacagggttcacggctctccatccggtgctgaagccaatcaaccttaacgacacgtgtgcggggtgtgcgtgttcacgggtcaagctccgttgctgacttgctggggtctagttgtccgaccgtgctcaaaagattctcgtgaag

SEQ ID NO: 2747 - DNA, 587 bp, Saccharum officinarum
gcgccgcccaatctcctcctccctcgtcttgtcaggcggacagccggacaggcatagcgcaccagctaaccatcagccgacagccggcgagcgagatgattctggtggcgatcgtggcggagctgctggaggagtacacggcgctggtggcgcgggtgctggagcagctgctccacggcgcgcccttcccgcgccgcatgcgcttcctcatgctccggagcctccccttcactgcgccgccgctcccgccgccgccaccgccgcacgcgctccacgtcgccacccgcgcctgatcgagcccacgtacgttgcggcgccggctcgccctgccgtcgctctggtatagaggagcactgttcctcaccgtgttttggtactctacgtacttgctgtaattcgattcagtcatgaaaaacaaggtcgtagtaaataaatctgcagtggctccgcggctcctcggtgtctgaatgtctcgctgggaagcatcagcaagaggcagttccaatacacggatctgctatggaaattctctaactaaattggccaaggaatagtagtgactagtgactgaagaacaagagattttg

SEQ ID NO: 2748 - DNA, 1602 bp, Hordeum vulgare
cgcctgccctcggacggtaacaagtcaacaccacatccacatccaaaggagtagacacaaatcccgagctagggaaaaaccgattccctttcttaccgcaccgcgaggcgaaggcgagcctatcaccggcggcgatgttcctggtggggatagtggcggagctgctggaggactacacgatgctggtggcggaggtgctggagcagctgctcaacagcgcgccgttcccccgccggatgcgcacgctcatgctgcggagcctccccttcgtggccccgccgctggcgccgcccccgccgccgcacgccctccgcgtcaccacccgaggctgatcgatccagccgcccgcctctgctcagcctcgtccgataggttcattcagatcgttcattttgcctcttttttccgtccattccgttgattcgtttggtgtgcagaccgactgtaccgcttgtattatgatgtcttattatccaactgtgggaacgagacagccttctccatggctttgtaaatagttctggtgagaccaagggaccttttgagtttgagctcctttttcgtgtggataataatgcatgctactactccgtagaactctggatgatgtcttttgctggatgggaacatgagttcatggctgattgtctggacgaatggattttgtcgatcctttttaaacacgacactagctgaccaaagatggccactggaaagaatcgctggactgtcgtggctggttgtttgcgatacgtgacgatggatggttggttctgtttggcattcctttcctttggtcggccacaatttagggtttatacacgatacacgtcatatcagtgtttccatcagttccttccacatttggtgatgcactggttgtctggtcggtgatcaaataaagccgtcgaggaaaacactttgcgcatgaatgaaatgcacaaaaccactacaattgtgacatcttttgtcttgtttcaaaaataaaataaaactgtgacattttttcttttgcaaattacagcgtgcatttttattttttttgcaaattgtaccgattgctcgtatggcctggtgccgaactaacaggtcgggccactttcagtggatgatgtgtcaaagggggagacgaatggcatctgatgtcctttaaccgtgtgtttcaacatttgcatccttctttcatcggagacccacaaaaagaccttcgtgcaagtgatccttccgtgcaatgcacaggtggaggctaactttctcccgttcttcttgtcgtcccactattctctcttgtgatggcggagcatggcggcggcagcggcgatggacgtggtgcaaatggtgaagacggaggccctgctttggacgagcaccgcggcagtttcaacccattcaagtgctggatgcatgaccgagtgttcacggcgacacactcttatgattggacggtgaaggccaatattgttaatttggatgattgtattggttgaaatccaatttttttttaacttagatcatttttttgagtccatttgttgtttaactccttgaggcttgtgtatcctgactaactctttcagatcatgcagttagtaaatcctttat

SEQ ID NO: 2749 - DNA, 635 bp, Hordeum vulgare
aacaagtcaacaccacatccacatccaaaggagtagacacaaatcccgagctagggaaaaaccgattccctttcttaccgcaccgcgaggcgaaggcgagcctatcaccggcggcgatgttcctggtggggatagtggcggagctgctggaggactacacgatgctggtggcggaggtgctggagcagctgctcaacagcgcgccgttcccccgccggatgcgcacgctcatgctgcggagcctccccttcgtggccccgccgctggcgccgcccccgccgccgcacgccctccgcgtcaccacccgaggctgatcgatccagccgcccgcctctgctcagcctcgtccgataggttcattcagatcgttcattttgcctcttttttccgtccattccgttgattcgtttggtgtgcagaccgactgtaccgcttgtattatgatgtcttattatccaactgtgggaacgagacagccttctccatggctttgtaaatagttctggtgagaccaagggaccttttgagtttgagctcctttttcgtgtggataataatgcatgctactactccgtagaactctggatgatgtcttttgctggatgggaacatgagttcatggctgattgtctgga

SEQ ID NO: 2750 - DNA, 633 bp, Brachypodium distachyon
ccgaaagccggtcgggtccccttttaaaagcccgtgcgctggacgccccgctctcatcatcagacgatagcaagtccacatccaagtcctgattctcctcctcccaactcgatcgagccagcgaaaaattcgatccccgatcctttttacccgcagctagcgacgatgttcctcgtgggggtggtggcggagctgctggaggactacacggcgctggtggcgcgggtgctggagcagctgctcaacgacgcgcccttcccccgcccgatgcgcaccctcatgctgcggagcctccccttcgccgcgccgccgccgcctccgcccccgccgccgcacgcgctccgcgtcacggccgcccgaggttgatcgagccccgttgtcgtgcccatgctccaattgtgctagctgatctgatacggagtatgtcaattcagagtatcagactctgtttctcctgtgtttcgcttcgttttgttgattcgtttggtgtacggttactgtaaatatattttttgtgagattaagagatttttttcccgcaaaagaaagagattaagtaaaaaattatttctctgtctgtggataatgcgttggtattactttttggtggatggaacgtgacttattgacaaa

SEQ ID NO: 2751 - DNA, 823 bp, Sorghum bicolor
gccacgccgcgcgcgggcgccgctggctcaccagggccccagcggcaatggcctgcactgcaaaccaccagccacgccgcccaccggacgccaaagcgaccaaaattatggttcatcccggtcccggccgtatccaggaatccaacccaaacccaatccacggaccgtttttaagggcccccgcggcgcggccaatcatcgatttcgctcccaccgcaccaccggagagttcctttcccggtttttccccccagccccgccgcgccgcaaaaatctcccccagcgcaccgattaatcatcagccgacacacagccggggagcgagatgattctggtggcgatcgtggcggagctgctggaggagtacacggcgctggtggcgcgggtgctggagcagctgctccacggcgcgcccttcccgcgccgcatgcgcttcctcatgctccggagcctccccttcgccgcgccgccgccgccgccaccgcacgcgctccacgtcgccacccgcgcctgactgagcccgcgccctgacgtcgctcttctggtatacaggagcactgttcgtctgtgtccttcgccgtgtgtttacttgctgtaattctcagtcatggaaagaaagggtcgtagtaaatctgcagtggctccgcggctcctcctcgttgtctgaatgtcccgttcagaagcttcagctagagcagcagttccagtccacggatctgctatgtaaattctctacttaatttgtccaagtaattgtagtgattgatgaacagcagattcggagttgtgcttttgcaaaaattttcgtttctcaccaccgtag

SEQ ID NO: 2752 - DNA, 671 bp, Triticum aestivum
cacatccagagtacacacaaatcccgagctagcgaaaaccgattccttttcttaccgcaccgcgaagccaaggcgaaggcgaaggttatcatcggcgatgttcctggtggggatagtggccgagctgctggaggactacacgatgctggtggcggaggtgctggagcagctgctcgacggcgcgccgttcccccgccggatgcgcacgctcatgctgcggagcctccccttcgtggccccgccgctcgcgccgccgccgccgccgcacgccctccgcgtcaccacccgaggctgatcgatccagccgactgcctctgctaagcctcgtccgatcccataggttcatccggattgcctctttcggtttattctgttgattcgtttggtgtacagaccgactgtactacttgtactatgatgtctcttattatccagcggtggaaatgagactgagttttccatggctcctttgtaaatagttctggtgagatcaaggggcctttcaatttgagctcctttttcatgtggataatgcatacctagtagaactgtggatgatgtcttttgctggatgggaacatgagttcatgactgattgtctggacgaatggattttgtcgatcctttttaaacatgacactaggtgaccagagatggccactgaaaagaac

SEQ ID NO: 2753 - DNA, 636 bp, Triticum aestivum
tcaacaccgcatccacatccacatccaaagtagagtacacacacaaatcccgagcgagcgaaaaccgattccttttcttaccgcaccgcgaagccaaggcgaaggcgaaggttgtcgtcggcgatgttcctggtggggatagtggcggagctgctggaggactacacgatgctggtggcggaggtgctggagcagctgctcaacggcgcgccgttcccccgccggatgcgcacgctcatgctgcggagcctccccttcgttgccccgccgctggcgccgcccccgccgccgtacgccctccgcgtcaccacccgaggctgatcgatccagccgactgcctctgccaagcctcgtccgatccgataggtccatccagatcgtctgttttgcctctttcggttcattctgttgattcgtttggtgtacagaccgactgtactagttgtactgtgatgtctcttgttatccacagcggtggaaatgagaccgatttttccatggctcctttgtaaatagttctggtgagatctgggggcctttcagtttgagctcctttttcatgtggataatgcatactagtagaattctggatgatctcttttgctggatgggaacatgagttcatgactgattgtc

SEQ ID NO: 2754 - DNA, 1634 bp, Zea mays
agcagccgcgcccaccggacgccgaagcgaacaaaactatcctggccccaccgtcccatatccatgaatccaacccaaaccctaaacccaatccatggaccatacacacaccgaggcgcccgtaggccgtacccaatcaattttcctaccaccgccgcaccaccggaccgttcattcccgcttttcccagccccgcgctcccgctcccgctcccgcgcccgcgcccgcgcccgcgctgctcctcctccctcgtcttgtgaggccgacagccggagaggcacagcgcaccaaatgattctggtggccatcgtggcggagctgctggaggagtacacggcgctggtggcgcgcgtgctggagcagctgctccacggcgcgcccttcccgcgccgcatgcgattcctcatgctccggagcctccccttcgccacgccgccgctcccgccgccgccgccagcgcacgcgctccacgtcggcgcgccctccccgcccctctgagtcagagtactgttcctcgccgtgtttcagcgtttggtacgtaagttctcatctcggtcatgaaagaaaagggtagcgaatgtgaatctgcgctgcctccgatcctctcctcgttgtctcgttgagaagcctcagcaagagcagttccagtgtccacggatctgctgtgtaaattctttgcttagtttgtccgagtaatataatagcagtgattaatgagcaggagattcggagttgttcttcttctccgtattttgccagtttggatagcttcagcgcagctgcctacctggttctggatgtgactagagtttactcttctccagtggcgtcacggtcaggagtagctagcaggcgtctggaaatttcggacagacacgtggcagcccatgctagcttccaggcgttggaccatgatctaacgctggccgcagaatcgctgtcgctggcgagaagggactgcgggtgggactgccgtctcattcttttggtgacgtgtgcgaggggatccaaatccaagggacgagacgacatgcaagtgttgcttcaattttggcccttaattctccgaatactcttcgtcatcttcactaccaccgagttcccggttcattcaaccttgacctcgttcgttcgttcactttagtatacaatagtaatcacactataaacacggttattgtgatctcgtaagacttataagtgtctcatggtataactacaattatgtgtgtaagtgtcaaataatacatgcaagtatcaagggttggatgtgtctatttctcactcctaatcactaggtataatctagagcaagcaataatataacagactaactaatcaaaatactttatagagcatctacgctaatccatgagtgatttttaattttttggggtctagagttatagaaatggagtatcaactttatagagcacatacgctaaacactttatagagcacctacgttaatttaaacaaaactgttggatccttggctaaaactagagacctctatagatgagaaatatgagtgcttaagccctgagctaaaataaatggtagccaagtgatactaaacttgtcggggaccataattaggggtaccctcaaggcgcctaattctcagctggtaa

SEQ ID NO: 2755 - DNA, 2133 bp, Saccharum officinarum
ggctgcgcgtcgcccctcgctgctccacctcgcggccgtcgccgtcctctgctcggtgtcctacctcctcggcatctggcaccacggcggcttctccgcgggccccgccgccggcggcggcgtctcctcctcggtctccatcgccaccgccgtctcctgcgccaccccggccctgacgaccgcctcctcgtctccccccgcggggccgctcgacttcgccgcgcaccacacggcagaggggatggaggcggaggccgcgctccgccagcgcagctacgaggcgtgccccgccaagtactccgagtacacgccctgcgaggacgtggagcgctccctgcggttcccgcgggaccgcctcgtctaccgggagcgccactgccccgcggacggcgagcgcctccggtgcctcgtgccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaggttccgcttccccgggggcggcaccatgttccctcgcggcgccggcgcctacatcgacgacatcggcaagcttatccccctccacgacggatccatccgcaccgcccttgacaccggctgcggggtggcgagctggggagcctacttgctgtcacgcaacatccttgccatgtccttcgctccgcgagactcccacgaggcgcaggttcagtttgcactagaacgtggtgtgccagcgatgattggagtcctcgcctccaatcggcttacctatccggcacgttcctttgacatggcgcactgctctcgttgcctcatcccgtggcagctttatgatgggctgtacttgatagaggttgatcgtatcctgcggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgctatctggcagaagcctactaaccacattcattgcaaggccatccacaaagttatcaagtccccgcccttctgttctaaccaaaacccagatgctgcctggtatgacaagatggaggcttgtataactccactcccagaggtcagtgacttaaaggaggttgccggcggcgcgttgaagaaatggccggagaggctcactgcagtgccgcccaggattgccagtggcagcatcgagggggtcacggcagagatgtttgtggaagataccgtgttatggaagaagagagttgggcactacaagtccgtgattgctcaactcggccagaaaggccggtaccgcaacttactcgatatgaatgcaaagtttggcggcttcgctgcggcattggttaatgaccccttgtgggtcatgaacatggtccctactgtggggaactcaacaacccttggcataatatacgagcgtggcctcattgggagctaccaggactggtgtgagggcatgtccacgtatccccggacctacgacctcattcatgcagattcagtgttcacactgtacaatggcagatgtgaggcggagaacattctgctcgaaatggacagaattctgaggccagagggcacggtcatcatcagagatgacgtggacctgttagtgaagataaagagcatcacggacgggatgagatggaatagccagatcgtggatcacgaagatggtccgctcgtccgcgagaagctcctccttgttgtgaagacatactggactctcgaggacaacaaacaatagcaataacgtggaataaaagagtagaatgattattgacatgatcggcaaatcttgtgactgcctcaccatttgccctgtgaatctggtggagtttgttttctgttttcgttttgggtattcattttgggggggaagggttcatataataatggagatgtaatctccttgttaagatataagagggaaacccagcacagattttgacattaaaaaaaaagatgttgtgcaaagtgggtaaatagaaaatacaatttgggatc

SEQ ID NO: 2756 - DNA, 2305 bp, Zea mays
cgcgtctcagcctacacgtccgagccgccagccgtgcgctttaagtgagcgcacccacgaaaagcagccaggcagcggagccggagagaagaagcagcagtagcagcagggccgtcaacaccatggcggtgggcgcgaccgccacgaagctcctcccgtcggcggccgcggccgcgcgccgcccatcgatgctccacctcgcggccgtcgccgtcctctgctcgctgtcctacctcctcggcatctggcaccacggcggcttctccgcggggcccgccgccggcgactcctcctcctcggtctctatcgccaccgccgtctcctgcgccacccccgccccgacgaccgcctcctcgtctccccccgcgggaccgctcgacttcgccgcgcaccacacggcggagggggtggaggcggagggcgcgctccgccatcgcaactacgaagcatgccccgccaagtactccgagtacacgccctgcgaggacgtggagcgttccttgcggttcccccgcgaccgcctcgtctaccgggagcgccactgccccgcggccggcgagcgcctccggtgcctcgtcccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaagttccgcttccccgggggcggcaccatgttccctcgcggcgccggcgcctacatcgacgacatcggcaagcttatccccctccacgacggatccatccggaccgctcttgacaccggctgcggggtggcgagctggggagcctacttgctgtcacgcaacatccttgccatgtccttcgccccgcgagactcccacgaggcgcaggttcagtttgcactagagcgtggtgtgccggcgatgattggggtccttgcctccaatcaactcacttatccggcacgttcctttgacatggcgcattgctctcgttgcctcatcccatggcagctttacgacgggctgtacttgatagaggttgatcgtatcctgcgtcctggaggttattggattttgtctggaccaccaataaactggaagaaacactggaaggggtgggacaggactaaagaagacctggacgcagagcagaaagccatcgaggcagttgccaggagcctatgttggaagaagatcaaggaggagggcgacattgctatctggcagaaaccaactaaccacattcattgcaaggccatccacaaagttatcaagtcaccgcccttctgttctaacaaaaacccagatgctgcctggtacgacaagatggaggcttgcataactccactaccagaggtcagtgacttaaaggaggttgctggcggctcgttgaagaaatggccggagcggctcactgcagtgccgcccaggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggattcgctgcggcattggtgaatgaccccttgtgggtcatgaacatggtccctactgtggggaactcaacaacccttggggtaatatacgagcgtggcctcattgggagctaccaggactggtgtgagggcatgtccacttatccccggacctacgacctcattcatgcagatacagtgttcacactgtacaatggcagatgtgaggcggagaacattctgctcgaaatggacagaattctgaggccagagggcacggtcatcatcagagatgacgtggacctcttagtgaagataaagagcatggcggacgggatgagatggaatagccagatcgtggatcacgaagatggtccgctcgtccgtgagaagctcctccttgttgtgaagacatactggactctcgatggcagcgaacaatagcaataacgtcaaataaaagagttggaatgattatatggcatgatcggcagatgtgactgcctacccatttgccctgtgaatctggtggagtttgttttctgtttttttggggggtattcattttaggagatagttaacataatggagagataatctccttgttaagatatcaaagagcagcccagcacagattttgacataaaaacaacaaattgtgcgaagtgggtaaatagaaagtacagtactgggatcagttctgtctccgg

SEQ ID NO: 2757 - DNA, 2197 bp, Zea mays
cagcagcagggccgccaacgccatggcggtaggcgcgaccgccgcgaagctgcacctctcgtcggcggcagcggccgcgcgccgcccgtcgctgctccacctcgcggccgtggccgtcctctgctcgctgtcctacctcttcggcatctggcaccacggcggcttctccgctggccccgccgccggcggcgccacctcctcctcctcggtctccatcgccaccgccgtgtcctgcgcctcccccgccctgacgaccgccccctcgtcaccccccgcggggccgctcgacttcgccgcgcaccacacggcggaggggatggagtccgaggccgcgctccgccagcgcagctacgaggcgtgccccgccaagtactccgagtacacgccctgcgaggacgtggagcgctccctgcggttcccgcgggaccgcctcgtctaccgcgagcgccactgccccgcggacggcgagcgcctgcgctgcctcgtgccggcgcccaggggctaccgcaacccgttcccctggccggccagccgcgacgtcgcctggttcgccaacgtgccccacaaggagctcagcgtcgagaaggcggtgcagaactggatccgcgtcgacggcgacaggttccgcttccccgggggcggcaccatgttccctcgcggcgccggcgcttacatcgacgacatcgccaagcttatccccctccacgacggatccatccgcaccgcgcttgacaccggctgcggggtggcgagctggggggcctacttgctgtcacgcgacattcttgccatgtccttcgccccgcgagactcccacgaggcgcaggttcagtttgcactagagcgtggtgtgccggcgatgattggtgtcctcgcctccaatcggctcacctatccggcacgttcctttgacatggcgcactgctctcgttgcctcatcccgtggcaactttacgatggcctgtacttgatagaggttgatcgtatcctgcggcctggaggctattggattttgtctgggccaccaatcaactggaagaaacactggaaggggtgggacaggactaaagaagacctggatgcagagcagaaagccattgaggcagttgccaggagcctctgctggaagaagatcaaggaggcgggcgacattgctatctggcagaagcctactaaccacattcattgcaaggccatccacaaagttagcaagtccatacccttctgctctaaccaaaacccagatgctgcctggtatgacaagatggaggcttgtataactcgactcccagaggtcagtgacttaaaggaggttgccggcggtgcgttgaagaaatggcccgagaggctcactgcagtgccacccagaattgccagtggcagcatcgagggggtcacggaagagatgtttgtggaagatactgagttatggaagaagagagttgggcactacaagtccgtgattgcgcaacttggtcagaaaggccggtaccgcaacctactcgatatgaatgcaaagtttggcggcttcgctgcggcattggtgaatgatcccttgtgggtcatgaacatggtccctactgtggggaactcaacaacccttggggcaatatacgagcggggcctcattggaagctaccaggactggtgtgagggcatgtccacttatccccggacctacgacctcattcatgcggattcactgtttacactgtacaatggcagatgtgaggcggacaacattctgctcgaaatggacagaattctgaggccagagggcacggtcatcatcagagatgacgtggacatgttagtgaagataaagagcatcacggacgggatgagatggaatagccagatcgtggatcacgaagatggtccgctcgtccgggagaagctcctccttgctgtgaagacatactggactctggacgacagcaaacaatagcaataacgtggaatagagagttagaatgattattgacgtgatcggcaaatcttgcgactgccttaccgtttgccctgtgaatctggtggactttgggttccattttctttttgggtattcattggggggagatagttcacataatggagatataatctccttgttaagatataagactgaacccagcacagattttgacataaaaaacatacattgtgcaaagtgggtaaatagaaagtacaatattgg

SEQ ID NO: 2758 - DNA, 2471 bp, Setaria italica
ccattaacacgcccttcctctcccgtctcgtctccagtctccaccccgtggtaatcaaatcgagcgcacatgcgcttccctttcacggcctccccccgtttccacctccacctaatccccagcgccccaatccgaggcgaccaccgtgcgccttaagcgagcgcaccacacgggcgggggcgcgccgagcgcacacaaggcagtgcggtaataagcaggggagccagcggagcggagagcagcggccgcagaagcagcagcagggccagccaccatggcggtgggcactaccgccgtgaagctgcacctctcgtcggccgccgcggccgcgcgccgcccctcgctgctccacctcgcggccgtcgccgccctctgctccctgtcctacctcttcggcatctggcaccacggcggcttctccgcggcccgcgcctccggcgccggcgccgccgtctccatcgccaccgccgtctcctgcgcctcccccaccccgaccgcctcctcctcctcctccactcccgcggggccgctcgacttcgccgcgcaccacaccgcggaggggatggaggaggatgccgcgccgcgccagcgcgcctacgacgcgtgccccgtcaagtactccgagtacaccccctgcgaggacgtggagcgctccctgcgcttctcccgcgaccgcctcgtctaccgggagcgccactgcccctcctccgacgccgagcgcctccgctgcctcgtcccggcgcccaggggctaccgcaacccgttcccgtggcccgccagccgcgacgtcgcctggttcgccaacgtgccgcacaaggagctcaccgtcgagaaggcggtgcagaactggatccgcgtcgacggcgacaagttccgcttccccgggggaggcaccatgttcccgcgcggcgccggcgcttacatcgacgacatcgggaagatcatcccgctccacgacggatccatccgcaccgccctcgacaccggctgcggggtggcgagctggggagcctacttgctgtcacgcaacatcctggccatgtccttcgccccgcgagactcacacgaggcgcaggtgcagtttgcactggagcgtggtgtgccagccatgattggggtgctcgcctccaatcggctaacctatccggcccgttcctttgacatggcgcattgctcccgctgcctcatcccatggcagctctacgatggtctgtacttgatagagattgatcgtgttctgcggcctggagggtattggatcttgtccggaccaccaattaactggaagaagcactataaggggtgggccaggtctaaagatgacctgaatcaagagcagcaagctattgagaaagttgccgcaagcctttgctggaagaaggtcaaggaggaaggcgacattgctatctggcagaagcctactaaccacattcactgcaaggccatccgcaaggttatcaagtccccacccttttgctctagccaaaatccagatgctgcctggtacgacaagatggaggcttgtataactccactcccagaggttagtgacttaaaagaggttgccggtggcaagttgaagaaatggccggagaggctcacggcagtaccgcccaggattgccagtggcagccttgagggggtcactgaagagatgtttgtggaagataccgagttatggaagaagagaattggacactacaagtccgtgatccctcaattagcgcagaagggccggtaccgcaatttgctcgatatgaatgcgaagtttggcggcttcgctgcggcattggtgaatgaccccgtgtgggtcatgaacatggtccctactgtgggcaactcaacaaccctgggggtaatatacgagcgtggcctcattgggagctaccaggactggtgtgagggcatgtccacttatccccggacctacgacctcattcatgccgattcagtgttcacgctgtaccatgggaggtgtgaaatggagaacgttctgctggaaatggacaggatcctgaggccggagggcacggtcatcatcagagatgatgtggacctgttagtgaagataaagagcatcgcggacggaatgagatggaatagccagatcgtggatcacgaagatggtccactcgtccgcgagaagctcctccttgttgtgaagacatactggacgttgggtgacaacaaacaatagcaataacgtggaataaaagagttagtgattgacatgcttggcaaatcttgtgagtttgtgactggcttaccatttgccctgtgagtctggagtttctttccttttttttttctttttgggtattcttttggggggaatagttcacaaaatggagatataatctacttgttaagctatgagaaagggaaacccagcacagattttgacatgagaaaaaaaaaggacaaattgtgccaagtgggtaaatagaaagtataatattttgtgggcattt

SEQ ID NO: 2759 - DNA, 3415 bp, Panicum virgatum
cggtgggcgcgaccgccgcgaagctgcacctctcgtcggtcgccggggccgctcgccgcccctcgctgctccacctcgcggccgtcgcggtcctctgctccctgtcctacctcctaggcatctggcaccacggcggcttttccgcggcccccgccgccggcgccggcgccggcgtctccatcgccaccgccgtctcctgcgcctccccgaccccgaccgtccccgcgggctcctcctcctcggggccgctcgacttcgccgcgcaccacaccgcggaggggatggaggcggaagccgcgccgcgccagcgcgcctacgaggcctgccccgccaagtactccgagtacacgccctgcgaggacgtggagcgctccctgcgcttctcgcgcgaccgcctcgtctaccgggagcgccactgcccctcctccgacaccgagcgcctccgctgcctcgtgccggcgcccaggggctaccgcaacccgttcccgtggcccgccagccgcgacgtcgcctggttcgccaacgtcccgcacaaggagctcaccgtcgagaaggcggtgcagaactggatccgcgtcgacggcgacaagttccgcttccccgggggaggcaccatgttcccgcgcggcgccgacgcctacatcgacgacatcgggaggatcatcccgctccgcgacggatccatccgcaccgccctcgacaccggctgcggggttgcgagttggggagcctacttgctgtcgcgcaacatcctggccatgtccttcgcaccgcgagattcacatgaggcacaggtgcagtttgcactggagcgtggtgtgccagccatgattggggtgcttgcctccaatcggctcacctatccggcccgttcctttgacatggcgcattgctcccgctgcctcatcccatggcagctctatgatggtctgtacttgatagagatcgatcgtgttctacggcctggagggtattggatcttgtccggaccaccaatcaactggaagaagcactggaagggttgggccaggaccaaagaggacctgaatgcagagcagcaagctattgagaaagttgccagaaacctctgctggaagaaggtcaaggaggaaggtgacattgctatctggcagaagcctactaaccacattcactgcaaggtcaatcgcaaggttatcaagtccccacccttttgctctagccaaaatccagatgctgcctggtacgacaagatggaggcttgtataactccactcccagaggtcagtgacttaaaggaggttgccggtggcgagttgaagaaatggccggagaggcttactgcagtaccgcccaggattgccagtggcagcatcgagggggtcacggaagatatgtatgtcgaagatactgagttatggaagaggagagttgggcactacaagtccgtgatctcgcaattcgggcagaaaggccggtaccgcaatttgcttgatatgaatgcgaagtttggtggcttcgctgcagctttggtggatgacccagtgtgggtcatgaacatggtccctactgtgggcaactcaacaaccctgggggtaatatacgagcgtggcctcatcgggagctaccaggactggtgtgagggcatgtctacttatccccggacctacgacctcattcatgctgattcagtgttcacgctatacaatggcaggtgtgagatggagaacattctgctggaaatggacaggatcctgaggccggagggcacgatcatcattagagatgacgtggacctgttagtgaagataaagagcatcgcggacgggatgagatggaatagccagatcgtggatcacgaagatggtccgctcgtccgcgagaagctcctccttgttgtgaagacatactggacattgggggacaacaaacaataggaataacgtggaataaaagagttagagtgattgacttgctcggcaaatcttgtgactggctttgccctgtgaatctcgagtttgttttcgtttttccttttgggtattcttttggaagaaatagtccacaaaaaggagatgctctccttgttaagctatgagagagggaaacccagcacagattttgacatgaaaaaacagaacaaattgtgcgaagtgggtaaatagaaagtataatattgggttcaaatttttctcccggtggacattgtttagttttagttgttagatgttcattatgtgatgctttttgttcaaatgtcaccggatcaaaaacctgaactcagactaatcatcatcaccttgtgactctgatcagaattcagaagtggtcttgtttcccctgaacagataatgtaggaatcatgctgacttatcgtctaactgttctgaacttatgccctgatcgtgaaatgctcgccggccgtgcagaatgcatcgacgtcatttcttcaccagcaaagcaagcaactgtatgccaactagatgttctgatttgatcgcaaatttggttgcaagttgggtgcttcacaccgaacgcatcatgggtgaaacggttccgactggttttcctagcgcctgcgactctgttactttctgccggcgtatgtgtcggtgccgaaattacaagtggaacacaggccaagcaaaataccactctgattcgcagtgtcagataagcccagaaaaaaagagccgaaacactcgaaccactcgatttccgtgggcatccgaaagcgatttttgcgcaaatatagcacaaatctgtcaccttcacgcgacgtgttttttagaaaagttttttttttggaaaaggtcacgcggcatgttttgtctagcggccttaatagcaatcaccaaacgactaatgacttctggcagaacaaatcttagtatagctgggcagctggcaccatgctttgagtgcagtcggtgccctaaattgtggtctcagtcagaagcatgaacagttcaggagcatccatttgcccattggccattgcctggctcaactccaagatcagaagtggggataggatcggtacctttcaacaacggcgacgagcgatcgtcttcactggcatgcacacactgtgacacacaggaaccagacagcaagtgcaaccgcccaagagcggattggtcccggacaggaggagcaagagaacaaacgctggtggtcaaacgtggcacgtaccgaatcgaaaaccgataaagacacgtaacagattacagaacgtgaacaggaggcccgttggtatggtcatgtactcatgtaagttttttttccccattttttttcatgaaagagtgcacagaggtgtcccggtttttagctagctaggtgtggtgctgctaaactcacctaacactgcattatagagctcggattggaatgatggcctctctagatctgcatgtagtaattggctgcctgt

SEQ ID NO: 2760 - DNA, 2403 bp, Oryza sativa
gtcttcacctccacctaatcaatcgatccccacgcccctaatccttcctaggcggcaagcgctttaagcagccagcaaggggggcagtggtgcagaaaggcgaatcgccccaatcccacaagaggcgaggggagagaggagagcgcgcagcgggagcagcagaagccgccagccagccatggcggtgggcgcgaccgccacgaagctgcacatgccgtccgcgggcggccgccgcccgtccctgttccacctcgcggccgtcgcggtgctctgcacggtgtcctacctcatcggcatctggcaccacggcggcttctccgcctccccggccggcggcgtcgcctcctccgtctccatcgccaccaccgcctccgtctcctgcgtctcccccaccccgacgctccttggcggcggcggcggcggcggcgactcctcgtcgtccgcgccgctcgacttcgcggcgcaccataccgcggaggggatggaggtggcgtcgggccaggtgcaccgcacgtacgaggcgtgcccggccaagtactccgagtacacgccgtgcgaggacgtcgagcgctcgctgcggttcccgcgggaccggctcgtgtaccgggagcggcactgcccgtcggagggcgagcggctccggtgcctcgtgccggcgccccaggggtaccgcaacccgttcccgtggccgaccagccgcgacgtcgcgtggttcgccaacgtgccgcacaaggagctcaccgtcgagaaggcggtgcagaactggatccgcgtcgaaggcgaaaagttccggttccccggcggcggcaccatgttcccccacggcgccggcgcgtacatcgacgacatcggcaagatcatccccctccacgatggatccatccgcaccgccctcgacaccggttgtggggtagcgagctggggcgcatacttgctgtcacgcaacatcctggccatgtccttcgcgccacgtgactctcacgaggcacaggttcaatttgcactggaacgtggtgtgccggcgatgatcggtgttctttcatccaaccggctcacctatccagctcgtgcctttgacatggcacattgctcccgctgcctcattccctggcagctctacgatgggctgtacttggctgaggtggatcgcattctgcggccaggagggtattggattttgtctggacctccaatcaactggaagaagcactggaaggggtggcagagaaccaaggaggacctgaatgcagagcagcaagcgattgaggcagtggccaagagtctttgctggaagaagatcacgctcaaggaggttggtgacattgccatctggcagaaacctactaaccacattcactgcaaggcctcccgcaaagtcgtcaagtccccacccttctgctcaaataaaaatccagatgctgcatggtacgataagatggaggcttgcataactcctctcccagaggttagtgacataaaagagattgcgggtggccagttgaagaaatggccagagaggctcactgcagtgccacccagaattgccagtggtagcattgagggtgtcactgatgaaatgttcgtggaagacaccaaactatggcagaagagggtcgggcactacaagtccgtgataagtcaatttggacagaaaggacggtaccgcaacttgcttgatatgaatgcgcgctttggcggcttcgctgcggcattggtggatgaccctgtgtgggtcatgaatatggtcccaactgttggcaattcaacaactcttggggttatatacgagcgtgggctcatcggaagctaccaagactggtgtgagggcatgtccacgtaccctcggacctacgacctcattcatgccgattcagtgttcacgctatacaaggacagatgccagatggacaacattctgctggaaatggacagaatactgaggcctgagggtacagtgattataagagatgatgttgatatgttggtgaaaataaagagcattaccgacggtatgagatggaacagccaaatcgttgatcacgaagatggcccgctcgtccgggagaagctcctccttgttgtaaagacatactggacactcggggaagaaaaggaatagcaataacgtgaaataaagtgttagaaaaaattgacatattgggcaaatatcgtaatcggcttaccatttgccttgtggatttgaagtttctttttccatttcattctttgggtggaatagttcacatatggagttcagccctcgatgtttaggtgtaaaagaggtgctgagaaggaaaccctgcaaagttttttacattaaaggacaaccaaagtattccaggtctggtttctacggtcagtagcattcttcatgcgctgtcatcaggcattttagtacggagt

SEQ ID NO: 2761 - DNA, 3072 bp, Oryza sativa
acgattaaaccaaaaccggatgcatgtgcggctccctttcacggcctccccccgtcttcacctccacctaatcaatcgatccccacgcccccaatccttcctaggcggcaagcgctttaagcagccagcaaggggggcagtggtgcagaaaggcgaatcgccccaatcccacaagaggcgaggggagagaggagagcgcgcagcgggagcagcagaagccgccagccagccatggcggtgggcgcgaccgccacgaagctgcacatgccgtccgcgggcggccgccgcccgtccctgttccacctcgcggccgtcgcggtgctctgcacggtgtcctacctcatcggcatctggcaccacggcggcttctccgcctccccggccggcggcgtcgcctcctccgtctccatcgccaccaccgcctccgtctcctgcgtctcccccaccccgacgctccttggcggcggcggcggcggcggcgactcctcgtcgtccgcgccgctcgacttcgcggcgcaccataccgcggaggggatggaggtggcgtcgggccaggtgcaccgcacgtacgaggcgtgcccggccaagtactccgagtacacgccgtgcgaggacgtcgagcgctcgctgcggttcccgcgggaccggctcgtgtaccgggagcggcactgcccgtcggagggcgagcggctccggtgcctcgtgccggcgccccaggggtaccgcaacccgttcccgtggccgaccagccgcgacgtcgcgtggttcgccaacgtgccgcacaaggagctcaccgtcgagaaggcggtgcagaactggatccgcgtcgaaggcgaaaagttccggttccccggcggcggcaccatgttcccccacggcgccggcgcgtacatcgacgacatcggcaagatcatccccctccacgatggatccatccgcaccgccctcgacaccggttgtggggtagcgagctggggcgcatacttgctgtcacgcaacatcctggccatgtccttcgcgccacgtgactctcacgaggcacaggttcaatttgcactggaacgtggtgtgccggcgatgatcggtgttctttcatccaaccggctcacctatccagctcgtgcctttgacatggcacattgctcccgctgcctcattccctggcagctctacgatgggctgtacttggctgaggtggatcgcattctgcggccaggagggtattggattttgtctggacctccaatcaactggaagaagcactggaaggggtggcagagaaccaaggaggacctgaatgcagagcagcaagcgattgaggcagtggccaagagtctttgctggaagaagatcacgctcaaggaggttggtgacattgccatctggcagaaacctactaaccacattcactgcaaggcctcccgcaaagtcgtcaagtccccacccttctgctcaaataaaaatccagatgctgcatggtacgataagatggaggcttgcataactcctctcccagaggttagtgacataaaagagattgcgggtggccagttgaagaaatggccagagaggctcactgcagtgccacccagaattgccagtggtagcattgagggtgtcactgatgaaatgttcgtggaagacaccaaactatggcagaagagggtcgggcactacaagtccgtgataagtcaatttggacagaaaggacggtaccgcaacttgcttgatatgaatgcgcgctttggcggcttcgctgcggcattggtggatgaccctgtgtgggtcatgaatatggtcccaactgttggcaattcaacaactcttggggttatatacgagcgtgggctcatcggaagctaccaagactggtgtgagggcatgtccacgtaccctcggacctacgacctcattcatgccgattcagtgttcacgctatacaaggacagatgccagatggacaacattctgctggaaatggacagaatactgaggcctgagggtacagtgattataagagatgatgttgatatgttggtgaaaataaagagtattaccgacggtatgagatggaacagccaaatcgttgatcacgaagatggcccgctcgtccgggagaagctcctccttgttgtaaagacatactggacactcggggaagaaaaggaatagcaataacgtgaaataaagtgttagaaaaaattgacatattgggcaaatatcgtaatcggcttaccatttgccttgtggatttgaagtttctttttccatttcattctttgggtggaatagttcacatatggagttcagccctcgatgtttaggtgtaaaagaggtgctgagaaggaaaccctgcaaagttttttacattaaaggacaaccaaagtattccaggtgggtaaatagaagctacaattatggtgtcaatcctttttgttccaatgcacggtgtttgccattactttttactagtagattaccattctgatataattcttacattactcgtaggtctggtttctacggtcagtagcattcttcatgcgctgtcatcaggcattttagtacggagtaccagtgtaccaccatagtacgcctactctccctagaacagtagaactaccgtggaatgtttacatggctagacgcaaattgtctgaactgcctttacgtttgctcgcacatgctactggagtgctgaactcaactactatgcctgtgaggtttgactctggattcagctgaaaatttggtggcccacactgagcgtaccatatgcattcgtctacactaactccagatcttgcaagtaatggactaacggctaattaaagagttcatcaccattggcatgcatgcaatgcgacggcaacagaacgcactggtccccgacaggaggagcagaagaaacaattcacttttgggcgatcggtgcatgtattgaaatgatgaggacacttgacagaccacgaggtccccctgtcacaaggattcatctgagatatcccccattatccaccggaagaacagtgatgcataccaccttacagctaaccaaagtgtcaatctcac

SEQ ID NO: 2762 - DNA, 2166 bp, Echinochloa colona
aaaccggccgccatggcggtgggagcagccgccgcgaagctgcacctctcgtccgccgccgcggccgcgcggcgcccctcgctgctccacctcgcggccgtcgcggtcctctgctccctgtcctacctcctcggcatcctgggcaccacggcggcttctccgggtccgcccccgccggcggcgccggcgcctccgtctccatcgccaccgccgtctcctgcgcctcccccaccccgaccggctcctccccatcctcctccgcggggccgctcgacttcgccgcgcaccacaccgcggaggggatggaggcggtggccgcccctcgccagcgcgcctacgaggcgtgccccgccaagtactccgagtacacgccctgcgaggacgtcgaccgctccctgcggttcagccgcgaccgcctcatctaccgggagcgccactgccccaaggacgacgagcgcctgcgctgcctcgtcccggcgcccgagggctaccgcaacccgttcccgtggcccgccagccgcgacgtcgcctggttcgccaacgtgccgcacaaggagctcaccgtcgagaaggcggtgcagaactggatccgcgtcgacggcgacaggttccggttccccgggggaggcaccatgttcccgcgcggcgccggcgcctacatcgacgacatcggcaagatcatcccgctccacgacggatccatccgcaccgccctcgacaccggctgcggggtggcgagctggggagcctacttgctgtcacgcaacatcctggccatgtccttcgccccaagagactcgcacgaggcgcaggtgcagtttgcactggagcgtggtgtgccagcaatgattggggtgcttgcctccaatcggctcacctatccagcccggtcctttgacatggcgcattgctcccgctgcctcatcccgtggcagctctacgatgggctgtacttgatagaggttgatcgcattctgcggcctggtgggtattggatcttgtctggaccaccaatcaactggaagaagcactggaaggggtgggccaggactacgaaagacctgaatgaagagcagcaagctattgaggcagttgccaaaagcctctgctggaagaaggtcaaggaggaaggcgacattgctgtatggcagaagcctactaaccacattcactgcaaggccatccgcaaggttatcaagtccccgcccttttgctctgaccaaaatccagatgctgcctggtacgacaagatggaggcttgtataactccactcccagaggtcagtgacttaaaggaggttgccggtggcgagttgaagaaatggccggagagactcactgcagtaccacccaggattgccagtggcagcatcgagggggtcaccgaagagatatttgtggaagataccgagttatggaagaagagggttggacactacaagtctgtgatttctcaattcgggcagaagggccggtaccgtaacttgcttgatatgaatgccaaatttggtggctttgctgcggcgttggtgagtgaccccgtgtgggtcatgaacatggtccctactgtgggcaactcaacaacccttggggtaatatacgagcgtggcctcattgggagctatcaggactggtgtgagggcatgtccacttatccccggacctacgacctcattcatgccgattcagtgttcacgctgtacaatggcaggtgtgagatggagaacattctgctggaaatggacaggatcctgaggccggagggcacagtcatcatcagagatgatgtggacctgttagtgaaggtaaagagcatcgcggacgggatgagatggaatagccagatcgtggatcacgaagatggtccgctcgtccgtgagaagctcctccttgttgtgaagacatactggacattgggggacagcaaacaataggaataacgatgaataaaagagttagagcgattgacatgcttggcaaatcttgtgactggcttaccgtttgccctgtgaatctggagtttgttttctttcttttgggtattcttttggggggaatagttgacataacggagacatggtctccttgttaagctatgagagagggaaacccagcacagattttgacatgaaaacagaaaaattgtgccaagtgggtaaatagaag

SEQ ID NO: 2763 - DNA, 2438 bp, Secale cereale
cctaatcaatcgcccggctcggttccctcggctacccaccctacgcccccaatccgaggccagaacttttaaggcagcagggggaggggacggaggggacgtgcagaaagcgaaacgcccggccagtccagtccagtccagcggcggcagaggagaggggacgagagcagagcgcgcaggggagcgcggcgatggcggtgggcgcgaagccgcacctctcgtcggccgcccggcgccccacgctgccccagctcctggcggtcgccctgctctgctcggcgtcctacctcgccggcgtctggcaccacggcggcttcaccgccggccccgccgcctccccctcccccgtctccatcgccgccgccgccgcctccgtcacctgcgtctccccgaacccgcccgccgtcgccggtggctcctccctcgacttcgaggcgcaccacgccgcggacgacgcggaggtgaaggccgcgccggcgcggcgcgcgtacgaggcgtgcccggccaagtactccgagtacacgccctgcgaggacgtggagcggtcgctgcggttcccgcgcgaccggctggtgtaccgggagcgtcactgccccgcggagggcgagcggctgcggtgcctcgtcccggcgcccaaggggtaccgcaccccgttcccgtggcccgccagccgcgaccgcgcgtggttcgccaacgtgccgcacaaggagctcaccgtggagaaggcggtgcagaactggatccacgtcgagggcgacaagttccgcttccccggcggcggcaccatgttcccccacggcgccggcgcctacatcgacgacatcggcaagctcatccccctccacgacggatccatccgcaccgccctcgacaccggctgcggggtggctagctggggagcgtatctgctgtcacgcaacatcctggccatgtcgttcgctccgcgggactcgcacgaggcgcaggtgcagttcgcgctcgaacgcggggtgccggcgatgatcggcgtcctcgcctccaacaggctcacctatcctgcacgcgccttcgacatggcgcactgctcccgctgcctcatcccctggcagctctacgatggcctgtacttaatcgaggtggatcgcattcttcgtcctgggggctactggatcttgtccggaccaccaatcaactggaagaagcactggaaggggtggcagaggactagagaggacctcaatacagagcagcaagccatcgagacagtcgccaagagcctctgctggaagaagatcaaggaggttggcgacattgccatctggcaaaagcctaccaaccacatccactgcaaggccctccgcaaagtcatcaaatccccgccattctgctcgaacaaaaacccagatgctgcctggtacgacaagatggaggcttgtataactccactcccggaggttagtgacatcaaggaggtcgctggtggtgagctgaagaagtggccgcagaggctcactgccgtgccacccagaattgttagtggcagtatcgagggggtcactgctgaaatgtttaacgaagataccaagttatggaagaagagagtcaggcactacaagtccgtgataacccagttcgggcagaaggaccggtaccgcaacttgctcgatatgaatgcacgctttggcggcttcgctgcggcattggcgggtgaccctatgtgggtgatgaacatggtcccaaccgttggaaattcaacgactcttggggtgatatatgagcgtggcctcattgggaactaccaagactggtgcgagggcatgtccacgtatccccggacctacgacctcatccatgctgattcagttttcagtctgtacaaggacaggtgtgatatggacaccatcctgctggaaatggacagaattctgaggccggagggcacggtgatcatcagggacgacgtggacctgctagtgaaaataaagagcatctcggatgggatgagatggaatagccagatcgtggaccatgaagatggcccgctcgtccgggagaagctcctccttgttgtgaagacatactggacactcggggatgagaaacaacagcaatagcgtggagtaaaacatgaaaaatgagagaattgacatactgggcagatgtcacaattggcttcctctcactgtttcgccctgcggtttttgaaatttaatcttgtctgggtattcttttggtgaaatagttaaaacatgatggagatgtgccctgtctgtcaaggtgtaacagagggcgaatgtgagaagggaaaccagcagagattttgacatggaaggacagccacaaccagatcgggtagatagagatttcattatgtttcttattactgtacaaagggttggttatgtacaagttacccatcggctgttctgcccaaactgaatcagacccaagaataataa

SEQ ID NO: 2764 - DNA, 2597 bp, Brachypodium distachyon
cgcatgccaaatttaacccgccgccgctcttcccagcaaatcaaacgcgtatgctcctctcctctctctctttcacgcggcccctcggcctcctcccccccaccccccgcgtctccgcctccacctaatcaatcccccacgcccccaatcctaggccgagacctttaagcaaggcatcatcaccactctagtatcgcgacgagggggcagggcggtgcgaaaagcaacaaacgcccaaaccccgcagcggcagacgagaggagaggtgaggacagcgcgcggggggaagccgccatggcggtcggcgtgcccggcacgaagctgcacctctcgtcggtcgcccggcggcccacgctgcaccagctcgcggccgtcgccgtgctctgctcggtctcctacctcatcggcgtctggcaccacggcggcttctccgcatcccccccgggaggcactacttcccccgtatccgtcgccatcaccaccccctccgtcccctgcgtctctccaaacgtcaccgtcctcggcggcggcggcggcggcggtcgattggctccgccgctcgacttccgcgcgcaccacacggcggaggggacggaggtggagtccgcgccggccaagcgcacgtacgaggcgtgcccggcccagtactccgagtacacgccgtgcgaggacgtggagcggtcgctccggttcccgcgggaccggctgatgtaccgggagcggcactgcccttccgagggggagcggctgcggtgcctcgtgccggcgccgcagggctaccgcaacccgttcccgtggccgacgagccgcgacgtcgcgtggttcgccaacgtgccccacaaggagctcaccgtggagaaggcggtgcagaactggatccgcgtcgacggcgacaagttccgcttccctggcggcggcaccatgttcccccacggcgccggcgcctacatcgacgacatcggcaagctcatccctctgcacgacggatccatccgcaccgccctcgacaccggctgcggggtggcaagctggggagcctatttgttgtcgcgcgacatcttggtcatgtccttcgccccacgggactctcacgaggcacaggtgcagtttgcgctagagcgtggtgtgccggcgatgatcggtgtgctctcctccaaccggcttacctatcctgcccgtgcctttgatatggcgcactgttcccggtgcctaatcccctggcagctctacgatggtctgtacttgatagaggtcgatcgcattcttcgtcccggaggctactggatcttgtcaggaccaccaatcaactggaagaagcactggaagggctggcagaggaccacggaggacctgaatgcagaacagcaagccattgaagccgttgccaagagcctctgctggaagaagatcaaggaggttggcgacattgcaatctggcaaaaacctactaatcatatccactgcaaggcctcccgcagaatcaccaagtccccgccattctgctcaaataaaaatccagatgctgcctggtacgacaaaatggaggcttgtataactccactcccagaggttagtgacataaagaaggttgcaggtggtgagttaaagaagtggccgcaaagactcaccgccgtgccgcccagaattgccagtggtagcattgctggggtcactgatgaaatgtttttggaagataccaagctatggaggaagagagttggacactacaagtccgtgataagtcaatttgggcagaagggccggtaccgcaacttgctcgatatgaatgctcattttggtggctttgctgcggcattggtgggtgaccctatgtgggtaatgaatatggtcccaactgttggaaattcaacaactcttggtgtcatatatgagcgtgggctcatcggaaactaccaagactggtgtgagggcatgtccacttatccgcggacctacgacctcattcacgccgattcagttttcagtctgtacaaggacagatgcgagatggacagcattttgctggaaatggatagaatccttcggccagagggcacagtgataatcagagatgatgttgacatactagttaagataaagagcatcacggacgggatgagatggaacagccaggtcgtggatcacgaagatggtccgctcgtccgcgagaagctcctccttgttgtgaagacatactggacacttggggacgaaaaaaaacaatagcagcaacgtgaaataaaacattaaattgataaatctcattcttgggatggtctgtcttgttggcttactgcttgccggtacaactgttttgcctgtagattttttggagggtattcttttggaggagcggttaacataatgggggatattggccctatatgttggtataaaagatggagcatgtgagaggagcaacatgcaaagattttgaaatgaaaggactgccaaaagtgtccgaagtgggtaaatagagattgcagttgtgttgtcatcgttgccctgaagcggatgtatatgggctctttgtaaaaggagttaattataacttataagttcccagtggccatgactgttttgttgtcggtgaatct

SEQ ID NO: 2765 - DNA, 3355 bp, Zea mays
cgcatgttgaggtttgcctgatgagtgctgagggctgaggccgtgagtcaaaacaacccgatactgcatttagaaattgcggttgatgcgcgacttgtgctgccgctgttgctggttcttgctgccaaccgcacggtaacagagcgctggtgagaccgtgatcgtcctggaagacttcttgctgctcacatggactgggtggagtaacggtgaccggtacaacgacccttgtttgatcctctcttttttttcctttttacgatatgttcggtgacatggtttccgacaccttcaccatctttgtagcgtgtctttgtgaagagaaagagcaagggctcctatagtgcacctacaaagctgttgcgatgactcactgcacagttgattgacaatttttttttgttcatatatggctcaaatacgatttttgtaactgcattctatttccgatctgtcttgtacaagtttggctaccaaactcgataagaaacagccgcgaaggggaacggaaaacgcccactcgcccagcagcggccaactccgactcgcgtgctccagctccaggcagctccactcctatgcttcttctacatatataagtaaacgcgccaagccacgccacgctctgccatcccaacccgaccacctgccgaccgaggtctccgcagcgacacgccaccaccagagcgcgccgagctcgtgcacccagcaaggagcaaaggaccaacaaccgactgacgcggatggccaccccgggccacgccgtcgcggtcgacatcgacgagccagcctcctgcggcaacggcgaggcggcggcggccacgccgctgccccagccgacggtgccgtacgtgctccgcttcaccgacctgtcctacagcataaggaagcgcggcagcgggctaggctgcctgccttcgcgctggcccagcaaccgcctggcgtccttggacgcgccggcgtcgtccgcgaccgccgccagcgccacccggaacaccaagacgctgctggacggcatctccggggaggcccgggagcgggagctgttcgcggtgatgggcgcgagcgggtcgggcaagtcgacgctgctggacgcgctggcggggcgcatcgcgcgggacagcctccgcggcggcggggccacgctgaacggggagccgctgcagggccggcggctgcgcgccatctccgcgtacgtgatgcaggacgacttgctgtacccgatgctgacggtgcgcgagacgctgctgttcgccgccgagttccgcctgccccgcgcgctgcccgcggaccgcaagcgcgcgcgcgtcgacgcgctcgtcgaccagctcggcctcgcccgcgccgccgacaccatcatcggcgacgaggcccaccgcggggtgtcgggcggcgagcgccgccgcgtgtccatcggcaccgacatcatccacgaccccatcctgctgttcctcgacgagcccacctcgggcctcgactccgccagcgccttcatggtcgtgcaggtgctccgccgcatcgcgcgcagcggcagcgtcgtcatcatgaccgtccaccagcccagcgcgcgcatcctcgccatcctcgacaggctgctcctgctctcgcgggggcgcaccgtgtacgccggcacgcccgcggggctcaagcccttcttcgccgacttcggcgcgcccatcccggacaacgagaacccggccgagttcgcgctcgacaccatccgcgagtacgagcgctgccccgacggcgccgccccgctcgccgacttcaacgtcaagtggcagaacggcagcagttccacttccacctttgacaacaacaacgacgacgacaacgatagcagcagcaagctcatgccgctggagctcgccatcgccgagagcgtgtcccgcgggaagctggtggccgggagcgcggtcaccgcgtcgtcggtgccaacgttcgccaacccgccgtggaccgaggtgtgggtgctcatcaagcgctccttcaccaacacgggccgcatgccggagctcttcgtcatgcgcctcggcaccatcatggtcaccggcttcatcctggccaccatcttctggcgcctcgacgacacgcccaagggcgtgcaggagcgcctgggcttcttcgccatggccatgtccaccatgttctacgtgtgcgccgacgcgctgccggtgttcgtgcaggagcgccacatctacctccgcgagaccgcgcacaacgcctaccgccgcatctcctacgtgctggccaacgccgtggtcgcgttcccgccgctggtgttcctgtcgctggcgttcgcggtcaccacgttctgggcggtggggctcgcgggcggcgccccctcgttcctcttcttcgtgctcatcatcctcgcctccttctgggcgggcagcggcttcgtcaccttcctctccgctgtggtgccgcacgtcatgctgggctacacggtggtcgtcgccatcctcgcctacttcctcctcttctcgggcttcttcatcaaccgcgacaggatcccggactactggatctggttccactacctgtcgctggtcaagtacccgtaccaggcggtgctgcagaacgagttcagggacgcctcgcgctgcttctcgcgcggcgtcgagatgttcgagggcacgcccatagggcacatgacggagcccgtcaagctcaaggtgctgcaggccatcagcaggacgctggggtccaacatgacggccacaacctgcgtcaccaccggcgccgacgtgctggcgcagcaggccgtcacggacattggcaaatggaaatgcctgctggttactgtggcctgggggttcttcttcagggcactcttctacgtcgtcttgctcgttggcagcaagaataagaggaagtaaaattagtatacacaatgtatacggcgtatacataacatatacatatgtgtcaatgtgtgacggtgaaacaaatgtataggtcgacatgtgaaattattgttttgtttttaagaattgccgtattttttttcaaacatgcgtttacctagagtactgaattatatttgaattctttgcagttattcaacggcgtcatgctttcaatagatatacatatatgtatgggcaagcagcgtggcatgttcttttaacaaaagcagcaacaaacggtggtagcactcatatatataaactaggtgggtgcccgtgcgatgccacggaacacaaattgcgagcctctaatgaacttagagccctggcagagctctaggtacgtgctcgtgcgttgtcacgagacaagaaaaatgcccgtgcatcatgatataatacccgtgtattgtgacgacgacataattactcacttccagtggcat

SEQ ID NO: 2766 - DNA, 2789 bp, Setaria italica
caagaaatacccgggtccctcctctttgggaagcaggtgttagccccagacaatcgtgatcgaaaaagaaagcaccgagaaggggaagaggagagaaacggcgtggacggctggtcgccggtctccattcccactccgactcgtgcgtcaagtacgaaacggagccgaacccctgaacccaactcgggcctgccctctccaccgcctcttccttataagcgaacgcgcccgcgccacaccctcccaacacaaccactttgcccgcccaacgcgcgcgcgcgcacccaccggagccgtgccgtgctctccacaacgacgcgccgccaccaagatcttgcgcccggctgacgcgactccacacaccatgatggccaactccggccaggccgtggtcgacatcgacgaggccggcggcgaggccatgcggccgccggcgctaccgccggtcccctacgtgctcaacttcaccgacctgtcgtacagcgtcaagaagggcggcgggctgctgggctgcctcccgtcgcggcccagcaaccgcctcgcgtccgcggacgcgccgccggccgcgccggccgggaacaccaagacgctgctcgacggcatctccggcgaggcgtgcgcgggcgagctgttcgccgtcatgggcgccagcggctccggtaagtccacgctcgtcgacgcgctggcggggcgcatcgcgcgggagagcctccacgggagcgtcacgctcaacggggagccgctccaggggcggcggctccgcgccatctccgcctacgtcatgcaggacgacctgctgtacccgatgctgacggtccgcgagacgctgcacttcgccgccgagttccgcctcccgcgcgctctgtcgcaggagaagaagcgcgcgcgcgtggacgcgctcatcgatcagctcggcctcacccgcgccgccgacaccatcatcggcgacgagggccaccgcggggtgtctggcggcgagcgccggcgagtttcgatcgggacggacatcatccacgacccgatcctgctgttcctggacgagcccacctccgggctggactcggcgagcgccttcatggtggtgcaggtgctccgccgcatcgcgcagagcggcagcgtggtgatcatgaccatccaccagcccagcgcccgcatcctcggcatcctcgaccgcctgctcctcctctcgcgcggccgcaccgtctacgccggcacgcccgccggcctcaagcccttcttcgccgagttcggcgcgcccatcccggacaacgagaaccccgccgagttcgcgctcgacaccatccgcgagtacgagcgccagcccgacggcgccgccgcgctcgccgacttcaacgccaagtggcagaacaacggttcttccacggacaaggacagcaagctgatgagcacgatgcccttggagctcgccatcgccgagagcgtgtcccggggtaagctggtcgccgggagcgggtcggggagcgcggtgagcggcacggtgccgacgttcgcgaacccgccgtggacagaggtgtgggtgctgatcaagcggtccttcaccaacacggcgcgcatgccggagctcttcgccatgcgcctcggcaccatcatggtcacgggcttcatcctggcgaccatcttctggcgcctggacgacacgcccaagggcgtgcaggagcggctgggcttcttcgccatggccatgtcgactatgttctacgtgtgcgccgacgcgctgccggtgttcgtgcaggagcgccacatctacctgcgcgagaccgcgcacaacgcctaccgccgcatctcctacgtgctcgccaacgccgccgtcgccttcccgccgctcgtgctcctctccctcgccttcgccgtcaccaccttctgggcggtggggctcgccggcggcgcctcgtcgttcctcttcttcgtcctcatcatcctggcctccttctgggcgggcagcggcttcgtcaccttcctctccgccgtggtgccgcacgtcatgctggggtacacggtggtcgtcgccatcctcgcctacttcctcctcttctccggcttcttcatcaaccgcgatcgcatccccgactactggatctggttccactacctgtccctggtgaaatacccgtaccaggccgtgctccagaacgagttcagggacgcgtcgcgctgcttctcccgcggcatcgagatgttcgacggaacacccgtggggcgcatgtccgaggccgtcaagctcaaggtgctcgacgccatcagcaagacgctggggtccaacatgacggcgagcacctgcgtcaccaccggcgccgacgtgctggtgcagcaggccgtcacggacatcagcaagtggaagtgcctgctggtgaccgtggcgtgggggttcttcttcagggccctcttctacgtggttctgctcgtcgggagcaagaacaagcgcaaataagctagtagaaaaggaaaaatatgttcagttattttgttgaattgtgctggtgaagcaaatgtatagctcgatctgtgcaacttttatgtttaagaaatatgtatcatttttttttacattttacgcataatgaatgcaatgcttggtgtgaaaaacttcaaatactagttttacagcagcaattattcagattactatgtcctatgtggtgtgcctcgatgaatctgcttggttcatggactcatggtcaaggcagcggtcttttcacatggagagagagagagagagacttctttcgtgtctgtttcaacattccccaaatgtgagtggcaagcagcgg

SEQ ID NO: 2767 - DNA, 2918 bp, Zea mays
ggctaccaaactcaaattgtcacccccaaacaacctaccatatacagtagcgtgagtgtgaaacaacttggtcttccgtcgtcgtcctcatcgtcatcatctgtaaaacgaagcagggagagacagaaacgtggtggacggccggtctcctactccgactggtacacgtacacccagacacagacacagacacagtacgagaccccaaagctggagaggatcccgctccacgcctcctccctataactaaacgcgcccgcccacgccacgctctcaagtctcaaccgcagcgacacgccaccaccagagcgcgccaacctcgtgctcgtgaacacacacacacacacacgcagctagccaaccgtctagcgcggatggccacctcgggccacgccgccgtggtggtcgacatcgacatcgacgagccagcctcgtgcggcggcaacgccgatgcggcgggcacgcgacagctgctcccaccggttgtgctcccgccggtgacgtacgtgctccgtttcaccgacctgtcgtacagtgtgaagaagcgcggcggcggtctgggctgcctgctgcctcggcggcggcccagcaaccgcctggcgtcctcggacgcgccggcgccggcgccgtccgacaccaccaccaagacccttctcgacggcatctccggggaggcgcgggacggggagctgctggcggtcatgggcgcgagcgggtcgggcaagtcgacgctggtggacgccctggcggggaggatcgcgcgcggcagcctccgcggcggcgtcacgctcaacggggagccgctgcagggccggcgcctgcgcgccatctccgcgcacgtgatgcaggacgacctgctgcacccgatgctgacggtgcgcgagacgctgcggttcgccgccgagttccgcctcccgcgcgcgctgcccgccgaccgcaagcgcgcgcgcgtcgacgcgctcgtcgaccagctcgggctggcccgcgccgccgacaccatcatcggcgacgaggcccgccgcggggtgtcgggcggggagcgccgccgcgtgtccatcggcaccgacatcatccacgaccccatcctgctgttcctcgacgagcccacgtcgggcctcgactccgccagcgcgttcatggtggtgcaggtgctccgccgcatcgcgcgcagcggcagcgtcgtcatcatgaccgtccaccagcccagcgcgcgcatcctcggcatcctcgaccgcctgctcctgctctcgcgcggccgcaccgtgtacgccggcacgcccgcggggctcaaacctttcttcgccgccttcggcgcgcctatcccggacaacgagaacccggccgagttcgcgcttgacaccatccgcgagtacgagagcagccccggcggcgccgccccgctcgccgacttcaacgtcaagtggcagcgcggcggcgacgcgcccgccgagggcaagctcatgccactggagctcgccatcgctgagagcgtgtcccgcgggaagctggtggccgggagcggtcgtcccggcggtggcggtggcggcggcgcggccaccgggtcgtcggtgccgacgttcgccaacccgccgtggacggaggtgtgggtgctcatcaagcgctccttcaccaacacggggcgcatgccggagctcttcctgatgcgcctcgggaccatcatggtcacgggcttcatcctggccaccatcttctggcgcctcgacgacagccccaagggcgtgcaggagcggctgggcttcttcgccatggccatgtccaccacgttctacgtgtgcgccgacgcgctgccggtgttcgtgcaggagcgccacatctacctccgtgagaccgcgcacaacgcctaccgccgcgcctcctacgtgctggccaacgccgtcgtcgcgttcccaccgctggtgctcctgtcgctggcgttcgcggtcaccacgttctgggcggtggggctcgcgggcggcggcccctcgttcctcttcttcgtgctcatcatcctcgcctccttctgggcgggcagcggcttcgtcaccttcctctccgcggtggtgccgcacgtcatgctgggctacacggtggtcgtcgccatcctcgcctacttcctcctcttctcgggcttcttcatcaaccgcgacaggatcccggactactggatctggttccactacttgtcgctggtcaagtacccgtaccaggcggtgctgcagaacgagttcagcgacgcctcgcgctgcttcacgcgcggcgtcgagatgttcgagggcacgccgatagcgcacatgacggaggccgtcaagctcaaggtgatgcaggccatcagcgacaccctgggctccaacctcacggccaacacctgcgtcaccaccggcgccgacgtgctggcgcagcaggccgtcacggacattggaaaatggaactgcctgctggtgaccgtggcgtggggcttcttcttcagggcgctcttctacgtcgtcttgctcgttagcagcaagaataagaggaagtaaattaattaattaattagcaggttgattaaacttatataaaataatgcacgtgtgatattgtgatgtagctagggatgatggagcaaatgcataacaccagatgtaaatttattgtttttgttttttaataagaaatatacacattgtttgtcatgttttgtttttttaaggatggcatggattgtgttgagaaatttgtgtgttttcagttaagaaacctgccttcgttccagccttccaggaaagtgtgttgcaagagtcttgctaacacttctttcaaagaaaaggaaaaacctggtctcacaataatccaacaattttggatactattattgttgagctctaaaaagagcagtgcggacggtccggccccgaggccggacggtccgtgatccggac

SEQ ID NO: 2768 - DNA, 2914 bp, Sorghum bicolor
gctacacgcttttttttttttctctcaatacagatgggtggggcgaataaatgtccgtgctctttggacggcacgacgcgtccagggcccaactccatcgcacgcccgccgacttcgagcctatctcgtccacacccgccccgcaccactccctataagagaagtcggaaacgagcccagcccacgctccacgcgcacctgcggctcggctggcaaccaatccaaacaaccagcccgcccgccctcgccgctcgctgctcgccggcgcttagagccaagtagccaacacaacacacatggcagccaccggccacgccgtggtcgacatcgacttccccgacgaggcggccgacgccgcaaagccgccggtcgcgccagtcccctacgtgctccacttcgccgacctgtcctacagcgtgaggacccgcagcaagggcggcggcggcggcctgctgccgtcgtcgtcgtcggggcaccgccgccttgtggcctccgcggccacgcccccgccccctgcgccgacgtcgtccggatcgtcgtccaggcgcaccaagacgctgctcgacggcgtctccggcgcggcgcgcgcgggcgagctgctcgccgtcatgggcgccagcgggtcgggcaagtccacgctcctggacgcgctggccgggcggatcgcgcgggacagcctccgcggcgccgtcacgctgaacggcgagccgctccagggccggcggctccgcgccatctccgcgcacgtcatgcaggacgacctcctgtacgcgatgctcaccgtgcgcgagacgctgcggttcgccgccgagttccgcctcccgcgcgcgctgtctgccgagcggaagcgcgcgcgcgtcgacgcgctcgtcgaccagctgggcctgtcacgcgccgccgacaccatcatcggcgacgagggacaccgcggggtgtccggtggggagcgacggcgcgtgtcgattgggaccgacatcatccacgaccctatcctgctcttcctcgacgagcccacctccgggctcgactccgccagcgcgttcatggtggtccaggtgctccgccgcgtcgcgcagagcggcagcgtcgtcgtcatgaccatccaccagcccagcacccgcatcctcggcatcctcgacagcctcctcctgctctcgcgcggacgcaccgtgtacgccggcactcccgccgggctcaagcccttcttcgccgagttcggcgcgcccgtcccggacaacgagaacccggccgagttcgcgctcgacaccatccgcgagtacgagcaccagcccgacggcgccgcgccgatcgccgacttcaacgtcaagtggcagcacagcagcagcgcatcgttcgccgccgtggacaacaacaacaacaacaagctgatgccgctggagctggcgatcgccgagagcgtgtctcgagggaagctggtggccgggagcggtgggacgggcggcgggagcgcggtgacggtgccgacgttcgccaacccgccatggacggaggtgtgggtgctgatcaagcgttccttcaccaacacggggcggatgccggagctcttcgtgatgcggctcggcaccatcatggtcaccggcttcatcctggccaccatcttctggcggctggacgacacacccaagggcgtgcaggagcggctagggttcttcgccatggccatgtccaccatgttctacgtgtgcgccgacgcgctgccggtgttcgtgcaggagcgtcacatctacctgcgcgagacggcgcacaacgcgtaccgccggatctcgtacgtgctggcaaacgccgtggtcgcgttcccgccgctggtgttgctgtcgctggcgttcgcggtcaccacgttctgggcggtggggctggccggcggcgcgtcgtcgttcctcttcttcgtgctcatcgtgctggcatccttgtgggcgggcagcggcttcgtcacgttcctctcggcggtggtgccgcacgtcatgctgggctacacggtggtcgtcgccatcctcgcctacttcctcctcttctccggcttcttcatcaccagggatcgcatcccggactactggatttggttccactacctgtcgctggtgaagtacccataccaggccgttcttcagaacgagttcggcgcggcgtcgcgctgcttctcgcgcggcgtggagatgttcgacggcacgccgatcgggcgcatgccggaggccatgaagatgaaggtgctcgaggccattagcgccaccctgggcaccaacgtcacggcggatacatgcgtggtcaccggcgcagacgtgctggcgcagcaggctgtcatggacatcagcaagtggaagtgcctgctggtgactgtggcatgggggttctttttcagggttctcttttatgtggtcttgctagtagggagcaagaacaagagaaaataaggtagcacccacaacagaacacatgtaaagttatagctcgatttgtgtaacttgttagaacgtttccaatggtttttaaatagctggtctaaaaataattctattggctattttctgtgttctcagttttaaatcaaatggcgggacattattctttttaaactgaaagagattttcgaaggcaggcgaataagaactggctttctccgttaaagtgtaacagaggcagacgcctcagcggtgccaccttagttaatggattaacgaggtagacaatttaggaggccctcctccattaatacacattaacacaaacggccattctaatataaccatttgcgttaatggattaatggaggtgcacgtcttgcccaccaagcctttttttttacccgcctcagataagaagtttttagtagtaacaactggtaaaatatctcaagctctaaccgcaggtcgtatttggatagctcttgatcagattt

SEQ ID NO: 2769 - DNA, 10745 bp, Oryza sativa
aaactaacaccgcggtgtgatccattctgcaagtgatccgttctgcatggcgacctccgcccacacggtgctcgacgtcgactccggcggcggcgcggcgaccgcggcggccggcccgccggtgccgtacctgctgtccttcaccgacctctcgtacagcgtcaggaagggcggcggcggggtcctgtcgtgcctgccgtcgagccgccgccgccgccacagcaaccgcctggcgtccgcggacgcgccggcgccgcccgacgcgcccaccaaggcgctgctcgacggcatctccggcgaggcgcgggacggcgagctgttcgccgtcatgggggccagcgggtccggcaagtccacgctggtcgacgcgctcgccggccgcatcgcgcgggagagcctccgcggcgccgtcgagctcaacggcgagccgctccatgggcgccgcctccgcgccatctccgcgtacgtcatgcaggacgacctgctgtacccgatgctcaccgtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccatatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcgacgcggtgcttctcccgcggcgtcgagatgttcgacgggacgccgatcggcgccatgtccagggccgtcaagctcaaggtgctcgatgccatcagcaagacgctcggcaccaacatgacggcgaacacctgcgtcaccaccggcgccgacgtgctggcgcagcaggccgtcactgacattggcaagtggaagtgcctgctggtcaccgtggcgtgggggttcttcttccgggctctcttctacgtcgtcttgctcgtcggcagcaagaacaagaggaggtagagagagaggggccgatcatgttcagctgatatgatgtctgaattaatgacagcaagaaatgtgtgatatgctagtagtgtatttgtttgtgtaattttctcattttgttgaagatgcagttcatgtatgtgaatgtgttcagttttactggctgttatacactaaaacatacagaattacatgttgatatactgtttctcaatgacccttctgttctgaggctctctctgattttatttttatgccttctactattattattttttcaagggaacggcaaggagctcctgcatttcactatagaagaagagagttgatcaatgataaacagatgttaaaaaatgagtagctctttttgaacaaatgtgcaaaactatatgttctgtaacagtatatgttcaatagtaagaaactatatttcacagctacgataaagaaatgtgcagttgtatatgttgtgtacaactgagagttacactgttattagttaatagttattatcaacaataaatatgtcacacagttaagaagatgggcagcattgaaaatatcaaaagtaaaaaaaaaaaggcatggtatactgaattttgtaccatttgacgtatgctacctaactctgttttaataatcatatatttccttcctctatctgtttttagctggtgccttgctcctggctaaatgataatgacaaggatgcaacaagttgttgcacatttgggtttcctcaaggaaactgaaattaaaagatgttcggttgcattgatccttttgttgaattggtgctgccaaaaaggcatggttttctatcatcattcggatggttagttctgccaaacagtttaaatttgtagtattgaaaaggttgcaccacacatgatttacttgctcaatcttcaggttcaggtcagcagatgggtcagagggagacgtctgtcctactagcttatttggtcagtatgaaatggcggcttaaagtttcagacacttcagctcaaattcttctgatatggtacatgtgtacaaccagctgttacactgtcttcagagacttgtatttccaaacttcctttttcttctgaagcaggttggtgcaaacttaacttctcaactttgccaaatactagggctcttgtgctagtagaaacatctgtcttgtcaagttgaacatgcattactaattcaagaaacttaccatggagttccatgttgctgaaatcatgcaatggattatggatgtacatgtttcagacaccttttctgacagtaagaaaaacccaaaaatgtttcataagattgttaacccagaagtaatagttaagtactattggcagattcgactgtatacatcgatccactttggatgtagaggctgagttttaatctttttttaaaaaaaatgttatagtataaggcagctgaaatgcaaccgtagttttcttgtacacgacatgtatgtacatatatctgtggtcaaatacctgtcgtgacggcgacacatgagactagtggtttggcctgtagctgcaagtcaagagcgaggcaggcaaggcaacctgaattttgagaaacacagatgtcacaaatttgccggtttgttcatcacaaggaaaatgtggcttcagaaaggagaattcgacaagatgccaatgccaaatggatccagagaaagatgatggatagatatccattcgtccatcatgctaagtaggattagtatctatcagctaaatctcatctccttacgtttctcaatgaggatgcaacgccattggctgatccatgttttgttcaggtgtttgggctacctctgatggctcctgcagccacaccttttgccttgctttcaaaagggtctcggagaagaaaccaactaaagctattttgttttaaagaatctaggggacaatatcagcagcaaatgtgtagtatttgacaactcatatgtctcacaaacaaagttaactcttgctaatctatgcacagtggttagtaggactaatggaggaaatcaatgtcatttactagttcatttcaggccttgatcattaaactgacctgcccttgtttcttgattggatctgagagaaggtaggaagatgctataacataatacttcctatatggcatccttaacttttgatatgcatttaaccatttattttgataaaaaaattgtgcaagtatctaaaaatataagttatgcttaaaatacattaatgataaaacaaatcataataaaacaagtaataattatcacgcatggttaaagatgtgtctgaaaatcaacaaaaaaaataacagggagtatatgtatattttttggatggcggatcaatgtgataagtgcaagaaaggccctactagctagcaaaatcgcacaagttagttcctgctgacttcaaactttgtcaatcatcagctacagtgttttttattttgttttcattccgattcttctcctgatctgcaacagcaacaagaacaaggataggaagaagaagacgtagaacgtacaagaaaacatgtgttcctcgtgatcccattttatcctcctcctgtgcctaatgcatgtatttccttccaaacgagttggagaaaagctacaaacttctgccaaattcccagcaattaattaatgcccatcacatgtaaacttcagactggttgcaaattgactttcagagatttttcaactctagctctatctcctctcaaaagacgacgaaatacaatacaagacatgccaaatttaacttgaaaacatcaataacgcgtcccaaaattgaatatctgtactcatgtatgtactgccttctttttcttgcacgaaataattttgcatcccgaattaatacactgttcggtgcaggaggaccagagagatgatagatgatgatattaagagtggctgcaagaaactggtactaacttggccagcgaatctgcactgtttctgctagtaatggaattcattttggttcgtgccgactaatagctggttacatctcgctttcttggcactcgatgactctcgagactttctcgcgtgacttgctgctcgaattaatttgcacccatactagtacgtgattaattcatctcaagaaatgaaaaggatgaaaaatttcaataagggtgtgtttagattcagtggtgtaaagttttagcgtgtcacatcgggtattatacagggtgtcgcatgaattgtttgggcactaataaaaaactaattacagaatccgacagcaaaccacgagacgaatttattaaacctaattaatccatcattagcaaatgtttactatacgtagcaccacattgttaaatcatgtagcaattaggcttaaaaagttcatctcgtaaattagtcacaacatgtgaaataagtttttttcagcctatatttaatacttaatgtagatgttcagacattcgatgtgacagggagtaaatttttcgtgtggaactaaacatagcctaatacagtactaaggtccctttttttaagttaaagtgcagatcctacatcagtttcgttagaacgctgtttaaattgttaaacggtatgtttcgtgcgaaaactttatttttatatacaagttgctttaaaatattaaataaatttatttttaagtttataataattaaaactcaattagccatacacttatgactttttccttttgcatgtttttacttaatgttaacttttgtctatcccgaacaggcctaattactactgagaaacagagaagaatctgtagtagcaagaaacagaagcatcagagtgggtcaatgaaagattggcaggcagttgctcgatttggcaggcgagttcgtcttggcttgcatactgaggtgacagtgagggaagaagattgagcgcccatcaaggaggaaacagaggatgatttggagctcatcacgcttgactttgacctaaattaatttcctgtaactgccctgcccataacgaaattctactattgcatgcacgggtgcagtaagtagtagtgtacggtggattcagactttcagatattcctactacagtggacggtgatgtcttgacaccccgtgtgtacccactcttttcgtaccccctccatcccaaaataagcacatcacctatggaacatctatttccatgtacaactttaatcgttcatcttatttaatttttttagaaaacctaaaaaacataagtcacgcataaagtactatttatgtttcataatctaataataataaaaatattaatcataaaaaaaaattaaataagacggatgatcaaagttagacacggaaagttatgactatgtttattttattttgggacgaagggactaagggagtacacgctatgacagtatgacaccctcgctagagagcccggacagctagacatacgactgtttatcgactgaaaattggattgagaatttagttgaggagttgatgcagtgattggtcatgtgagttttattttaaggtctcgcctgaaacgtaggattggaggagtacatgtacagaggaaaaacacagaaatataaaagaaatgtatatgcaaaattaatgattgaaaaaagtagaaaaactctaagaatggtctaaatggtctaatagaaaaacacagaaatattatgttaatatatagtaaatcaaatctaaatggtctaatacatgcagcaaagcgtcaaggtaagatcaaacatatcttccaatggtgctttgcctcgaacctatgcatgggaaaagaatagctagctcgagatggatgttagtttttctataaaattcccttgaattcatggttataagaaaatttcataagctttttgctcacatatatatatgcttttcctttgtgttctcctaaatccctgtgcctcatttggtggtaaagataaatgataggatagggctacgggtcctaggtccgtcactagacatatagttcttcctaggagtggacaaaaagctcaggcttgatttggcctctgctctgttcgaaagccaaatgagaatatcctaagctagctcacgagccgcttgtttggctagtaagcttgagctaatatgtacttatgaggattgttttattctctgtatggctcgtaagcatgggttgtcttttgtcaacttatgatttattatacgattatgaagaattgaatatgtgaacttgttttagttttgcatttcgatgttttgttcgcatcgaataactacaaatcatagaagagatgtttcgtatgaaagtctcgctagccggctcaagccatgaaacgagctgagccaagctcatgtttagctcgatttcttgactctggctcgtctcgtttccaccccaagtgcttcctatattcttatcaatattgggtatagtttttttcgatcatctgatcgtattttctcccaacgtattgtttctgtagagtactcaaaaacttgaaaaaggaacgggctcatctccataggagctatccaaactttatactacctctataaaatacatggtgtgagtgctcttaacatatcctccctctatctcaaaatagattatatcatattctattctagattagtttattttgagacaggaaagctccttgcctacactaatagggattttgggcatcatgacgtgtgcacttggctgagaacttgagtatatacgcctctttgcacacatgtatcacttgcttggattgaatatgtgcttatgaatgattgattgatgcacaaaggttggtccatttgtgggcctcttgagttgttaggttagttaggtacggcatactacttgcccagaccagagagccccagaatgtcttttaagcgatacatggcccacaagttatcttcgatgtgggcccaactaactcaatacggcccagtccatttgttactactgatctgacctcctggcccaacacaggttatgggctttccatattgcgtttactagcccagttattatttagattgagcccaattacgaccagtgcaatgtgttgaaaaagaaaacgcactcctcctattggttaactcttttactcgaaatgagaatacaatcataagcaatatcagatgttttggttgtcatctaattttcagtaataatttcactcatttgtattttaggacggaaatagtagcaatttgtttttccccatattccaactcattaccaaaatttcaacccaaatttcaaaatataataaaaacaaaagaaatggcaaatatatagatccaattcatggaaagcatgaaagctcaggccgtgtttagtttcaaaataattcttcaaacttccaacttttctatgacatcaaaacttttctacacacacaaatttccaacttttccgtcacatcgtttcaatttcaaccaaactttcaattttaatatgaactaaacacagcctcaatggaatatactaaatgaaattgaaattttatagtcctcccagtctcccatgctactgacgcaagatgtcaaagcacctttctgtctcaaagtgctgagtctgttcctgacacttccaaatccacagctccatcgagctgtctgattcccatgtcgtcggaaggaacagttgccaatgatatcccaccgtccgattcgtgccacgtgtcgtacgcttcatgtatacttgtacatcagactgtatattcatgttagcatgtatgatgtatacgtatctctatgccattcatgccttgcttgaagtatggaccaaggtttgcaacagcagatcagcagagcagagagaaaagaactggtctgaaaaattttgcctttttgccatgaacaatgatgctgtctcatgacactgtattagtactccaagatgcataatcttttttgcctttttttagatcttggtgaaatggtgatcggtgagtgctgtactactactagtctctggaaggaagaacacatcatcaacctggcattgacaagagtgattatctatcagtgacactgaagagagaggcagaactggcaatggcgtgcgtggtgactataatcatatcccatgcatgtgtagtgttgcctgcgccttcttgatgatggccattcgttttcagttcatcatcgatctagtgcttcacccatgtcctttgctttgacacatctttgtgcacaatggtattgtttatctcaacaacttgggggattgcagaaggtcaattgattaaattaactgttgctacttggtatctgttctgaattctgactgaaaacaggtattgctcttctcttgtctctccgtttcagggagggtgcagcaatttatgaaattgagatgagagaaataacaacagagaatgttgtagcttactcttctgtttctgttttccaatatacttttacagggggagaagggatagatctcattactctgcttaaagatatgtaggcctgaatcattctgaataacagtgctacctgattatttcctacctgaactttcagaaagtccctctatgtaatgtagcacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctag

SEQ ID NO: 2770 - DNA, 2704 bp, Setaria italica
cctagtcctagtacagggcccaacccagctgcaagtcggtctcctgctccagcatgtaacgagtccgacccccgatccgagtcagagcccgactcggtcggccccccgccgcagcccgcaggcgcacccctcctctataagactacaacatgtagacgagcccacgccacgctcttcacacaccaaaacggaccatccaagcaacgacgccggccgtgcgcccgcgacgaagcagatacacacatggcggcctccggccacgcggtggtcgacatcgacgcggcgaagccggcgctcgcgcctgtcccctacgtgctcagcttcgccgacctctcctacagcgtcaggaagggcggcggcctggcgggctgcctcccgtcgcgcgccagcagcagccgcctggtggcgtccgcggacgcgcccccgtcgtcgtcggggtccaggcacaccaagacgctgctcaacggcgtctccggcgaggcgtgcgcgggcgagctgctcgccatcatgggcgccagtggctccggcaagtcgacgctggtggacgcgctggcggggcggatcgcgcgggagagcctccggggcagcgtcacgctcaacggggagccgctccaggggcggcggctccgcgccatctccgcctacgtcatgcaggacgacctgctgtatccgatgctgacggtccgcgagacgctgcacttcgccgccgagttccgcctcccgcgcgcgctgtcgccggagaagaagcgagcgcgcgtggacgcgctcatcgaccagctcggcctcgcccgcgccgccgacaccatcatcggcgacgagggccaccgcggcgtgtcgggcggggagcgccggcgcgtgtcgatcgggacggacatcatccacgacccgatcctgctgttcctggacgagcccacctccgggctggactcggcgagcgccttcatggtggtgcaggtgctccgccgcatcgcgcagagcggcagcgtggcgatcatgaccatccaccagcccagcgcccgcatcctcggcatcctcgaccacctgctcctcctctcgcgcggccgcaccgtctacgccggcacgcccgccggcctcaagcccttcttcgccgagttcggcgcgcccatcccggacaacgagaaccccgccgagttcgcgctcgacaccatccgcgagtacgagcgccagcccgacggcgccgccgcgctcgccgacttcaacgccaagtggcagaacaatgcttcttccacggacaaggacagcaagctgatgagcacgatgcccttggagctcgccatcgccgagagcgtgtcccggggtaagctggtcgccgggagcgggtcggggagcccggtgagcggcacggtgccgacgttcgcgaacccgccgtggacagaggtgtgggtgctgatcaagcggtccttcaccaacacggcgcgcatgccggagctcttcgccatgcgcctcggcaccatcatggtcacgggcttcatcctggcgaccatcttctggcgcctggacgacacgcccaagggcgtgcaggagcggctgggcttcttcgccatggccatgtcgactatgttctacgtgtgcgccgacgcgctgccggtgttcgtgcaggagcgccacatctacctccgcgagaccgcgcacaacgcctaccgccgcatctcctacgtgctcgccaacgccgccgtcgccttcccgccgctcgtgctcctatccctcgccttcgccgtcaccaccttctgggcggtggggctcgccggcggcgcctcgtcgttcctcttcttcgttctcaccatcctagcctccttctgggcgggcagcggcttcgtcaccttcctctccgccgtggtgccgcacgtcatgctcgggtacacggtggtcgtcgccatcctcgcctacttcctcctcttctccggcttcttcatcacccgagaccgcatcccgggctactggatctggttccactacctgtccctggtcaagtatccgtaccaggccgtgctccagaacgagttcggcggtgcggcgcgctgcttctcgcgcggcgtcgagttgttcgacggcagcccaatcgggcggctgccggaggccgtgaagctgaaggtgctggaagctatcagtgccacgctgggtacgaacgtcactgccaacacctgcgtcaccaccggcgccgacgtgctcgcgctgcaggccgtcaccgacatcgggaagtggaagtgcctgctggtaaccgtggcctgcgggttcctgttcagagcattgttttatgttgtcttgctcgtcagcagcaagaacaagaggaagtgaacaagagcatgtgtatcagtattcagcaatgttgtttaatttctgttttctttcttccagcagtatttcttaatttctcaaacatgtgtcctgctttaactgatggaagagttgaagctgtaaatgtttatgaagtatgtagtccttcccagaaaataaaggagtttcttagaaacatgttcgtatcagagttaaaataatcatttgccaattaacatcgatgaaaaaaacgtgaatgcataagcaaataataattacggcttctgcggtggaaggcgtcaaatacaacacactaatgtaaataagatgcacaaattaatcagaagtttctttccacagaaaaaataatcagaagtagcaaaaggtggtatcagagatgagaagggca

SEQ ID NO: 2771 - DNA, 2368 bp, Oryza sativa
gaacagttgtaagaaaagcaattgattgcgcacttgatccataccttacattcttgattacacattgctgactttatcgtgatgagtaaattaaatttgcacagtcgattgtttagcctgacacgagtcttcaagtctgaacccaaatcgagccaaccaaacacgctcctatataaaggccgcgaccaacacgcaccgcaccgcaaactaacaccgcggtgtgatccattctgcaagtgatccgttctgcatggcgacctccgcccacacggtgctcgacgtcgactccggcggcggcgcggcgaccgcggcggccggcccgccggtgccgtacctgctgtccttcaccgacctctcgtacagcgtcaggaagggcggcggcggggtcctgtcgtgcctgccgtcgagccgccgccgccgccacagcaaccgcctggcgtccgcggacgcgccggcgccgcccgacgcgcccaccaaggcgctgctcgacggcatctccggcgaggcgcgggacggcgagctgttcgccgtcatgggggccagcgggtccggcaagtccacgctggtcgacgcgctcgccggccgcatcgcgcgggagagcctccgcggcgccgtcgagctcaacggcgagccgctccatgggcgccgcctccgcgccatctccgcgtacgtcatgcaggacgacctgctgtacccgatgctcaccgtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccacatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcgacgcggtgcttctcccgcggcgtcgagatgttcgacgggacgccgatcggcgccatgtccagggccgtcaagctcaaggtgctcgatgccatcagcaagacgctcggcaccaacatgacggcgaacacctgcgtcaccaccggcgccgacgtgctggcgcagcaggccgtcactgacattggcaagtggaagtgcctgctggtcaccgtggcgtgggggttcttcttccgggctctcttctacgtcgtcttgctcgtcggcagcaagaacaagaggagctggtgccttgctcctggctaa

SEQ ID NO: 2772 - DNA, 2491 bp, Panicum virgatum
gggcctgagttcttcgacatgatctctcctagctagcttcagcggagggaccaacccagctagcagctactagccggacggactcctacaccgaactcgagcatgtactccgtccgcagccgacccgagtcggagcagagcacgactcgggctcgcactgcccactacgcccctctctataacaagtaaacgagcccacggacgctattcacacaaccaaacatccaaggtacatccaagccaggaagcaccatgcccaccctcgcctggttcctgcaacgaggctcgagcgctcgtgacgcagcggatacagcaggcatggcggcctccgggcacacggtgatcgacatcgacgccgccgatggcgaggcgacgaagacgccgctcgcgcccgtcccctacgtgctcagcttcgccgacctctcgtacagcgtcaacaaggcgggctgctgcctggctccccgcgccaacagccgcctggtggcgtccgcggacgcgcccccgccgcgaacgtcggggtccgggcgcgccaagacgctgctcgacggcgtctcaggcgaggcgcgcgcgggcgagctgctcgccgtcatgggcgccagcggctccggcaagtccacgctgctggacgcgctggcggggcggatcgagcgcgagagcctccgcgggagcgtcacgctcaacggggagccgctccagggccgccggctccgcgccatctccgcccacgtcatgcaggacgacctgctgtacccgatgctgacggtccgcgagacgctgcgtttcgccgccgagttccgcctcccgcgcgcgctgtcgcaggacaggaagcgcgcgcgcgtggacgcgctcatcgaccagctcggcctgtcccgggccgcggacaccatcatcggcgacgagggccaccgcggggtgtccggcggcgagcgccgccgcgtgtccatcgggacggacatcatccacgacccgatcctgctgttcctcgacgagcccacctccgggctggactcggccagcgccttcatggtggtgcaggtgctccgccgcatcgcgcagagcggcagcgtggtcatcatgaccatccaccagcccagcgcgcgcatcctgggcatcctcgaccgcctgctcctgctctcgcgcggacgcaccgtgtacgccggcacgcccgccggcctcaagcccttcttcgccgagttcggcgtgcccatccccgacaacgagaaccccgccgagttcgcgctcgacaccatccgagagttcgagcgccagcccgacggcgccgccgcgctcgccgaattcaatgcgaacaggacgatgaagaccatagtcaagcttacgagcaccatggctctggagctcgccatcgccgagagcgtgtctcgggggaagctggtcgccgggagcggttcggggagcgcgttgagcgggacggtgccgacgttcgcgaacccgccgtggacggaggtgtgggttctgatcaagcggtccttcaccaatacggcgcgcatgccggagctcttcgccatgcggctgggaacgatcatggtgaccggtttcatccttgccaccatattctggcgcctggacgacacgcccaagggcgtgcaggagcggctgggcttcttcgccatggccatgtcgaccatgttctacgtgtgcgccgacgcgctgccggtgttcgtgcaagagcgccacatctacctccgcgagacggcgcacaacgcctaccgccgcatctcctacgtgctcgccaacgccgtcgtcgccttcccgccgcttgtgctcctatccgtcgccttcgcgctcatcaccttctgggcggtggggctcgccggcggcgcgtcgtcgttcctcttcttcgtgctgatcatcctggcatccttctgggcgggcagcggcttcgtcacgttcctctccgcggtggtgccgcatgtcatgctagggtacacggtggtcgtggccatcctggcctacttcctcctgttctccggcttcttcatcacctcggaccgcatccccgactattggatgtggttccattatctctcgttggtcaagtacccctaccaggcggtgctccacaacgagttcagggacgcgtcgcgctgcttctcacgcggcatcgagatgttcgatggcagaccgattgggcacctcccggaggccgtgaagctcaaggtgttggacgccatcagcaatacgttgggatccaacatgacggctagcacctgcgtcaccaccggcgctgacgtgctggcgcagcaggccgtcacggacataggcaggtggaagtgccttatggtcaccgtagcatgggggttcgtgttcagggcactcttttatgtggtcttgctcattggcagcaagaacaagcgcaaatgattgtgctgataatcatatctttatatgtccagctttttatttttaagaaataataatatgggtgtgtctagacatgttgattgatatttgtggtatccatcaatcaccg

SEQ ID NO: 2773 - DNA, 1982 bp, Oryza sativa
ctctctctacctcctcttgttcttgctgccgacgagcaagacgacgtagaagagagcccggaagaagaacccccacgccacggtgaccagcaggcacttccacttgccaatgtcagtgacggcctgctgcgccagcacgtcggcgccggtggtgacgcaggtgttcgccgtcatgttggtgccgagcgtcttgctgatggcatcgagcaccttgagcttgacggccctggacatggcgccgatcggcgtcccgtcgaacatctcgacgccgcgggagaagcaccgcgtcgcgtcgcggaactcgttctggagcaccgcctggtacgggtacttgacgagcgacaggtagtggaaccagatccagtagctcgggatgcggtcgcggttgatgaagaagccggagaagagcaggaagtaggcgaggatggcgacgaccaccgtgtatcccagcatgacgtgcggcaccaccgcggacaggaacgtcacgaacccgctccccgcccagaacgacgccaggatgatcagcacgaagaacaggaacgaaccgccgccgccggcgaggccgacggcgaagaaggtggtcaccgcgaacgccagcgacaggaacaccagcggcgggaacgcgacgacggcgttggcgaacacgtaggagagtctccggtacgcgttgtgcgctgtctctcggaggtagatgtggcgctcctggacgaacaccggcagcgcgtcggcgcagacgtagaacatggtggacatcgccatggcgaagaagccgagacgctcctggactcccttgggcgtgtcgtcgaggcgccagaagatggtggcgaggatgaaccccgtcaccatgatcgtgccgagccgcatcacgaacagctccggcatgcgccccgtgttcgtgaaggatcgcttcatcagcacccacacctcgacggacagcgggttcgcgaacgtcggcaccgaggtcgacgacgccgtccccgagccgctgccggcgacgagcttccccctcgacacgctctccgtgatggcgagctcgagtggcatggtgcatcgcttgctgtccttgctgtcagctgccgggagtgcggcgtgcatggactgccacttgacgttgaagtcggcgagcggggcggcgccgtcgggctggtgctcgagctcgcggatggtgtcgagcgcgaactcggccgggttctcgttgtccgggatggggtcgccgaactcggagaagaagggcttgagccccaccggcgtgccggcgtagacggtgcggccgcgggagaggaggaggaggcggtcgaggatgttgaggatgcgcgcgctgggctggtggatggtcatgatgacgacgctgccgctctgcgcgatgcggcggagcacctgcaccaccatgaacgcgctcgccgagtccagcccggaggtgggctcgtcgaggaacagcaggatggggtcgtggacgatgtccgtgccgatggacacgcggcggcgctccccgccggacacgccgcggtgggcctcgtcgccgatgatggtgtccgcggcgcgcgcgaggccgagctggtcgatgagcgcgtcgacgcgggcgcgcttcttgtccggcgagagcgcgcgcgggaggcggaactcggcggcgaacagcagcgtctcccgcacggtgagcatcgggtacagcaggtcgtcctgcatgacgtacgcggagatggcgcggaggcggcgcccatggagcggctcgccgttgagctcgacggcgccgcggaggctctcccgcgcgatgcggccggcgagcgcgtcgaccagcgtggacttgccggacccgctggcccccatgacggcgaacagctcgccgtcccgcgcctcgccggagatgccgtcgagcagcgccttggtgggcgcgtcgggcggcgccggcgcgtccgcggacgccaggcggttgctgtggcggcggcggcggctcgacggcaggcacgacaggaccccgccgccgc

SEQ ID NO: 2774 - DNA, 2370 bp, Hordeum vulgare
acgacacacggagcgagccgggttttgctcccgcaccacaccacaccacaaaccccctccgtcgtcgatccatcgactcctctatcgatctttaccatgtccaactccggccacatcgccgtcgaggtcgacgacgcggcggagcgggagctgcaggcgctggtggcggcggggccaccggtgccgtacacgctctccttcacggacctctcgtaccgcgtgaagcagggccggggcgggctgctgggctgcctgccggcccgcgccagcaaccgcctggcgtccacggacgcgccgccggccaacaccaaggcgctgctggacggcatctcgggggaggcgcgggagggggagctgttcgccgtcatgggcgccagcggctccggcaagtccaccctcgtcgacgccctcgccggacggatcgcgcgcgacagcctccgcggccacgtcacgctcaacggggagccgctccacggcagccgcctccgggccatctccgcctacgtcatgcaggacgacctgctctaccccatgctcaccgtgcgggagacgctgctcttcgccgccgagctccggctatcccgcgcgctctcccccgccgccaagcgcgaccgggtggaccgcctcgtcgaccagctcggcctctcccgcgcggccgacaccatcatcggcgacgagggccaccgcggggtgtcgggcggggagcgacggagggtctccattggcaccgacatcatccatgaccccatactgctcttcctcgacgagccaacctctggcctcgactcggccagcgccttcatggtggtgcaggtgctccgcaccatcgcacgaagcggcagcgtcgtcgtcatgaccatccaccagcccagcgcgcgcatcctcggcatcctcggccgcctcctgctgctctcgcgcggccgcaccgtctacgccggcacgcccgcggggctcaagcccttcctcgccgagttcggcacgcccatcccggacaacgagaacccggccgagttcgcgctcgacaccatcagggagcgcgagggccagcccgacggcaccgcggtgctcgccgacttcaacgccaagtggcaggcgacccacaagctcatggacggcaacggcgccaagagggtgagcccgatgacgctggagtacgccatcgcggagagcgtggcccgggggaagctggtggccgggagcggcacggggacggtgtcgctgcagatgccgacgtacgcgaacccgatgccggtggaggtgtgggtgctgatcaagcgcgccttcaccaacacgcgccgcatgccggagctcttcggcatgcgcctcggcaccatcatggtgacgggcctcatcctggcgaccatcttccttcgcctcgacgacacgcccaagggcgtgcaggagcgtctggggttcttcgccatgggcatgtccaccatgttctacgtgtgcgcggacgcgctgccggtgttcgtccaggaacggcacatctacctgcgggagacggcgcacaacgcgtaccgccgcatctcgtacgtcctcgccaacgcggtagtgtcgttcccgccgctggtggccttgtccctggcgttcgcggtcaccacgttcttcgccgtggggctcgccggcggggcctcgtcgttcctctacttctcgctcatcatcctcgcctcgctctgggccggcagcgggttcgtcaccttcctgtcggcggtggtgccgcacgtgatgctggggtacacggtggtcgtggccatcctggcatacttcctcctcttctcgggcttcttcatcaaccgcgacaggatccccgactactggatatggttccactacatctccctcgtcaagtacccgtaccaggccgtgctccagaacgagttcggcgacgccacgcggtgcttcgcgcgaggggtgcagatgttcgacggcacgcccatcggcggcatgccggaggccatcaagatgaaggtgctcggcgccatcggcaacgcgctgggcacgcgcatgacgtcccacacctgcgtgctcaccggcgccgacgtgctcgcgcagcaggccgtcaccgacctcggcaagtggatgtgcctcctcgtcaccgccgggttcggcttcttcttccgcgcgctcttctacgtcgtgctgctcgtcggcagcaagaacaagaggaagtgataatggctcgatccctcgatcggcatgcattatgttcctgtatcttatttcagttttcgttttcatgtagtcaaaaagaggccgatgaatcagtgtacatgtatcaaatgttaagtactattggctcgtttatgatcataaattcagtgtatttgttcagtcattcgagcagtgacagcctactgttaaaaaaac

SEQ ID NO: 2775 - DNA, 2601 bp, Hordeum vulgare
cggagattagcgagcgggatggcgtggcaagcaacccgccccacgctccccgcgccatcgatcgcagctcctcaaccggccacggcacaaaaacctactccgatcgggactcagaccgcttccctcccctcccctcccctcccccacgactcggaaacgcacctcctccctcctcccccctatatattacagtacgctccaaccatacacggcacgacacacggagcgagccgggttttgctcccgcaccacaccacaccacaaaccccctccgtcgtcgatccatcgactcctcgatcgatctttaccatgtccaactccggccacatcgccgtcgaggtcgacgacgcggcggagcgggagctgcaggcgctggtggcggcggggccaccggtgccgtacacgctctccttcacggacctctcgtaccgcgtgaagcagggccggggcgggctgctgggctgcctgccggcccgcgccagcaaccgcctggcgtccacggacgcgccgccggccaacaccaaggcgctgctggacggcatctcgggggaggcgcgggagggggagctgttcgccgtcatgggcgccagcggctccggcaagtccaccctcgtcgacgccctcgccggacggatcgcgcgcgacagcctccgcggccacgtcacgctcaacggggagccgctccacggcagccgcctccgggccatctccgcctacgtcatgcaggacgacctgctctaccccatgctcaccgtgcgggagacgctgctcttcgccgccgagctccggctatcccgcgcgctctctcccgccgccaagcgcgaccgggtggaccgcctcgtcgaccagctcggcctctcccgcgcggccgacaccatcatcggcgacgagggccaccgcggggtgtcgggcggggagcgacggagggtctccattggcaccgacatcatccatgaccccatactgctcttcctcgacgagccaacctctggcctcgactcggccagcgccttcatggtggtgcaggtgctccgcaccatcgcacgaagcggcagcgtcgtcgtcatgaccatccaccagcccagcgcgcgcatcctcggcatcctcggccgcctcctgctgctctcgcgcggccgcaccgtctacgccggcacgcccgcggggctcaagcccttcctcgccgagttcggcacgcccatccctgacaacgagaacccggccgagttcgcgctcgacaccatcagggagcgcgagggccagcccgacggcaccgcggtgctcgccgacttcaacgccaagtggcaggcgacccacaagctcatggacggcaacggcgccaagagggtgagcccgatgacgctggagtacgccatcgcggagagcgtggcccgggggaagctggtggccgggagcggcacggggacggtgtcgctgcagatgccgacgtacgcgaacccgatgccggtggaggtgtgggtgctgatcaagcgcgccttcaccaacacgcgccgcatgccggagctcttcggcatgcgcctcggcaccatcatggtgacgggcctcatcctggcgaccatcttccttcgcctcgacgacacgcccaaaggcgtgcaggagcgtctggggttcttcgccatgggcatgtccaccatgttctacgtgtgcgcggacgcgctgccggtgttcgtccaggaacggcacatctacctgcgggagacggcgcacaacgcgtaccgccgcatctcgtacgtcctcgccaacgcggtggtgtcgttcccgccgctggtggccctgtccctggcgttcgcggtcaccacgttcttcgccgtggggctcgccggcggggcctcgtcgttcctctacttctcgctcatcatcctcgcctcgctctgggccggcagcggcttcgtcaccttcctgtcggcggtggtgccgcacgtgatgctggggtacacggtggtggtggccatcctggcatacttcctcctcttctcgggcttcttcatcaaccgcgacaggatccccgactactggatatggttccactacatctccctcgtcaagtacccgtaccaggccgtgctccagaacgagttcggcgacgccacgcggtgcttcgcgcgcggggtgcagatgttcgacggcacgcccatcggcggcatgccggaggccatcaagacgaaggtgctgggcgccatcggcaacgcgctgggcacgcgcatgacgtcccacacctgcgtgctcaccggcgccgacgtgctcgcgcagcaggccgtcaccgacctcggcaagtggatgtgcctcctcgtcaccgccgggttcggcttcttcttccgcgcgctcttctacgtcgtgctgctcgtcggcagcaagaacaagaggaagtgataatggctcgatccctcgatcggcaagcattatgttcctgtatcttatttcagtttttgttttcatgtagtcaaaaagaggccgatgaatcagtgtacatgtatcaaatgttaagtactattggctcgtttatgatcataaattcagtgtatttgttcagtcattcgagcagtgacagcctactgttaaaaaaaccactcttcagtttttttt

SEQ ID NO: 2776 - DNA, 1466 bp, Setaria italica
cgtccccgtcggccgcgcggctctgctgctgcagctgcctccgcctgcctgcctcgaagcttctcgcctcctccacccgtcccgtccccttcccctccaccgcgcctcctctccctcccaccgctcgcgccaagctagatttgattcctagccacttttaggatcggatcagattttcctctccgcccgattcgatttcaccacgacgaggctgcctctatcatttgttcagtctggtggtgttatcttgagaagacagaatacaggagtcgaatccaatgagttatgcctatcttcatcgtggttaaccaacggtggcaactgcttgtagctaatatcattccgagaacacccaatatggcggcaaatgttggggaatcgacaagcggcagcagcagtggcgctgatgctgggggtagcttcgagtgcaacatatgcttcgagctgccacaggagccgatcgtaacgctctgtggccacctcttctgctggccatgcctctacaagtggctgcgcatccactcgcactcgccagagtgcccagtgtgcaaggctgtcgtcgaggaggataagctcgttcccctgtatggccgtggcaaggaccgtgttgacccaaggtcaaagaacgtcccaggggctgacattcccaaccggccagctgggcagaggcctgcaacagctccgcaggctgatcctaacaaccacttccccaacgccaacccaaacccgtggttcatgggcggaggcatcccgctggccaatgcgcggtgggggaactacacattctcagccgcgttcgggggtctgttcccgctgctcagcttccaggtgcatgggttccctgatgcaacagcctatggtcagccggctgggttcccttatgggtatggccacggccacgggcatgcgttccacggtgggcacgctggacatgctcatgccgcagctccccggcacgggccgcatgggcagcagcagcaggcggatgtgtacctgaaggcgcttctcatcctggttggatttctcgtgatcgcaagcctcatcacgttctaggcttgcttgttggtgtcatattgctggtcagccttgctggtaataagtgggagatacagacaattgccgattctgatgttgttgtgtgcatttacctagctttgcctccatacacgactaaatctgaattgagtggtgcgtttgcatggaagtgttgatagagaaattcgtgtacatactgtttggatgtggtcctgtggagcacctacaggtatactgcggttttgattatacaatgaataatttggaacctctgtaactctgtttgtttgaatggaatgtagcaaggacattttaccctgcgtgtataccccttgtactttggatatctgtaagttgagcattaggcaaatggtcatgacttgtttggtttgaactttgaagaaggaatcaaacttatcctgtctaaatgc

SEQ ID NO: 2777 - DNA, 995 bp, Saccharum officinarum
cccacgcgtccggtccaggcaaatcccgtcttctctcccgtccccgtctgcctctcgtcgcacgcctcgaagcttctcgcatctactgggtgctccgtctcccacgccaccgccgccccggccgccggtaggtaatatcagttccaagagcactcgatatggcagccaacgttggggaatcaacaagcggcagcagcagtggcgctgatgctgggggtagcttcgagtgcaacatatgcttcgagctgccacaggagccgatcgtgacactctgcgggcacctcttctgctggccgtgcctttacaaatggttgcgcatccactcgcactcccccgagtgccccgtgtgcaaggctatcgtcgaggaggacaagctcgtccccctgtacggccgtggcaaggaccgtgttgacccaaggtccaagaacgtccccggggcagacatccccaaccgtccagctggacagaggcctgccacagctccgcaggccgaccccaacacccacttccccaacgccaacgcgaacccgtggttcatgggcgggggcatcccgctggcaaacgcgcggtgggggaactacaccttctcggcagcgttcgggggcctgttcccgctgctcagcttccaggtgcatgggttcccggacgccaccgcctatggccagcctgccgggttcccttacggatacggccacggccatgcgtttcatggcgggcacgctggaggacatgcccacgccgccgcagctcctcggcacgggcagcagcagcaggcagatgtgtacctcaaggcgctgctcatcctggtcggcgttctggtgattgtgagcctggtcacgttctaagctttgcctgttggttggtgtcatattggtttggtgttgccttgctggtaataaggagtagtaagagagcagaaacgttgtgatgctgctgtgcctttatcttgccctctccatgaatccatatacaacacgatcgaaactgaattatgc

SEQ ID NO: 2778 - DNA, 1211 bp, Oryza sativa
ggacccgatcccctcgcccgcctcgaaccttctccgccttcctcttcctcttcgtcttcctctgcggcgcacgcaggcggcgaatcctcctccgtcgacgcgactcctcctccgccgcccgccgctcatctcatcccactatggcagccaatgttggggaatccacaagtggcagcagcagcggtggtgccgattctgggggaagcttcgagtgcaacatatgctttgagcttccgcaggagcctattgtcacgctctgtggccacctcttctgctggccatgcctctacaagtggctgcacatccactcgcattcacctgagtgcccggtctgcaaggctgttgtcgaggaggataagcttgtccccctctatggccgtggtaaggaccgtgttgacccaaggtcaaagaacgtccctggggctgacattcctaatcgcccagctggacagaggcctgccacggctccgcaggccaatcctaacacccacttccccaatgccaaccccaacccttggttcatgggtggaggcatcccactagccaatgcacggtgggggaattacaccttctcggcggcatttgggggtttgttccccctgctcagcttccaagtccatgggttcccagatgcaaccgcctatgggcagcctgctggttttccctacggatatggacacggccacggtcacggtcatgggcacgcgttccacggcggacatgcccatgctgctgctgctccccgccatggaccgcctgggcaacaacagcaggcggatgtgtacctgaaggcgcttctcatcctggttggttttcttgtgattgcaagcctcatcacattctaggattgtgccatcatattgctgtgcttgtaataagaggaatgatttcccgagttgctttctgatgttgtgcattaccttgcctccacacacgacccagtctgaatcaagtggttcttttgcgcaaagtgttgatagaattcttgtatatacgaaatagatgtggtcgtgtggagcatatgtgtactgtggttcatgaataacatggaagctctgtctgaatgaactagagcaatgatacttatattgtgtttttgatatgatgatgctcagaatgagcaggctatgcaattgtttggagcacaaatgtattcctctatggcttgtactaaagactatcgcactgatatcatatctgtgttttgtggt

SEQ ID NO: 2779 - DNA, 2608 bp, Oryza sativa
gaaaaagattagagggggacccacccacccatgcgggacccgatcccctcgcccgcctcgaaccttctccgccttcctcttcctcttcgtcttcctctgcggcgcacgcaggcggcgaatcctcctccgtcgacgcgactcctcctccgccgcccgccggtgagtcatccgcctctatcctctctacctcctcgcgagcttgatttgctcggcctcacctcatctcatcccactatggcagccaatgttggggaatccacaagtggcagcagcagcggcggtgccgattctgggggaagcttcgagtgcaacatatgctttgagcttccgcaggagcctattgtcacgctctgtggccacctcttctgctggccatgcctctacaagtggctgcacatccactcgcattcacctgagtgcccggtctgcaaggctgttgtcgaggaggataagcttgtccccctctatggccgtggtaaggaccgtgttgacccaaggtcaaagaacgtccctggggctgacattcctaatcgcccagctggacagaggcctgccacggctccgcaggccaatcctaacacccacttccccaatgccaaccccaacccttggttcatgggtggaggcatcccactagccaatgcacggtgggggaattacaccttctcggcggcatttgggggtttgttccccctgctcagcttccaagtccatgggttcccagatgcaaccgcctatgggcagcctgctggttttccctacggatatggacacggccacggtcacggtcatgggcacgcgttccacggcggacatgcccatgctgctgctgctccccgccatggaccgcctgggcaacaacagcaggcggatgtgtacctgaaggcgcttctcatcctggttggttttcttgtgattgcaagcctcatcacattctaggattgtgccatcatattgctgtgcttgtaataagaggaatgatttcccgagttgctttctgatgttgtgcattaccttgcctccacacacgacccagtctgaatcaagtggttcttttgcgcaaagtgttgatagaattcttgtatatacgaaatagatgtggtcgtgtggagcatatgtgtactgtggttcatgaataacatggaagctctgtctgaatgaactagagcaatgatacttatattgtgtttttgatatgatgatgctcagaatgagcaggctatgcaattgtttggagcacaaatgtattcctctatggcttgtactaaagactatcgcactgatatcatatctgtgttttgtggtgtctttctgtcaacttatctctactagctttcagaatgtgttttaactgtccattgtacctttggttaaataatgaatacgagtgtgttagttgtatactgcatttctttttccaagaagttttttccgaagactcaaaaaactgtttaatgccaagtagctgtgggaaatggtggctgagtttgtgttcactatctgtaatagtagaatctatttgatgagactttctgaatcctgaatttctgatacattgagatttgaacagggttttgacttgtttgaccggagtagtatgaaattacaatacaacggcatttttactaaatgtatttctttagtaatgaggtgaggtagcaaaattcgaattcaaaattcataactccgtatccgtatggtaggtagcgtaactcgaaagctactgatgaaacgaaaagccgaggcgagactgaaggagtgtcagagcggaggggcacgtgtcgagcacccattgggtccctcgcctgcgcccctctgctctctttcccgccctttttattccccatctcctctctctcttctcctcctcggtttcgtttccttccttcttctcctcctcctccttctcccaatcgatcgcattcgaagcttcctccggtagctccggtgagggtgatggacgacctggacatggcgctgcctcaggccttcgagctcctcctcggcagaggtgatccatccatccattccctcatcctccctccctaaaccctagcgatcgatcgtttgtttcagtttgttcttaataatctcatcttttccattgctccatccgtgcagatcgagacgcctggccgcgcggggccgcgttcctcgtcgccgcccactacggggacgtccgcgaaatgaagagtaagccacatccaagaacccattttctttcccccctttgggttctgcttctgcatcgcatttggtacgaatttcttgctgaacatggctgcggggttttcatgtgtgggtgcttgcgctggattcttctggtatgatgttgatctgtttgtgccacggattcttggggggtgggggtgggggggtgctcttctctaattttggactaaaatctgggtacaaaaccacccaaagattgcaacttcgtgtatatacagctcgaaagtttcgttatgttcctaaaatgtctcccttttcttcttggtttgtgaagggattgcaaaggagctggacgaggacggcaaagggatcgaggcgactgtggctaacacaagcttcctcggcatgaacgcccttcacgcactgggttggctcg

SEQ ID NO: 2780 - DNA, 1161 bp, Panicum virgatum
tgtggcaatttccatccagtccggtccagctaatatcaggatatggcggcaaatgtcggggaatcgacaagcggcagcagcagcggcgctgatgctgggggtagctttgagtgcaacatatgctttgagctgccacaggagccgattgtaacgctctgtggccaccttttctgctggccatgcctttacaaatggctgcgcatccactcgcactcgccagagtgcccagtgtgcaaggctgttgtcgaggaggataagctcgtccccctgtatggccgtggcaaggaccgcgtcgacccaaggtcaaagaacgtcccaggggctgacattcccaaccggccagctgggcagaggcctgcaactgctccacaggccgatcctaacaaccacttccccaatgccgatcctaacaaccacttcccgctggccaatgcacggtgggggaactatacgttctcggctgcgttcgggggtttgttcccgctgctcagcttccaggtgcatgggttccctgatgcaacagcttatggtcagccggctgggttcccttacgggtatgggcacggccatgggcatgcatttcacggtgggcatgcagggcatgctcacgccgcagctccccggcatggaccgcatgggcagcagcagcagcaggcggatgtgtacctgaaggcgctgctcatcctggttggatttcttgtgatcgcaagcctcatcactttctaggcctgcttgttggtgtcatactgtttgtcagatttgctggtaataagtgagagaaagacatacaagacaattgccgtggtgatacgattccgatgttgctgtgtgcgtttacctagctctccatgcaggaccaaatacgaatggagtggtgcgtctgcatggaagtgttgacagagaaattggtgtacatactgtttggatgtggtatactgcggttttgattatacaagaataatttggacatgtgtttgcttgaatgaaacgtagcaagggcattttgccctacatgtaaattgtactttttgatgaatctgtaatgaactagcaaggcatgcagttgttaagatgggatgagtccaacagctgatgtttaaatttatatgggactgatgtttatagttgaactagattcagagtggtgacagactcgtgatt

SEQ ID NO: 2781 - DNA, 1200 bp, Festuca arundinacea
ggcacgagggaggcgcctcgccgtctcctcggtccagccgccgctcattgtggttctgatcagcgcccaatatggcggccaacgttggggagtccacgagcggcagcagcgtggcgggagatggcgggggcagctttgagtgcaacatatgcttcgagctgccacaggagcccatcgtgacgctctgcgggcacctcttctgctggccgtgcctctacaagtggctgcacatccactcgcactcccccgagtgccccgtctgcaaggccgtcgtcgaggaggacaagctcgtcccgctctacggccgcggcaaggaccgcgtcgacccaaggtccaagaacgtgcctggggcagccgatatcccccaccggccgaccggacagaggcctgccatggccccacaggctgatcctaacaaccacttccccaacgcaaacccgaacccgtggttcatgggtggaggaggcagcgtcccgctggccaacgcccgatgggggaactacacattctctgccgcgttcggcggtctgttcccgctgctcagcttccaggtgcatgggttcccggatgcgaccgcgtacgggcagcccgcagggttcccctacggatatggccatggccatggccacgggcatgctttccacggtgggcatgctggacatgcccacgccgctccaaggcacgggccgcacgggcaacagcagcagcaggcggacgtgtacctcaaggcactgctcatcctggtcggcttcctcgtgatcgccagcctcatcacgttctaggtctgtcgattttcattgttgtcacggccataataaaagaaacagttatcacgatactcgctgatgttgtgtgcattatatttatgcccccccataggagccctgatctgaatcgagtggtgcgtttgagcaaattgttgatagaactcctgtatatattatttagatggggccctatgggtgtctgtttaccatagtttcgtgctgattcatgaaagatttggagctctgttttatgtatcaaaacaattgtgtcatgtataatttttatttgactgcccatgtgaatgggatgtgcaagtcatgtatcttttttcctgtgctctatgtaagatgcttgcaagcagtcatgtttgtgccaaaacaattgtatcatctataattttgattttgactgtcaaaaaaaaaaaaaaaaaaa

SEQ ID NO: 2782 - DNA, 1106 bp, Avena sativa
cttcctggaagcttctcgtcgagagcgcacgggaggggggcgccgcgtcgtctcctcggtccagccgccgctcatcttggttccgaaacagcgcccaaaatggcagccaatgttggggaatccacgagcggcagcagcgtggcgggtgacggtgggggcagcttcgagtgcaacatatgctttgagctgccgcaggagcccatcgtgacgctctgcgggcacctattctgctggccatgcctctacaagtggctgcacatccactcgcactcccccgagtgccccgtctgcaaggccgtcgtcgaggaggacaagctcgtcccgctctatggccgtggtaaggaccgcgtcgacccgaggtccaagaacgtgcccggggcggccgacatcccccatcggcctaccgggcagaggcccgccacggcaccgcaggccgatcccaacaaccacttccccaatgcgaacccgaacccatggttcatgggcggaggaggaggcgtcccgctggccaacgcgcggtgggggaactacactttctcggctgcgttcggcggtctgttcccgctgctcagcttccaggtgcatggattcccggacgcaaccgcgtatggacagcctgcgggcttcccctatggatatggccatggccacgggcatgggcacgctttccacggcgggcacgcccatgccgccccaaggcacgggccgcatgggcaacagcagcagcaggcggacgtgtatctcaaggcgctgctcatcctggtcggcttcctcgtcattgccagcctcatcaccttctaggtccgtcgattttcattgttgtcatggccataataagagaaacgattgtcgcgatactcgctgatgttgtgtgcattatattatatttatgccccttcttaataggagccctgatctgaatcgagtggtgcgtttgagcgaattgttgacagaactcctcctgtatatattatttagatggggccttacgggttgtcttgtctctgtactctactgtagtttcatgccgattcatgaaaatgatttggaagctctgttttatgtatcaaaacaattgtatcatgtatgattttgatttgactgtc

SEQ ID NO: 2783 - DNA, 1230 bp, Triticum aestivum
gccggagggaggcgcctcgccgtctcctcgccgccgctcgtcgagggtggttcctggcgagcgactgaagcccagccagcatggcggccaacgtgggggagtccacgagcggcagcagcagcgtggccggcgacggcgggggcagcttcgagtgcaacatatgctttgagctgccgcaggagcccatcgtcacgctctgcggccacctcttctgctggccctgcctctacaagtggctgcacatccactcgcactcgcccgagtgccccgtctgcaaggccgtcgtcgaggaggacaagctcgtcccgctctacggccgcggcaaggaccgcgtcgaccccaggtccaagggcgtgccggccggggccgagatccccaaccggccgaccgggcagcggcctgccaccgccccgcaggccgaccccaacaaccacttccccaacgcgaaccctaacccctggttcatggggggagggggcgtccctttggccaacgcgcggtgggggaactacaccttctcggccgcgtttggcggcctgttcccgctgctgagcttccaggtgcatggattcccggacgcgaccgcgtacgggcagcctgccgggtttccctatgggtacggccatggccatggccacgggcatgctttccatggcgggcacgcccacgccgctgccccccggcacgcgccgcccgggcagcagcagcagcaggcggacgtgtacctcaaggcgctcctcatcctggttggctttctcgtgatcgcgagcctcatcacattctaggttcgtcaccattgtcatttgtcaccgtcataataagagaaacgattgtcatgatacttctcagatgttgtgtgcattaccttgcccccccgtacgaaagccccggtctaaatctgagtggtgcgttttgagcgaaagtgttcatagaactcatgtatatatgtgctatttagacgcggtctgaatggggggtgcctgtgtaccgtagtagtttcacactgattcgtgaatgatttggaaacctctgtttggagtggatgtaccagaccaattatatcatgtgtaattttgtttcgactgtcaaagtgagtggggtgtccagctatttggagtccatgtcttgtcttcctcttctgtactgtattgttaagatgctttgcgatgatggctgtaactctctcatgtcagtgttcatgttagaatactgaattcatatcttcttttt

SEQ ID NO: 2784 - DNA, 1204 bp, Zea mays
ggtccaggcgtgcgtctcctctcgcgtccccgtcttcctcttgtgatcttgtcgcctgcctctgcggctctgcctgcctctctcgaagcttctcgcgtctcctgggtggccgtgtccagtctcccacgccaccgccccgaccgccggtaggtaattccagttccaagagcactcgacatggcggccgctaatgttggggaatcaacaagcggcggcagcagcagcagcggcgccgacgccgggggcggattcgagtgcaacatatgcttcgagctgccgcaggagccgatcgtgacgctgtgcgggcacctcttctgctggccgtgcctctacaagtggctgcgcatccactcgcactcgcccgagtgcccggtgtgcaaggccgtggtcgaggaggagaagctcgtgcccctgtacggccgcggcaaggaccgcgtcgacccgaggtccaagaacgtccccggggcggccgacatccccagccgtccggctgggcagaggccggccacggctccgcaggcggaccccaacaacgcccacttccccaacgccgccaacccggcgaacccgtggttcatgggcggcggcggcggaggcatcccgctggccaacgcgcgctgggggaactacaccttctcggcggcgttcggtgggctgttcccgctgctcagcttccaggtgcacgggttcccggacgccacggcctatggccagccagctgggttcccgtacgggtacggccacggccacgcttttcatggcgggcacgctggagcacatgcccacgccgcagctgcagctcctcggcacgcgcagcaccagcagcagcaggcggatgtgtaccttaaggcgctgctcatcctagtcggcgttctggttatcgcgagcctcgtcacgttctagggcgtcgcctgttggtaggtgttcatcatattgttgctgccttgctggtaataaataagagagagagacagagacaacacgaccgaaactgaattattcagagcggtgcaatgtgttgatagaagggttgttgttgtacatgctgatacatgattgtatactgtggtctttgaacatacattattatcgaataataatctggaggctctgtttgaagtaatctgtattcgtttgctgtgaagaaacaatgaaaaccttcatgtcaaatgcgatttggttccaatttgaaaggatgaatctg

SEQ ID NO: 2785 - DNA, 1276 bp, Lolium multiflorum
gtggactttttactctgcttcttcttcccggaagcttctcgtcgggagctggcgcctcgccgtctcctcggtccagccgccgccgctctgagcagcgtgcgcccgatatggcggccaacgttggggagtccacgagcagcagcagcgtggcgggtgacggcgggggcagctttgagtgcaacatatgcttcgagctgccgcaggagcccatcgtgacgctctgcgggcacctcttctgctggccgtgcctatacaagtggctgcacatccactcgcactcccccgagtgccccgtctgcaaggccgtcgttgaggaggaaaagcttgtcccgctctacggccgcggcaaagaccgcgttgacccaaggtccaagaacgtgcccggggcagccgacatcccccaccggccgactggacagaggcctgccacggccccacaggctgatcctaacaaccacttccccaacgcgaacccgaacccgtggttcatgggcggaggcggcggcgtcccgcttgccaacgcgaggtggggaaattacacattctctgccgcgttcggtggtctgttcccgctgctcagcttccaggtgcatgggttcccggacgcgaccgcgtatgggcagccagcagggttcccctatggatacggccacggtcatggccacgggcatgctttccatggagggcatgcaggacacgcccacgctggtcccaggcatgggccgcacgggcaacaacagcagcaggcagatgtgtatctcaaggcgctgctcatcctggtcggcttccttgttatcgccagcctcatcaccttctaggtctgtcgattttcattcttgtcacggccataataagagaaacgattgtcgcgatactcgctgatgttgtgtgcattatatttatatatgccccccataggagccctgatctgaatcgagtggtgcgtttgagcgaattgttgataggactcctgtatatattatttagatggggccctatgggtgtctgtttactgtagttttgtgccgattcatgaaagatttggagctctgttttatgtatcaaaacaattgtgtcatgtataatttttatttgactgcccatgtgagtgggatgtgcaagtcatgtatcttttttcctgtgctctatgtaagatgcttgcaagtagtcatgtctgtgccaaaacaattgtatcatgtataattttgatttgactgtcacattgagttctaacattgtaattatttcgaatacatggtcttcttttctgtaaaat

SEQ ID NO: 2786 - DNA, 1107 bp, Secale cereale
ccgccccgtccgtccggccgccgcagctcaccgtcaccgtgggtggttgctctcgagcgagcatggcggccaacgtgggggagtccacgagcgggagcagcagcgtggctggcgacgccgggggcagcttcgagtgcaacatatgcttcgagctgccgcaggagcccatcgtcacgctctgcggccacctcttctgctggccctgcctctacaagtggctgcacatccactcgcactcccccgagtgccccgtctgcaaggccgtcgtcgaggaggacaagctcgtcccgctctacggccgcggcaaggaccgcgtcgaccccaggtccaagggcgtgccggccggggccgagatccccaaccgcccgaccgggcagcggcccgccactgccccgcaggccgaccccaacaaccacttccccaatgcgaaccctaacccctggttcatgggtggagggggcgtcccgctggccaatgcgcggtgggggaactacactttctcggccgcgttcggcggcctgttcccgctgctgagtttccaggtgcatggattcccggacgcgaccgcgtacgggcagcctgctgggttcccctacgggtatggacatggccatggccacgggcatgctttccatggcgggcacgcccacgccggtgccccccggcaagcgccgcccgggcagcagcagcagcaggccgacgtgtacctcaaggcgctgctcatcctggttggctttctcgtgatcgcaagcctcgtcacattctaggttcatcggttcccactattgtcatttgtcaccgtcttaataagagaaacaattgtcgtcatacttctcagatgttgtgtgcattaccttgcccccccccccccccccccatacaaagccccggtctaaatctgagtggtgcgttttcagcgaaagtgttcatagaactcctgtatatatgtgctatttagacgcggtcctgtgggggggcgcccgtgtaccgtggaagtttcgcgcagatttgcgagtgatttggaaacctctgtttggagtggatgtaccagaccaattatatatcatgtgtaattttgattgactgtcaaagtgagtggggtgtcca

SEQ ID NO: 2787 - DNA, 1187 bp, Secale cereale
gactctcgcaggcagcagctagtcgcctattcatactctccttcccccacctcttctcttcctctcgcaccgccggagggaggcgcctcgccgtctcctcgccccgccccgtccgtccggccgccgcagctcaccgtcaccgtgggtggttgctctcgagcgagcatggcggccaacgtgggggagtccacgagcgggagcagcagcgtggctggcgacggcgggggcagcttcgagtgcaacatatgcttcgagctgccgcaggagcccatcgtcacgctctgcggccacctcttctgctggccctgcctctacaagtggctgcacatccactcgcactcccccgagtgccccgtctgcaaggccgtcgtcgaggaggacaagctcgtcccgctctacggccgcggcaaggaccgtgttgaccccaggtccaagggcgtgccggccggggccgagatccccaaccgcccgaccgggcagcggcccgccactgccccgcaggccgaccccaacaaccacttccccaatgcgaaccctaacccctggttcatgggtggagggggcgtcccgctggccaacgcgcggtgggggaactacaccttctcggccgcgttcggcggcctgttcccgctgctgagcttccaggtgcatggattcccggacgcgaccgcgtacgggcagcctgctgggttcccctacgggtatggacatggccatggccacgggcatgctttccatggcgggcacgcccacgccggtgccccccggcacgcgccgcccgggcagcagcagcagcaggccgacgtgtacctcaaggcgctgctcatcctggttggctttctcgtgatcgcaagcctcgtcacattctaggttcatcggttcccactattgtcatttgtcaccgtcttaataagagaaacgattgtcgtgatatttctcagatgttgtgtgcattacccttgccccccccccccatacaacgccccggtctaaatctgagtggtgtcgtttcagcgaaagtgttcatagaactcctgtatatatgtgctatttagacgcggtcctgttggggggcgcccgtgtaccgtggtagtttcgcgcagatttgcgaatgatttggaaacctctgtttggagtggatgtaccagaccaattatatatcatgtgtatttttgattgactgtcaa

SEQ ID NO: 2788 - DNA, 817 bp, Avena sativa
actctgcttcttcttcctggaagcttctcgtcgagagcgcacgggagggggcgccgcgtcgtctcctcggtccagccgccgctcatcttggttccgaaacaacgcccaaaatggctgccaatgttggggaatccacgagcggcagcagcgtggcgggcgatggtgggggcagctttgagtgcaacatatgctttgagctgccgcaggagcccatcgtgacgctctgcgggcacctattctgctggccgtgcctctacaagtggctgcacatccactcgcactcccccgagtgccccgtctgcaaggccgtcgtcgaggaggacaagctcgtcccgctctatggccgtggcaaggaccgcgtcgacccaaggtccaagaacgtgcccggggcggccgacatccccgaccggcctaccgggcagaggcccgccacggcaccgcaggccgatcccaacaaccacttccccaatgcgaacccgaacccatggttcatgggcggaggaggaggtgtcccgctggccaacgcgcgtgggggaactacactttctcggctgcgttcggcggtctgttcccgctgctcagcttccaggtgcatggattcccggacgcaaccgcgtatggacagcctgcgggcttcccctacggatacggccatggccacgggcacgggcacgctttccatggcgggcacgcccatgccgccccaaggcacgggccgcatgggcaacaacagcagcaggcggacgtgtacctcaaggcgctgctcatcctggtcggcttcctcgtcattgctagcctcatcaccttctaggtccgt

SEQ ID NO: 2789 - DNA, 1993 bp, Brachypodium distachyon
aacaattaaacaactcgtggtccccctagttactctccgcttcgtcttcttcctctaagcttctcctctctcggcgcgggaggcaggcgcagcatcgtcgtcgtcggtcgcctcggctccggccgccgaagtccagaatctccgcatctcgtcgccgagcgacccagcaagccccctcgcttcgctctccgtggatcttcttcctcctcgcgcgagcgccgccgccgcccatcccgctgccgagcgcccgagccccctagctcgtcttcctcctcgctcgagcgagcgcctccgccgcaggttcatctccccttcgctcccgaccgtttctcctcccatcacccccaccaacggatcccgccctttagatccccgtttcataatcttccccaattcgtaactgaggcaaaaatcaaggtactgggtcctccgcccgtgatctcgtagtcgtaggtggtgtgtcgctgcctcgaccagagggttgggtaattttatttttctttctaatgtagcgagtagatttgaagtgctcctcctaccagcatggctctcatgtgagattccataataaggcttattattagtagtagctaaatgacacgagttcacaaattaatcgagaaattcgactcagatcgctctgatgtagtagtggtttcgccagggacttgatgctgtttgagcagcacataattagtgctcgtcacctaataatagtgggtattaagcacaatatctctgcactaggttttaatttgcaacctgtttccttctctcagtgtacctactctgtgttgctgatgattgtagcgattccatccattgcaggtgcagaggaccgtgtttttttctttccggacaacacccgatatggcagctaacgtcggggaatccacgagcagcagcggcggcgccggcgatggcgggggcagctttgagtgcaacatatgcttcgagctgccgcaggagcccatcgtgacgctctgcgggcacctcttctgctggccgtgcctttacaagtggctgcacatccactcgcactcgccggagtgccccgtgtgcaaggctgtcgtcgaggaggacaagctcgtcccgctctatggccgtggcaaggaccgcgtcgacccgaggtcgaagaacgtccctggggctgaaattccccaccgtccgactggacagaggcctgccacggctccacaggccgatcctaacaaccacttcccgaacgccaatcccaacccgtggttcatgggtggaggaggcgtcccgctggccaatgctcggtggggaaattacacgttctcagcggcgtttggcggcctctttccgctgctcagcttccaagtgcatggattcccagatgcaactgcttatgggcagcctgcgggtttcccctatggatatggccatggtcatggtcatggacacgctttccatggcgggcatgctggacacccccatgctgctcctcggcaggcacagccgggtcaacagcagcaggcggatgtgtacctcaaggcgctgctcatcctggttggctttcttgtgatcgcaagcctcatcacattctagattgtcagtctggttatgagttttgtggcggctagcggtttgaaccaaccgcaagataaaatgcaatgttttcttatgacgaatttgagggttgggtggggatcctgggtttgctgttgattctaacaggttggacaatcggagacgtgtttggtggtgtgagttcatcatttgatctgcattgccagggaaacctgatactctatttgatgccacttgtatgatgcgttggggcatccatgtactgtagtttcgtgctgttccatgaatatttcgaaatctctgtttggatgaacctgaacaagtacatcatgtataatttttatttgactgtcaaagtgggtgggctgtgcaactctttgtagtccgtatcttttttatataattcatacataatgctggcaatgatgccagtaactgc

SEQ ID NO: 2790 - DNA, 1138 bp, Secale cereale
ccgtccgtccggccgccgcagctcaccgtcaccgtgggtggttgctctcgagcgagcatggcggccaacgtgggggagtccacgagcgggagcagcagcttggctggcgacggcgggggcagcttcgagtgcaacatatgcttcgagctgccgcaggagcccatcgtcacgctctgcggccacctcttctgctggccctgcctctacaagtggctgcacatccactcgcactcccccgagtgccccgtctgcaaggccgtcgtcgaggaggacaagctcgtcccgctctacggccgcggtaaggaccgtgttgaccccaggtccaagggcgtgccggctggggccgagatccccaaccggccgaccgggcagcggcccgccactgccccgcaggccgaccccaacaaccacttccccaatgcgaaccctaacccctggttcatggggggagggggcgtcccgctggccaacgcgcggtgggggaactacaccttctcggccgcgttcggcggcctgttcccgctgctgagcttccaggtgcatggattcccggacgcgaccgcgtacgggcagcctgctgggttcccctacgggtatggacatggccatggccacgggcatgctttccatggcgggcacgcccacgccggtgccccccggcaagcgccgcccgggcagcagcagcagcaggccgacgtgtacctcaaggcgctgctcatcctggttggctttctcgtgatcgcaagcctcgtcacattctaggttcatcggctcccgctattgtcatttgtcaccgtcttaataagagaaacaattgtcgtgatacttctcagatgttgtgtgcattaccttgcccccccccccccccgcccccccatacaaagccccggtctaaatctgagtggtgcgttttcagcgaaagtgttcatagaactcctgtatatatgtgctatttagacgcggtcctgtgggggggcgcccgtgtaccgtggtagtttcgcgcagatttgcgaatgatttggaaacctctgtttggagtggatgtaccagaccaattatatatcatgtgtaattttgattgactgtcaaagtgtagtggggttgttcccgtcttattttggtagttacctaaaaaaaa

SEQ ID NO: 2791 - DNA, 1301 bp, Hordeum vulgare
gcagctcgacgtgggtggttactctgtgctgtgttgctgacgatcaagcatggcggccaacgtgggggagtccacgagcgcgagcgggagcgtggccggcgacggcgggggcagcttcgagtgcaacatatgcttcgagctgccgcaggagcccatcgtcacgctctgcggccacctcttctgctggccatgcctctacaagtggctgcacatccactcgcactcccccgagtgccccgtctgcaaggccgtcgtcgaggaggacaagctcgtcccgctctacggccgtggcaaggaccgcgtcgaccccaggtccaagggcgtgccgcccggggccgagatcccccatcggcccaccgggcagcggcccgccaccgccccgcaggcagaccccaacaaccacttccccaacgccaaccctaacccctggttcatggggggaggcggcgtcccgctggccaacgcgcggtgggggaactacacattctcggccgcgttcggcggcctgttcccgctgctcagcttccaggtgcacgggttcccggacgcgaccgcgtacgggcaacccgcggggttcccctatgggtacggacacggccatggccacgggcaagctttccacggccacgccgctgccccccggcacgcgccgcccgggcagcagcagcagcaggcggatgtctacctcaaggcgctgctcatcctggtcggcttcctcgtgattgcaagcctcatcacgttctaggttcgtcggttcccactattgtcatttgtcagttcataataagagaaacaattgtcgtgatacttctccgatgatgttgtgtgcattatcctggcccccccgtacaaagccccggtctaaatctgagtggtgggttttgagcggaagtgttgatagaactcctgtgtatatatatgctatttaggcgcggtcctgtggggggcgcctgtgtaccgtggtagtagtttcgtgctgattcgcggatgatttggaaacctctgtttggagtggatgtaccagaccaattatatatcatgtgtaattttgattcgactctcaaagtgtattggggtggttcagctatttggagtccatgtcttttgggacgatggctgtaactccatcatgtcaatgttcatacttttgatttgactgtccaagtgagtagtgtgtgtgtgcagttatttagagtccatggttgtaactcaggcatgtcagtgttcatgttagaatactgaattcttaccttcttttttctgtagcatataatttcggttcgactgtcaaaatgagtggg

SEQ ID NO: 2792 - DNA, 1903 bp, Hordeum vulgare
gtggccaaagtcagaagcaattaataactcggcgtcgcctattcatactctctcagcctcgtcctcttcctcgaagcttctcgtcctctcccatcccctctcgcccgcaccgccggcgggaggcgccgcgccgtcccctccctccgcccggccgccgctcgacgtgggtggttactctgtgctgtgttgctgacgatcaagcatggcggccaacgtgggggagtccacgagcgcgagcgggagcgtggccggcgacggcgggggcagcttcgagtgcaacatatgcttcgagctgccgcaggagcccatcgtcacgctctgcggccacctcttctgctggccatgcctctataagtggctgcacatccactcgcactcccccgagtgccccgtctgcaaggccgtcgtcgaggaggacaagctcgtcccgctctacggccgtggcaaggaccgcgtcgaccccaggtccaagggcgtgccgcccggggccgagatcccccatcggcccaccgggcagcggcccgccaccgccccgcaggcagaccccaacaaccacttccccaacgccaaccctaacccctggttcatggggggaggcggcgtcccgctggccaacgcgcggtgggggaactacacattctcggccgcgttcggcggcctgttcccgctgctcagcttccaggtgcacgggttcccggacgcgaccgcgtacgggcaacccgcggggttcccctatgggtacggacacggccatggccacgggcaagctttccacggccacgccgctgccccccggcacgcgccgcccgggcagcagcagcagcaggcggatgtctacctcaaggcgctgctcatcctggtcggcttcctcgtgattgcaagcctcatcacgttctaggttcgtcggttcccactattgtcatttgtcagttcataataagagaaacaattgtcgtgatacttctccgatgatgttgtgtgcattatcctggcccccccgtacaaagccccggtctaaatctgagtggtgggttttgagcggaagtgttgatagaactcctgtgtatatatatgctatttaggcgcggtcctgtggggggcgcctgtgtaccgtggtagtagtttcgtgctgattcgcggatgatttggaaacctctgtttggagtggatgtaccagaccaattatatatcatgtgtaattttgattcgactctcaaagtgtattggggtggttcagctatttggagtccatgtcttttgggacgatggctgtaactccatcatgtcaatgttcatacttttgatttgactgtccaagtgagtagtgtgtgtgtgcagttatttagagtccatggttgtaactcaggcatgtcagtgttcatgttagaatactgaattcttaccttcttttttctgtagcatataatttcggttcgactgtcaaaatgagtggggtgtgcggtgatttagagtccatgcctttctcttttcttcagtctatataagatgatgacagtaacttgctaactgcatctttgtctggagaccaaacagcaaacaaccatgttggtgctcatgttagaacgagaactggttctttcataccttgttcctctctcgctctgctgaaggtttgaatttggagaaattaatggggcagaagagtatatggtcttttacattcgatggtttattgttccgggtcgactttgtcctgtgtttcattttctgaggtcctgtgtatgcatttcccagtgttgaaaccgtatgaacatcaggggatctgccgttgatttttatttatttatttttgagaccgatccggcgtcgatgttgtgagtccatccgttttgcattgcctgagaagcctgatagatagatatcctgattcagcgacacttgc

SEQ ID NO: 2793 - DNA, 1866 bp, Panicum virgatum
ccgtagaatacgcgcattggtcgcgggtcaggtggaaacgctgcgaactgaaggcagcatcgggatgtgacgatcccttgcgtgacccgcctcagcacgcagcagctgcggccaagtttccgtatcccttcacgggagacgccccccgccttggtagtctgccagtcaggcgcagcgctgcccgctccgccccgagactacccagattctagaatcttccggcgtgggccccgcggcctcccctaattttgtgctgcccgcgggtccaggtcaccgcgtagagcctagagttattcgcctcgacgcccccgtcggtcgccgcgccgtcgcgtcgaatatctccgcgtccgtcgcccgctacaacccctcgctcgcagtttaatttattccgaatatcatcaagatgtcagccaatgtcggtgaatcagcaagtgctggcagcagcagcgacgcagctggggggagttttgagtgcaatatatgctttgagctgcctcaggagccaatagtgaccctctgtggccatctcttctgctggccatgcctttaccgctggttgcatgtccatgcacactcaccagagtgcccagtgtgcaaggcccttgtcgaggaagacaagcttgttcccctttatggacgtggcaaggaccgtgttgacccaagatcaaagaacatgcctgaatctgacattcctcaccgcccgactggccagaggcctgccacagctccacaggctgatgctaacaacaacttccccaatgccaatgcaaacccatggttcatgggcacaggagtcccattggcgaatgcaaggtgggggaattatgcattttcagctgcttttggaggcctgttccctatgcttagcttccaagtccatggattccccgatgccgctgcttatgcgcagccagctgggttccactatgggtacggccatgggcatggattccatggtgggcatatgggacacgctcacggcgtccaccggcaagcacctttggggcaacagcagcaggcagatatctacctgaaggccctgcttctcatggttggagttctagtgattgcgagcctcattgcattttaaagctgttgaacctggaggccctgctcatcatggttggaattctcgggggtgcaatgcaaggctcctggcatttctgatgctgtgatggcagattggcttaagaattgtcttatttcagtgttggttctgtattatagcttggtgctgaatgttgcatgagttattcgtgtatttgcatgaagtgtccatagaatatgtatttatagctccaggcaagtatctgccttttacagcaccttatatagtattaggaggaacctggtgcaattattgctgtttagttttgatgatttttggaggtgaacgtgatgtacaattgttgggtagccatctcccacctgcatctgttgtctgtaccatttagattggaaatggatagcatgagacagaatatatgagaatttggaattagtgttttgtgtagtccgaacactcattatttccatcaatttgcacaacatgcatttacgttcatagtggccggagagaatgtactaaactgctgataatgacaagctgtgtccaagttcattgtgaccccgtttttcgaatggaactccgtgtccagctgcaagcctgcaattacgttggttacggaaccgtacgttctgcagcatagggccgttgctcactgctgcccccagccatcttgaacttgcacgcacacgcgcaaaggagatacgatgcgtctctgaagccgttggattggggacaaccggacaagatgggagaactcttggccaatggaacattgaaagcctggaaaaaggcggaaa

SEQ ID NO: 2794 - DNA, 1183 bp, Pennisetum glaucum
agttattttcgctcgcctcgtctcgtctccccccgtcggtcgccgcgccgtcgagttgaatttctctgagtccgtcgccctcgctcgcagcttaatcagcaagatgtcagcaaatgttggtgaatcaacgagtgccggcagcagcagcgacgcagctgggggcagttttgagtgcaacatatgctttgagctgcctcaagagccaattgtgacgctttgtggccatctcttctgctggccatgcctttaccggtggttgcacatccacgcacactcaccagagtgcccagtgtgcaaggcccttgttgaggaagacaagcttgttcccctttatggacgtggcaaggaccgtgttgacccaagatcaaagaatatgcctgaatctgacattcctaaccgcccgactggccagaggcctgccacagccccacaggttgatactaacaacaacttccccaatgccaatgctaacccatggttcatgggcacaggagtcccattagcgaatgcacggtgggggaattatgcattctcggctgcttttgggggcctgttccctatgcttagcttccaagtccatggatttccagatgctgctgcctatgcgcaacctgctgggttccactatgggtacggccatggacatggcttccatggcgggcatatgggacacacccatggtgtccaacggcaagcaccattggggcaacagcagcaggcagacatctacctgaagggtctgctcctcgtcgttggagttttagtgattgcaagcctccttgcattttgaagctgttagcaacatccacccggaggccctcctctgctcatcatggttggaattcttggggacgcaagcaggtctcggacaactttacattgtgatgatgtggcttttacgaattgtcttatatcagtgttgaacgttgcataagttatttgtgtgttcgcatgaagtgtccatagaatgtgtacttagctctagataagtaatcagcgttttacagcaccctacatttaggaggaacctggtacagtttatgcttagttttgatgattcttggaggtgaacgtgatgtacaattgtttggaagtcatctccccgcatctgtaatctgtacccatttagaccagacatgggtaacaccagacagaatatatgagaaatagtgttttgtgtgtc

SEQ ID NO: 2795 - DNA, 1106 bp, Avena sativa
aattttatacggacggggtgccgtcgtccaggtcatcggaccgtggtttcgccgtcggatcgaatacctttcccccttcctccctcgcagcggtcgcgggtcggcttcccctcgctcatcggagcttgtttcacggccaataactgcgagatggctaccaatgttggggaatcaacaagcgttggcagcagcagtgatgctgctgggggaagcttcgagtgcaatatctgcttcgagttgccacaagagccaatagtaactctctgtggccacttgttctgctggccatgcctctacaggtggctgcacatgcacgcgcacacgccggagtgccccgtgtgcaaggccatcgttgaagaagacaagcttgttcccctgtacggccgtggcaaggaccgtgtcgatccgaggtcaaagaacacacctggagccgacattcctaaccgcccagctggccagaggcctgcaacagcccagcaggctgatcccaacaacaatttcccgaatgcccacgcgaatccatggttcatgggcatgggcgctggagtcccgctggcgaacgcacggtggggtaactatgcgttctcggctgcattcggaggtttgttccctatgcttagcttccaaatgcatggaatcccagatccaacggcttatgcccagcctgctgggtttcactacgggtatggccatggccatgggttccatggcgggcatatggggcctgcccatggcgttccccgccagggacctcttggacaacagcagcaggcagacgtctacctgaaggccctgctcctcatggttggagttcttgtgattgcgagcctgcttgcattttaatttaaagttgtcagtagtttgcatctgtaatggttgtttggtggtaagaaactgctagaattcctcgggtggtgtcagggtgtgggcttatctttctaccgaatgtgacagtaaattagttggaatgtttatacgaagtgtccatggtatttagatttagataagcttcaacatgttattacagcatcatgtgtgctatttggatgaagattgtataatttgtgtagttttgatgcttttggtgaatgtgatgtacaattggg

SEQ ID NO: 2796 - DNA, 1047 bp, Avena sativa
ttccccccttttcccccttcctccctcgccgcggtcgcgggtcggcctccactcgcccatcggagcttgtttcacggccaataactgcgagatggctaccaatgttggggaatcaacaagcgttggcagcagcagtgatgctgctgggggaagcttcgagtgcaatatctgcttcgagctgccacaagagccaatagtaactctctgtggccacttgttctgctggccatgcctctacaggtggctgcacatgcacgcgcacacgccggagtgccccgtgtgcaaagccatcgttgaagaagacaagcttgttcctctttatggccgtggaaaggaccgtgttgacccaaggtcaaagaacacacctggagccgacattcctaaccgcccagctggccagaggcctgcaacagcccagcaggctgatcccaacaacaatttcccgaatgcccacgcgaatccatggttcatgggcatgggcgctggagtcccgctggcgaacgcacggtggggtaactatgcgttctcggccgcattcggaggtttgttccctatgcttagcttccaaatgcatgggatcccagatccaacggcttatgcccagcctgctgggtttcactacgggtatggccatggccatgggttccatggcgggcatatggggcctgcccatggcgttccccgccagggacctcttggacaacagcagcaggcagacgtctacctgaaggccctgctcctcatggttggagttcttgtgattgcgagcctgcttgcattttaatttaaagttgtcagtagtttgcatctgtaatggctgtttggtggtaagaaactgctagaattcctcaggtggtgtcaggttgtgggcttatctttctaccgaatgtgacagtaaattagttggaatgtttatacgaagtgtccatggtatttagatttagataagcttcaacatgttattacagcatcatgtatgctatttggatgaagattgtataatttgtgtagttttgacgcttttggtgaatgtgatgtacaattggg

SEQ ID NO: 2797 - DNA, 857 bp, Avena sativa
gggtcggcctccactcgcccatcggagcttgtttcacggccaataactgcgagatggctaccaatgttggggaatcaacaagcgttggcagcagcagtgatgctgctgggggaagcttcgagtgcaatatctgcttcgagttgccacaagagccaatagtaactctctgtggccacttgttctgctggccatgcctctacaggtggctgcacatgcacgcgcacacgccggagtgccccgtgtgcaaggccatcgttgaagaagacaagcttgttcccctgtacggccgtggcaaggaccgtgtcgatccgaggtcaaagaacacacctggagccgacattcctaaccgcccagctggccagagaccagcaacagcccagcaggctgatcctaacaacaatttcccaaatgcccacgcgaatccatggttcacaggcatgggcgctggagtcccgctggcgaatgcacggtggggcaactacgcgttctcggccgccttcggtggtctgttccctatgcttagcttccaaatgcatggaatcccagatccaaccgcttatgcgcagcctgctgggtttcactatgggtatgaccacggccatgggttccatggcgggcatatggggcctgcccatggcgttccccgccaggggcctcttggacaacagcagcaggcagacgtctacctgaaggccttgctcctcatggttggagttcttgtcattgcaagcctccttgcattttaatttatgaagttatcggtagattccagttgtgacgggttgtttggttgtaagaagaactgctagaaagccttgggtggtttcagggtgtgtgtctacggaatgctacttaag

SEQ ID NO: 2798 - DNA, 2754 bp, Zea mays
tttccaaaacaaaacaaccccaagtccccaacccagtttcaaacaaactagatccgcggcgaccatgcggcgcggcggcggtcgccggttccccaagccctccttggcgccctccaccgcggccgaggccaccccggcgctggacgccagcgtcatccgcaacctcgactccgccttctcccgccgcgactccgacgccaacagcctctgcagcagccgtcccgcttctaccgtcggcgccatcctcaacttctccgaccgcgccacgcaggtcgccgcgctccgcgtcgtcaacacattcctcgcccccgccgtcacgctccgggggcctctgcccgccgcgcgcgacatccaggcggcgctccgcctcctcgtcgaccgtctccacttgccccgcaacgacgccacattcgatgatgacctcatccaggaccttcgccttctcggatgcccctacaaggtcacccgctccgcactcaaggcccccggcaccccgcactcgtggccggtactgctctccgtactccactggctcaccctcctctgccactcccaaggagacgacccggatgccccgagcggcccatccgacgatctcttgctctacatcacccagtcgtactcccacttcttgtcgggggacgacgccgccgtcgaaaccgtcgacgaggagtacgcctccaaagcccggatgaccggtgaggcgtacgttgcaacggctcgtgccctggagaaggaggctgaggaactggagacccaggtgaataagctcatctcgggtccctcgcggcgggaagcactggagtcagagaaggaggccttcaatgctgatattcacaagttcgacgcagtggtgaatgcttggaaaactaagttcaatgaaagggaacaatcgtttggggatttggagaaagagttggaggcaaaagtgtcggacacccagcgcgctgctgctgaaattcaggatctattgaaacaagtggatgctcagccggtgaatgtgaaggatgtggatagaatgcgtagggagatgcaggctattgaagatgacattgccaacgccgagaaggggaaaacagcactggaggataaggtctgggaacttgaagctaagctggttaccaagcttgaggagcttgagaggcatgctgagcagtgcaaccaggccctcaaaaagttgaaacctactgttgcttttcagtacatgatagattcaaaaggatcttctcctgctgagatgctaggtactggttacaaaacagtactaaaacctgcacttctggctcatgctgaggagaacaaaaggatctgtctctcaaatcttgaaaacttaaatgatctacagaagcagctgcaaggaaatgctaaggttctagaggaggaaaggaataatatttccagtctccaggaaaaaaatgacgaaatcgttgctcgtttgaatttactggatcgtgaaattataaatgatgactcaagattcacatctgaagctgcacaaatgaaagatgagttggagaaaaagaagaatagtttgatttctgctgaaaagcaggcagatgattttcttaagaaatcggagaagaggctccaagatgtaacacttaaagttgaagaagaaactcaggcagctgctaaggagctgctggagcttcttgattccatggctgaacataaagagttcatggaaacaacaattgctcagaggaggaaggacctctatgaaactgcagattatatagcatctgtggcatccaagacagtcatcacccaagtaccgaaccctgctgaatcctgatacctgaattatgcagtaatcttttcgcatagaaagttcatcatagcaggcctgcctaccgtggcagccttctctggcatgtaatataagttgaagttgtcccacttgaagctgtggtcttttttggccttggactttggtttgcgttctggtgaggtagtagttggtatgttcgggcttcaatcctagatgtcatgaaactgttgtaatttcattgcttcagtaatgaactttggattggtcctctgtgaaaaagtacccaaccctcttggtgtttgtttcagctttatgaacctgcttctgctttagaaaaacacaaacaagttcagttttgtttctacttattagaattggaacccctaaccctaatcagggttgggtgtggtattaatagacttgggtaattgggcctgacccattacaaaggggtgagatggtaattacatggggaagaccccaaaccctagacgggtattctaacaccctccgcagtcacaactcctgtacagatgttgagattggattgaaagtctaaaaatacactcgacggtaaccccttggtgaagatgtcggcgaactgcagcgtggtggggacgctgagaacccgaacgtcaccggcagcgacacgctcgcggataaagtgcaggtcgatctccacgtgcttcgtgcgctgatgctgcacagggttggtggagaggtagaccgcgctgacgttgtcgcagtagacgagggtggcgcgctggaggggactgtggagctcgtggaggagctggcgcagccaggaggcctctgccacgccgttggccacgacacggtactcggcctcagcgctggagtgagagacgacgtgctgtcgcttggcggcccaagagacgaggttggcgcccaggaacacggcgtaaccggaggtggaccggcgcgtgtcgggacagccagcccagtcagcgtcggtgtagacc

SEQ ID NO: 2799 - DNA, 1104 bp, Flaveria ramosissima
cgtgacaacacccatcacctaattttcatctatatatatactcaacccctatcaacgacaagaatacgtgattcagctgccggaatattcacaaatcagtcatgatcggaccacagaggcctcagattgtgttgttcggatcatcaattgttcaacttagcttcagcaatgatggttggggcgccattctcgccgatgtatacgctcgtaaggcggatattgtgctgcgagggtactatggctggaattccagacgtgctgtgaaggtccttgatcaagtctttccaaaggatgctgctagtcagccttcattgatcattgtttactttggtggtaacgattcaatgggacctcactcatcgggtctaggcccccatgttcctcttcctgaatatattgaaaacatgagaaaaattgctactcatctccaggggctttcagacaccactcgcttaattttcctcacctgcccacctgtggatgaggtcaaacttggtgaaaacacaagctcaatttttagcgaactagttagaacaaatgagctatgccggacttattcagatgcttgtgtagagctgtgcaatgagatgggaataaaagtcatcgatctttggactgcgtttcagaaacgagatgattggttgactttctttacggatggggtgcatttatcaggtgagggcagcaagatagttgttgaggagatactaaaggtgctcaaagaagcagaatggaaaccgagtctacactggaaatctatgcctactgagttttcggaagactcgccctatgatttagtcttttcagatggcaaaacgaccctaaacccatctgactggactttccacagagacatacagtgggattaaaaatacgattttcattcataactgcagaacacgtgcattcgactgtaggtaatagaatactttctattgcagtgtttgtaccagtgatctttatctggttcattgtagttctttttatgcttatattgcaagcttctaatgcaatgtctacatgtagcattgaccataaaattccttgtttactatataccacatacataatgttcttactgcaaaagacttgtaccatatgttt

SEQ ID NO: 2800 - DNA, 1199 bp, Echinacea purpurea
cggccgggggaaggaaataaagagcaggttgttcggtggtaatcaatgcgacccccctctaaatcaaacatctccctccctcttctcccctgttcgtctgcaccaatcaccaaatcttcacctataaatcatctacctccaaatctccaatcatcaacaccattcagcttccaaaatcttcaacaatggtcggaccacagaggccacagattgtgttgttcggatcatcaatcgttcaactcagtttcagcaatgacggttggggcgccattctcgctgacgtctacgctcgtaaggcagatatagtgttgcgagggtactatggctggaattcccgacgtgctgtcaaggtccttgatcaagtttttccaaaggatgctgctagtcaaccttcactgatcattgtttacttcggtggtaatgattcaatgggacctcactcatctggtctaggcccgcatgtccctcttcctgaatatattgaaaatatgagaaaagttgctactcatctccaggggctttcagacacaacgcgtttaattttcctcacttgcccaccagtggatgaggtcaaacttagtgaaaccacaagctcaatctttagcgaacttgttagaacaaatgagttatgccgggcttattccgatgcttgtgtagagctgtgcaatgagatgggaataaaagttatcgatctttggactgcatttcagaaacgagataattggttgacttgctttacggatggtgtgcatttatcaggtgagggtagcaagatagttgttgaggagatactaaaggtgcttaaagaagcagaatggaaacccagtctacactggaagtctatgcccaccgagttttcagaagactccccctatgatttagtctatacggatggcaaaacgaccctaaacccgtctgattggactttccacagagaaatacagtgggactaaaatgacggttaaccgcagaacacgctcatttgtctgtaagtaatggaatacattctatcatggcaactgagatttgtaccggtgatctttaacccggttctttgtacttcttattatgcttctaatgcaacaactacatgtagcattgcctataagatcccttgtttactgcttaccatgtactaccgcaaaagcctgtaccataagtttacgaggtttaatatatactgagtaccttaatttagt

SEQ ID NO: 2801 - DNA, 1001 bp, Ambrosia trifida
cccatcacctactactcttcccctgtatataaatcaaacacccacctctaataatcaacacaagttccttcattcattcactccctttaataataataacattattattattattctcaatcatcaaccatgaccggaccacagaggccgcagattgtattgttcggatcatccattgttcaactcagttttagcaacgatggttggggcgccactcttgccgacatctacgctcgtaaggcggatatagtgctgcgagggtactatggctggaattcccgacgcgctgtcaaggtccttgatcaagtttttccaaaggatgctgctagtcaaccttcactgatcattgtttactttggtggtaatgattcaatgggacctcactcatctggtctaggcccccatgtccctcttcctgaatatattgaaaacatgagaaaaattgctactcatcttcaggggctttcagacacaacgcgtttaattttcctcacttgcccaccagtggatgaggtcaaacttggtgaaaacacaagctcaatttttagtgaactcgttagaacaaatgagttatgccggacttattcagatgcttgtgtagagctgtgcaatgagatgggaataaaagttatcgatctttggactgcatttcagaaacgagataattggttgactttctttacggatggggtgcatttatcaggtaatggcagcaagatagttgttgaggagatactaaaggtgctaaaagaagcagaatggaaaccgagtctacactggaaatccatgcccaccgagttttcagaagactcgccctatgatttagtctatactgatggcaaaacgaccctaaacccgtctgactggactttccacagggaaatacagtgggactaataagattacattcataaccgctgaacacgcgcatttgtctgtaagtaaccgaatggaataccttctattgcagcaactgagatttgtaccagtgatctttagtc

SEQ ID NO: 2802 - DNA, 1184 bp, Ambrosia trifida
acacattaaaatcaaaacatctccctcccctccctcctctaatgtgatggtgcacccatcacctactcttcacttatatatataggtatacatatacacccacctccagtaatcaacacaagttccatcatccattcacctcccttaataattatcaatcctcaaccatgaccggaccacataggcctcagattgtattgtttggatcatcaattgttcaactcagttttagcaacgatggttggggtgccactcttgccgacgtctacgctcgtaaggcggatatagtgctgcgagggtactatggctggaattcccgacgtgctgtcaaggtccttgatcaagtttttccaaaggatgctgctagtcaaccctcactgatcattgtttactttggtggtaatgattcaatgggacctcactcatctggtctaggccccccctgtccctcttcctgaatatattgaaaacatgagaaaaattgctactcatcttcaggggctttcagacacaactcgcttaattttcctcacttgcccaccagtggatgaggtcaaacttggtgaaaacacgagctcaatttttagtgaactcgttagaacaaatgagttatgccggacttattcagatgcttgtgtagagctgtgcaatgagatgggaataaaagttatcgatctttggactgcatttcagaaacgagataattggttgactttctttacggatggggtgcatttatcaggtgagggcagcaaggtagttgttgaggagatactaaaggtgctaaaagaagcagaatggaaaccgagtctacactggaaatccatgcccaccgagttttcagaagactcgccctatgatttagtctatactgatggccaaacgaccctaaacccgtctgactggactttccacagggaaatacagtgggactaataagattacattcataaccgctgaacacgtgcatttgtctgtaagtaatggaatggaatactttctattgcagcaactgagatttgtaccagtgatctttagtctagttctttgtacttctttgatctttctatgcttatatcacaagcctctaatgcaacatctacatgtagcattgcccataaggttccttgtttactgtgcactgctgcaaaaccttgtaccatatgtttatgaggtttattata

SEQ ID NO: 2803 - DNA, 1145 bp, Cichorium intybus
taaaccgaaaaaagaaatcatctccctccatcggtccatcccctgcgcggcttcaacccttcatctactcctccataaatctaaatccaaccaacaaaatcaaactcgcaaccccaagttacgtgatagacctgcttttcagctatctgaatctttggtctttacggagagatggtcggaccagggaggccacagatagtattgttcggatcatcaattgttcagcttagtttcagcaatgatggttggggcgccattctcgccgacgtatacgctcgcaaggcggatatagtattacgaggttactatggctggaattccagacgtgctgtcaaggttcttgatcaagtttttccaaaggatgctgctagtcaaccttcactgatcattgtttactttggtggtaatgattcaatgggaccacactcatcaggtctaggcccccatgtccctcttccagaatatatagaaaacatgagaaaaatcgcaactcatctcaagggcctttcagacacaactcggttaatttttctcagttgtccaccagtggatgaggtcaagcttagtgaaaacacaagctcaatttttagtgaacttgttcgaacaaatgaattatgccggacatattcagaagcttgtgtagagttatgcaatgaaatgggaattaaagttatcgatctttggactgcatttcagaaacgagatgattggatgactgcttgcttcacggatggagttcatctatcaggtgaaggcagcaagatagttgttgaagagatactaaaagtgcttaaagatgcagaatggaagccaagtctacattggaaatccatgcctacagaattttcagaagattcaccgtatgatttagtgtattcagatggaaaaaccacattgaatccatctgattggacctttcatagagaaattcaatgggactaagattgttatgaaagaattatggtgattgaggactgtaagtaaggaaatatttctatcacagtaatgtagatgtggttgtatttctttttatggttttaatattacgtttcaatgaatcaagaacaagtggcaatgccaattagattacttgtttacatgtttctatatgggagaagattgtgtttatgtatgttctttgaatt

SEQ ID NO: 2804 - DNA, 1141 bp, Cichorium intybus
ccgaaaaaagaaatcatctccctccatcggtccatcccctgcgcggctccaaccctccatctactcctccataaatctaaatccaaccaacaaaatcaaactctcaaccccaacttacgtgacaaacctgcttttcagctgcctgaatctttggtctttacggagaaatggtcggaccagggaggccacagatagtattgttcggatcatcaattgttcagcttagtttcagcaatgatggttggggcgccattctcgccgacgtatacgctcgcaaggcggatatagtattacgaggttactatggctggaattccagacgtgctgtcaaggttcttgatcaagtttttccgaaggatgctgctagtcaaccttcactgatcattgtttactttggtggtaatgattcaatgggaccacactcatcaggtctaggcccccatgtccctcttcctgaatatatagaaaacatgagaaatatcgcaactcatctcaagggcctttcagacacaactcggttaatttttcttagttgtccaccagttgatgaggtcaagcttagtgaaaacacaagctcaatttttagtgaacttgttcgaacaaatgaatcatgccggatatattcagaagcttgtgtagagttatgcaatgaaatgggaattaaagttattgatctttggactgcgtttcagaaacgagatgattggttgactgcttgcttcacggatggagttcatctatcaggtgaaggcagcaagatagttgttgaagaaatactaaaagtgcttaaagatgcagaatggaagccaagtctacattggaaatccatgcctacagaattttcagaagattcaccgtatgatttagtgtattcagatggaaaaaccacattgaatccatctgattggacctttcatagagaaattcaatgggactaagattgttatgaaagaattatggtgattgaggactgtaagtaaggaaatatttctatcacagtaatgtagatgtggttgtatttctttttatggttttaatattacgtttcaatgaatcaagaacaagtggcaatgccagttagattacttgtttacatgtttctatatgggagaagattgtgtttatgtatgttctttgaatt

SEQ ID NO: 2805 - DNA, 1201 bp, Chrysanthemum coronarium
tattttacccccatacgcaactgcacctatcacctaattattacttacttcaatttatttcacaatcaaacaaacaccttttatataaactcattttattaagctccctttatattcaatttcttcttgttttacaaaatgataggaccagagagaccacaaatagtgctgtttggatcatcaattgttcagcttagttttagtaatgacggttggggtgctgctcttgctgatatttactctcgcaaggcagatatagtgttgcgagggtactatggctggaattccagacgtgctgttaaggttattgatcaaatttttccaaaggaagctgctagtcaaccttcactcatcattgtttactttggcggtaatgattcaatgggaccccactcatctggtttaggtccccacgtccctctttccgaatatattgagaacatgcggaaaattgctagtcatctccagggcctttcagacacaactcgtcttattttcctcggttgcccacctgttgatgaggccaagcttagtgaaaacacaagcacaatttttagtgaacttgttcgaacaaatgagttatgccggatatattcagaagcttgtgtagagttgtgcaatgagatgggaatcaaagtcatagatctctggactgcgtttcagaaacacgataattggttgactttctttacggatggggtgcatttatcaggagagggtagcaagatagtcgttgaggagatactaaaagttcttaaagaagctgaatggaaaccaagcctacactggaagtctatgcccactgagttttcagaagattcgccttatgatttggtctattcagatggaaaaacgacactaaacccatctgattggaccttccaccgagaaattcaatgggactaaacttagtcaattcattcgtcaaagatttgtgatgatttagagctacaaaacacacgaatttgattgtaagtaatgcaacactttctttcataaatgctgagatgtgtagccgaggtctcctatctggtcactgtactttcttttatgcttctatcacgaccttataaatgcatctagaacaagtagggttgctaatcagattccttgtttacatgcatacatgatgtttttatttggcgcccaaaagcttgcaccatgtgcttaagagcttgtatgttcttttaactaatagtag

SEQ ID NO: 2806 - DNA, 1679 bp, Artemisia annua
ctcgcgtgtcagtactccgacggggaataaaaagaaaccatctccttccttccttcctttcttgactccctccatatttacccatacgcaactgcacctatcacctaataattacttacaaaaaatttatataaattcctgtcattcattcggttacctgaatattcattcaacttttaagaaatgataggaccagagagaccacaaatagtgttgtttggatcatcaattgttcagcttagttttagtaatgacggttggggcgctgctcttgctgatatctactctcgtaaggccgatatagtgttgcgagggtactatggctggaattccagacgtgctgttaaggttattgatcaaattttcccaaaggaagcggctagtcaaccttcactcatcattgtttactttggtggtaatgattcaatgggaccccactcatctggtttaggtccacatgtccctcttgccgaatatattgagaacatgcggaaaattgctagtcatcttcagggcctttcggacacaacacgtcttattttcctcggttgcccacctgtggatgaggccaggcttcgtgaaaacacaagcacaatttttagtgaacttgttcgaacaaatgagttatgccggatatattcagaagcttgtgtagagttgtgcaatgagatgggaatcaaagttatagatctctggactgcatttcagaaacacgataattggttgactttttttacggatggggtgcatttatcaggagagggtagcaagatagtcgttgaggagatactaaaagttctcaaagaagctgaatggaaaccgagtctacactggaaatctatgcccactgagttttcagaagactcgccttatgatttggtctattcagatggaaaaacgacactaaacccttctgattggaccttccaccgagaaattcaatgggactaaacttaattagtcaattcatttgtcaagtcttgtagtaattcagagctacaaaacacacgaatttgattgtaagtaatgcaacactttctttcataaaaacactgatgtgcagccgagatctcctatctgggtcactgtacttccttttattcttctgttacgaccttctaatgcatctagaacaagtagggttgctaatcagattccttgtttacatgcatacatgatgtatttatgtggcgcacaatgttacttgatttatcttacttgtttacatgctagacctaacatttatcttgcttgtttatcagtatcctacaatgttacttgattatcaaacacaaatatcgtgtttaaaattcttataacatttgtctttcgtattactcatgtcacgttcaattaggatagagtatcgaaaaaagcacgaatgctgtaattataaactagctttgccaaagcaataaaaattttggccgtcaaaacatagagtaagcgatactggccataaactatccatggctattgtaacttagagcatgtgctatttttatggcaaccacgtctttggtttaattattgccaacaactttttcacaaatatgtatatttctcacacacgtttacccttttgaaagagtttatggaagatcagcaagggaactcggaataccgatccctctcccgtgatgctgacaccgctgcaatggcgacatcaacccctcgtc

SEQ ID NO: 2807 - DNA, 1032 bp, Chrysanthemum coronarium
tgaacattcaactttttctacgaaatgataggaccagagagaccccaaatagtgctgtttggatcatcaattgttcagcttagttttagtaatgacggttggggcgctgctcttgctgatatctacgctcgtaaggccgatatagtgttgcgagggtactatggctggaattccagacgtgctgttaaggttattgatcaaattttcccaaaggaggctgctagtcaaccttcactcgtcattgtttactttggtggtaatgattcaatgggaccccactcatctggtttaggtccccatgtccctcttgccgaatatattgagaacatgcggaaaattgctagtcatcttcagggcctttcagacacaactcgtcttattttcctcggttgcccacctgtggatgaggccaggcttcgtgaaaacacaagcacaatttttagtgaacttgttcgaacaaatgagttatgccggatatattcagaagcttgtgtagagttgtgcaatgagatgggaatcaaagttatagatctctggactgcgtttcagaaacacgataattggttgactttttttacggatggagtgcatttatcaggagagggtagcaagatagtcgttgaggagatactaaaagttcttaaagaagctgaatggaaaccgagtctacactggaaatctatgcccactgagttttcagaagactcgccttatgatttggtctattcagatggaaaaacgacactaaacccatctgattggaccttccaccgagaaattcaatgggactaaacttagtcaactcatttgtcaaagatttgtagtgatttagagctacaaaacacacgaatttgattgtaagtaatgcaacactttctttcataaaaactgagatgtgcagccaaggtctcctatctgggtcactgtacttccttttatgcttctgtaacgaccttctaatgcatctagaacaagtagggttgctaatcagattccttgtttacatgcatacatgatgtttttatttggcgc

SEQ ID NO: 2808 - DNA, 1216 bp, Chrysanthemum coronarium
tccttccttcattcactccctccaatattacccatacgcaactacacctatcacctaataattacttacttaattcatatctaaacattttatataaatccccgtcattcattcggtgaacattcaacttcttctacgaaatgataggaccagagagaccccaaatagtgctgtttggatcatcaattgttcagcttagttttagtaatgacggttggggcgctgctcttgctgatatctacgctcgtaaggccgatatagtgttgcgagggtactatggctggaattccagacgtgctgttaaggttattgatcaaattttcccaaaggaggctgctagtcaaccttcactcgtcattgtttactttggtggcaatgattcaatgggaccccactcatctggtttaggtccccatgtccctcttgccgaatatattgagaacatgaggaaaattgctagtcatcttcagggcctttcagacacaactcgtcttattttcctcggttgcccacctgtggatgaggccaggcttcgtgaaaacacaagcacaatttttagtgaacttgttcgaacaaatgagttatgccggatatattcagaagcttgtgtagagttgtgcaatgagatgggaatcaaagttatagatctctggactgcgtttcagaaacacgataattggttgactttttttacggatggagtgcatttatcaggagagggtagcaagatagtcgttgaggagatactaaaagttcttaaagaagctgaatggaaaccaagcctacactggaagtctatgcccactgagttttcagaagattcgccttatgatttggtctattcagatggaaaaacgacactaaacccatctgattggaccttccaccgagaaattcaatgggactaaacttagtcaattcattcgtcaaagatttgcgatgatttagagctacaaaaacacacgaatttgattgtaagtaatgcaacactttctttcataaatgctgagatgtgtagccgaggtctcctatctggtcactgtactttcttttatgcttctatcacgaccttataaatgcatctagaacaagtagggttgctaatcagattccttgtttacatgcatacatgatgtttttatttggcgcccaaaagcttgcaccatgtgcttaagagcttgtatgttcttttaactaatagtagtatgatttatct

SEQ ID NO: 2809 - DNA, 1215 bp, Lactuca sativa
ctaaaaatgaaaaagaaaactaaagtagaattcatctccctccatcggtcaattccatgttcagctccaaccaaccctttatctactcttcttccataaatccaaatctacatccaaccaacaaaatcaaactctcaactctcaaatcaaccccaattcacgtcaccaacttgccggaatctttcaaagttaggggttctcactcttacggagagatgatcggaccagggaggccacagatagtattgttcggatcatcaattgttcagcttagcttcagcaatgatggttggggcgccattctcgccgacgtctacgctcgcaaggcagatatagtactgcgaggatactatggttggaattccagacgtgctatcaaggttcttgatcaagttttcccaaaggatgctgctattcagccttcacttatcattgtttactttggtggtaatgattcaatgggaccacactcatctggtttaggtccccatgtccctcttcctgaatatattgaaaacatgagaaaaatagtaactcatctcaagggcctttcagacacaacaaggttaatttttcttagttgtccaccagtagacgaggtcaagcttagtgaaaacacaagttcaatttttagtgagcttgttcgaacaaatgagttatgtagaacatattcagaagcttgtgtagagttatgcaatgagatgggagtgaaagttatcgatctttggactgcatttcagaaacgagatgattggatgactgcttgcttcacagatggggtgcatctatcaggtgaaggaagcaagatagttgttgcagagatattgaaggtgcttaaagaggctgaatggaagcccagtctattctggaaatccatggccacagaattttcagaagattcaccatatgacttagtctatacagatggaaaaaccacacttaacccttctgattggaccttccatagggagattcaatgggactaataatattgttatcaaacaattctgttgtaagtaaggaaacatttctatcacaataatgtagtagttccatgtatttcttcttttattatgttccaatgaatcaaaacaatttagcaacgtcatttaaatgtttctatgtgagggaagatagttttattatgtatgttgtttggagtttagattgctttctacaatgtacatggggtttgttttcattccacctcccaaa

SEQ ID NO: 2810 - DNA, 1234 bp, Chrysanthemum coronarium
tccaatattacccatacgcaactacacctatcacctaataattacttacttaattcatatctaaacattttatataaatccccgtcattcattcggtgaacattcaacttcttctacgaaatgataggaccagagagaccccaaatagtgctgtttggatcatcaattgttcagcttagttttagtaatgacggttggggcgctgctcttgctgatatctacgctcgtaaggccgatatagtgttgcgagggtactatggctggaattccagacgtgctgttaaggttattgatcaaattttcccaaaggaggctgctagtcaaccttcactcgtcattgtttactttggtggcaatgattcaatgggaccccactcatctggtttaggtccccatgtccctcttgccgaatatattgagaacatgcggaaaattgctagtcatcttcagggcctttcagacacaactcgtcttattttcctcggttgcccacctgtggatgaggccaggcttcgtgaaaacacaagcacaatttttagtgaacttgttcgaacaaatgagttatgccggatatattcagaagcttgtgtagagttgtgcaatgagatgggaatcaaagttatagatctctggactgcgtttcagaaacacgagaattggttgactttttttacggatggggtgcatttatcaggagagggtagcaagatagtcgttgaggagatactaaaagttcttaaagaagctgaatggaaaccgagtctacactggaaatctatgcccactgagttttcagaagactcgccttatgatttggtctattcagatggaaaaacgacactaaacccatctgattggaccttccaccgagaaattcaatgggactaaacttagtcaactcatttgtcaaagatttgtagtgatttagagctacaaaacacacgaatttgattgtaagtaatgcaacactttctttcataaaaactgagatgtgcagctgaggtctcctatctgggtcactgtacttccttttatgcttctgttaagaccttctaatgcatctagaacaagtagggttgctaatcaggttccttgtttacatgcatacatgatgtttttaagtggtgcgcaaaagcttgcaccatgtgcttacgaccttgtatgataatgttacttgattatcaaacacaaatattgtgtttaaattcctattacaattgtctttcgtattaaa

SEQ ID NO: 2811 - DNA, 1106 bp, Chrysanthemum coronarium
gcaactgcacctatcacctaataattacttactctaaaacattttatataaatccccgtcattcattcggttacctgaaaaacattcaacttcttctacgaaatgataggaccagagcgaccccaaatagtgttgtttggatcatcaattgttcagcttagttttagtaatgacggttggggcgctgctcttgctgatatttactctcgcaaggcagatatagtgttgcgggggtactatggctggaattccagacgtgctgttaaggttattgatcaaattttcccaaaggaagctgctagtcagccttcactcatcattgtttactttggtggtaatgattcaatgggaccccattcatctggtttaggtccccatgtccctcttgccgaatatattgagaacatgcggaaagttgcgagtcatcttcagggcctttcagacacaacacgtcttattttcctcggttgcccacctgtggatgaagccaagcttagtgaaaacacaagcacaatttttagtgaacttgttcgaacaaatgagttatgccggatgtattcagaagcttgtgtagagttgtgcaatgagatgggaatcaaagtcatagatctctggactgcgtttcaaaaacacgataattggatgactttctttacggatggggtgcatttatcaggagagggtagcaagatagtcgttgaggagatactaaaagttcttaaagaagctgaatggaaaccaagtctacactggaagtctatgcccactgagttttcagaagattcgccttacgatttggtctattcagatggaaaaacgacactaaacccatctgattggaccttccaccgaaaaattcaatgggactaaacttagtcaattcattcgtcaaagatttgcgatgatttagagctacaaaaacacacgaatttgattgtaagtaatgcaacactttctttcataaagactgagatgtgtagtgtagccgaggtctcctatctgggtcactgtactttcttttatgcttctattaggacgttataatgcatctagaacaagtagggttgctaatcagattccttgtttacatgcatacatgatgtttt

SEQ ID NO: 2812 - DNA, 1100 bp, Chrysanthemum coronarium
ctaataattacttactctaaaacattttatataaactcctgtcattcattcggttacctgaacattcaactttttctacgaaatgataggaccagagcgaccccaaatagtgttgtttggatcatcaattgttcagcttagttttagtaatgacggttggggcgctgctcttgctgatatctacgctcgtaaggcagatatagtgttgcgagggtactatggctggaattccagacgtgctgttaaggttattgatcaaattttcccaaaggaagctgctagtcaaccttcactcgtcattgtttactttggcggtaatgattcaatgggaccccactcatctggtttaggtccccatgtccctcttgccgaatatattgagaacatgcggaaaattgctagtcatcttcagggcctttcagacacaactcgtcttattttcctcggttgcccacctgtggatgaggccaggcttcgtgaaaacacaagcacaatttttagtgaacttgttcgaacaaatgagttatgccggatatattcagaagcttgtgtagagttgtgcaatgagatgggaatcaaagttatagatctctggtctgcgtttcagaaacacgagaattggttgacttttttcacggatggggtgcacttgtcaggagagggtagcaagatagttgttgaggagatactaaaagttcttaaagaagctgaatggaaaccgagtctacactggaaatctatgcccactgagttttcagaagactcgccttatgatttggtctattcagatggaaaaacgacactaaacccatctgattggaccttccaccgagaaattcaatgggactaaacttagtcaactcatttgtcaaagatttgtagtgatttagagctacaaaacacacgaatttgattgtaagtaatgcaacactttctttcataaaaactgagatgtgcggtctcctatctgggtcactgtacttccttttatgcttctgttacgacctcctaatgcatctagaacaattagggttgctaatcagattccttgtttacatgcatacatgatatatttatgtggcgcgcaatgttacttgatt

SEQ ID NO: 2813 - DNA, 1193 bp, Cirsium arvense
aaatcatccctccatcccctgcacccatccatcatctactcttcccttcccatatatacatatacctatctatatctatatatccatctaactccaactaataaaacaacaaattacgtgcttccaatcttctagatttagggtttttttttccacatagagatgatcggaccacaaaggcctcagatcgtattgtttggatcatcaattgttcaacttagttttagcaatgatggttggggcgccactctcgccgatatctacgctcgtaaggcggatatagtattgcgagggtactatggctggaattctcgacgtgctatcaaggttcttgatcaagtttttccaaaggattctgctaatcagccttcacttgtcattgtttactttggcggtaatgattcaatggggcctcactcatcaggtcttggtccccatgtccctcttcctgaatatatcgaaaacatgagaaaagttgcaactcatcttcaggaactttcagacacaactcgtataatttttctcagttgcccaccggtggatgaggtcagagttcgtgaaaacacaagctcgatttttagtgaacttgttcgaacaaatgagttatgccgaatatattcagaagcttgcgtagagttgtgtaatgagatgggagtgaaagttattgatctatggactgcatttcagaaacgagatgattggatgactgcttgttttacggatggggtgcatttatcaggtgagggaagcaagatagttgttgaagagatactaaaagtgctgaaagaggctgaatggaagccgagcctacactggaaatccatgcccacggagttttcagaagactcgccctatgacttagtctattcagacggaaaaacgacgctaaacccgtctgattggaccttccacagagagattaagtgggattaattaaacacatattcttttcaatttgcaactctgcaagattgtacctcttgttatgcttgcttttatattaccacatactatttaatacatctatctacaagtagtagtattggctatcacattacttgtttacagactttacatgcatacattatgtttgtatatactgcaaaaccttctctaccatgtgcttaagaactactatgtttttttgtaattgttttgtacattgcacaagtgattaatatacttataagtac

SEQ ID NO: 2814 - DNA, 991 bp, Centaurea maculosa
tcaatcatcatcatctacccttccttccaactaacaaaacacaaattgtgtgcttatatcttctagggtttcttttctctttaattcacatagagagagatggttggaccagcagataggccgcagatcgtattatttggatcatcaatcgttcagcttagtttcagcaacgatggttggggcgccattctcgccgatgtctacgctcgtaaggcggatatagtattgcgaggatactatggctggaattctagacgtgctatcaaggtcctcgatcaagtttttccaaaggattccgctaatcagccatcgctggtcatcgtttactttggcggtaacgattcaatgggacctcactcctcaggtcttggtccccatgtccctctccctgaatacgtcgaaaacatgagaaaaattgcaactcatctccagggcctttcggagacaacccgtataatttttctcagttgcccaccggtggatgaagtcagagttcgtgaaaacacaagctcaatttttagtgaacttgttcgaacaaatgagttatgccgaatgtattcagaagcttgcgtagagttgtgcaacgagatgggagtgaaagttattgatctctggactgcatttcagaaacgagatgattggacgactgcctgctttacggatggggtgcatttatctggtgagggtagcaagatagttgttgcagagatactaaaagtgctgaaagaagcggaatggaagccgagcctacactggaagtcgatgcccacggagttttcggaagactcgccctacgacttagtctattcagacggaaaaactacgctaaacccgtcggattggaccttccacagagagataaaatgggattaattgaacacatcatttcaatttgtaagatttcaaatgtgattctactttcttttatattaatgcatctatctacaactagtactagtagcattgccaaaaagaaaaagtaccgactgcg

SEQ ID NO: 2815 - DNA, 1210 bp, Centaurea maculosa
ttctatagaatagaaagaaaaataggaaaataaacaatttagaattaaagagggttgttagaagttgctaaatgcaagcagaagaccaattgaagagaaatcatatatctccctccattcccatttccattcactcccatcatcaatcatcatcatctacccttccttccttccaactaacaaaaaacacaaattgcctgcttaaatcttcttctacttttttttagggtttcctttttgcaaatagagagatggttggaccagcagaaaggccgcagatcgtattgtttggatcatcaatcgttcagcttagtttcagcaacgatggttggggcgccattctcgccgatgtctacgctcgtaaggcggatatagtattgcgaggatactatggctggaattccagacgtgctatcaaggtcctcgatcaagtttttccaaaggattccgctaatcagccatcgctggtcatcgtttactttggcggtaacgattcaatgggacctcactcctcaggtcttggtccccatgtccctcttcccgaatatgtcgaaaacatgagaaaaattgcaactcatctccagggcctttcagagacaacccgtataatttttctcagttgcccaccggtggatgaagtcagagttcgtgaaaacacaagctcaatttttagtgaacttgttcgaacaaatgagttatgccgaatatattcggaagcttgcgtagagttgtgcaatgagatgggagtgaaagttattgatctctggactgcatttcagaaacgagatgattggatgactgcgtgctttacggatggggtgcatttatcaggtgagggtagcaagatagttgtagcagagatactgaaagtgctgaaagaagcggaatggaagccgagcctgcattggaagtcgatgcccacggagttttcggaagactcaccctacgacttagtctattcagacggaaaaactacgctaaacccgtcggattggaccttccacagagagattaaatgggattaattgaacacatcatttcaatttgtaagattttaaatgtgattctactttatttttatattaatgcatctatctacaactagtactagtagcattgccaatcagattacttgtgtacacattttacatgcatacatgatgatgatggtgatggttttatattgcaaaaccttctaccatagtgatta

SEQ ID NO: 2816 - DNA, 908 bp, Helianthus annuus
gatctagcgatggtgggaccagagaggccacagatagtattgtttggatcatcgatagttcagctgagtttcagcaatgatggctggggtgccattctcgcagatgtctatgctcgtaaggcggatatagtgttgcgagggtataacggatggaattccgcacgcgctgtcaaagtcctcgatcaaattttcccaaaggatgctgctagccagccttcactgatcatcgtttactttggcggtaatgattcaatggaacctcacccgtctggtttaggcccccatgtccctcttcctgaatatatcgaaaacatgagaaaaattgctactcatctccagggtctttcagacacgacacgcttaattttcctcggttgcccacccgtggatgaggtcggacttcgcgagaacacaagctcaattttaagggaacatgttcgaacaaatgagttatgccgcatatattcagaagcttgcatagagctgtgcaatgagatggggataaaagttattgatctttggacagcgtttcgaaaacaagatgattggttaacttactttacggatggggttcatttatcaggttcaggaagcaagatagttgctgaggagatactaaaggtgcttaaagaagccgactggaaaccaagtctacactggaaatctatgcctactgaattttcagaagactcgccttacgatttagtctcttcagatggcaaaacgacgctaaacccgtctgattggacctttcaccgagaaatccaatgggactaaaacatgatggatatcataggttcaaaacatgcgcatccgactgtaacaaatgtaacactttattttgcaataactaagatttgtagcagtgaccttaattatatgcaacatgtttttagtcccattggatt

SEQ ID NO: 2817 - DNA, 1288 bp, Arnica chamissonis
ccaatcaacactaaattacgtgccggaatcttagcaatggccggaccacagaggccacagatggtattgtttggatcctcaatcgttcagctcagtttcagcaatgatggttggggcgccactctcgcagacatctacgctcgtaaggcggatatagtgttgcgagggtactatggatggaattccagacgtgctatcgaagttcttgatcaaattttcccaaaggatgctgctatccagccttcactgatcattgtatactttggtggtaatgattcaatgggacctcactcgtctggtttaggtcctcatgtccctcttcctgaatatgttgaaaacatgagaaaagttgctactcatctccagggtctttcagacacaacacgtctaattttcctcacttgcccacccgtggatgaggtcaaagttcgtgaaaacacaagcgcagtttttagtgaacttgttcgaacaaatgagttatgccggatatattctgaagcttgcgtaaagttgtgcaatgagatgggaataaaagttatcgatctttggactgcatttcagaaacatgatgattggttgactttctttacggacggggtgcatttatcaggttcgggaagcaatatagttgttggggagatactaaaggtgcttaaagaagcagaatggaaaccaagtttacactggaaatccatgcccactgaattttcagagaattcgccttatgatttagtctataaagatggcaaaacaaccataaacgcgtctgattggacatttcacagagatatccaatgggactaaagacatgatctcatagcttcaaaaacacgcatttgactgtaagtaatggagtactttctattgcgcgaacaatgactaaaatttgtatcagactatcagtgatctcgatcttgttcattctaactttttatgcttctgtagtatgtaacatgtggcattgccaatcagattcgttgttttacatgtttttggtttctttgatatttgttgctcgctttttgatatatgtttcctgaggtatcgtttgcctaccctcagaccctactctttgagcgggattttgttgggtatgtttgtttttgttattcattgcatacatcatacaccaagggtttcacatgaaattgctccaaatcttagccatagtttgctaccaatgacaacaaaattcttgttgtattcatttctgcaacattagcaaatgtaccatataccacatgttttagtaaactccttttgatttcataagttctaaaaaaaaaaa

SEQ ID NO: 2818 - DNA, 1058 bp, Echinacea purpurea
cttacttgattcagcagccggaatcgtaaaagaatagctatggtcggaccacggaggccacagatagtattatttggatcatcgattgttcagctcagtttcagcaacgatggttggggcgccattctcgcagatgtctacgctcgtaaggcggatatagtgttacgaggatacaatggatggaactccagacgcactgtcaaaatcctcgatcaaattttccctaaggatgctgccagccagccttcactaatcatcgtttactttggcggtaatgattccatggaacctcactcgtctggtttaggcccccatgtccctctccctgagtatattgaaaatatgagaaaaattgctactcatctgcagggtctttcagacacaacgcgtataatttttctcggttgcccacccgtggatgaggtcagccttcgcggagacaaaagctcaattttaagggaacatgttcgaacaaatgagttatgccggatatattcagaggcttgcatagagttgtgcaatgaaatgggaataaaagttattgatctttggacggcgtttcggaaacaagatgattggttgacttactttacggatggggttcatttatcaggttcgggaagcaaaatagttgttgaggagatacttaaggtgcttaaagaagccgaatggaaaccaagtctacactggaaatctatgcccactgaattttcagaagactcgccttatgatttagtctatacagatggcaaaacgaccctaaatccgtccgattggacctttcacagagaaatcaagtgggactaaaaacatgatatctcaatctttgtagcttcaaaacacgcgcattcaactgtaagtattgcaatactttctattgcattaactaagatttgtaccttgtgtgcttgtattgtattaatgcaacatgtggcattgccaaccagattcattgcttacaagcaatgaaaacaagattaatctttttgtattcatatatgcaacattagctaatgtattttagtagtctataccatatgcttgcgtacaaccttttg

SEQ ID NO: 2819 - DNA, 1237 bp, Amsonia hubrichtii
gggggatggtaggaccacagagaccgcagttcgtgcttttcgggtcatcgattgtgcagctcagcttcagtaatggtggttggggtgctatcctcgcggatgtctatgctcgtaaagcagacatagttttgcgaggttattatggatggaactcccggcgtgctgttcaggtcctagatcaagttttcgcaaaggatgctgctaatcagccttctttagtcattgtttattttggtggcaatgattcgatgggaccacattcgtctggactgggtcctcatgtaccacttccagaatacattgagaacatgagaaaaattgcaactcatctcaagagcctttcagagtcaactcgcctaatcttcctcagttgtccacctgttgatgaggtcaaagttcgtgaaaatacaagctcagcattcagtgagctagtccggacaaatgatttatgtcaaaaatattcagaagcttgtattgagttgtgccatgagatgggcataaaggttgttgacctttggactgcaatgcagaaacgagaagattggttgagtgcttgctttacggatggggttcatctttctgaagaggggagtaaaatagtggtggaagagatactcaaggttttgaaggaagctgaatgggttccatgtctacactggaaatccatgccaactgagttttcagaggactcgccttatgacctcgtggcttccgatggaaaaaacacattgaatccatccgattggactttccacagaaaaatccaatgggactaaattgaaaggcatttgcctctgttgccattgtacatctagttgtttgcagaagatgtgcaaaaacatatgcatcattgaagagttataaggaaaaaaatgtgaggatttaacgagctatatgaaactggaaagcgttgtccgtagccaaatttttatatatagtagggtaaatttgtttgttgctcgtgtttatgaagtccttctctctaaactttatttagttgtcagggttagtttatggtcctcaggtgtacagtgctggggcacaaattaagagtgatttttgcttggtatgcgctcaaataaattttgacttgtttgcgttttgtaatatcccctaacaagcccaagtatagcctgagcggaggttcttcttttgccactaactagtgagattccgaatttgaaaaaagaaagtgcagaaaaaattttatggaatctaataggatgaattctccatt

SEQ ID NO: 2820 - DNA, 1363 bp, Catharanthus roseus
ttattcagctcattctgattttggtaaccttcagttaaaattgtttgcttgccgtttaacttcggtaaaccaaaaccgacgctctgatggtaggacctcagaggccgcagttcgtgctttttggatcatcgattgtgcagctcagcttcagtaatggtggttggggtgctatcctagccgatgtatatgctcgtaaagcagacatattattgcgaggttactatggttggaactcccggcgagctgtgcaggtcctagatcaagttttcccaaaggatgctgctaatcagcctgatttggtgattgtttattttggtggcaatgattcaatgggaccacattcatcaggattgggtcctcatgtaccacttccagaatacattgagaacatgagaaaaattgcaattcacctcaagaacctttcagaatcaactcgcctgattttcctcagttgtccgcctgttgatgaggtcaaggttcgtgaaaatacaagttcagtattcagtgagctagttcgaacaaatgaattgtgtcgaagttattcagatgcttgtattgagttgtgtcacgagctggggataaaggtagttgatctttggactgcgatgcagaaacgagaagattggttgactgcttgctttacggatggggttcacctttcggaggaagggagtaaaatagtggtggaagagatactcaaggtgttgaaagaagctgattgggttccatgtctacactggaaatccatgctaactgagttttcagaggactcaccttatgaccttgttgcttctgatggaaagaccacattgaatccatccgactggactttccaccgaaagatccagtgggactgaattgaaatacatttacctcaggtaccatcctacgtctagttattatttgctaaagataatcaaaatatatgcctcgatgaattgttagagaagaaaagcataagtagggtatgaaactagctatttgtaactgcaaactgttcctaaatttcaccacgttctgggatttttatattatgcacctgtcagggttagtttatgcttcttctcactggtgcatgttaacattgcttgaactttccatcacattcctgttgcatgatttgtgaaagaaggatgaagtttaaagtgaaaattttgcattcactttagaaaggaaaacaaattcaagacactgtaagtagttttctagtttgtgcctctgtgtaacttaaaagtgtaattctatagagtaataatgcaagcacttatatgaaatattttgagttgttcacattttctatatggaaaaaatgctaatggatgagtcctatcatattcactggtcaccactgctgaaattttaa

SEQ ID NO: 2821 - DNA, 1160 bp, Tabernaemontana elegans
cattaatgtacacagtgtgacggtactgaggaggcagggtgttgtcactaccgccgaagcgtttaataccatgtcaatatgtttggtgccgttcagttaacaacattcttcttcttctacataggctgactgcttaacgtcggtaacccaacacacagtgagggaaggagggatggtaggaccacagagaccgcagtttgtgcttttcggatcatcgattgtgcagctcagcttcagcaatggcggttggggtgccatcctcgctgatgtctatgctcgtaaagcagacatattattgcgaggttactatgggtggaactcccggcgtgcggtccaagtcctagatcaagttttcccaaaggatgcggctaatcagccttctctggtgattgtttattttggtggaaatgattcaatgggaccacattcatctggactgggtcctcatgtaccactcccggagtacattgagaacatgagaaacattgcaactcatctcaagaacctttcggagtctactcgcctaatcttcctcagttgtccacctgttgatgaggtcaaagttcatgaaaatagaagttcagcactcagtgagctagttcgaacaaatgatttgtgtcgaacatattcagaagcttgtattgagttatgccacgagatgggcataaaagttgttgatctttggacagcaatgcagaaacgagaagattggttgactgcttgctttacggatggggttcacctatctgaagaggggagtaaaatagtggtggaagagatactcaaggtgttgaaggaagctgaatgggttccatgtctacactggaaatccatgccaagcgagttttcagaggactcacctttcgaccttgttgcatctgatggaaaaactacattgaatccatccgactggactttccacagaaaaatccagtgggactaaattgaaaggcatttttgcctctagtaccattctacttctagttgtttgcaaaagatgagcaaactatatgcatccttgcagagctgaaaggtaacaaatgtagggaatgtagttagctagtatcttcaagttgttgcctgtagcctaagcttcattttttttgggtcaaaacattagggagaattgttccttggtcgggttttatgaagtccgttta

SEQ ID NO: 2822 - DNA, 1352 bp, Conyza canadensis
aaacattaaaaacaattcatctccctccgttctctcaaactctacccatcgcctaatttttcacctatacatacattctttttctattgaactcccgatcaaaccagcagtacaaaaattccgatatggttggaccggcgaggccacaaattgtgttatttggatcatcaattgttcagcttagtttcagtaatgacggttggggtgccattcttgctgacgtctactctcgtaaggcggatatagtgttacgagggtactatggctggaattctagacgtgctgtcaaagttgttgatcagatttttccaaaggatgctgctagtcagccttcactgatcattgtttactttggtggtaatgattcgatgggacctcactcatctggtttaggtccacatgttcctcttcccgaatatattgaaaacatgaggaaaattgctagccatctaaagggcctttcagagacaactcgtataatctttcttacttgcccacccgtggatgaggtcaaacttgctgaaactacaaggtacgaggattattttactaacgagatgtgttcaagcaatgcatctaaggcctgtttacttttatgtaaaacagctcagtatttagtgaacttgttcgaacaaatgagttatgccagaagtattcagatgcctgtgtagagctgtgcaatgagatgggaattaaagttattgatctttggactgaatttcagaaacgagataattggttgtctttctttacggacggcgtacatttatcaggtgaaggaagcaaggtagttgttgaggagatactaaaagtgctcaaaaacgcagaatgggaaccaagtttacattggaaatccatgcccactgagttttctgaggactcaccatatgatttagtgtattcagatggaaaaacgactctaaatccgtctgactggaccttccacagagaaattaaatgggactagtagagatcattctatttgtgcaaaatttgtgatgatgcagagctgcaagtcacacatttggctataagtaagcaatactttcctatcacagtaacggagagttgtacctgtgttgtctaaatccggttcattatacttgctatgattctgtcacacccttctaatgcatctagaacaagtagcattggtaattagatatcttgtttacaggcatacatttaaacttgctgtttttgtatgggaaagttgtaccatatgcttaagagcttgtatgttatccgaattctgtaatttattttacttagaaaactacttaatgaatattgctgattgtcttagtaagtcacattatttttgctggggagtaggaagatatttaagttag

SEQ ID NO: 2823 - DNA, 1562 bp, Mimulus guttatus
tgctagaacacttctctctcacacacacaaacacactgtgaattgaattgaattgaatgacccgtacttcttcatctaccctattcggtgattgttggtgcaataaaagaggaaataaatgaaattcttgttgactaattggcctcaagtttacacttatttcgtgacgaggaattgtggaaaatatatataatcgagatcgaagcagaaaaatcaaacaccaaaaaaaagggaaagagatcgatcgttcgatggagatgatggtgggaccagggaggccattgtttgtgctgttcggttcatcgatagttcagctcagcttcagcaatggcggttggggtgccatcctctccgatatctacgcccgcaaagctgatataattacacgaggttattacggttggaattctcgacgagctctaaagatccttgatcaagtttttccaaaggatgctgctgttcaaccttctttaattatcgtgtattttggtggcaatgattctatgggagctcactcatcgggattaggtcctcatgtacctctcccagagtatattgacaacatgcgaaaaattgcaacccatctcaagaacctttcagacaaaacacgcttaatattcctcagctgcccacctgtcaacgaggttaaactacgcgaaaacacaagctcgtatttcagcgagctagtccgcacaaacgagctatgtcgaatatattcagaagcttgtataaacgtgtgccaagagatggatatcaaggtaattgatctttggacagccatccagaaacgagaagactggtcgaacgcttgctttacggatggagtacacttgtcaggtgagggaagtaaggtggttgtggaggaaatactgaaggtgttgaaagaagccgagtgggaaccgaagcttcactggaaatcaatggctactgaattctctgaggattcaccctatgatcttgttgcttctgatggaaaaaccaccattaatccctctgaatggacttttcacagagatattcaatgggattgatttgctcactcaccaatttcttatatatatatatatattattattattttttctgaattttggatgttatataataggttgttttttaaatttgtgcaatttctttggactataagccattttcagaatttaaaagaatctaaattattttgtttttaatttgttgttggtttgggcctgttaattttgagcttaattgggccttgacccatcgcacacaaaataacaaaagtgttagatgctaatgacaactctgctacaaattggatttatgcgtgcgagtagatggtgtgggcccgagttcgtcctgggccgatcaccatgcaaccctattgtaagctccttgtgtgtttttaatacgcgtaacgcgtctacggccactcctcgagtaaagctcgaattacgaaaaatctctcatgtttgggtaattacaatcacccatcacgtatgtattgcattatttctacttattcatttttacggtgtcaaatttacctattgaatgaatggtttttttaagacaatatatag

SEQ ID NO: 2824 - DNA, 862 bp, Vinca minor
aggaccacagagaccgcagttcgtgcttttcggatcatcaattgtgcagcatagcttcagcaatggcggttggggtgctattctcgccgatatctatgctcgtaaggctgacatattattgcgaggttactttgggtggaactcccggcgtgctatccaggtcctagatcaagttttcccaaaggacgctgctaatcagccttctttggttattgtttattttggtggcaatgattcaatgggaccacattcatctgggctgggtcctcatgtgccacttccagaatacgtcgagaacatgagaaaaattgcaaatcatctcaagaacctttcagagtcgactagagtgatcttccttagttgtccacctgttaatgaggtcaaagttcgtgaaaatacaagttcagtattcagtgagctagttcgtaccaatgaattatgtcgaatatattcagaagcttgtattgagttgtgccacaagatggggataaaggtagttgatctttggactgcaatgcagaaacgagaagattggttgactgcttgctttacggatgggattcacctttctgaagaaggaagcgaaatagtggttgaagagatactgaaggtgttgaaagaagctgattgggttccatgtctacactggaaatccatgccaactgagttttcggaggactcaccttatgatctcgtttattctgatggtaaaaccacattgaatccatccgactggacattccaccgaaaaatccagtgggactaggtaaaaatgttattaggtctctagttaccactccgtacgtctagttatttatttgcaaaagataaaggtaaaaattatatgcactccctagaagag

SEQ ID NO: 2825 - DNA, 1096 bp, Valeriana officinalis
aaattggcacataaatacgagagcgggacaacgccattcctccacagttccaacttccaagccagagacagagagaaagcgataattgatgttgttcaacttcaattcaaccactcgcttttctactctattctagatcctctccacagatttctgctaaacaaacaaacaatggtcggacctgccaggcctcagattgttctatttggatcctcaattgttcaactcagcttcagcaatggcggttggggtgccattctctccgacgtctactctcgtaaagcagatatagttttacgaggatactatggttggaattcgcgacgtgccctccaggtccttgatcaagtttttccaaaggatgctgttgttcagccctctttgataattgtatacttcggaggtaatgactcaatgggacctcactcaactggactcggccctcatgttcctcttccagagtacattgaaaacatgagaaaagttgcaactcatcttaagagcctttcagacacgacccgcataatttttctaagctgtccacctgttaacgaggaaaaagttcttaaaaacagttctatatttagtgagttagtacgaacaaacgaactatgccgcgtatattcagaggcttgtatggagttgtgccaggagatgggcttgaaagctattgacctttggaccgcatttcaacgtcgagatgattggttgaatgtctgtttcattgaggacggggtacatttagcagaagaaggaagcataatagttgtggaggaaatattaaaagttgtaaaagaagctgattggagtccaagcctacactggaaatccatgcctactgaattctcggaagactcatcatacgatttagtttattctgatggtaagacccttctcaatccgtccgattggacttttcacaggaaaattcagtgggactaatttcttattcaaatgccataaagttagtgaaaaggtacgttgttatgttgtttatttctgtaatacttaccatgtactatctttgttgaatttctctgctcgcaatttctatagtataaatgaaataatccgaaaaaaaacgatactagcgtgg

SEQ ID NO: 2826 - DNA, 1051 bp, Vitis vinifera
gttctcacgcatctcacaagttcgtctcttccggtggaaaacctgccggcggtgaaggtgactgcgccggcgccgagatggttggaccacagaggcctcagttcgttctctttggatcgtccattgtgcaactcagctacgccaatggcggttggggtgccatactctctgatgtctacgctcgtaaagcagacatagtgttgagaggatattatggttggaactcccggcgagctgtcgaggtccttcatcaagtttttccaaaggatgctgccacacaaccttctttagtgatagtctattttggtggtaatgattcaatggggcctcattcatctggcctaggccctcatgtaccacttccagaatatattgagcacatgagaagcattgcagctcatctccagagcctttcagataccacacgtgtcatttttctcagttgtcctcctgtcaacgaggcaaaagttcgagcaggcgcgagtggaatatttagtgagctagtacgaacaaatgagttatgcagacagtattcagaagcttgtatagagctgtgccaggaggtgggtgtgaaggttgttgatctttggactgcatttcagaaaagagatgattggttaaatgcttgcttcacagatggggttcacttatctgctgagggaagcaagatagttgtggaggagatactgaaggtgttgaagggagctgaatgggagccaagtctacactggaagtccatgctcactgaatttggggatgactccccatatgatcttgtggcttttgatggaaagacgaccttgaatccctcggattggactttccacagggagattcaatgggactaagctaccaggccatcttttgcctatgtttcctacatgggaatactcccccaaaactaaaaaacaaaaccactatatatcttcattgcccgggacatgcaaaagagtaaaaaaaaaaagggaaaatagaacagaactggagattgacagatgaagaagtatatttatatattttatagtgctattgcttattggaagtgcctaaa

SEQ ID NO: 2827 - DNA, 969 bp, Vaccinium corymbosum
accgaaaaggcctcagttcgttctattcggatcgtcgattgttcagctcagtttcagcaatggcggttggggtgccattctcgctgacatttactctcgtaaagccgacatagtgttgcgaggatactatggttggaattcacgacgtgcactgcaggttctcgatgaagtctttccaaaggatgctgcttctcagccttctttggtgattgtctacttcggtggtaatgattcaatggggcctcactcatctggcctaggtccccatgttccacttccggagtatacagaaaacatgagaaagattgcacttcatctgaagagcctctcggacacaacacgtattattttctcagctgtccaccagtcaacgaggccaaacttcgagaaaaacacaagcaaatattttagcgagctagtccggacaaatgagttatgccgaagttactcagaagcttgtgtagagttgtgccaggagatgggcctgaaggtggttgatctttggactgcaatgcagagacgagatgattggatgactgcttgctttaccgacggtgttcatttatctgccgaggggagcatagttgttgtggaggagatactcaaggtgctcaaggaagcagagtgggagccatgtttccattggaagtccatgcccacagaatatggagaaaattcaccttacgaccttgttgcttatgacggaaaaacgactataaatccgtcagaatggacctaccacagggaaatacaatgggattaggctacgacgaaattccccctactgcattggttatttaagtttgcacaacccatccggaattggctcatttctggtgaattggattgattttcttcattcgattcaaagctatgtagggatcctctcctgctgtcttttgctacatgttagtatttgttagtgtggcaatgtgtactgtagttgtcattttcactagaataataaat

SEQ ID NO: 2828 - DNA, 989 bp, Olea europaea
gaactgcacaaaatctcccaggaaatagaaagtgaagaagaaaaaatggtgggaccaaagaggccactgtttgtgttgtttggatcatccatagttcagcttagtttcagcaatggcggatggggtgccatactttccgatatctacgctcgtaaagctgatgtaatctcacgaggctactacggatggaattcacgacgagccatccaagtcctcgatcaagtttttccaaaggatgctgccattcagccatcattggtgatagtatattttgggggtaatgattctatgggacctcactcatctggactaggtcctcacgttccacttccagagtatattgaaaacatgaaaaaatagcaatccatctcaagagcctttcggatacaattcgcataatctttctgggttgcccacctgtcaacgaggctaagcttcgtgaaaccagaagtccatacctcagcgagcttgttcgaacaaatgaattatgccggaattattcagaagcttgtatagagttgtgcgaggagttgcatataaaggttgttgatctttggactgcgattcagaaacgagaagactggttgaatgcttgctttaccgatggagttcacttgtctgctgagggaagtaagatagtcgtggaagaaatactcaaggtgctgaaggaagctgaatgggagccatcactccattggaaatccatgcctacggaattcgcagaggattctccatatgatctagttgcttctgatggaaaaaccaccttaaatccgtctgaatggacttttcacagagaaattcaatgggactgactaggttaggttgtctaattccttttgagtcgatggtgtttcatgtttctaaaatgctatagttctgagaaaattatatggaactgcactggcttcattttatctatgattcaccatgtattggtaaacaaattcaaatcgcataagaagcttcaccggcatggtgtcatcgtg

SEQ ID NO: 2829 - DNA, 1298 bp, Rosmarinus officinalis
ggccgggggagagctctcttgtgcttatcatgagtgttacaacaccaaataaaaacacaaaagatttcccctattaaacatgaaaaagaaaaaggagagtaaatagagagagcagcacagccttcatttaaagcccacgctgccatgttagctactgcttcctttcagcagtgcccccaggccccacgcactctatttgcctgagattacgaaatatatcacagttcctcgctttccttattttaatcgcgtgtacaagaaggagaagtagaagaagcagcagagagagatggtgggaccggcgaggccattgttcgtcttgttcgggtcgtcgatcgttcaactaagctacagcaatggcggttggggcgctattctctccgacatctacgcccgtaaagctgacataatcttaaggggatattatggttggaattcgagacgtgctgcccaaatccttgatcaggttttcccagaggatgctactgttcagccgtcattaataatcgtgtattttggtggcaatgattccatgggacctcactcatctggactcggtcctcatgtaccacttccagaatatattgaaaatatgagaaaaatcgcgacccatctcaagaatctttcagagaaaactcgaataatatttctcagttgtccgcctgtcaatgagactaaacttcgtgaaaacacaagtacatatttcagtgagctagttcgaacaaatgagttatgtcggatgtattcagaggcttgcatagagctatgcaaggagatggatgtcaaagtagtcgatctttggacagcaatgcagaaacgagaagattggatgaacgcttgctttacggatggagttcacttgtccgcggagggaagcaaggtagtcgtggaagaaatactcgaggtgctgaaacaggccgagtgggagcctagtctacattggaagtcgatgctgactgaattctcggaggactcgccctacgatctagtcgcttctgatggaaaaacgaccataaatccttcggaatggacttaccacagagaaattcagtgggactagctgtgataagccatttttgctttcttggtggctacctgaaaacttccatagagcagaatgaatgtgtagtactacaaattcatgtattaactgcttgtattttgtatttggaatttggatcgattttgaaaccttgctgggcctagctatggatggaatgtggtttccaatataatgcacttcatccaccaagagtgtgtcataattatcttattcggtgatcacaaataatatgtca

SEQ ID NO: 2830 - DNA, 1228 bp, Theobroma cacao
gggttcctcgaggctccaccttgttttcccaattcacattcaaagggagagaaagagaaagagataaaaagagctttttagaggaaagacagtgaaaaatggtgggaccagcaaggccacagttcgtcctctttggatcatccattgtccaacttagtttcagcaatggcggatggggtgctattctagctgacgtctatgctcgcaaagctgacatacttttacgaggatattatggatggaattcgcgacgtgcagtagaggtgctcgatcatgttttcccaaaggatgctgctacacagccttctttgataataacttattttggtggtaatgattcaatgggacctcatccatctggccttggacctcatgtgccacttaatgaatatattgagcacatgaggaagatagcaattcatctgaagagcctttcagattcaacacgcctcatttttcttacttgtcctcctgttgatgaagacagagttagtaaaaacacaagtgaattctttagccaccttattcgaacaaatgagttatgccagaagtattctgaagcttgtgtaaagctgtgccaggaattggatgtgaaggtggttgatctttttactgcatttcaacgaagagataactggacagctgattgcttcacagatggggttcatctatctgctgaggggagcaagattgtagtggccgagatactaaatgtactcaaagaagccgagtggcagccatctctgcactggaaggccatgccaactgaattctcagaggactcaccttatgatcttgttgctgctgatgggaaaaccacattgaatccgtccgaatggacatttcaccgggcgattcaatgggactagagcagtgcagagttctcttccaggttcatgatctccaacatctcatggaaatcaaacctgtctcacttgaaattgaaggatgaagtaccaaagatgaacaggatttgtagaaaaggactgagctttgaaccatttaatggttgcttcttgcagaatccatcatgagtttgattaaatttagttcagttgattcttgtaaagtttatatatttatatagtaagttcaattccgactgaataagcctagaggaacttgaatttgaagcgcacaggccaaaaatgcttgattcgatttcgcccaatgggaaacattgttactttccaattttctatgtatacatctaaatcttttgtgtggg

SEQ ID NO: 2831 - DNA, 2186 bp, Ambrosia trifida
aggatcacatctcaccggaaaacaatgtcattttacaccgtcaaagtggaggattcaagggctgaggctggcgatgtgccgtcggccgggccggtttataggtgcatttatgccaaggatggtcttatggagttgcctcctggttatgactctccctgggactttttcagcgagtctgctaaaagaaacccaaagcaccctgcactcggtcgtcgtcaaatcatcgatggaaaggctggtgattactcatggatatcatatcaagatgcctacaattctgcaatcaggattgcttccgccatccgaacccgatcagttaatcctggtgatcggtgcggcatatatggaccaaactgtccagagtggataatttccatggaggcttgtaacagcagtggcataacctatgttcctctatatgatacgcttggtgctaatgcagttgagttcatcatcaaccatgccgaaatctctttggtttttgttcaggataacaaaatacctgctattttatcatgtcttccaaattgttcttcaaatctaaaaactattgtcagctttgggaatatctctgaatcgcaaaagaaagaagctaccgaacatggtgttgagtgcttctcttgggaagaatttgtttcaatggggagtttggaagatgaactgccagcaaaacataaaactgacatatgcacaataatgtatacaagtggcacgaccggagaaccaaagggtgtcatactaagtaatgctgctttcatgtctgaagtgttgtccatgcatcaattacttgttgaaacagacaaaccgggcacagaagaagatacctatttctcttttcttccattagcacatatatttgatcagataatcgagacatattgcatctacagaggcgcctcaataggattttggcaagcagatatcagatatttgattgaggaccttcttgtattaaagccaactatattttgtggtgttccaagagtttatgaccgcatttatactggtataatggctaagattttagctggaggtactgtaaggaaggcattattcgattttgcatacaactataaattgaggaaccttgaaaagggaatacaacaagacaagtcagcccctcttttggacaagctagtctttgataagattaaacaaggatttggaggacgggttcgccttatgttatctggagctgcacctttgccaaaacacgtggaagaatttttgagagtaacatgttgtacagtcctctcacaaggatatggtcttacagaaagctgtggtggatgctttacatccatagcaaatgtgtactctatgataggaactgttggtgtgcctatgacaaccattgaggcaagactagagtcggttccagagatgggatatgatgcacttggcagcgtgccgcgtggtgaaatttgtctcagaggaaacacgctattttcggggtatcataaacgagaggatctaaccaaagatgtcctagtcaatggctggttccatacaggtgacatcggagaatggcaggcagatggggcaatgaaaataattgacaggaaaaagaatatattcaagttgtcacaaggagaatatgtcgcggttgaaaacattgaaagcacatattcacggtgccctctggtgaccgcgatttgggtgtatggcaatagttttgaatcttttctcgtggcggttgtggtccctgataaaacggcaattgaagaatgggcagcaaagaacaatgaatcaggagactatatttcattgtgcaagaattcaaatgttaggaaatatgtccttgatgaacttaacgctgaagctcagaataacaaacttcgtggatttgagatgctgaaagctgttcatctagagcccgttccattcgactttgagagggacttgataaccccaacatttaaactgaagaggcagcaactgctaaaatactataaggattgcattgatacactgtatgctgaagcaaagacatccaagaaatgaacatgaaacacacacgtttcataacagtgttccatgttcatgatttgtatgaagtctattcttagtttagtttggacctcgtgtgttaccatctagaggctaaatcctaaaccttaaaaatattttaaatgaattatggtttgtaccttgtaatatgaacttgtttattttgaaacgtaaaa

SEQ ID NO: 2832 - DNA, 2210 bp, Ambrosia trifida
accggaaaacaatgtcattttacaccgtcaaagtggaggattcaagggctgaggctggcgatgtgccgtcggccgggccggtttataggtgcatttatgccaaggatggtcttatggagttgcctcctggttatgactctccctgggactttttcagtgagtctgcaaaaagaaacccaaagaaccctgcactcggtcgtcgtcaaatcatcgatggaaaggctggtgattactcatggatatcatatcaagatgcctacaattctgcaatcaggattgcttccgccatccgaacccgatcagttaatcctggtgatcgatgcggcatatatggaccaaactgtccagagtggataatttccatggaggcttgtaacagcagtggcataacctatgttcctctatatgatacgcttggtgctaatgcagttgaattcatcatcaaccatgccgaaatctctttggtttttgttcaggataacaaaatacctgctattttatcatgtcttccaaattgttcttcaaatctaaaaactattgtcagctttgggaatatctctgaatcgcaaaagaaagaagctaccgaacatggtgttgagtgcttctcttgggaagaatttgtttcaatggggagtttggaagatgaactgccagcaaaacataaaactgacatatgcacaataatgtatacaagtggcacgaccggagaaccaaagggtgtcatactaagtaatgctgctttcatgtctgaagtattgtccatgcatcagttacttgttgaaacagacaaaccgggcacagaagaagatacctatttctcttttcttccactagcacatatatttgatcagataatcgagacatattgcatctatagaggcgcctcaataggattttggcaagcagatatcagatatttgattgaggaccttcttgtattgaagccaactatattttgtggtgttccaagagtttatgaccgcatttatactggtataatggctaagattttagctggaggtactgtaaggaaggcattattcgattttgcatacaactataaattgaggaaccttgaaaagggaatacaacaagacaaatcagcccctcttttggacaagctaatctttgataagattaaacaaggatttggaggacgggttcgccttatgttatctggagctgcacctttgccaaaacatgtggaagaatttttgagagtaacatgttgtacagtcctctcacaaggatatggtcttacagaaagctgtggcggatgttttacatccatagcaaatgtgtactctatgataggaactgttggtgtgcctatgacaaccattgaggcaagactagagtcagttccagagatgggatacgatgcacttggcagcgtgccgcgtggtgaaatttgtctaagaggatacacactattttcggggtaccacaaaagagaggatctaaccaaagatgtccttgtcaatggctggtttcatacaggggatattggggaatggcaggcggatggcgcaatgaaaataattgataggaaaaagaatatattcaagttgtcacaaggggaatatgtcgcggttgaaaacattgaaagcacatattcacggtgccctctggtgactgcgatttgggtgtatggcaatagttttgaatcttttctcgtggcggttgtggtccctgataaaacagcaattgaagaatgggcagcaaagaacaatgaatcaggagactatacttcattgtgcaagaattcaaatgttaggaaatatgtccttgatgaacttaacgctgaagcgcagaataacaaacttcgtggatttgagatgctgaaagctgttcatctagagcccgttccattcgacttcgagagggacttgataaccccaacatttaaactgaagaggcagcaactgctaaaatactataaggattgcattgatacactgtatgctgaagcaaagacatccaagaaatgaacatgaaacacacatgtttcataacagtgttccatgttcatgatttgtatgaagtcgattcttagtttggtttcgacctcgtgtgttatcctatcctctagaggctaaacactcaaccatataagtattttaaatgaattatggtttgtaccttgtaatcatgaacttaattatattttatgttgaaacgtaaaggtataattaatagtcaaaaaagaa

SEQ ID NO: 2833 - DNA, 2163 bp, Echinacea purpurea
cggccgggggactcatctcttgccggaaaaaatgtcagtttacaccttcaaagtggaggatgcaatggcggcggctggagaagtgccgtcggcagggccggtttataggagcaaatatgctaaggatggtctcatggagctgcctcctggttacgactcaccctgggactttttcagcgagtctgcaaaaagaaacccgaaaaaccctgcgcttggtcgtcgtcaaatcatcatcgatggaaaggctggtggttattcatggatatcatatcaagatgcctacaattctgcactcagaattgcttccaccatgcgaagccgatctgttaatcctggagatcggtgcggcatatacggagcaaactgtcctgaatggatcatttccatggaggcttgtaacagcaatggcataacctatgttcctctctatgacactcttggtgctaatgcagttgaattcatcatcaaccatgcagaaatctcattagtttttgttcaagataacaaaatacccgctatcttatcatgtcttccaaattgttcatcaaatataaaaactattgtcagctttgggaaaatatctgactcacagaggaaagaagccatggaacatggtgttgagtgcttctcttgggaagaatttgtttcaatgggaaatttggaagatgaactgcctgcaaaacataaaactgacatatgcacaataatgtatactagtggcacaaccggagaaccaaagggtgtcatactaagtaattctgctttcatgtctgaagtcttgtcaatgcatcaaatgctcgtagaaacagacaaaccgggcacagaagaagatacctacttctcttttcttccattagcacatatatttgatcagataatagaaacgtattgcatctacagaggtgcctcaataggattttggcaagcagatattagatatttgattgaggaccttcttgtactaaagccaaccatattttgtggtgttccaagagtttatgaccgcatttatactggtataatggctaagattttagctggtggcactgtaaggaaggcgttattcgattttgcatacaactataaactgaggaatcttgaaaagggaatacaacaagacaaatcagcccctcttttggacaagctagtcttcgataagattaaacaaggatttggaggacgggttcgccttatgttatctggagctgcacctttgccaaaacatgtggaagaattcttgagggtgacatgttgtactgtcctctcacaaggatacggtcttacagaaagctgtggtggatgccttacatccatagcaaatgtgtactctatggtaggaactgttggtgtacctatgacaaccattgaggcaagactagagtcagtgccagagatgggatatgatgcactcagcagcgtgccacgtggtgaaatttgtctcaggggaaacacactattttcggggtaccataaacgagaagatcttactaaggatgtccttgtcaatggctggttccatacaggtgatattggggaatggcaggcagatggtgcaatgaaaataattgacaggaaaaagaatatattcaagttgtcacaaggggaatatgtcgcggtggaaaacattgaaagcacatattcacggtgccctttggtgactgcgatttgggtgtatggcaatagttttgaatcttttctcgtggcggtcgtggtccctgatagaatggcaatcgaagaatgggcagcaaagaataataaatcaggagactatgaatcattgtgcaagaattcacatgttaggaaatatgttcttgatgagcttaattgtgaagcacaggataacaaacttcgtggatttgagatgctgaaagctgtttatctggagcctgttccattcgactttgagagggacttgatcaccccaacatttaaactgaagaggcagcagttgctaaaatactataaggattgcattgataaactgtatgctgaagcaaaggcattcaaaaaatgaacacttttggaacttatgtgttataatctagaagctaaaccctaaacactatatatatttaaaatgaattggattgtaatcatgttttattgaacttgtgtattatttaaaacgtataaatatacaattaatagtctcgtatattgctt

SEQ ID NO: 2834 - DNA, 2297 bp, Arnica chamissonis
cacatatctcgccggaaaaaatgtcagtttacaccgtcaaagtagaggattcacgagaggccgccggagaaacgccgtcagcaggcccggtttacaggtgcatatatgccaaggatgctcttatggagttacctcccggttacgactctccctgggactttttcagcgagtctgtaaaaagaaacccgaagaaccccgcgcttggtcgtcgacaaatcatcgatggaaaggctggtggctatacatggatatcatatcaagatgcctacagttctgcactcagaattgcttccgccatccgaacccgagctgttaatcctggagatcggtgcggcatatatggaccgaactgtcccgaatggatcatttctatggaggcttgtaacagaaatggcataacatatgttcccctatatgatacgcttggtgcgaatgcggttgaatacatcatcaaccatgcagaaatctcattagtttttgttcaacagaacaagatacctgctatactatcatgtgttccaaattgctcatcaaatctaaaaactatcgtcagctttgggaatatctccgaatcgcaaaggaaagaagcggtggaacaaggtgttgattgcttctcttgggaagaatttgcttcaatgggaagtttggaagacgaactgcctgcaaaatgtaaaactgacatatgcacgataatgtatacaagtggcacgactggtgaaccgaagggtgtcatactaagtaatgctgctttcatgtctgaagtcttgtccatgcatcaactacttgtagagacagataaaccgggcacagaagaagatatctacttctcttttcttccattagcacatatatttgatcagataattgagacatattgcatctacagaggctcctcaataggattttggcaagcagatatcagatatttgattgaggaccttcttgtattaaagccaaccatattttgtggtgttccaagagtttatgaccgcatttacaccggtacaatggctaagattttagctggcggtactgtaaggaaggcgttattcgatttcgcatacaactataaattgaggaaccttgaaaagggaatacaacaagacaaatctgcccctcttctggacaagctagttttcgataagattaaacaaggatttggaggacgggttcgtctcatgttatctggagctgcacctttgccaaaacatgtagaagaatttctgagagtgacatgttgtactgtcctctcacaaggatatggtcttacagaaagttgtggtggatgttttacatccatagcaaatgtgtactctatgataggaactgttggtgtacctatgacaaccattgaggcaaggctagagtcggtgccagagatgggatatgacgcactcagcagcgtgccacgtggtgaaatttgtctgaggggaaacacattgttttcggggtaccataaacgagaggatcttactaatgatgtcctagtcaatggctggttccatacaggtgatatcggggaatggcaggcggatggtgcaatgaaaataattgataggaagaagaatatattcaagctgtcacaaggggaatatgtcgcggttgagaacattgaaagcacattttcacggtgccctttggtgaccgcgatttgggtgtatggcaatagttttgaatattttcttgtcgcggttgtggtcccggatagaatggcaattgaagaatgggcagcaaagaataatgaatcaggagactatgaatcattgtgcaggaactcaaatgttaggaaatatgttcttgatgagctcaattctgaagctcagaacaataaacttcgtggatttgagatgctgaaagctgttcatctggagcctgttccatttgactttgagagggatttgattaccccaacatttaaactcaagaggcagcagctgctaaaatactataaggatcgcgttgatcgactgtacgctgaagcaaagacatccaagaaatgaacatgaaaccgtttcacagatgtgttcatgttcgcgatttatatgaagtaaattattagtttagtttggaactcgcgtgtcgtgctctacggattgatatgtatactttaaacgaatttgcattatgctttgtaatcatgtgttattgaagtcccgtctcgcctatactggcaatgatcaacgagatggtatcgagtaaaggtgtcaaaatgcattggttaggtgggttgggtgacggatcaagacgagtttggtcgggccgggtcggaccgacctacaaatactttttgcatccat

SEQ ID NO: 2835 - DNA, 2190 bp, Cichorium intybus
tctccctgccagaaaacatgtcggtttacaccatcaaagtcgacgagtcaaggccggccaccggagaaacgccgtctgcagggccggcgtacaggtgcatttacgccaaggatgctctcatggagttgcctcccggttacgagtcaccctgggacttcttcagcgagtctgttaaaagaaacccaaagaaccctgcgcttggtcgtcgtcaaatcatcgatggaaaggctggtggttattcatggcaatcatatcaagatgcctacaattctgctatccgtattgcttccgccatccgaggccgttctgttaatcctggagatcggtgcggcatatatggaactaacagtccagaatggataatttcaatggaggcttgtaacagcaatggcataacctatgtgcccctatatgacacacttggtgctaatgcagttgagtacatcatcaaccatgcggaaatttccttggtttttgttcaagagaccaagttgcctgctatattatcatgtgttccaaattgctcatcatatctaaaaacaattgtgagctttgggaatgtctctgaatcacaaaagaaggaatccatggaacaaggtgttgattgcttctcttgggaagaatttacttcaatgggaaggttagatgatgaactgcctgcaaaacataaaactgacatttgcacaataatgtatacaagtggaacaactggagaaccaaaaggtgtcatactgagtaatgctgctttcatggctgaggtcctatctgtgcatcaactactcgtggaaacagacaaaccggccacagaagaagatacctacttctcttttcttcctttagcacatatattcgatcagataatggagacatattgcatctactgtggttcctcaatagggttttggcaaggagatatcagatatttgattgaggacctccttgtgttaaaaccaaccatcttttgtggtgttccacgagtttatgaccgcatttataccggtataatggccaagatttcaactggaggtgctgtaaagaaggcattatttgattttgcatattattataaattaaggaatcttgaaaagggtatacaacaagacaaatccgcccctcttttggacaagttggtcttcgacaagatcaaacaagggtttggaggacgagttcggcttatgttatctggagccgcacctttaccaaaacacgttgaggaatttttaagagtgacatgttgtactgttctctcacaaggatatggtcttactgaaagctgtggtggatgtttcacatccatagcaaatgtgcactccatgattggaactgttggtgtccccatgacaacaattgaagcaaggctagaatcagtgccagaaatgggatatgacgcacttgcccctgtgccacgtggcgaaatttgtttgaggggaaacacgttattttctgggtaccataagcgagaggatcttaccgattccgtccttgtggatggctggttccatactggtgacattggggaatggcaggctgatggggcaatgaaaattattgataggaaaaagaatatatttaagttgtcacaaggggaatatgttgcagttgaaaacattgaaagcacatattcacggtgccccttggtgacctcaatttgggtgtacggaaatagttttgaatcttttctagttgctgttgtggtgccggatagaatcgtgattgaagaatgggcagaaaggaataatgaatcaggggattttatgtcattatgcaaaaactcaaatgttaggaaatatgtcctagatgagcttaattctgaagctcagaaaaataaacttcgtggttttgagatgctgaaagcggttcatttggagccaattccgtttgactttgaacgggatttgataactcccacgtttaaactgaagaggcaacaactgctaaaatattataaggattgcattgatcaactatatagtgaagccaagacatccaagaaatgaaagtggaacacgtagatcaatggcatccctggttttaaagaaaattcgtgttttgtgtaaagtaaattcatagtttattgttgaacatgtgtgtcacgtagaaatctctattgccattctaaacagaatcgtgtactatggtttgtaatattgtattataacatattataaatgctatttacactttgttact

SEQ ID NO: 2836 - DNA, 2610 bp, Centaurea maculosa
gtcggtttacactgtgaaagtcgaggattcgagggcggccgccggagaaacaccgtcggcagggccggtttaccggtgcatttacgccaaggatggtctcatggagttgcctcctggttacgaatctccttgggactttttcagcgagtctgttaagagaaatccaaagaaccctgcacttggtcgtcgtcaaatcatcgatggaaaggctgctggttattcatggatctcataccaagatgcatacaattctgccttacgaattgcctccgccatcacatcgcgagccgttaatcctggagatcgatgtggcatatatggaactaactgtcccgaatggataatttcaatggaggcttgtaacagcaatggcattacctatgtgcccctatatgatacacttggtgccaatgcagtcgagttcatcatcaaccatgccgaaatttctttagtttttgttcaagaaagcaagttacctgctatattatcatgtgttccaaattgttcatcgaatctaaaaactattgttagttttgggaagttgtctgaatcacaaaagaaggaagccatggcacaaggtgttgattgcttctcttgggaagaattttcttcgatgggaagtttggatgatgaactgcctgcaaagcgtaagacggacatttgcaccataatgtatacaagtggaacgaccggagaaccaaagggtgttatactaagtaacggtgctttcatgtctgaagtcttgtccatgcatcaactactcgtggaaacagacaaaccgggcacggaagatgattcttacttctcttttcttcccttggcgcatatattcgatcaaataatcgaaacatattgcatctacagaggttcctcgataggatttttggcaaggagatatcagatatctgatcgaggaccttcttgtgttgaaaccaaccatattttgtggtgttccacgagtttatgatcgcatttataccggtataatggccaagatttcaagcggaggtgctgtaagaaaggcgttgttcgattacgcatattattataagttaaggaatcttgaaaagggaatgcagcaagacaaatcagctcctcttttggacaaactggttttcgataagattaaacaagggtttggaggaagggtccgtcttatgttatctggagcggcacctttgccaaagcacgtagaggagtttttgcgagttacatgttgtaccgtcctctcgcaaggatatggtttaacggaaagttgtggtggatgtttcacgtccatagcgaatgtgtactctatgatcggaactgttggtgtccctatgacgaccatcgaggcaaggctggagtcagtgcccgagatgggatatgatgcactcggcagcgtgccacgtggcgagatttgtctaagggggaacacgttattttcggggtatcataagcgagaggatctttcaaatgctgtacttgtggatggatggttccatacaggtgacattggggaatggcagcctgatggagctatgaaaattattgacaggaaaaagaatatattcaagttgtcgcaaggggaatatgtcgcagtcgaaagcatcgaaagcacctattcacggtgtccgttggttacctcgatctgggtgtatggtaacagtttcgaatcttttcttgttgcggttgtggtgcccgataaaatggcgatcgaagaatgggcagccaagaacaatgaatcaggagactacgaatcgttgtgcaaaaactcaaatgctaggaaatatgttctagatgagcttaattcggaagctcaaaaaacaaacttcgcggtttcgagatgcttaaagcggttcatctggagccggttccatttgatttcgaaagggatttgataactccaacctttaaactcaaaaggcagcagctgctaaaatactataaggattgtgttgatcaactgtatgatgaagcaaaaacagccaagaaatgaagatgggattttgtatttgtgtaaagtaaattcatagtttagtatcggatcggatgttttcacgttccacaaatcgcggtatttatttaaggagtgcaatatatggtttgtaatatcggattattaggggtgggtgaaatcaatcaatcaagcaatcgattccatccagcagccgattaacaaacagagaggaggtagaaagaagaagaaggaggagatggcttcgaccgccgccgtgccgttctggagatccgccgggatgacgtacataacatactccaacatctgtgcgaacctggtgaggaactgtctgaaagagccccacaagaccgaagccatcagccgggagaaggtccatttctccgtctccaagtgggttgacggaaagcctcagaaacctaccatccgctccgactccccggaagagtgatgcaggatgttctctacatgctttatttttcatctttaccaagctgattacgaatttaatctctgattggttttaaaacaccagaccttggaacaatgcaatttgcatagttgttgccttcaataaaatatgtaccgttttgttggacgtggaagttttgtatctttttctgataatgcttttgcttatttctataatattt

SEQ ID NO: 2837 - DNA, 2299 bp, Chrysanthemum coronarium
ctgagccaccaccttccttctttaattcttccatacactctttatcaacctactcacttattcagtgcacatttaattccccctatctatctttctctctctaactttctgaaaaataacatgtctctttacaccgtcaaagtcgaggattcacgggttgccaccggagaaacgccgtctgcagggccggtttataggtgcatttatgctaaggatggcctcatggagttgcctcctggttatgaatctccttgggactttttcagtgagtctgttaaaagaaacccaaagaatcctgccttaggtcgtcgtgaaatcatcgatggaaaggctggtggttatacatggtcatcatatcaagaagcctataactctgctctccgcattgcttctgctatccgaattcgatctgtgaatcctggagacaaggttggaatttatggaaccaactgtcccgaatggatcatttcgatggaggcttgtaacagcaatgcgataacctatgttcccctgtatgatacacttggtgctaatgcggttgagtacatcatcaaccatgccgaaatttcactagtttttgctcaagagaacaagttgcctgcaattttatcatgtcttccaaattgttcatcaaatctaaaaactatcgtcagctttggtaacatctctgaatcacaaaggaaggaagctaccgagaaaggtgttgattgcttctcgtgggaagaattttcttcaactggaaatttggaagacgaactgcctgcaaaaagcaaaaccgacatttgcacaattatgtataccagcggaacaacaggagaaccaaagggtgtcatactaactaatggggcttttatgtctgaagtattgtctatgcatcaactactcgtggaaacagaccaaccgggctcagaagaagatacatacttctcatttcttccgttagcacatatatttgatcagataattgagacatattgcatttatagtggtgcctcgatagggttttggcaaggagatatcagatacttgattgaggaccttattgtgtgcaaaccaaccatattttgtggcgttccaagagtttatgaccgcctttatacaggtataatggctaaggtttcagccggaggtgccgtaaggaaggcgttatttgattttgcatacaactataaactgaggaacctcgaaaaaggaatacaacaagacaaatcagcccctcttttggacagactggtcttcgataagatcaaacaagcgttcggagggagggttcgtcttatgttatctggagccgctcctttaccaaaacatgttgaggaatttttaagagtggcatgttgcactgtcctctcacaaggatatggtcttactgaaagtagtggtggttgctttacatctatagctaatgtgtactctatgatcgggactgttggtgtacccatgacgaccattgaggctaggcttgagtcggtgccagagatgggatatgatgcactcggcagtgtgccacgtggggaaatttgtctaagaggaaacacattgttttctgggtatcacaagcgagaggatctaacaaattccgtacttgtggatggttggttccatacaggtgacattggggaatggcaggctgatggagcaatgaaaatcattgacaggaaaaagaatatatttaagttgtcccaaggggaatatgttgcagttgagagtattgagagtacgtattcacggtgccctttggtgactgcggtttgggtgtatggaaacagctttgaatctttccttgttgctgttgtggtgcccgaaagaattgcacttgaagaatgggcagcaaaaaataacgaatcaggagattatgaatcgctgtgcaagaacccaaatgctaggaaatatgttctagatgagcttaactcagaagctaaaaataacaaacttcgcggttttgagatgctgaaagcagttcatttggagccggttccttttgactttgaaagggatttaataacccctacgtttaaattaaagaggcagcagctactaaaatactataaggagtgcattgatcagctatatgctgaagcaaagacaacggccaagaaatgagcttaagacacgtgctcgtttacaaatgtattttcttgtttgtctaaggaaaacttgtagagattagtttggaagccatgtatcaagttctacggatagctatatacatttagaaagaatgcacctatggtttgtactattgtatgattgaactcgcgtgtattatgaatgattaaagtcactatgtatgcttcgt

SEQ ID NO: 2838 - DNA, 2765 bp, Chrysanthemum coronarium
tccttctttaattcttccatacactctttatcaacctactcacttattcagtgcacatttaattccccctatctatctatctatctcagatctctcttgctggaaaataacatgtctctttacaccgtcaaagtcgaggattcacgggttgccaccggagaaacaccgtctgcagggccggtttataggtgcatttatgctaaggatggcctcatggagttgcctcctggttatgaatctccttgggactttttcagtgagtctgttaaaagaaacccaaagaatcctgcccttggtcgtcgtgaaatcatcgatggaaaggctggtggttatacatggttatcatatcaagatgcctataactctgctctccgcattgcttctgctatcagaagtcgatctgtgaatcctggagacaaggttggtatttatggacctaactgccccgaatggatcatttcgatggaggcttgtaacagcaatgggataacctatgttcctctgtatgatacacttggtgctaatgcggttgagtacatcatcaaccatgccgaaatttctctagtttttgctcaagagaacaagttgcctgcaattttatcatgtcttccaaattgttcatcaaatctaaaaactatcgtcagctttggtaacatccctgaatcacaaaggaaggaagctaccgagaaaggtgttgattgcttctcgtgggaagaattttcttcaacgggaaatttggaagacgaactgcctgcaaaaaataaaaccgacatttgcacaattatgtatacaagcggaacaacaggagaaccaaagggtgtcatactaactaatgggactttcatgtccgaagtattgtctatgcatcaactactcgtggaaacagacaaaccgggctcggaagatgatacctacttctcatttcttccgttagcacatatatttgatcagataattgagacatattgcatttatagtggtgcctcgatagggttttggcaaggagatatcagatacttgattgaggaccttattgtgtgcaaaccaaccatattttgtggcgttccaagagtttatgaccgcctttatacaggtataatggctaaggtttcagctggaggtgctgtaaggaaggcgttatttgattttgcatacaactataaactgaggaacctcgaaaaaggaatacaacaagacaaatcagcccctcttttggacagactggtcttcgataagatcaaacaagcgttcggaggaagggttcgtcttatgttatctggagccgcacctttgccaaaacacgttgaggaatttttaagagtggcatgttgcactgtcctctcacaaggatatggtcttactgaaagcagtggtggttgctttacatccatagctaatgtgtaccctatgatcggaactgttggtgtacccatgacgaccattgaggcaaggctcgagtcggtgccagatatgggatatgatgcactcggcagtgtgccacgcggggaaatttgtctgagaggaaacacattgttttctgggtactacaagcgagaagatctaacaaatgccgtacttgtggatggttggttccatacaggtgacattggggaatggcaggctgatggagcaatgaaaatcattgacaggaaaaagaatatatttaagttgtcccaaggggaatatgttgctgttgaaagtattgaaaacacgtattcaaaatgccctttggtgactgcggtttgggtgtatggaaacagttttgaatctttccttgttgctgttgtggtgcccgaaagaatggcacttgaagaatgggcagcaaaaaataacgaatcaggagattatgaatcattgtgcaagaacccaaatgctaggaaatatgttctagatgagcttaactctgaagctaaaatgaataaacttcgcggttttgagatgctgaaagcagttcatttggagccggttccttttgactttgaaagggatttaataacacctacgtttaaattaaagaggcagcagctactaaaatactataaggagtgcattgatcaattgtatgctgaagcaaagacaaccaagaaatgagcttaatgtaggggaaatctggtaataacgaacaccaatggatatgcttaatctctgaaaggcgtgtaatcactttcagatcaaatcaatttggcggttctaccaaattattcaatcggatacaattcagagttgagaattttctgtatgtgtgtgtctgagatattattgaaccgtatttattatctgaccaaataaactcgccctcacatgagacaagctcgcgttactgagctcagcgatagtttaggttccgagtggtctatataaacaagtaataagtttactttccaggcgatgtgggatgtaagcaaaagcttttggtatatattagttggatcccatgaaacttgaatgtgtttgtgcctaattgataacatgatggtacctgactttgtgttccataatctcttgagcgagaaccaaaacagcctgattgtcagtgtgctagatgttgctggccacgaccttcaaattagaactgattagcttcgtaatgcatagtgggacgcatctcatttctttaactcaagcaagaagtctaaagacgtctttatctgaacagacttggacacctacctaacgaggaacctacaagactaaggttctcaaagttggtttcatctcagactcgtcgttattacttattgtcatgttgtgatttaaacatcgat

SEQ ID NO: 2839 - DNA, 2117 bp, Flaveria ramosissima
gccggaggaatgccgtcggccggaccggtttaccggtgcatatatgccaaagatggtcttatggagttgcctcctggttatgactctccatgggactttttcagcgaatctgcgaaaagaacccaagaacccagcccttggtcgtcgtcaaatcatcgatggaaaggctggtggatattcatggatatcatatcaagatgcctacaattctgcactcaaaattgcttccgccatcagaagccgatccgttaatcctggagatcggtgtggcatttatggaccgaactgtcccgaatggatcatttctatgaaggcttgtaacagcagtggcataacctatgttcctctatatgatacacttggtgctaatgcagttgaatacatcatcaaccatgctgaaatctcattggtttttgttcaagataacaaaatacctgctattttatcatgtgtaccaaattgctcgtcgaatttaaaaactatcatcagctttgggaatgtctctgaatcgcaaaggaaagaagccatggaacatggtgttgattgcttctcttgggaagaatttgtttcaatgggtaatttggaagatgaactgcctgcaaaacataaaacagacatatgcacgataatgtatacaagtggcacaaccggagaaccgaagggtgtcatactaagtaatgctgctttcatgtctgaagtcttgtccatgcatcagctacttgtagagactgacaaaccgggcacagaagaagatacttacttctcctttcttccattagcacatatatttgatcagataatagagacatattgcatctacagtggtgcctcaatagggttttggcaagcagatattagatatttgattgatgatcttcttgtattaaagccaaccatattttgtggtgtcccaagagtttatgaccgcatttacacaggtataatggctaagattttagctggaggtaccgtaaggaaggcgttattcgatttcgcatacaactataaattgagaaaccttgaaaagggaatacaacaagacaagtcggcccctcttctggacaggctagtcttcgataagattaaacaaggttttggaggacgggttcgtcttatgttatctggagccgcacctttgccaaagcacgtggaggaatttttgagagtgacatgttgtactgtcctctcacaaggatatggtcttacagaaagctgtggtggatgttttacatccatagcaaatgtgtactctatggtaggaactgttggtgtgcctatgacaaccattgaggcaagactagagtcggttccagagatgggatatgatgcactcagcagcgtgccacgtggtgaaatttgtctaagggggaccacactattttcggggtatcataaacgagaggatcttactaatgatgtcctagtcgatggctggttccatacaggtgatatcggcgaatggcaggcggatggtgcaatgaaaataattgacaggaaaaagaatatattcaagctgtcacaaggagaatatgtagccgttgaaaacattgaaagcacatattcacgctgccctttggtgaccgcgatttgggtgtatggcaatagttttgaatcttttctggtggcggttgtggtccctgatagaatggcaatcgaagactgggcagcaaagaataacgaatcaggagactatgaatcattgtgcaagaactcaaatgttaggaaatatgttcttgatgagctcaattctgaagctaagaataataaacttcgtgggtttgagatgcttaaagctgttcatctggagcctactccattcgattttgagagggatttgattaccccaacatttaaactcaagaggcagcagctgctaaaatactataaggattgcattgataaactgtatgctgaagcaaaggcatccaagaaatgaacatgaatggtggtatatatgaagcaagctattagtttaagtataatatggaacttgtgtgtcatactctaccgattgctatgtatattttagaggaatttgcattatggcttgtaatcatgtgttgttgtaacttgtgttttatttaaaacatataagttataagttcaattgctatgtt

SEQ ID NO: 2840 - DNA, 2058 bp, Chrysanthemum coronarium
tctcttgctggaaaataacatgtctctttacaccgtcaaagtcgaggattcacgggttgccaccggagaaacgccgtctgcagggccggtttataggtgcatttatgctaaggatggcctcatggagttgcctcctggttatgaatctccttgggactttttcagtgagtctgttaaaagaaacccaaagaatcctgccttaggtcgtcgtgaaatcatcgatggaaaggctggtggttatacatggtcatcatatcaagaagcctataactctgctctccgcattgcttctgctatccgaattcgatctgtgaatcctggagacaaggttggaatttatggaaccaactgtcccgaatggatcatttcgatggaggcttgtaacagcaatgcgataacctatgttcccctgtatgatacacttggtgctaatgcggttgagtacatcatcaaccatgccgaaatttcactagtttttgctcaagagaacaagttgcctgcaattttatcatgtcttccaaattgttcatcaaatctaaaaactatcgtcagctttggtaacatctctgaatcacaaaggaaggaagctaccgagaaaggtgttgattgcttctcgtgggaagaattttcttcaacgggaaatttggaagacgaactgcctgcaaaaaataaaaccgacatttgcacaattatgtataccagcggaacaacaggagaaccaaagggtgtcatactaactaatggggcttttatgtctgaagtattgtctatgcatcaactactcgtggaaacagaccaaccgggctcagaagaagatacatacttctcatttcttccgttagcacatatatttgatcagataattgagacatattgcatttatagtggtgcctcgatagggttttggcaaggagatatcagatacttgattgaggaccttattgtgtgcaaaccaaccatattttgtggcgttccaagagtttatgaccgcctttatacaggtataatggctaaggtttcagccggaggtgccgtaaggaaggcgttatttgattttgcatacaactataaactgaggaacctcgaaaaaggaatacaacaagacaaatcagcccctcttttggacagactggtcttcgataagatcaaacaagcgttcggagggagggttcgtcttatgttatctggagccgcaccattaccaaaacatgttgaggaatttttaagagtggcatgttgcactgtcctctcacaaggatatggtcttactgaaagtagtggtggttgctttacatctatagctaatgtgtactctatgaccgggactgttggtgtacccatgacgaccattgaggctaggctcgagtcggtgccagagatgggatatgatgcactcggcagtgtgccacgtggggaaatttgtctaagaggaaacacattgttttctgggtatcacaagcgagaggatctaacaaattccgtacttgtggatggttggttccatacaggtgacattggggaatggcaggctgacggagcaatgaaaatcattgacaggaaaaagaatatatttaagttgtcccaaggggaatatgttgcagttgaaagtattgaaaacacgtattcacggtgccctttggtgactgcggtttgggtgtatggaaacagctttgaatctttccttgttgctgttgtggtgcccgaaagaatggcacttgaagaatgggcagcaaaaaataacgaatcaggagattatgaatcattgtgcaagaacccaaatgctaggaaatatgttctagatgagcttaactctgaagctaaaaagaataaacttcgcggttttgagatgctgaaagcagttcatttggagccggttcctttcgactttgaaagggatttaataacacctacgtttaaattaaagaggcagcagctactaaaataggagtataaggagtgcattgatcaattgtatgctgaagcaaagacaaccaagaaatgagctcaaaacacgtactcgtttacaaatgtgtttcttgtttgtgcaaaacttgtaaa

SEQ ID NO: 2841 - DNA, 1903 bp, Flaveria ramosissima
ccttggtcgtcgccaaatcatcgatggaaaggctggtggatattcatggatgtcatatcaagatgcctacaattctgcactcaaaattgcttccgccatcagaagccgatctgttaatcctggagatcggtgcgggatttatggaccgaactgtcccgaatggatcatttctatggaggcttgtaacagcagtggcataacctatgtgcctctatatgatacacttggtgctaatgcagttgaatacatcatcaaccatgccgaaatctccttagtttttgttcaagataacaaaatacctgctattttatcgtgtgttccaaattgctcatcaaatctaaaaacgattgtcagctttggaaatgtctctgaatcacaaaggaaagaagccatggaacatggtgttgattgcttctcttgggaagaatttgcttcaatgggaaatatagaagatgaactgcctgcaaaacgtaaaacagacatctgcacgataatgtatacaagtggcacaaccggagaaccaaagggtgtcatactaagtaatgctgctttcatgtctgaagtcttgtccatgcatcaactacttgtagagacagacaaacctggcacggaagaagatacttacttctcttttcttccattagcacatatatttgatcagataatagagacatactgcatctacagtggtgcctcaattggattttggcaagcagatattagatatttgattgatgatcttcttgtattaaagccaaccatattttgtggagtcccaagagtttatgaccgtatttacacaggtataatggctaaaattttagctggaggaactgtaaggaaggcgttatttgattttgcatacaactataaattgagaaaccttgaaaagggaatacaacaagacaagtcggcccctcttttggacaggctagtcttcgataagattaaacaaggttttggaggacgtgttcgtcttatgttatctggagctgcacctttgccaaaacatgttgaagaatttttgagagtgacatgttgtactgtcctctcacaaggatatggtcttacagaaagttgtggtggatgttttacatccatagcaaatgtgtactctatggtaggaactgttggtgtacctatgacaaccattgaggcacgactagagtcggttccagagatgggatatgatgcactcagcagcgtgccacgtggtgaaatttgtctaagggggaccacactattttcggggtatcataaacgagaggatcttaccaatgatgtcctagtcgatggctggttccatacaggtgatatcggggaatggcaagcggatggtgcaatgaaaataattgacaggaaaaagaatatattcaagttgtcacaaggggaatatgtcgcggttgaaaacattgaaagcacatattcacggtgcccattggtgaccgcgatttgggtgtatggcaatagttttgaatcttttctcgtggcggttgtggtccctgatagaatggcaattgaagaatgggcagcaaagaataacgaatcaggagactatgaatcattgtgcaagaactcaaatgttaggaaatatgttcttgatgagctcaattctgaagctaagaataataaacttcgtgggtttgagatgctgaaagctgttcatctggagcccgttccattcgactttgagagggatttgataaccccaacatttaaactcaagaggcagcagctgctaaaatactataaggattgcattgataaactgtatgctgaagcaaaggcatccaagaaatgaacatgaatggcggtatatatgaagcaagctattagtttaagattattttggaacttgtgtgtcatgctctacagattgctatgtatattttagaagaatttg

SEQ ID NO: 2842 - DNA, 1934 bp, Flaveria ramosissima
gcccttggtcgtcgtcaaatcatcgatggaaaggctggtggatattcatggatgtcatatcaagatgcctacaattctgcactcaaaatttcttctgccatcagaagccgatctgttaatcctggagatcggtgcgggatttatggaccgaactgtcccgaatggatcatttctatggaggcttgtaacagcagtggcataacctatgtacctctatatgatacacttggtgctaatgcagttgaatacatcatcaaccatgctgaaatctccttagtttttgttcaagataacaaaatacctgctattttatcgtgtgttccaaattgctcatcaaatctaaaaacgattatcagctttggaaatgtctcagaatcacaaaggaaagaagccatggaacacggtgttgattgcttctcttgggaagaatttgcttcaatgggaaatatagaagatgaactgcctgcaaaacataaaacagacatctgcacgataatgtatacaagtggcacaaccggagaaccaaagggtgtcatactaagtaatgctgctttcatgtctgaagtcttgtccatgcatcaactacttgtagagacagacaaacctggcacagaagaagatacttacttctcttttcttccattagcacatatatttgatcagataatagagacatactgcatatacagtggtgcctcaattggattttggcaagcagatattagatatttgattgatgatcttcttgtattaaagccaaccatattttgtggagtcccaagagtttatgaccgtatttacacaggtataatggctaaaattttagctggaggaaccgtaaggaaggcgttatttgattttgcatacaactataaattgagaaaccttgaaaagggaatacaacaagacaagtcagcccctcttttggacaggctagtcttcgataagattaaacaaggttttggaggacgtgttcgtcttatgttatctggagctgcacctttgccaaaacatgttgaagaatttttgagagtgacatgttgtactgtcctctcacaaggatatggtcttacagaaagttgtggtggatgttttacatccatagcaaatgtgtactctatggtaggaactgttggtgtacctatgacaaccattgaggcaagactagagtcggttccagaaatgggatatgatgcactcagcagcgtgccacgtggtgaaatttgtctgagggggaccacactattttcggggtatcataaacgagaggatcttactaatgaggtcctagttgatggctggttccatacaggtgatatcggggaatggcaggcagatggtgcaatgaaaataattgacaggaaaaagaatatattcaagttgtcacaaggggaatacgtcgcggttgaaaacattgaaagcacatattcacgttgtcctttggtgaccgggatttgggtgtatggcaatagttttgaatcttttctcgtggcggttgtggtccccgatagaatggcaatcgaagaatgggcagcgaagaataacgaatcaggagactatgaatcattgtgcaagaactcaaatgttaggaaatatgttcttgatgagctcaattctgaagctaagaacaacaaacttcgtgggtttgagatgctgaaagctgttcatctggagcccgctccattcgacttcgagagggatttgataaccccaacatttaaactcaagaggcagcagctgctaaaatactataaggattgcattgataaactgtatgctgaagcaaaggcatccaagaaatgaacatgattcacggtttatatgaagcaagttattagtttaagtttaatttggaacttgtgtgtcatactctactgattgctatgtatattttagaggtaatttacattatggcttgtaatcatgtgttattg

SEQ ID NO: 2843 - DNA, 2110 bp, Lactuca sativa
aatagtcgttgctttgatttttaatatcgaaagcaatcggaaggttttagatgatcatattaaaagcttttggttattggttacagcgagtcagttaagagaaacccaaagaaccctgcgcttggtcgtcgtcaaatcatcgatggaaaggccggtggttattcatggctatcatatcaagatgcctacaattctgctatcaaaattgcatccgccatccgaacacgatctgttaatccaggagatcgatgcggcatatatggaactaacagtcccgaatggataatttcgatggaggcttgtaactgcaatggcataacctatgtgcccctatatgacacacttggtgctaatgcagttgagtacatcatcaaccatgcagaaatttccctagtttttgttcaagagagcaagttggctgctgtattatcatgtgttccaaattgctcatcaaatctaaaaactattgtgagctttgggaatgtttctggatcacaaaagaaggaagccatggaacaaggtgttgattgcttctcatgggaagaatttacttcaatgggaaacttggatgatgaactccctgcaaaacataaaaatgacatttgcacaataatgtatacaagtgggacaactggagaaccaaaaggagtcatactaaataactctactttcatgtctgaagtcctatctgtacatcaactacttgtagaaacagacaaacctgccacagaagaagatacctacttctcttttcttccattagcacatatatttgatcagataatggagacatattgcatctacagtggttcctcaatagggttttggcaaggagatatcagatatttgattgaggaccttcttgtgttacaaccaaccatattttgtggtgtcccacgtgtttatgaccgcatttacactggtataatggccaagatttcaaccggtggtgctgtaaaaaaggcattattcgactttgcatacaattataaattgaggaatcttgaaaagggtatccaacaagacaaatccgcccctcttctggacaagctggtcttcgataagatcaaacaagggtttggaggacgtgttcgtcttatgttatctggagctgcacctttaccacaacacgttgaggaatttttaagagtcacatgttgcactgtcctctcacaaggatacggtcttaccgaaagttgcggtggatgttttacatccatagcaaatgtgcattccatgatcggaaccgttggtgtcccaatgacaacaattgaagcaagactagaatcagtgcccgaaatgggatatgacgctcttgcccctgtgccacgtggcgaaatttgcttgaggggaaacactttgttttcagggtaccataagcgagaggatcttacaaactctgtccttgtggacggctggttccatactggtgatattggggaatggcaacctgatggagcaatgaaaattatcgacaggaaaaaaaatatatttaagttgtcacaaggggaatatgttgcagttgaaaacattgaaagcacgtattcacgttgccccttggtaacctcgatttgggtgtacggaaatagttttgaatcttttctagttggtgttgtggtgccggatagattggcgattgaagaatgggcagaaaagaatggcgaatcaggggattttgtgtcgctgtgtaacaactcgaatgttagaaaatatgtccttgatgagcttaattctgaagctcagaaaaataaacttcgtggttttgagatgctgaaagcggttcatttggagccagttccgtttgactttgaaagggaattgataactcccacttttaaactgaagaggcagcagctcctaaaatattacaaggattgcattgatcaactatatagtgaagcgaagacatctaagaaatgaaactgaaacacgtgggtggatccatggcattcaaagcaacgttcaggtcgtgttttgtgtattgtaaattcatacgttatttttgaacatgtttgtcacgtagaaatctctatatatatggtttgtaatattgtattattaaagattataaaggctatttacattttgtcatatgagatccaccattttt

SEQ ID NO: 2844 - DNA, 2112 bp, Artemisia annua
cagtgagtctgttaaaagaaacccaaagaatcctgcccttggtcgtcgtgaaatcatcgatggaaaggctggtggttatacatggttatcatatcaagatgcctataactctgctctccgcattgcttctgctatccgaagtcgatctgtgaatcctggagacaaggttggtatttatggacctaactgtcccgaatggatcatttcgatggaggcttgtaacagcaatgggataacctatgttcccttgtatgatacacttggtgctaatgcggttgagtacatcatcaaccatgccgaaatttcgctagtttttgctcaagagaacaagttgcctgcaattttatcgtgtcttccaaattgttcatcaaatctaaaaactatcgtcagctttggtaacatccccgaatctctaaggaaggaagctactgagaaaggtgttgattgcttctcatgggaagaattttcctcaacgggaaatttggaagacgaactgcctgcaaaaaacaaaaccgacatttgcacaataatgtatacaagcggaacaacaggagaaccaaagggtgtcatactaactaatggggctttcatgtctgaagtattgtctatgcatcaactactcgtggaaacagacaaaccgggctcggaagatgatacctacttctcatttcttccgttagcacatatatttgatcagataattgagacatattgcatttacagtggtgcctcgatagggttttggcaaggagatatcagatacttgattgaggaccttattgtgtgcaaaccaaccatattttgtggcgttccaagagtttatgaccgcctttatacaggtataatggctaaggtttcagctggaggtgctgtaaggaaggcgttatttgattttgcatacaactataaactgaggaacctcgaaaaaggaatacaacaagacaaatcagcccctcttttggacagactggtctttgataagatcaaacaagcattcggaggaagggttcgtcttatgttatctggagctgcacctttaccaaaacacgttgaggaatttttaagagtggcatgttgcactgtcctctcacaaggatatggtcttactgaaagtagtggtggttgctttacatccatagctaacgtgtaccctatgatcggaactgttggtgtacccatgacaaccattgaggcaaggctcgagtcggtgccagagatgggatatgatgcactcggcagtgtgccacgcggggaaatttgtctgagaggaaacacattgttttctgggtactacaagcgagaggatctaacaaattccgtacttgtggatggttggttccatacaggtgacattggggaatggcaggctgatggagcaatgaaaatcattgacaggaaaaagaatatatttaagttgtcccaaggggaatatgttgctgttgaaagtattgaaaacacgtattcaaaatgccctttggtgactgcggtttgggtgtatggaaacagttttgaatctttccttgttgctgttgtggtgcccgaaagaatggcgcttgaagaatgggcagcaaaaaataacgaatcaggagagtatgaatcattgtgcaagaacccaaatgctaggaaatatgttctagatgagctaaactctgaagctaaaattaacaaacttcgcggttttgagatgctgaaagcagttcatttggagccggttccttttgactttgaaagggatttaataacccctacgtttaaattaaagaggcagcagctactaaaatactataaggagtgcattgatcagttgtatgctgaagcaaagacaaccaagaaatgagcttaaaacacgtactcgtttaaaaatgtgtttcttgtttgtgcaaagtaaacttgtaaagattagtttggaagtcatgcatcacgttcctatatgcatctagaaagaatgcactatggtttgtattcttgtatgattgaactcatgtattatgaatggttaaagtcactatgatgcttcggtgtccgttaaggccaattcattagtctagctctggcgtatcaagcgagagcgagattgaagcgctattaatgcaagaaagtttttgtgggaaa

SEQ ID NO: 2845 - DNA, 1739 bp, Ambrosia trifida
cgtacggggaccgacgaatctaccccggaaaacgaaactagttcattttataccggtcaagtaggagggagttcaagggcgggcgagccggggagtgtgccgtcggccgggccggtttataggtgcatttatgccaaggatggtcttatggagttgcctcccggttatgactctccatgggactttttcagcgagtctgcaaaaagaaacccaaagaaccctgcactcggtcgtcgtcaaatcatcgatggaaaggctggtggttattcatggatatcatatcaagatgcctacaattctgcaatcagaattgcttccgccatccgaacccgatcggttaatcctggtgatcggtgcggcatatatggaccaaactgtccagagtggataatttccatggaggcttgtaacagcagtggcataacctatgttcctctatacgatacgcttggtgctaatgcagttgaattcattattaaccatgccgaaatctcgttggtttttgttcaagataacaaaatacctggtattttattatgtcttccaaattgttcttcaaatctaaaaactattgtcagctttggaaatatctctgaatcgcaaaagaaagaagctacggaacatggtgttgcgtgcttctcttgggaagaatttgtttcaatggggagtttggaagatgaactgccaacaaaacataaaactgacatatgcacaataatgtatacaagtggcacgacgggagaaccaaagggtgtcatactaagtaatgctgctttcatgtctgaagtattgtcaatgcatcagttactcgtagaaacagacaaaccgggcacagaagaagatacctatttctcttttcttccattagcgcatatatttgatcagataatcgagacatattgcatctacagaggcgcctcaataggattttggcaagcagatatcagatatttgattgaggaccttcttgtattaaagccaactatattttgtggtgttccaagagtttacgaccgcatttatactggtataatggctaagattttagctggaggtactgtaaggaaggcattattcgatttcgcatacaactataaattgaggaaccttgaaaagggaatacaacaagacaaatcagcccctcttttggacaagctagtctttgataagattaaacaaggatttggaggacgggttcgccttatgttatctggagctgcacctttgccaaaacacgttgaagaatttttgagagtaacatgttgtacagttctctcacaaggatatggtcttacagaaagttgtggtggatgttttacatccatagcaaatgtgtactctatgataggaaccgttggtgtgcctatgacaactattgaggcaagactagagtcggtgccagagatgggatatgatgcacttggcagcgtggcgcgtggtgaaatttgtctaagaggaaacacgctattttcggggtatcataaacgagaggatcttactaaagatgtccttgtcaatggctggttccatacaggtgacatcggggaatggcaggcagatggcgcaatgaaaataattgacaggaaaagaatatattcaagttgtcacaaggagaatatgtcgcggttgaaaacattgaaagcgcatattcacggtgccctttggtgactgcgatatgggtgtatggcaatagttttgaatcttttctcgtagcggttgtggtccccgatagaatggca

SEQ ID NO: 2846 - DNA, 1414 bp, Solanum phureja
acaagcccttacttgtactcctctagatccaaaccccaccgttaaattctcgccggcggtgatccttccgacgtcgggaatcgggaaatgaaacgtggcagcggattctcgttccacgtcaccgtcgtcatagccgccattgcattcatatacttctcaacggtgttcgtcttcattgatcagtggtttgggatttggtcgtcccctggaatgcttaacgcggtcttcttcaccgtcgttgctgttatgtgcatttccaattatgcccttgccatctacaccgatccgggtcaggttcctagctcatttgtacccgacgttgaagaccctgataatattgttcatgagatcaaacggaagggtggggatttgagatactgccaaaagtgttccctttataagcctccacgtgctcatcattgtcgtatatgtaacagatgtatactacgaatggatcatcattgcgtgtggatgaataattgtgtgggccatgcgaactacaagatcttcttcatctttgttatgtatgctgttgttgcttgcatatattccttggttttacttgctggtagcataaccatagactctccaaaggatgaccagctaagtgaaggctcttacagagttgtatatattatctcagggcttatactagtccctctaagtttggcactgggctttttcctgtgttggcatttttacctgattttgcaaaacaaaacaacaattgagtaccaagaaggtgttagagcgatgtgcgttgctgaaaagggaggttatgtctattcacatccatatgatcttggtgcatacgagaatttgatagcagttctaggtccaaatgtcctttactggctgttgccctccacaaaacatatagactctggccttcgttttcggacatcatttgataacgtaccgaggacgcctgtatcaaaatgaaatgtttcttcttacagcagagatgtaaagtgtttgatcaccaaagcagttcggtgcagctgtgtaagtctagcttttaccttgtaaagtagcagctccactcttcgtgttgccaaatgatacaacatggaggcagtcatcaacttttttgtattctaacagttgtaagagatgttcagtcctccatcggcggtcgcactgtagtcgaaggtaactagagaattgaagcagttggacataggatactagcattgttcatagttgtggcattatttacgtgatgtacaaaaagaagttccctttacaagctaacttagagcattgtgctgtagctcaaatggttgtaaattgtaatacatgcaaattgcaactacataatgagttaatgttacctgtaatgtttaattttttacaagttttgttagacagacacattttcttattatcttttattctaccttaacttgttaaa

SEQ ID NO: 2847 - DNA, 906 bp, Solanum tuberosum
gccaaaccccaccgttaattctcgccggcggtgatccttccgacgtcgggaaatgaaacgtggcagcggattctcgttccacgtcaccgtcgtcatagccgccattgcattcatatacttctcaacggtgttcgtcttcattgatcagtggtttgggctttggtcgtcccctggaatgcttaacgccgtcttcttcaccgtcgttgctgttatgtgcatttccaattatgcccttgccatctacaccgatccgggtcaggttcctagctcatttgtacccgacgttgaagaccctgataatattgttcatgagatcaaacgcaagggtggggatttgagatactgccaaaagtgttccctttataagcctccacgtgctcatcattgtcgtatatgtaacagatgtatactacgaatggatcatcattgcgtgtggatgaataattgtgtgggccatgcgaactacaagatcttcttcatctttgttatgtatgctgttgttgcttgcatatattccttggttttgcttgttggtagcataaccatagactctccaaaggatgaccagcaaagtgaaggctcttacagagttgtatatattatctcagggcttatactagtccctctaagtttggcactgggctttttcctgtgttggcatttttacctgattatgcaaaacaaaacaacaattgagtaccaagaagtgtgagagcgatgtgtgttgctgaaaagggaggttatgtctattcacatccatatgatcttggtgcatacgagaatttgatagcagttctgggtccaaatgttctttactggctgttgcctccacaaaacatatagactctggccttcgttttcggacatatttgataacgtaccgaggacgctgtatcaaatgaaatg

SEQ ID NO: 2848 - DNA, 1544 bp, Capsicum annuum
cgtgttctcgttccacgtcaccgtcgtcatagctgccattgccttcatttacttttcaacggtgtttgttttcattgatgagtggtttggtctttggtcttctcccggtatgcttaacgccgttttcttcaccgtcgtagctgttatgtgcatttacaattatgcccttgctatatataccgatccgggtcaagttcctagctcctttgtacctgacgttgaacatcctgatcacattgttcatgagatcaaacgcaagggtggggatttgagatactgccaaaagtgttccctttataagcctccacgtactcatcattgtcgtatatgtaacagatgtgtactacgaatggatcaccattgcgtgtggatgaataattgtgtgggccatgcaaactacaagatcttcttcatctttgttatgtatgctgttgttgcttgcatatattccctggttttgcttgctggtagcataactgtagactcttcaaaggacgacctgcaaagtgaaggctcttacagagttgtatatattatctccggacttacactagtccctctaagtttggcactgggcttcttcctaggttggcatttttacctgattttgcaaaacaaaacaacaattgagtaccaagaaggtgtgagagcgatgtgtgttgctgaaaagggaggttatgtgtattcacacccatatgatattggtgcatacgagaatttgatatcagttctaggtccaaatgtcctttgctggccattcccctccacaaaacatattgattctggccttcggttccggacatcatttgatagcatacctgggacgccagcatcaaaatgaatgtttcttcttacggcagagatgtaaagtgtttgatcgccaaagtagcatagcgcaggtgtgcaagtctaacgtttccttgtaaagtagcagctctactcttcgataaaggagtgaagaagagccctgtttcagactgccatgcgatacagcacggaggcagtcatcaaccttttgttttctatcgattctaagatatgttcggtcctccatcggcagttgcattgtagtctaaggtaacaagagaattaaagcagttgggacgtaggataatatcgttgttcatagttggagttattcaagtgatgtacaaaaagttcctttttccaagctaacttagagcattatgttgtagttcaaatggttgtgtaatacatgcaactacaaaatgagtaatgtcaacaatttttggagcaatattgtaggccccaatccgttctctttcccagtatagtttggaatgacactatgccactaatgaaccaaatcattgaaatttttctattactcataagtttggatggacggtcaaaacatggtacagtcagagctctgtgacggctcgaactaatttttgatggtatattttacttctgtatgaaaacattcgatcataactgtaatgacatttattctgttagtatactttttgaaaaatttcctacattaatatagcatacttgaatagtattatatttataag

SEQ ID NO: 2849 - DNA, 1070 bp, Nicotiana benthamiana
aattaaagaaagttcgacccaaacaccaaacaagcctcgctccaatcaaccagatccaacccgccgttaaattatcgcccggcggtgatcgttctgacgccgggaaatgaaacgtggcagcaaattctcgttccacgtcaccgtcgtgatagccgccattgcattcatctacttctcaacggtgttcgtcttcattgatcagtggtttgggcgttggtcctccccaggtatgcttaacgccgtcctcttcaccgtcgtagctgctatgtgcatttccaattatgcccttgccatttacacggatccgggtcacgttcccagctcatttgtacccgacattgaagaccctgagcacatcgttcatgagatcaagcgcaagggtggcgatttgagatactgccaaaagtgttcccttcataagcctccacgtgctcatcattgtcgtatatgtaatagatgtgtactacgaatggatcatcactgcgtgtggatgaataattgtgtgggccatgcaaactacaagatcttcttcatctttgttatgtatgctgctgttgcttgcatatattccctggttttgcttgttggtagcatgaccttagactctcctaaggatgacgaggaaagtgaaggctcttacagagttgtatatatcatttcggggcttatactagtccctctaagtttggcgctgagcttttttctgggttggcatttttacctgattttgcaaaacaaaacaacaattgagtaccaagaaggcgtgagagctatgtgtgttgctgaaaagggaggttatgtctattcacatccgtacgatcttggtgcatatgagaatttgatatcagttctaggtccaaatgtcctttgctggccattcccctccagaagacatattggttctggtcttcgtttcaggacaggatttgataatgtacctgggagagcagcatcaaaatgaacgtttctgaaacatcctgcgacaagattttaagtgtttgattgccaaaggagcatgggggagctgcgcaagtctagctttatcttgtaaagtagctctactcttggtg

SEQ ID NO: 2850 - DNA, 939 bp, Secale cereale
tcagcgagcagccacttcacacaggcaagcgagtggtagaggttcaggcatggcagctccgagagcgctcgccctttgcgtcctgctggcgatcgccgtcgccaacgcagaggcggcgtccgtcgtcgtcggcctggccaagtgcgccgactgcaccaggaagaacatgaaagccgaggaagccttcaaaggtctccaggtggcgatcaagtgcaagaacgtccacggcgactacgagagcaaggcggtgggtgccctcgaccgcaccggcgccttcagcgtgcccctcgccgccgacctccacggcgccgactgtgtcgcgcagctccacagcgctgcctccaacacgccgtgccccggccaggagccatccaagattgtgccggtgtccgagggcaccacctacggcatcgtcgctggtgacaacgtggccacgccgtctgcggcttcgccggagtgcgcgtccatgactctgtgcgggccgatcaagaagcacatcatcgagcacttccaccacaagaagcccgtgccaccgaagccggagcccaagccccagccccacccggactacggccccgtgcccaagccggagcccaagccgcagccccacccggactaccaccccgtccctcccacgcccacctacggcggcggcggcggcggtggataccacggacaccactgagtccgatctaccatcatcgggcacagcagtgaaatttcatggctggttgctgtcagtgagtgagcgacgttgctatttatgtcacgggttagtttgatcttctatcattcagaataacagttgtgagggataactatgtatgtcacgcaaatgcacgggtgatgggtcggttttttttacaaggtttgtaatatcggtgtggatttttgcaatgagaagttcctatatatatctgaatgaaccaagtacactca

SEQ ID NO: 2851 - DNA, 965 bp, Secale cereale
tcagaccaccaccagccacttcagacagggaagtagtggagttcgattcaggggttcaggcatggcaactccgagagcactcgtcctcggcgtcctcctggtgatcgccgtctccaacgctgaggcggcgtccgtcgtcgtcggcctggccaagtgcgccgactgcaccaggaagaacatcaaggccgaggaagctttcaaaggtcttcaagtggcaatcaagtgcaagaacgtccacggcgactacgagagcaaggcagtgggtgccctcgaccgcaccggtgccttcagcgtgcccctggccgccgacctccacggcgccgactgtgtcgcgcagctccacagcgccgcctccaacacgccttgccccggccaggagccatccaagatcgtgccagtgtccgagggcaccacctacggcatcgtcgctggcgacaacagcgcctcgccggccacggcttcgccggagtgcgcgtccatgaccctgtgcgggccgatcaagaagcacatcatcgagcacttccaccacaagaagccggtgccgcccaagccggagcccaagcctcagccccacccggactacggccccgtgcccaagccggagccgaagccgcagccccacccagactaccaccccgtccctcccacgcccacctacgacggcggcggcggtggataccacggacaccactgagtctgatctgccaccgtccggcccagcacggaaatctcatcagcgagttgatgatcagtgtcagtgagtgatcggcgttgctatttatcatcagttgcatgcgtggccgcgtgggtattctttggtggtctcctgccattcgctgccccattttagtctctgcactgcagagttgagacttcagaataacatttgtgaggacgtgtattgcttttttaagatttgcaatttcggtgtgtgttttgtacaagaaagtggtgtgtgttttgta

SEQ ID NO: 2852 - DNA, 842 bp, Leymus cinereus x Leymus triticoides
cgagctgctagctacttcacacaggcaagcagtagagttcgattcacaggttcagacatggcagctccgacgagagcactggtcctcgccgtccttctggcgatcgccgtcgccaacgccaaggcggcgtccgtcgtcgtaggcctggccaagtgcgccgactgcaccaggataacatgaaggccgaggaagccttcaagggtctccaggtggcgatcaagtgcaagaacgtccagggcgagtacgagagcaaggcggtgggcggcctcgacggtaccggcgccttcagcgtgcccctcgccgccgacctccacggcgccgactgcattgcgcagctccacagcgccgcctccaacacgccgtgccccggccaggagccatccaagatcgtgccggtgtccgagggcaccaccttcggtgtcgtcgccggcgccaagacctccacgccgtcggaggcatcgccagagtgcgcgtccgcgaccctgtgcgggccgatcaagaagcacatcatcgagcactttcaccacaagaagcccgtgccgccgaagccggagcccaagccccagcctcacccggactaccaccccgtgcccaagccggagcccaagccggagccccaccccgactaccaccccgtccctcccacgcccacctacggcggcggcggcggcggtggtggataccacggacaccactgactccgatctgccaccctcccgcccagcactgaaatccccatggtttcgtgctgtcggtgagtgagtgaccctgctatttatgattatcgcgtcgcatgcatggttggtttggttttcttcagtatctgcggaactcaagagtca

SEQ ID NO: 2853 - DNA, 1491 bp, Hordeum vulgare
aggccgacggcaaagggcgggctcgcagtctacgacgagctcatagatagaccccgaggaagcggcgccatggttatctcggtccccggtcaccggcgctccatgcgcgacgcaatgctcggcgggggccgccagctccacaagccccttcgctgcgccttctacgacgggattcccggcgaaggcctcgccgccgcgctcgccgaggccaccgggagcgtttccctctcccgcagtcccgccaccgacggcggcggcggagggaaggcggcgaggaacgtgctcatcctcatgagcgacaccggcggcggccaccgcgcctccgccgaggctctccgggacgccttccgccacgatttcggcgacgcctaccaggtgttcgtcagggatttggggaaagagtacggcggctggccgctgaacgacatggagcggtcgtacaagttcatgatccgccatgtccggctctggaagatggccttccatggcacctccccgcgctgggttcacggaatgtacctcaccgctctcgcctacctctacgccaatgaggtggtcgccgggatgatgaagtacaagccgaacgtgatcatcagcgtgcaccctctcatgcagcacatcccactgtgggtgctcaagtggcagagcctgcagcccaaggtccccttcttcaccgtcatcaccgacctcaacacctgccacccgacatggttccaccacggcgtgacaaggtgctactgcccgtcggccgaggtggcgaagagggcgctgacccgcgggctcgacccgtcccaaatccgcgtgtacgggctgcccatcaggccatccttctgccgcgccgtgctcgacaaggatgagctgaggaaagaacttggcctgcaccctcaactgcccgctgttctactgatgggtggcggcgaagggatgggcccggtggaggagacagccaaggccctcggccaggagctttacgatcaccagagacaccggccggccgggcaggtcgtggtcatttgcggcaggaatcaggcgctgcggtccaccttgctgtccctgacatggaaggtccctgtcaagattagggggttcgagaagcagatggagaagtggatgggctcttgcgactgcatcatcaccaaggctggccccggtacaattgcagaagccttgataagaggacttccaattattctcaacgatttcatccctggacaggaggtagggaatgtgccttatgtggtcgacaacggcgccggtgtgttctgtaaggacccaggggaagctgcaagacaggttgcccgatggtttactacagaaactgacgagctcaagaggtactcctgcaacgcactgaagctagcgcagcccgaagcagtgttcgacatcgcgagggacatccacaagctccagccgcaaccagccgctctaacccggatcccctactcgttgacttcatcgttctcataccatatatgaacttttggaaactct

SEQ ID NO: 2854 - DNA, 1743 bp, Hordeum vulgare
cggcgtcaaggattcaggccgacggcaaagggcgggctcgcagtctacgacgagctcatagatagaccccgaggaagcggcgccatggttatctcggtccccggtcaccggcgctccatgcgcgacgcaatgctcggcgggggccgccagctccacaagccccttcgctgcgccttctacgacgggattcccggcgaaggcctcgccgccgcgctcgccgaggccaccgggagcgtttccctctcccgcagtcccgccaccgacggcggcggcggagggaaggcggcgaggaacgtgctcatcctcatgagcgacaccggcggcggccaccgcgcctccgccgaggctctccgggacgccttccgccacgatttcggcgacgcctaccaggtgttcgtcagggatttggggaaagagtacggcggctggccgctgaacgacatggagcggtcgtacaagttcatgatccgccatgtccggctctggaagatggccttccatggcacctccccgcgctgggttcacggaatgtacctcaccgctctcgcctacctctacgccaatgaggtggtcgccgggatgatgaagtacaagccgaacgtgatcatcagcgtgcaccctctcatgcagcacatcccactgtgggtgctcaagtggcagagcctgcagcccaaggtccccttcttcaccgtcatcaccgacctcaacacctgccacccgacatggttccaccacggcgtgacaaggtgctactgcccgtcggccgaggtggcgaagagggcgctgacccgcgggctcgacccgtcccaaatccgcgtgtacgggctgcccatcaggccatccttctgccgcgccgtgctcgacaaggatgagctgaggaaagaacttggcctgcaccctcaactgcccgctgttctactgatgggtggcggcgaagggatgggcccggtggaggagacagccaaggccctcggccaggagctttacgatcaccagagacaccggccggccgggcaggtcgtggtcatttgcggcaggaatcaggcgctgcggtccaccttgctgtccctgacatggaaggtccctgtcaagattagggggttcgagaagcagatggagaagtggatgggctcttgcgactgcatcatcaccaaggctggccccggtacaattgcagaagccttgataagaggacttccaattattctcaacgatttcatccctggacaggaggtagggaatgtgccttatgtggtcgacaacggcgccggtgtgttctgtaaggacccaggggaagctgcaagacaggttgcccgatggtttactacagaaactgacgagctcaagaggtactcctgcaacgcactgaagctagcgcagcccgaagcagtgttcgacatcgcgagggacatccacaagctccagccgcaaccagccgctctaacccggatcccctactcgttgacttcatcgttctcataccatatatgaacttttggaaactcttgcagaatatactctgcaaagtgaatatgccttcaaacttggttgtggctgggcttggctgcctgctgaagaacctgtatataccatgtacataactggatggcccgtctatgttggtgtttctgttgtgcttgactgcttgcattggactattggtaattgaaatgcgaaaagtgtttttctgaccaaattattgcttgataaacatatatccctagcccgtagtagttgtagtgt

SEQ ID NO: 2855 - DNA, 1829 bp, Brachypodium distachyon
cttcctcgccaccttctcccctgctctctctctcccacggcggttgtccaccaggagctcatacacgcccccaagcgagcgagagcgccatggtgatctcggtccccagccaccggcgctccatacgcgacgccgtgctcggcgggggacgccagctgtacacgcccctccgctgcgccttctacgacggcgccgccgcgggaggcggggttcccggagaagggctcgccgccgtgctctcggaagcagctggtagctgcttgtccctctccgccggcatctccgccgtcgatggtggtggtggcggcggaaggaaggcggcgaagaacgtgctgatcctcatgagcgacaccggcggcggccaccgcgcttccgccgaggctctccgcgacgccttccgcctcgagttcggcgacgcgtaccaggtgttcgtgagggatttggggaaagagtacggcggctggccgctgaacgacatggagcggtcgtacaagttcatgatccgccacgtccgcctctggaaggtggccttccatggcacctccccgcgctgggtgcacggcgtgtacctcgccgccctcgcctactactacgccaatgaggtggtggccgggatcatgaagtacaagccggacgtgatcatcagcgtgcacccgctgatgcagcacatcccgctgtgggtgctcaagtggcagagcctgcagcccaaggtccccttcctcaccgtcatcaccgacctcaacacctgccacccgacatggttccaccacggcgtgacacggtgctactgcccctcggccgaggtcgcgaagagggccctgctccgggggctcgagccgtcccaaatccgtgtgtacgggcttccgatcaggccgtccttctgccgcgcggtgcttgacaaggatgagctgagggaagaacttggcatgcaccctgaactacctgctcttctactgatgggaggtggagaggggatgggtccagtggaggagactgccagggctctcggcgaagagctttacgaccaccggaggcgccggccggtcgggcaggtcgtggtcatatgtggcaggaatcaggcgctccggaacaccctgcagcgcctgccatggaaggttcctgtcaagattagggggttcgaaaagcagatggagaagtggatgggtgcttgcgactgcatcatcactaaggctggtcctggtacaattgcagaggccttgataagaggacttccaattattctcaatgatttcatccctggacaggaggttggaaatgtgccttatgtcgtagataatggtgccggtgtgttctgcaaggacccaagggaagccgcaagacaagtttcccaatggtttagcacagacattgacgagctcaagagatactcccgcaacgcgctgaagctagcagagccagaagctgtgttcaacatcgtgagggacatccacaagctccagcagcaacctgctgctgtaacccggatcccctactccttgacatcatcattctcataccatacatgaatccaaaagaactgttgcagaacacactctgcaaaagtgaatacttgagactgatgtgttagctggaggaacctgtatatataggattgccgttcttgggctcttgggccttggagttgcccgtaccccgtatgtccatacatagcaatgtaataggaagtgaagttattgtgttgtctggggtttgtaagaagcttgcatgagggtgttgtgggggagaaatcgatagaaatggctattggtgcctcttgtgatttcggcgatctttttaaacaaggcccataaacgaacgtagctagctgg

SEQ ID NO: 2856 - DNA, 1836 bp, Oryza sativa
aggctcggtccacgagacgaggaggagaagccgccgcccccgccgccgccgccatggtgatctcggtcgccaccccccgccgctccatccgcgacgccgtgctgggtggcgtgctcggcgccggaggccgccagctctaccagcccctccgctgcgccttctacgacggcgccgccgggggcggcctcaccgccgcgctctcggaggatggagccgagggcggcgtccccctcccgtgcgggaggaagacggcggcggcgaagaacgtgctcatcctcatgagcgacaccggcggcggccaccgcgcatccgccgaggccctccgcgacgccttccgcctcgagttcggcgacgcctaccaggtgttcgtgagagatttggggaaggagtacggcgggtggccactgaacgacatggagcggtcgtacaagttcatgatccgccatgtccggctctggaaggtggcgttccacggcacttcgccgcgctgggtgcacggcatgtacctcgccgcgctggcctatttctacgccaacgaggtggtggccgggatcatgaggtacaaccccgacattatcatcagcgtgcacccgctgatgcagcacatcccgctgtgggtgctcaagtggcagagcctccaccccaaggtgccattcgtcaccgtcatcaccgacctcaacacctgccacccgacatggttccaccatggcgtgacgaggtgctactgcccgtcggcggaggtggccaagagggcactgctccgggggctcgagccttcccaaatccgtgtgtacgggttgccgatcaggccgtccttctgccgcgccgtgctcgacaaggatgagctgaggaaagagctggacatggatcccgacctgcctgcagtgctactgatgggcggcggcgaggggatgggtccggtggaggagacggcgagagcactcagcgacgagctctacgatcgccggagacgccggcctgtcgggcagatcgttgtcatctgtggcaggaaccaggtgctgcggtccacgctgcagtcgtcacggtggaatgtccctgtcaagattagagggttcgaaaagcagatggagaagtggatgggcgcttgcgattgcatcatcacaaaggctggtcctggtacaattgcagaggccctgataagaggactcccaattattctcaacgacttcatacctggacaggaagtcgggaatgtgccttacgtcgtggacaatggtgccggtgtgttctccaaggacccgagggaagccgcgagacaggttgccagatggttcaccacacacacaaacgagctccggagatactccctcaacgcgctgaagctagcgcagccagaagccgtgttcgacatcgtgaaggacatccacaagctccagcagcagcctgccacggtgacgcggatcccttactccctgacctcatcgttctcatacagcatatgaaaaaccatcaaggttacaggatgtactatgctatgctctgcaaacatgctttgcctcggaaggttggtccgcttgctgaagaacttgtacatactgaattggatttgttcgtttgtccaaatgtgtaaatgcaataagaacagatgaactgaagatgttgtctaactggcctgctgctgatatgaagatgaagttgtggtgagagtgactgactacgagtgacaaatcatcccctcccatagctaaatatgtcctgatagaacatcttcatcttttgtacaactacagtatagttacgtggctaactggaccatctgcatagtttttctttttcactccttgtcaatcgtattgatactagattgtttggcac

SEQ ID NO: 2857 - DNA, 2005 bp, Sorghum bicolor
gtaaatccatctcagcagcatctcccctggctctctgtctcccctctgcttcccacgcctcgccaccttctcgacgcgcgtgtgtgcaactgcgaggctccgtcgacgacgagctcgtagaactaagacggccccgcaacccacgcgcgtcggcgccgccatggtgatctcggtggccactccccggcgctccacctccatacgcgacgccgtgctgggcggcgtgctcggcggcggcgggcgccagctgtaccagcccctccgctgcgccttctacgacggcacagccgggggcggtggcggtggcttacccggggacggcctgtccgccgcgctctccgaggagcccgcccgcgtctccgctgccggcggcggcaataagcagaagcaggcggcgaggaacgtgctgatcctgatgagcgacaccggcggcggccaccgcgcgtcggctgaggccctccgcgatgccttccgcatcgagttcggcgacacctacaaggtgttcgtgacggatttggggaaggagtacggcgggtggccgctgaacgacatggagcggtcgtacaagttcatgatccgacatgtgaggctctggaaggtggcgttccacggcacctccccgcgatgggtgcacggcatgtacctcgccgcgcttgcctactactacgccaacgaggtggtggctgggatcatgaagtacgagccggacatcatcatcagcgtgcacccgctgatgcagcacatcccgctgtgggtgctcaagtggcagagcctacaccccaaggtgcccttcgtcaccgtcatcaccgacctcaacacctgccacccgacatggttccaccacggcgtgacaaggtgctattgcccatccaccgaggtggcgaacagggccctgctccggggcctcggcccgtcccaggtccgcgtcttcgggcttcccatccggccctccttctgccgcgccgtgctcgacaaggatgaggtgaggaaagagcttggactggatcctcagctgccggctgttctactgatgggaggcggcgaggggatgggtccggtggaagagaccgcgagggccctcggcgaggagctctacgaccaccggagacggcgccgggtggggcaggtcgttgtcatatgcggcaggaaccaggcgctgcgatccaccctgcagtccctcagatggaaggtccctgtcaagatcagagggttcgaaacacagatggagaagtggatggccgcctgcgactgcatcatcacaaaagctggtcctggtacaattgcagaggcacttataagaggacttcctattatcctgaacgacttcatccctggacaggaagttggaaacgtgccttatgtcgtggacaacggtgccggtgtgttctcgaaggacccaagggaggctgcaagacaggttgtccgctggttcagcacagatgaggatgagctcaagagatactcacgtaacgcgctgaagctagcacaacccgaagccgtgttccacatcgtaaaggacatccacaagctccagcaacagccagctgcggttacccggatcccctactcgttgacctcatcgtttccttaccatatatgaattcaaggatactcttacagttacatattctgccatatactgggtattatgccttgaaacttatgcctagcctactgaagaatctgtatatacatgcatgatattggcattccttagcctagcttggagtagctctcagttatgttcatatatgtcagctcaatatataaggattgaagttattgagctagctgccctgaaccttgtaatctgctgacttaagggtttggtatcgtaggatagaaattcctagagggcgcatgtggcctatagtgatacataattgatctctgtgtaagtccgataaagaactatcaactagctatatagctaacttgatcctttatatcggttcttgttatgtacgcagtatttggtgatggggatgtgcaatgtatttctcgc

SEQ ID NO: 2858 - DNA, 1837 bp, Setaria italica
atgacgacgttctacagtcgtgtccttgacgggggcatcgtcgtggagaatcctcgctatgttgtgatcattgtcatgccacattctagtgcatggccgttgtgttgtaatctgtggatatgccccaattttacccttgtgctgggtgtggtgttcttcgtattcgtggtgatctcggtcgccactccccggcgctccatacgcgacgccatgctgggcggcgtgcttggcggcggcggccgccagctataccagcccctccgctgcggcttctacgacggcgcggccgggtgtggcggcctacccgtcgacggcctcgccgccgcgctctccgaggaagccgccgacgccgtccgcgtctccgccggcggtaaggcggcgaagaacgtgctcatcctgatgagcgacacaggcggcggccaccgcgcctccgctgaggccctccgcgacgccttcctcatcgagttcggcgacgcctaccaggtgtttgtgagggatttggggaaggagtacggcggctggccgctgaacgacatggagcgatcgtacaagttcatgatccgccacgtgcgcctatggaaggtggccttccacggcacctctccgcgatgggtgcacggcatgtacctcgccgcgctcgcctacttctacgctaacgaggtggtgtccgggatcatgaagtataagccggacattatcatcagcgtgcacccgctgatgcagcacataccgctgtgggttctcaagtggcagagcttgcagcccaaggtacccttcgtgaccgtcatcaccgacctcaacacctgccacccgacatggttccaccacggcgtgacaaggtgctactgcccctccgccgaggtggcaaacagggccctgatccaaggcctccaactctcccaagtccgcgtcttcgggctgccgatcaggccctccttttgccgtgccgtgctcgagaaggatgagatcaggaaagaacttgagttggctcctgaactgcctgcagttctactgatgggaggcggcgagggaattggtccggtggaggagaccgcgagggcgcttggcgaggagctttacgattaccggagaaggcgcccgatggggcagattgtggtcatttgcggcaggaatcaggtgctacggtccaccctgcagtccctgagatggaaggtccctgtcaagataagagggttcgaaaaacagatggaaaagtggatgggggcctgcgattgcatcatcacaaaggctggtccaggcacaattgcagaggcattgataaggggacttcctattatcctgaacgactttatccccggacaggaagttggaaatgtgccttatgtcgtggacaacggtgctggtgtgttctccaaggacccaagggaggcttcaagacaggttgcccggtggttcagcacagatgcggatgccctccagagattctcccgtaatgcgctgcagctagcacaacctgaagccgtgtttgacatcgtcaaggatatccacaagctccagcaacaatccgcagcggttacccggatcccctactccttgacctcgtcattttcgtaccatatatgaattcaagaatacgattacagttaagtattctccatatgttggatatgccttggaacttccatctgtatttatagaactggcatcctgccctgtagtagctcttcagtttatatatgtcaattttcaattcaataagaaaagaagtaactgagcactgaactgcctgagggcttgtaatccgctgatttatgggtaaagctttggagagaatctaccctactaattcaccaaagttttctttgctagatccacc

SEQ ID NO: 2859 - DNA, 1796 bp, Zea mays
cgcgtttgattcttcggcagacagaaacaataagcaagatgatgaggcgccaaagtgaaagaagctctccctctcctctctgcttcgcacgcctcgccaccttccacgacgagctcctacagtcctacctagacgtaagccggcgccgccatggtgatctcggtgcccgcggcccggcgctccacctccgtacgcgacgccgtgctgggcggcggcgggcggcagctgtaccagcccctccgctgcgccttctacgacggcctggccgccgcgctgtccgagtccgaggagccctccgactcggacgccgccgcccgcgtccccgctggctgcaagcggcaggcggcgaggaacgtgctgatcctgatgagcgacaccggcggcggccaccgcgcctccgccgaggccctgcgcgacgccttccgcatcgagttcggcgacgcctacaaggtgttcgtgacggatctggggaaggagtacggcgggtggccgctgaacgacatggagcggtcgtacaagttcatgatccggcacgcgcggctctggaaggtggcgttccacggcacctccccgagatgggtgcacggcgtgtacctcgccgcgcttgcctacttgtacgccaacgaggtggtggctgggatcacgaagtacgagccggacatgatcatcagcgtgcacccgctgatgcagcacatcccgctatgggtgctcaagtggcagcagagcctgcgccagcaccaccccaaggcggtggtgcccttcgtcaccgtcgtcaccgacctcaacacctgccacccgacatggttccaccacggcgtgacgaggtgctactgcccctcggccgaggtggcgagccgggccctgctccggggcctcagcccgtcccaggtccgcgtcttcgggctgcccatccggccctccttctgccgcgccgtgctcgacaaggatgaggtgaggaaagagctggggctggaccctcagctgcccgctgttctgctgatgggaggcggcgaggggatcggcccggtggaggagaccgcgagggcgctcggcgaggagctctacgaccgccggagacggcgccgggtgggacaggtcgtggtcgtgtgcggcaggaaccgggcgctgcggtccaccctgcagtctctcagatggaaggtccctgtcaagatcagagggttcgagacacagatggagaagtggatggccgcctgcgactgcatcatcacaaaagctggtcctggtaccatcgcagaggcactcatacgagggcttcctatcatcctgaacgacttcatccctggacaggaagtcgggaacgtcccatatgtcgtggacaacggtgccggcgtgttctccaaggacccaggggaggccgcgagacaggtcgcccgctggttcagcagcagcagcacagacggggacgagctcaggagatactcgcgtaacgcgctgaggctagcgcagcccgaggcggtgttccacatcgtcagggacatccacaagcagctccagcgacagcctgccgcggtcacccggatcccctcccgctcgctgacctcgtccttcccgtaccatatgtgaaatcaagaatgctactgcagttacgttttctgctgcatgttggataatattatgcttgggacttgatgtatgcctaaccttttgaagaacctgtatattatattatattgtatataagaattgctctctgttctgttcatgagtgatttttgtgtatttctcgctactgaatactatttggaaagaagttaacatacattgtgactaagaat

SEQ ID NO: 2860 - DNA, 1798 bp, Panicum virgatum
cgcgtccataaaataaggacacatgaccaggaaaagcatgcaagcagagcagcataatcccagcatctcccacggaatcgtcccctacgcgcgggtcccacagagtcaaacaatagtctgggaaggataatgccggaaccttggagggaatattacacgtttgattcccggacggttcggcagaaaaaatcagaaataaaagacgacgaggtgaactggtgaagtgaaacaaaattaaagctccccgcctccctcgcctcgccaccttctctcctccctcctcctgccctgtctccacacccgcaaggccttcgatccatgcacgacgatcgatcaccacccgtgaagccatggtgatctccgtcggcactggccggcgctccatacgcgacgccgtgcttggcggcggtgtgcagggaggcggcggccggcagctttattaccggccgccgctccggtgtggcttgtacgatggctcggtcgtcggcggccagtccgtggacggcctcgccgccgctctctccgaggaggccgccgccgaccccgtccgcatcccggatggggcggccaaggccaagaacgtgctcatcctgatgagcgacaccggcggcggccaccgcgcctccgccgaggccctccgcgacgccttccgcatcgagttcggcgacgcctaccaggtgttggtaagggatttggggaaggagtacgggggctggccgctgaacgacatggagagatcgtacaagttcatgatccgccatgtccgcctctggaaggtggccttccacggcacctccccgcggtgggtgcacggcgtgtacctcgccgcgctcgcctacctctacggaaacgaggtagtggcggggctgatgaagtacaagccggacatgatcatcagtgtgcacccgctgatgcagcacatcccgctgtgggttctcaagtggcagagcctgcagcgcaaggttcccttcttcaccgtcgtcaccgacctcaacacctgccatccgacatggttccactacggcgtgacaaagtgttactgcccctccgccgaggtcgcgaacagggccctgctccggggcctccagacctcccaagttcgcgtcttcgggctgccggtcaggccctccttctgccgtgccgagctcgacaaggacgagatgaggaaagagcttgagctggatcctaacctgcctgccgtcctcctgatgggaggcggcgagggcatgggtccggtggaggagacagcgagggccctcggcgaggagctctacgatgacgagagacggcgcccgattgggcagatcgtggtcatctgcggcaggaaccgggctctgcggtcctccctgcagtccctgacatggaaggtccctgtcaagataagggggtttgaaaagcagatggagaagtggatgggggcctgcgattgcatcatcacaaaggctggtcctggcacaattgcagaagcgttgataaggggacttccaattatcctgaacgatttcatcccgggacaggaagttggaaatgtgccttatgtcgtggacaacggtgctggtgtgttcttcaaggatccaaggaaagttgcaaaccaagttgctcgatggttcagtgtagatgtggatgcgctaaagagatactcccgtaatgcgctaaagctagcccaacctgaagctgtgttcgacattgtcaaggacatccacaaactccagcaacattctgctgcgcttacccggatcccctacttcttgacctcatcatttttgtatcatatatgaattcaagaatactgttacaa

SEQ ID NO: 2861 - DNA, 2122 bp, Triticum aestivum
accggtttcaatttcaatttcaatcacggcccagcaaagtcggcgagaacgccgcacccgctttcaaatcctctccccccttcgtcgtcccatcgttccccttccccttcctcctcccgctcctcccctttcaaacccccctgccccctccctataaacctaggcgagggagcgcccgcagaccactcccagagcccagatctatccaacccctcttccatcgcaccgtcgtcctcgtccatggcgactccgccgtcgccgccgccgcccacgcgcgcctcctgcggctctttactccaggaactgcaggaactatggggagagataggcccggatgaactggaaagagataggatgatcttgcagttggaggaggactgcctcaatgtttacaggaagaaagttgaacaaactagaaagcaaaaggcagacctgcttcaagtgatgtccttgggcgaagctgagatagaaaagatactttctgctctgggagagcgtgaatccttttctagggtggagaagcttgggggtacattaatggaacaacttgcaaaactagagccagttctggatgatctgagacggcggagagatgagcgcataaatgaatttttggctgttcagctgcatatagttcgtctacaagctgagatttcaggaactattaatcatggggatcctgcagctcctttagtggatgagactgacctatctacaggaagactggctgaactgaaaacccagcttaatgagctccaaacagaaaagaatctcagactgcaaaagattgatggtcagatcaagtgtattaatgaaatgtgcaacatgatgtctcttgatcttaagaagacattatatgaagttcatcccagctttgttgaattggaaagaatcaaatccatgagtataagtgatagcacacttgataggcttgcaggaaaacttcacgcactaaatcaagaaaagaaacagaggctgcggaagctacaagatcttggaagcacactcattgagttatggagtctaatggacacaccattagatgaacagaaatgctttgatcatgttacctctttgatttcagtctcacccaatacagtgatgccccaaggatgccttgcacatgaccttattgagaaggtagaggttgaggtcaagagactgaagcatttgaaagctagcaaaatgaaagagcttgtcttaaagaaaatgactcagcttgaagaaatctacagaagtgttcacatgcatattgacagcgatcatgagtggcagattctcactgaacttattgattctggtagagcagatctctcagagctgcttacagatatggatgaccgaattgcagaagcaagagatcttgctctaagcagaaaggacattctagaaaaggtggaaaaatggacatcagcaactgaagaggagggttggctcggtgaatatgagggggatcaaaatcgctataatgctggtcgaggagctcacataaatctcaagcgcgcggagaaggcaagggtattggtcagcaaaattccatccctgctggagaatttgactactaaagttaatgcttgggaaaaggagaagggcatgtcatttatgtatgataagaagaggcttttggatagcttagaaaaatacacctctgaaagacaacaaaaggaagaggaaaaacgtcgatcacgggaacttaagaaactacaagaacagtttgcagcagaacaaggtgcgccatatggagcaaagcctagtcctatgcgcccgctttcggcaaggaaacctcttgggcagagtactaatgtcaacattgttggtggaactcctaacagccggcgtgtgtctaccccagtttcacgcaagggaggctcgtcttgtggaaaaatgaaggatactggcaagacagctgcttctataccggcaaattatgtttctcttcccaaggattgctcagacaattcttacatgtgaaaatgtaaccacctccgactagttggggcctctagcctgtactttcatacgtttggtctcatataggttaactgcttgttaatgcttgaattgttcgaatcgttgatcttaactctgatgcaaaatatgtttctgctcctgcacaatgctt

SEQ ID NO: 2862 - DNA, 1984 bp, Secale cereale
gactcttcctcttcccgctcctcccctttcaaacccatctcccccctccctataaacctaggggagggagcgcccgcagaccactcccggagcccagatccatccaacccctcttcgatcgccccggcgtcctcgtccatggcgactccgccgtcgccgccgcccacgcgcgcctcctgcggctcctttctccaggaactgcaggaactatggggagagattggcccggatgaactggaaagagataggatgatcttgcagttggaggaggactgcctcaatgtttacaggaagaaagtggaacagactagaaagcaaaaggcagacctgcttcaagtgatgtccttgggcgaggctgagatagaaaagatactttctgctctgggagagcgtgaatccttttctagggcggagaagcttgggggtacattaatggaacaacttgcaaaactagagccagttctggacgatctgaggcggcggagagatgagcgcataaatgaatttttggctgttcagctgcatatagttcgtctacaagctgagatttcaggaactattaatcatggggatcctgcagctcctttagtggatgagactgacctatctacaggaagactagctgaactgaaaacccagcttaatgagctccagacagaaaagaatctcagactgcaaaagattgatggtcagatcaagtgtattaatgaaatgtgcaacatgatgtctcatgatcttaagaagacattatatgaagttcatcccagctttgttgaattggaaagaatcaaatccatgagtataagtgatagcacacttgataggcttgcaggaaaacttcatgcactaaatcaagaaaagaaacagaggctccggaagctacaagatcttggaagcacactcattgagttatggagtctaatggacacaccattagatgaacagaaatgcttcgatcatgttacttctttgatttctgtctcacccaatacagtgatgccccaaggatgccttgcacatgaccttattgagaaggtagagattgaggtcaagagactgaagcatttgaaagctagcaaaatgaaagagcttgtcttaaagaaaatgactcagcttgaagaaatctacagaagtgttcacatgcatattgacagcgataatgagtggcggattctcactgaacttattgattctggtagagcagatctctcagagctgcttacagatatggatgaccgaattgcagaagcaagagatcttgctctaagcagaaaggacattctagaaaaggtggaaaaatggacatcagcaactgaagaggaggcttggctcggtgaatatgagggggatcaaaatcgctataatgctggtcgaggagctcacataaatctcaagcgcgcggagaaggcaagggtattggtcagcaaaattccatccctgctggagaatttgactactaaagttaaagcttgggaaaaggagaagggcatgtcatttatgtatgataagaagaggcttttggatagcttagaagaatacacctctgaaagacaacaaaaggaagaggacaaacgtcgatcacgggaacttaagaaactacaagaacagtttgcagcagaacaaggtgcgccatatggagcaaagcctagccctatgcgcccgctttcggcaaggaaacctcttgggcagagtactaatgtcaacattgttggtggaactcctaacagccggcgtgtgtctaccccagtttcacgcaagggagccttgtcttgtggaaaaatgaaggatactggcaagacagcagcttctataccggcaaattatgtttctcttcccaaggattgctcagacaattcttacatgtgaaaatgtaaccacctccgacaagttggcctctatcctgtactttcatgtgtttagtctcatataggttaactgcttgttaatgcttgaattgttcgaatcgttgatcttaacttctgat

SEQ ID NO: 2863 - DNA, 2009 bp, Secale cereale
gactcccgctcctcccctttcaaacccatctcccccctccctataaacctaggggagggagcgcccgcagaccactcccagagcccagatccattcaaccaatcttcgatcgccccgacgtcctcgtccatggcgactccgacgtcgccgccaccgccgccgcccacgcgcgcctcctgcggctcctttctccaggaactgcaggaactatggggagagattggcccggatgaactggaaagagataggatgatcttgcagttggaggaggactgcctcaatgtttacaggaagaaagtggaacagactagaaagcaaaaggcagacctgcttcaagtgatgtccttgggcgaagctgagatagaaaagatactttctgctctgggagagcgtgaatccttttctagggtggagaagcttgggggtacattaatggaacaacttgcaaaactagagccagttctggacgatctgagacggcggagagatgagcgcataaatgaatttttggctgttcagctgcatatagttcgtctacaagctgagatttcaggaactattaatcatggggatcctgcagctcctttagtggatgagactgacctatctacaggaagactagctgaactgaaaacccagcttaatgagctccagacagaaaagaatctcagactgcaaaagattgatggtcagatcaagtgtattaatgaaatgtgcaacatgatgtctcttgatcttaagaagacattatatgaagttcatcccagctttgttgaattggaaagaatcaaatccatgagtataagtgatagcacacttgataggcttgcaggaaaacttcatgcactaaatcaagaaaagaaacagaggctccggaagctacaagatcttggaagcacactcattgagttatggagtctaatggacacaccattagatgaacagaaatgctttgatcatgttacttctttgatttcagtctcacccaatacagtgatgccccaaggatgccttgcacatgaccttattgagaaggtagagattgaggtcaagagactgaagcatttgaaagctagcaaaatgaaagagcttgtcttaaagaaaatgactcagcttgaagaaatctacagaagtgttcacatgcatattgacagcgataatgagtggcggattctcactgaacttattgattctggtagagcagatctctcagagctgcttacagatatggatgaccgaattgcagaagcaagagatcttgctctaagcagaaaggacattctagaaaaggtggaaaaatggacatcagcaactgaagaggagggttggctcggtgaatatgagggggatcaaaatcgctataatgctggtcgaggagctcacataaatctcaaagcgcgcggagaaggcaagggtattggtcagcaaaattccatccctgctggagaatttgactactaaagttaaagcttgggaaaaggagaagggcatgtcatttatgtatgataagaagaggcttttggatagcttagaagaatacacctctgaaagacaacaaaaggaagaggacaaacgtcgatcacgggaacttaagaaactacaagaacagtttgcagcagaacaaggtgcaccatacggagcgaagcctagtcctatgcgcccgctttcggcaaggaaacctcttgggcagagtactaatgtcaacattgttggtggaactccgaacagccggcgtgtgtctaccccagtttcacgcaagggaggcttgtcttgtggaaaaatgaaggatactggcaagacagctgcttctataccggcaaattatgtttctcttcccaaggattgctcagacaattcttacatgtgaaaatgtaaccacctccgacaagttggcctctatcctgtactttcatatgtttagtctcatataggttaactgcttgttaatgcttgaattgttcgaatcgtcgatcttaacttctgatgcaaaacctgtttctgactacctt

SEQ ID NO: 2864 - DNA, 1837 bp, Triticum aestivum
ctggaaagagataggatgatcttgcagttggaggaggactgcctcaatgtttacaggaagaaagtggaacaaactagaaagcaaaaggcagacctgcttcaagtcatgtccttgggcgaagctgagatagaaaagatactttctgctctgggagagcgtgaatccttttctagggtggagaagcttgggggtacattaatggaacaacttacgaaactagagccagttctggacgatctgagacggcggagagatgagcgcataaatgaatttttggctgttcagctgcatatagttcgtctacaagctgagatttcaggaactattaatcatggggatcctgcagctcctttagtggatgagactgacctatctacaggaagactagctgaactgaaaacccagcttaatgaactccagacagaaaagaatctcagactgcaaaagattgatgctcagatcaagtgtattaatgaaatgtgcaacatgatgtctcttgatcttaagaagacattatatgaagttcatcccagctttgttgaattggaaagaatcaaatccatgagtataagtgatagcacacttgataggcttgcaggaaaagttcatgcactaaatcaagaaaagaaacagaggctccggaagctacaagatcttggaagcacactcattgagttatggagtctaatggacacaccattagatgaacagaaatgctttgatcatgttacctctttgatttcagtctcacccaatagagtgatgccccaaggatgccttgcacatgaccttattgagaaggtagaggttgaggtcaagagactgaagcatttgaaagctagcaaaatgaaagagcttgtcttgaagaaaatgactcagcttgaagaaatctacagaagtgttcacatgcatattgatagcgatcatgagtggcagattctcactgaacttattgattctggtagagcagatctctcagagctgcttacagatatggatgaccgaattgcagaagcaagagatcttgctctaagtagaaaggacattctagaaaaggtggaaaaatggacatcagcaattgaagaggagggttggcttggtgaatatgagggggatcaaaatcgctataatgctggtcgaggagctcacataaatctcaagcgcgcggagaaggcaagggtattggtcagcaaaattccatccctgctggagaatttgactactaaagttaaagcttgggaaaaggagaagggcatgtcatttatgtatgataagaagaggcttttggatagcttagaaaaatacacctctgaaagacaacaaaaggaagaggaaaaacgtcgatcacgggaacttaagaaactacaagaacagtttgcagcagaacaaggtgcgccatatggagcaaagcctagtcctatgcgcccgctttcggcaaggaaacctcttgggcagagtactaatgtcaacattgttggtggaactcctaacagccggcgtgtgtctaccccagtttcacgcaagggaggcttgtcttgtggaaaaatgaaggatactggcaagacagctgcttctataccggcaaattatgtttctcttcccaaggattgctcagacaattcttacatgtgaaaatgtaaccacctccaacaagttggcctctagcctgtactttcatacgtttggtctcatataggttaactgcttgttaatgcttgaattgttcgaatcgttgatcttaacttctgatgcaaaacctgtttctgctcctgcacaatgcttgtgctctttttcctgcctatttgtgctgcattcagcttctgcagaatataaattc

SEQ ID NO: 2865 - DNA, 2097 bp, Brachypodium distachyon
ccacacttcccttccctttctgctcccgctctccccctttcaaatccctccccccgctgtctattaaccctaggcgagggagcagcgcaaaacactcctaaatctgagccctttcgatcgtcccgcccccctcgttcatggcgactccgccgtcgccgccgccgcccacgcgcgcctcctgcggctcctttctccaagaactgcaggaactgtggggagaaattggccaggatgaactggaaagagataagatgatactgcaactggaggaggactgcctgaatgtttacaggacgaaagtggaagaaactagaaagcaaaaggcagacctacttcaaacgatgtctttgggcgaagctgacatagataggatcctttctgcccttggagagcgtgaatccttttctaggatagagaagcttgggggtacattaatggagcaacttgcaaaagtagagccagttctggacgatttgagaatgaggagggatgagcgcgtaaatgaatttttgactgttcagctgcgtatatttcgtctagaagctgaaatttcaggaactactgatcacggggatcctgcagctcctttggtggatgagaccaatctgtcaataagaagactaacggaattgaagacccagcttaccgagctccagacagaaaagaatctcaggctgcaaaagattgatttccagatcaagtgtattaatgaaatgtgcagcatgatgtctctagatcttaagaagacattatacgaagttcatcccagctttgttgagttgggaaaaaccaaatctatgagtataagtgattgcacacttgacagtcttgcaggaaaagttcacgcactaaatcaagaaaagaagcagaggctccggaagctacaagatcttggaagcacacttattgagttgtggaatctcatggacacaccaattgatgagcaaaaatgctttgatcatgttacctctttgatttcagtctcacccaatacagtgatgccccaaggatgccttgcgcatgaccttattgagaaggtagaggttgaggttaagagactgaagcacttgaaagctagcaaaatgaaagagcttgtcctaaagaaaatgactgagcttgaagaaatctacaaaagtgttcacatgcatatggacagtgatcatgagtggcggcttctcgctgatcttattgattctggcagagcagatctctcagagctgcttacaggtatggatgatagaattacagaagcaagagagcttgctctaagcagaaaggatattctagaaaaagtggaaaaatggacatcagcatctgaagaggagggctggcttggtgaatatgagagggatcaaaatcgctataatgctggtcgaggagctcacgtaaatctcaagcgcgcggagaaagcaaggatattggtcagcaaaattccatctctgcttgagaatttgactgctaaaattaaagcttgggaaaaggagaagggcatacagtttatgtatgataagacgaggctgctgcatagcttagaagaatacacctcggaaagacaacaaaaggacgaggaaaaacgtcgatcacgggaacttaagaaacttcaggaacagtttgccgcagaacaaggtgcaacatatggagcgaaaccaagtcccatgcggccggtttcagcaaggaagccacttgggcagagttctaacgtcaacatcattggtggaactcctaacagccgtcgtgtctctacgccaatgtcacgcaagggaggcttgtcttctggaaaaatgaaggatgccggcaagacagctgcttctataccagcaaactatgttgccattaccaaggattgctcagacaattcttccctgtgaaaatgtcatctcctgcaagttggggcctgaagcccgtaccctagctttaccttccatatgcctaatctcatacagattaactgcttgctaatgcttgaatgatttggtgattatactttggatgcaaaaccttcaagacttgaaaccttcccaaaatagtactgcacatttctctctgctttcttttgtttggtgagaagtggtagtatgagaactcctgcgttgtttg

SEQ ID NO: 2866 - DNA, 1744 bp, Secale cereale
tgaactggaaagagataggatgatcttgcagttggaggaggactgcctcaatgtttacaggaagaaagtggaacagactagaaagcaaaaggcagacctgcttcaaatgatgtccttgggcgaagctgagattgaaaagatactttctgctctgggagagcgtgaatccttttctagggtggagaagcttgggggtacattaatggaacaacttgcaaaactagagccagttctggacgatctgagacggcggagagatgagcgcataaatgaatttttggctgttcagctgcatatagttcgtctacaagctgagatttcaggaactattaatcatggggatcctgcagctcctttagtggatgagactgacctatctacaggaagactagctgaactgaaaacccagcttactgagctccagacagaaaagaatctcagactgcaaaagattgatgctcagatcaagtctattaatgaaatgtgcaacatgatgtctcttgatcttaagaagacattatatgaagttcatcccagctttgttgaattagaaagaatcaaatccatgagtataagtgatagcacacttgataggcttgcaggaaaagttcatgcactaaatcaagaaaagaaacagaggctcaggaagctacaagatcttggaagcacactcattgagttatggagtctaatggacacaccaatagatgaacagaaatgctttgatcatgttacttctttgatttcagtctcacccaatacagtgatgccccaaggatgccttgcacatgaccttattgagaaggtagagattgaggtcaagagactgaagcatttgaaagctagcaaaatgaaagagcttgtcttaaagaaaatgactcagcttgaagaaatctacagaagtgttcacatgcatattgacagcgatcatgagtggcggattctcactgaacttattgattctggtagagcagatctctcagagctgcttacagatatggatgaccgaattgcagaagcaagtgatcttgctctaagcagaaaggacattctagaaaaggtggaaaaatggacatcagcaactgaagaggagggttggctcggtgaatatgagggggatcaaaatcgctataatgctggtcgaggagctcacataaatctcaagcgcgcggagaaggcaagggtattggtcagcaaaattccatccctgctggagactttgactactaaagttaaagcttgggaaaaggagaagggcatgtcatttatgtatgataagaagaggcttttggatagcttagaaaaatacacctctgaaagacaacaaaaggaagaggaaaaacgtcgatcacgggaacttaagaaactacaagaacagtttgcagcagaacaaggtgcgccatatggagcaaagcctagtcctatgcgcccgctttcggcaaggaaacctcttgggcagagtactaatgtcaacattgttggtggaactcctaacagccggcgtgtgtctaccccagtttcacgcaagggagccttgtcttgtggaaaaaatgaaggatactggcaagacagcagcttctataccggcaaattatgtttctcttcccaaggattgctcagacaattcttacatgtgaaaatgtaaccacctccgacaagttagcctgtacttttcatacgtttggtctcatataggttaactgcttgttaatgcttgaattgttcgaatcgttgatcttaactt

SEQ ID NO: 2867 - DNA, 2071 bp, Panicum virgatum
ctgaattttttaaccctaattagtttataattaaatattatttgtcaaataacaacgaaatatgttatagtaccgaaacccaaactttttcaccaactaaacacacagccttacccattttcccgttcaaaaagaaaagctttcgttttacacctcacgtcctcaccttcccgttccccacgcacaaaggcgacgcaagcagcgttgctttcctctcctctgctcggcctcgccgcttccccctctcccctgccccaacgattcttccgcttttcctttttcaaatcgcactttcctcgtgcgcgtgtcgactccgtcgtcctcgccgccgggttgggggggacgccgtctcggatgaggccgcgctgaccggagccggaccactcgcccacccatggtgatggcgcggccgcagcgagtgtacgaggcctggaaagggaacaataaattcctctttggtgggaggctcatattcggacctgacgccaagtccctcatcctttctgtttcgctcatcgtggtcccggtctcggtattctgcgcgcttgttgctcggcatctccgccaccatttcctggcttacaatgcgggatatgcgattcctttggtagctgtagtgtttatgatctatgtgcttgtgctgctcctgattacctcagctcaggatcctgggatcgtgcctcgcgcagcgcacccacccgaggaagagttttcatatgggaatgcattgtctgggggcacgcctgggaggctgcagttcccccgtgtaaaggaagtaatggttaatgggatgcttgtgaaagtgaagtattgcgacacctgcatgatttaccggccgcctcggtgctcacactgttcaatatgcaacaattgcgtggagcgctttgaccatcattgcccctgggttggacaatgcattggacagcgcaattaccggtactttttcatgtttgtttcttcctcgactcttctctgcatttatgtatttgcaatgtcagccttgtacatcaagtttctcatggacgagggctatccaacagtatggaaggctttcaaacactctccagcttctttggggcttttgatatattgtttcattgctctctggtttgttggtggacttactggatttcatctatacctcattagcaccaaccagaccacatacgagaattttcggtacagatcagacagcaggcctaatgtttataatcaaggatgtctgaataacttcctagaagtcttctgtagcaagacaaaaccttctaaacacaagttcagagcctatgcacaagaggaactgcgacctcccacagttagctttggtaggggggtcgaagacgaaccagttggtggtcctcggtctaaagttgaagatgatcttgaaattggtagtgatcttttgaagatctctcagcggcgaaactatgaggatgttgatgtagaaatgggaggccgttgcagtaatgagatggaagggatagccaatgccaaacttgggacaggttcagaatcatatattcctgcagttgggagtgatgtacgggtacgacactcaagctgggatcggcgaagtgggaactgggacatgtcatcagatgtacttacaagaagcgcatcagatgtgattgaacgtagtgtgtttgctaccgaggctgcacatccatctcaagcagaaactcactagtgaaatattttgtggattcagaaaatgtgtgggcgatttggattgcaaggccgtttaactcatggtggcacacccaaacagaaaggaagaaaacacccatcatgcattttgattttgactgccttgattgggtttttttcctgatgcttgtcatgtaagagcaattatttagtcaaagaattagccccattggtgtcatattttcgggtgtttgtgccacagcctcatctgacattgtatggtgcatagtcctgtctgtaaattgcaaatgcaatattctcttccaactgtaattcttcttcggctgttttgctttgagaatgtttaatatgcatctcacctagcctttgtcatcatcttgcattgcacctcacattcttctaa

SEQ ID NO: 2868 - DNA, 1977 bp, Sorghum bicolor
cccacacgcacaaaggcgacgcgacgcgacgccagcagcgcttgctttcctctccctgctctgctcggcctcgccgcttccccctcctctacccctgcctctgcctgcctgcctgcctcaacgattcctccgcttttcctttttcaaaatcgcccttttctcgtgcgcgtgtcgactccttcctggttcctgctcgccggcgggtctgggctggggggacggacgctgcctcggatgaggccgcgctgaccggagccggaccacccggcgcccacccatggcgcgtccgcagcgagtgtacgaggcttggaaagggaacaataaattcttctttggtgggaggctcatattcggacctgacgccaagtcactgatcctctctgtttcgctcattgtgatcccggtattggtcttctgcggatttgttgctcggcatctccgccaccatttcccggattacaatgcaggatatgcgattcctgcggtggctgtggtgtttatgatttacgtgctagtcctgctcttggttacatcagcgcaggatcctgggatcgttccccgcgcggcccacccgccggaggaagagttttcttatgggaacgccttgtctgggggcacgcctgggaggctgcaattcccccgtgtgaaggaagtcatggttaaggggatgcctgtgaaagtgaagtattgtgacacctgcatgatttatcggcctcctcgatgctcacactgttcgatatgcaacaattgtgtagagcgctttgaccatcattgtccctgggttggacaatgcattggacagcgcaattaccggtactttttcatgtttgtttcttcctcgactcttctctgcatttatgtatttgcaatgtcagccttgtacatcaagtttctcatggacgagggttatccaacagtatggaaggctttcaaacactctcccgcttctttggggcttttgatatattgtttcattgctctctggtttgtcggtggactcactggatttcatttgtacctcattagcaccaaccagaccacgtacgagaattttcgatacagatcagacagcaggcctaatatctatagtcaaggatgtctgaataactttctagaagtcttctgtagcaagacaaaaccttctaaacacaagtttcgggcatatgcacaagaggaagtgcgacctccaacagttagctttggtagggatgttgaagatgaaccagttggcggtcctcggtcgaaagttgaagatgatcttgaaattggtagtgatcttctgaagatctctcagcggcgcaattatgaggatgttaatgtagaagtgggaggtcctcacaggctcagcagtgagatggaaggcatagccaatgccaaacttgtggcatgttcagaatcacagatccctgcagttgggagcgacgtaagggtgcgacactcaagctgggatcggagaagtgggaactgggacatgtcatcagatgtacttacaagaagcgcatcagatgtaattgaacgtagcgtgtttgccacggaggctgcacatccatctctagcagagactcactagtgaattgtttgtgcattcagaacaatgtgtgtgcagtttggattgcaaggccatttaagttaactcatgttggctcacccagacagcaaggaagaaaacgcctgtcatgcattttgactttgactgccttgattgggttttctttccgacccttgtcaattgtcatgtatgagcaactatttagtcaaagaattagccccattgtgccattatattcgtgtgtttgtgccatagtctcaatctgacgctgtgttgcgtatggtcctgtctgtaaattgcaagtgcaggattctcaatttctcatccaattgtaattcttcttaggctatttctttgagaatgttatctcgcctggccctttttaattatctgcacctcacaggattctaagaagcactgatgctaga

SEQ ID NO: 2869 - DNA, 1783 bp, Zea mays
acaaaggcgacgcgagcagcgtttgcttccctttccctgctgtgctcggcctcgccgcttcctctgccctggctcaacgattcctccgcttttcctttttcaaaatcgccctttcctcgtgcgcgtgtcgactccttcctgctcgccgccgggtctgggctgggtgacgctgcctcggatgaggccgcgctgaccggagccgtagccggaccacccgcccacccatggcgcgcccgcagcgcgtgtatgaggcttggaaagggaacaataaattcttctttggtgggaggctcatattcggacctgacgccaagtcactgatcctgtctgtttcgctcattgtggccccggtattggtcttctgcggattcgttgctcggcatcttcgccaccacttcccggcttacaatgctggatatgcgattcctgcggtagctgtagtgtttatgatttatgtgctagtcctgctcttgattacatcagcgcaggatcctgggatcgttccccgcgcagcccacccgccggaggatgagttttcttatggcaacgctttgtctgggggcacgcctgggaggctacaattcccccgtgtaaaggaagtactggttaatgggatgcctgtgaaagtgaagtattgtgacacctgcatgatttatcggcctcctcgatgctcacactgttcgatatgcaacaattgtgtagagcgctttgaccatcattgcccctgggttggacaatgcattgggcagcgcaattaccggtactttttcatgtttgtttcttcctcgactcttctctgcatttatgtatttgcaatgtcagccttgtacatcaagtttctcatggatgaggattatccaacagtatggaaggctttcaaacactctcccgcttctttggggcttctgatatattgtttcattgctctctggtttgttggtggactcactggatttcatttgtacctcattagcaccaaccagaccacgtacgagaatttccgatacagatcagacagcaggcctaacatctatagccaaggatgtctgaataactttctacaagtcttctgcagcaagacaaaaccttctaaacacaagttccgggcctacgcgcaagaggaagtgcggcctccaacggttagcttcggcagggaggtcgatgaggaaccggtcggcgggcctcggccgaaagttgaggacgatcttgaaattggtaccgatcttctgaagatctctcagcggcgcaactacgaggacgtcgatgcagaaacgggaggccgtcgcagtcgcagcagcgaggtggaaggcacggccagtgccagacctgctgtggcgtgctcggagtcccagatccctgcggtcgggggtactgacgtgagggtgcggcactcgagctgggaccggcgaagcgggaactgggacatgtcggctgtgcttacgaggagcgcgtcagatgtgattggacgtagcagcgtgttcgccgcggacgctgcacgtccatctctagaagagactcgctagcgaactgtgtctgtgcatccaggaaacatgtgcgagcggttcggatagcgaggccatttgactcgtggtggtggtgacacacacccaggtgttttggctttggctgccttgattgggtttttgttaccgacccttgtcagttgtcatgtatggacagttatttttagtcagagaatctgcccccattgttgccggcatgttcgtgtgcctgtaaattgcaaatgcaggatcctcatcaacttcaattcttattgggctgt

SEQ ID NO: 2870 - DNA, 1851 bp, Oryza sativa
gcaagcacgcagcttttctttcttggcctcgcctcgcctcgcctctgcccatctcccctcccactcgattcctccacctctgctccgaatctccctttccgcgtgcgcgcgtcgattcctccgtgctctcaccacccgatttgggggccggtctgagatggggcagtggcactgaccggaggaccttcgccgacgtcgtccatggcgcagccgcagaagcgagtctacgaagcttggaaagggaataataggttcttgtttggtgggaggttgatattcggacccgatgccaagtccctgctcgtctctgtttcgctcatcgtggtgcctgttctcgtcttctgcgtgttcgttgcgcggcatctccggcatcagttctccacctacaacgcaggatatgcgattcctgcggttgcagtactcttcatgatctatgtacttaccttgttgttcatcacctcagctcaggatcctggcattgtgcctcgcgcatcgcatccaccggaggaagagtttgcctatggcaatccattgaacgggggcacaccaggcaggctgcaatttccccgtgtaaaagaaataatggttaatgggatgcttgtgaaagtaaagtattgtgacacctgcatgatttaccggccccctcggtgttcgcactgttcaatatgcaacaattgtgtcgagcgctttgatcatcattgcccttgggttggacaatgcattggacagcgcaattatcgattctttttcctgtttgtttcctcctcgactcttctttgcatttatgtatttgcaatgtcggcgttatacatcaagttcctcatggaggagggctatcctacagtgtggaaggctttgaaacactctccagcatctttggtgcttatgatatactgtttcatcgccctctggtttgttggtggactcactggatttcattcatatctcatttgcactaaccagaccacatacgagaactttcgatacagatcagacaacaggcctaatgtctatgatcaaggatgtctgaataattgcttaggagtcttctgtagtaagacaaaaccttcaaaacacaaattcagagcctatgtacaagaggaagtacgagctccagtagttaactttggcaggcagatggaagaagagccagctggtggccctcgggcaaaagtagaagatgatcttgagatcggtagtgatctcctgcagatctctcagcggcgcaactatggggatgttgatcttgaaatgggaagtcaggactgcagtgagatggaaggcattcccaacgccaaacttgcgataggttctgaatcgcagattcctgcaatcggaagtgaggtacgagtgcggcactcgagctgggatcgtagaagtgggaattgggacatgtcattagatgtaattggaagaagtgcatcagatgtaattagaagaagtgcttctggccatgaggctgcacctccatttcaaacagaaactcactagtcagttattcgtgcattgagaagatgtgtcagaaacctgaacttggatttcaaggctgtttaactgatgatgacagtatgacacatacccagagagcaagaaagaaaaatgcacatgacgcattttgactttgactgccgtaattggtattttcaatcatttttcatgtatgaacagttactttagtcaaagattccgtgcggttggggtcacatatttgtgttttttttttctttttttgtgtggcaatctgatctcacagcgtcttcatgattctttatgtaaattactattgcatgatactcatccacctgtaattcctctgcagcttccttcaggaatttctgtagtgcatctcca

SEQ ID NO: 2871 - DNA, 2982 bp, Oryza sativa
agctggagggggacttcgctggctgggcctggtccaccgtgcaaccatcactgtccctggctgtttgaccatacgcgggcccctcagcgacctggaaactcccgtcctagacccggtgcagggactagtgagcatttgctgcccttttgcttttgtttgcttgcctggctttctttgcgcgtagccctcgcacatttttggattgttttaagaatagttctttgaagtagaaatttttggaattatcagtaagagagtagcaacatgctaccgactagaatttagagtaatttggaggcaaggtttcatttttaagtgtattttgatcatgctaattactcataacttaagtcacaacactttgttctttaccaataggctatgcaaatgagttgaattaattgtagaatgatttaatgtattgccatatgagtgaaatgggagcttaaattaaatacgaaggtacatgttggtataaagatgaaaacatgtcttctagatatgaattaagttttgcaagttgcagtgtatcctcttgaacctatttgtattgaatggttcatacaaatgaaaaagaattctagattactatttagcgcatatttattcatagcatgcaccttttcatataaaagttttcataaaaaagttcttgatgaaagtttcttataaaagtattcccataaaaccttttcagatgaaagttttctagttaaatgtttttcagatgaaaattttctagatgaacgttttcagaaaaagcgtacgatgagaatgcatatgcgctaaatagcagtccttatgaaatcttggttctccgtgaagccgagttaacggtagtgttaaaccttcgataagttttaccactaccaattttacatgtgctatggttggttcgaagttcttttgctgctgaatgttatatgtgtcgttcctataaaatccaaggtttcatttgcaaaaagagcaatagagcacgcagcacacactccctcttcttcttcagcaattcactccagttcactttgccagcttgtctctctgattttattatccttttcttttcctcacgcagggaaaaaggcacccgttgtacacctcacctcacgctcaaaggcaacgcaagcacgcagcttttctttcttggcctcgcctcgcctcgcctctgcccatctcccctcccactcgattcctccacctctgctccgaatctccctttccgcgtgcgcgcgtcgattcctccgtgctctcaccacccgatttgggggccggtctgagatggggcagtggcactgaccggaggaccttcgccgacgtcgtccatggcgcagccgcagaagcgagtctacgaagcttggaaagggaataataggttcttgtttggtgggaggttgatattcggacccgatgccaagtccctgctcgtctctgtttcgctcatcgtggtgcctgttctcgtcttctgcgtgttcgttgcgcggcatctccggcatcagttctccacctacaacgcaggatatgcgattcctgcggttgcagtactcttcatgatctatgtacttaccttgttgttcatcacctcagctcaggatcctggcattgtgcctcgcgcatcgcatccaccggaggaagagtttgcctatggcaatccattgaacgggggcacaccaggcaggctgcaatttccccgtgtaaaagaaataatggttaatgggatgcttgtgaaagtaaagtattgtgacacctgcatgatttaccggccccctcggtgttcgcactgttcaatatgcaacaattgtgtcgagcgctttgatcatcattgcccttgggttggacaatgcattggacagcgcaattatcgattctttttcctgtttgtttcctcctcgactcttctttgcatttatgtatttgcaatgtcggcgttatacatcaagttcctcatggaggagggctatcctacagtgtggaaggctttgaaacactctccagcatctttggtgcttatgatatactgtttcatcgccctctggtttgttggtggactcactggatttcattcatatctcatttgcactaaccagaccacatacgagaactttcgatacagatcagacaacaggcctaatgtctatgatcaaggatgtctgaataattgcttaggagtcttctgtagtaagacaaaaccttcaaaacacaaattcagagcctatgtacaagaggaagtacgagctccagtagttaactttggcaggcagatggaagaagagccagctggtggccctcgggcaaaagtagaagatgatcttgagatcggtagtgatctcctgcagatctctcagcggcgcaactatggggatgttgatcttgaaatgggaagtcaggactgcagtgagatggaaggcattcccaacgccaaacttgcgataggttctgaatcgcagattcctgcaatcggaagtgaggtacgagtgcggcactcgagctgggatcgtagaagtgggaattgggacatgtcattagatgtaattggaagaagtgcatcagatgtaattagaagaagtgcttctggccatgaggctgcacctccatttcaaacagaaactcactagtcagttattcgtgcattgagaagatgtgtcagaaacctgaacttggatttcaaggctgtttaactgatgatgacagtatgacacatacccagagagcaagaaagaaaaatgcacatgacgcattttgactttgactgccgtaattggtattttcaatcatttttcatgtatgaacagttactttagtcaaagattccgtgcggttggggtcacatatttgtgttttttttttctttttttgtgtggcaatctgatctcacagcgtcttcatgattctttatgtaaattactattgcatgatactcatccacctgtaattcctctgcagcttccttcaggaatttctgtagtgcatctccattagctttca

SEQ ID NO: 2872 - DNA, 1911 bp, Brachypodium distachyon
ccccacgcacaaaggcaacgcaagcaatagcagccttttctcgctcagactcgcctcatctcccctctcagttcctcgccccaccacctctctcaaaatccccctttccgtgtgcccgtgtcgattccttcgtgctcgtcgtcgatttggaggcgcttggatgaggcggctgcactgacctgagccgaatccaccgccgcccatggcgcaaccgcagcgagtctatgaagcttggaaagggaataataggttcttccttggagggaggttcatattcggacccgatgccaagtccctgcttgtctcggttgcgctaattgtggtaccggtttttgtcttctgcgtcttcgtcgcgcgataccttctccatcgattctccgtatacaatgcgggatacgcgattcctgctgtagcgatagcgtttatgatctatgtgcttctgttgctgttgatcacctcagctcaggatcctggtattgttcctcgcgcatcacatccaccggaggaagagttttcatatggcaatccattagccggggaaacaccgggcaggctgcaattcccccgtgtaaaggaagtaatggttaatgggatgcctgtgaaagtaaagtattgcgatacctgcatgatttacaggcctccccggtgctctcactgttcgatatgcaacaattgtgttgagcgctttgatcatcattgcccctgggttggacaatgcattggacagcgcaattaccgatacttcttcctatttgtttcttcctcgactcttctttgcatttatgtctttgccatgtcggcattacacatcaagtttctcatggacggggactatcctacagtatggaaggctttcaaacactctccagcttgcttggttcttatgatatattgtttcattgctctctggtttgttggaggtctcactggatttcattcatatcttattagcactaaccagaccacatatgagaattttcgatacagatcggataacaggcctaatgtctataatcaaggatgtctgaataatttcctagaagtcttgtgcagcaaggggaaaccttctaaacacaggttccgagcctatgttcaagaggaagtacgggctccagtagttaactttggtaggcagatggaagaggaaccaactggtggctctcgagcaaaagtagaagatgatcttgagattggcagtgatctcttgaagatctctcagcggcgcaattacgaggatgttgatgtcgaaatgggaaaccaggaccacagtgagatggaaagcatggctaatgccaagcttgtgatgggttcggaatcacagattcctgcagttgtaagtgaggtacgagtacgacactcaagctgggatcagagaagtggaaattgggacatgtcatcagatgtaatgggaaggagtgcatcagatgtaattggaagaagtgcttcagtctctgaggttgcatctcaaagagaaactcactagccaattatgtgtgaattcagaacatgtgtgggctagttggattctgtggttgtttactgatggtgacaaacacacctggagaacaaagaagagcaatgacaatgatacattttgacttttgactgccatatttggtattttcgatcctttttcatgtatggacttattgtagtcaaagtattggcggtattgggggggtcatatattggtattttgtgccattgtcatctgacggtgtctatatcatcgtgtacattactagtgcaggatactcatccacctgtcgttcctctccgtctcttcttctgtgagaatgatgagagcatcttctgttggtttctgagtgtccgactactgcaaaggacttaactggaagactagagcatgaagcctgataatgacaaaccagaagacatcagaattcccag

SEQ ID NO: 2873 - DNA, 1820 bp, Lolium multiflorum
caccgtcaccgcaccagcagagccaccccacgcacaaaggcgacgcaagcaagcagctttcctcgctcactctcgcctctcatctcccccctctcgcgcaccaactctttcaaatccacctttttcgcgtgcccgtgccgattccgtcgtgctcgccgtcgattctggatgaggcggcggcactgaccgggcccgaatcctccgccgccgccgccacatggggcagccgcagcagcgagtctaccaagcttggaaagggaataataagttcatccttggagggaggctcatattcggacccgatgccaagtccctgctcgtctcggttgcgctcattgcggtgcctgttttggtcttctgcgcgttcgtcgcgccgcaccttctccatcgattctctgcgtacaacgcgggatatgcgattcctgccgtagcgattgtgtttatgatctatgtgcttctgttgctgttgaccacctcagctcgcgaccctggtattgtgcctcgagcatcgcatccaccggaggaagattttacgtatggcaacccgttagccggggaaacaccgggcaggctgcagttcccccgtataaaggaagtgatggttaatgggatgcttgtgaaagtgaagtattgtgatacctgcatgatttaccggcctcctcggtgttcgcactgttcaatatgcaacaattgcgtggagcgctttgatcatcattgcccctgggttggacaatgcattggtcagcgcaattacagatactttttcctatttgtttcttcatcgactcttctttgcatttatgtctttgccatgtcggcattacacataaagtttctcatggacgaagactaccctacagtatggaaggctttgaaacactctccagcttgcttggtgcttatgatatattgcttcattgctctctggtttgttggcggactcactggatttcattcgtatctcattagcacaaaccagacgacatacgagaattttcgatacagggcagacagcaggcctaacgtctatgaccaagggtgtctgaataatttcctagaagtactgtgcagtaaggggaaaccttctaaacacaggttccgagcctatgttcaagaggaagtacgcgctccagtagttaactttggtaggcagatggaagaagaaccagctggtggccctcgtgcaaaagtagaagatgatcttgagattggcagtgatctcctgaagatctctcagcggcgcaattacgaggatgttgatgttgaaatgggaagtcaagactacagcgagagtgaaggcacgggcaatgccaaactggggatgggttcaggatcgcagatccctgcggtcggaagtgaggtacgagtacggcactcgagctgggaccaaagaagtggaaactgggacatgtcatcggatgtaattggaaggagcgcatcggatgtgcttgggagaagttcttcactcacccaggttgcatctccatctcgaagagaaaatcactagccggttccgtgagaattatgaatgtgtgttagggagttggattctgcggttggttgcggatggtgacgtacacccggagagcaaagaagaacaatgaccaaatgcattttgacttttgactgccaaatctggtatcttcgatcctatttcatgtatgaagacttgttgtagtcaaaatgatttgtggtaccggggggtcgtttttgcgccgctgtcacccaaaggtgtctatatcattctttatgtaaattactaatgcgggatactcatccacctgtaattcctatccatctcatcttgagaatgtctccag

SEQ ID NO: 2874 - DNA, 2114 bp, Triticum aestivum
agcagctttcctcgcctcatctccctccctctctcccagttcctcgctcgcgcaccaactctttcaaaatcccccactttctcgcgtgcctgcgtcgattccgtccgtcgtgctcgccgccggttcggggcgcgcctggatgaggcggccccgctgaccggagccgaatccgccgcgcgccgcccatggcgcagccgcagccgcagcagcgggtctaccaagcttggaaagggaataataggttcttcctcggagggagactgatattcggacccgatgccaagtccctgctcgtctcggttgcgctcatcgtggtgccggttctcgtcttctgcgccttcatcgcgccgcacctcctccaccgattctccggctacaacgcaggatacgcgattcctgcggtggcagtggggttcatgatctatgtgcttctgttgctgctgatcacctcggctcaggatcctggtatcgtgcctcgtgcatcgcatccaccggaggaagattttgcgtatggcaatccgttagccggggaaacaccgggcaggctgcagtttccccgtataaaggaagtgatggttaatgggatgcttgtgaagataaagtattgcgacacctgcatgatttaccggcctcctcggtgctcgcactgttcgatatgcaacaactgtgtggagcgattcgatcatcattgcccctgggttggacaatgcattggtcagcgcaattaccgatactttttcctatttgtttcgtcctcgactcttctttgcatttatgtctttgccatgtcggcactacacatcaagtttctcatggacggagactatcctacagtatggaaggctttcaaacactctccagcttgcttggtgcttatgatatattgtttcattgctctctggtttgttggcgggctcactggatttcattcatatctcattagcactaaccagacgacatacgagaattttcggtacagagcagacagcaggcccaacgtctatgaccgaggatgtctgaataacttcctagaagtcctgtgcagcaaggggaaaccttctaagcacaggttccgagcctatgttcaagaggaggtacgcgctccagtggttaacttcggtaggcagatggaggaggaaccagctggcggccctcgcgcaaaggtagaagacgatcctgagattggcagcgatctcctgaagatctctcggcggcgcaactacgaggacgttgacgtcgaaatggggaaccaggacgacggtgagaaggaaggcatgggcgacgccaaactggcggcgggttcgggatcgcagatccctgcggtcgggagcgaggtgcgggtgcggcactcgagctgggaccggaggagtgggaactgggacatgtcgtcggacgtgatcggaaggagcgcatcggatgtgcttggaagaagcgcttccctcaccgaggctgcgccgcggtctcaaagagaaactcactagtagccaatatgtgtgaattcttctgaactttgtgttggcgggctgggttctgtgattgtttactgatggtgacacaccgggagaagagggaagaacgatgaccgtgacccattttgacttttgactgccatgttttggtatcttggatcgtgttttatgtatggacagttgttgtggtcgaagggtttagtggtaatgggggtcacatatcggtcttttttgcgccggtgttgtcatctgacagtgttcggtgccattctttgtgtaaattactgatgcgggatactcatccacctgtaattcctcagcagctcttccttggaaatgtctctagtttagcttgcatctcaacttaataagttcttgtcgcgcctttcccgtcccattcttctgatgaacaaggagatatcaaatttagtttgcgtgttgacatcatctatttgtttgcaagcagacgtaaaactctttgtgttcttccggaattgaccgttcgaacttcgaaggttggcagttgctttgttttgagtggaactgcattgagcatcttttttgttggtttcttgggttctctgactgctgcaaagggcggacttgaaccggaggaccggagcacggtgaagccggcctgatagt

SEQ ID NO: 2875 - DNA, 1746 bp, Secale cereale
aactctttcaaaatcccccctttttcgcgtgcctgcgtcgattccgtcgtgctcgccgccggctcggggggcgcctggatgaggcggccccgctgaccggagccgaatccgccgcgcgccgcccatggcgcagccgcagccgcagcagcgggtctaccaagcttggaaagggaataataggttcttccttggagggaggttgatattcggacccgatgccaagtccctgctcgtctcggttgcgctcatcgtggtgccggttctcgtcttctgcgccttcatcgcgccgcacctgctccaccgattccccggctacaacacaggatacgcgattcctgcggtggcagtggggttcatgatctatgtgcttctgttgctgctgatcacctcagctcaggatcctggaatcgtccctcgcgcatcgcatccaccggaggaagactttgcgtatggcaacccgttggccggggaaacacctggcaggctgcagtttccccgtataaaggaggtgatggttaatgggatgcttgtgaagataaagtattgcgacacctgcatgatttaccggcctcctcggtgctcgcactgttcgatatgcaacaattgtgtggagcgattcgatcatcattgcccctgggttggacaatgcattggtcagcgcaattaccgatactttttcctatttgtttcgtcctcgactcttctttgcatttatgtctttgccatgtcggcactacacatcaagtttctcatggacggagactatcctacagtatggaaggctttcaaacactctccagcttgcttggtgcttatgatatattgtttcattgctctctggtttgttggcgggctcactggatttcattcatatctcattagcactaaccagacgacatacgagaattttcggtacagagcagacagcaggcctaacgtctatgaccgaggatgtctgaataatttcctagaagtcctgtgcagcaaggggaagccttctaagcacaggttccgagcctatgttcaggaggaagtacgcgctccagtagttaactttggtaggcagatggaagaggagccagctggtggccctcgcgcaaaggtagaagatgatcttgagattggcaacgatctcctgaagatctctcggcggcgcaactacgaggatgttgatgtcgaaatggggaatcaggacgacagtgagacggaaggcacgggcgacgccaaactggcgacgggttcgggttcgcagattcctgcggtcgggagcgaggtgcgggtgcggcactcgagctgggaccggagaagtgggaactgggacatgtcgtcggacatgatcggaaggagcgcatcagatgtacttggaagaagcgcttcactcaccgaggctgtgccgcggtctcaaagagaaactcactagccaataatgtgtgaattcttctgaaccttgtgttggcgagctgggttctgcgattgtttactgacggtgacaaaccgggagaagagagaagaacaatgaccgtgatccgttttgacttttgacagccatctttgatcgtgttttatgtatgaacagttgttgtagtcaaagggttggcggtaatgggggtcgcatatcggtcttttttgcgccggcgttgtcatctgacagtgttcgatgccattctttgtgtaaattactgatgcaggatactcatccacctgtagttcctcaccagctcttctttggtaaattgtttttttttt

SEQ ID NO: 2876 - DNA, 1904 bp, Pennisetum glaucum
gtggtcgcaggtgcgcgcgccggtgatcgtgccgctgctgcgcctcgcggtggccgtgtgcctcaccatgtccgtgctcctcttcctcgagcggatgtacatggccgtcgtcatctccgtggtgcgcgtcttccgcctccgccccgaccgacgctaccgctgcgaaccgctacccgaggacgacccggagctcggctcctccgccttcccctccgtgctcgtccagatccccatgttcaacgagcgcgaggtgtaccagctgtcgatcggcgcggtgtgcgggctgtcgtggccgtcggaccggctggtggtgcaggtactcgacgactccacggacgaagtgattaaggagatggtgcggatggagtgcgagcggtgggcgcggaaggggatcaacatcacgtaccagatccgtgacgaccggagagggtacaaggccggtgcgctcaaggccgggatgaagcacgcgtacgtgcgggagtgcgagtacgtggccatcttcgacgccgacttccagcccgacccggacttcctcaagcgcaccgtcccctacctcgtgcacaacccggagatcgcactcgtccaggcgcgatggcgattcgtgaacgcggacgaatgcctgatgacgaggatgcaggagatgtccctggactaccacttcacggtggagcaggaagtgagctcctccgtctgcgccttctttggcttcaacgggactgccggcgtgtggcgcattaccgcagttaatgaggccggagggtggaaggacaggaccaccgtggaggacatggaccttgctattcgggcaagcctcaagggctggaagtttgtctacctcggtgatgttcaggtgaaaagtgagctgccgagcaccttcaaggctttccggttccagcagcacaggtggtcgtgcgggcccgcaaacctgttcaggaaaatgctcatggagattgtgacaaataagaaagtgacgatctggaagaagatccatgtcatctacaactttttcttgatacgcaagattattgcacatattattacattttcattctactgcctcatcattccggcaacgatctttgtccccgaggtccgcatacctaagtggggctgtgtttatattccctcggccatcacccttctcaattctgttggcactcccaggtcttttcacttgcttttcttctgggtcgcctttgagaacgtcatgtccctccacagaacaaaagccacattgatcggcttgttagaggctggcagggccaacgaatgggttgtgacagctaagctcggcagcgctatgaagatgaaatcagctaataaaggaggactcaagaaacaatttatgaggatatgggagaggttgcacattacggagctcggtgtgggaaccttcctcttctcctgcggatggtatgatctcgcctatgggagggaccatttttacatctacctcttcttccagtccatagctttcttcattatcggtattggctacgttggcacaatcgtcccgcagtcgtaacagaagtgttcagatcatccgcctctggctttggcattgtcttcagcaagtttcgtagtggataaccagtttgaagtaaagatcataaggtcctctctcccatcgtcttttttggggaccggtcatgtagccttctgttgcatgtgctacttgtaaaataggaaatgcagtgttgtaagatcactgcaggaaaatttagagattggagccgtatgggcaggaaatgttgtggtgtttttgcttatatatttatagcaagtacgtgatgtgtttcaaggggcgcaggatggcttcttccaatgtactagtaacatacagaaaaaaaagaggttcagacatgtgttgagaaaaatcaagtgttcatccttctcttgtacgg

SEQ ID NO: 2877 - DNA, 2070 bp, Sorghum bicolor
gcccgcgccccaacaccgagccgagccgagccccgcaggcagccgcccggcccaggcagccaccaccctgccgacggccacattgcgcgctgctgcctctctccctctctctccgagccggccggccgcaccgtaccgagctagcgagcgaggcgatggacgcggcggcggggacggcggcggcgctgccggaggcgtggtcgcaggtgcgcgcgccggtgatcgtgccgctgctgcggctggcggtggccgtctgcctcaccatgtccgtgctgctgttcctggagcggatgtacatggccatcgtcatcaccggcgtgcgcctgctgcggttccgccccgaccgccggtaccgctgcgacccgttgcccgacgacgacccggagctcgggtcctccgcgttccccgtcgtgctcgtccagatccccatgttcaacgagcgcgaggtgtaccagctatccatcggcgccgtgtgcgggctgtcgtggccggcggaccggctggtggtgcaggtgctggacgactccacggacgaaatgattaaggaaatggtgcggctggagtgcgagcgttgggctcggaaggggatcaacataacgtaccagatccgtgacgaccgcaagggttacaaggccggcgcgctgagggccgggatgaagcacgcgtacgtgcgggagtgcgagtacgtggtgatcttcgacgccgacttccagccggacccggacttcctcaagcgcaccgtcccttacctcgtccacaacccggagatcgcactcgtccaggcgcgatggagattcgtgaacgcggacgagtgcttgatgacgcggatgcaggagatgtccctggactaccacttcaccgtggagcaggaagtgagctcctccgtctgcgccttctttggattcaacggcaccgctggcgtgtggcgcatctctgcgataaacgaggccggagggtggaaggaccggaccacggtggaggacatggatcttgccatccgggccagcctcaagggttggaagtttgtctaccttggcgatgttcaggtgaaaagtgagctgccgagtaccttcaaggcttttcggttccagcagcacaggtggtcgtgcggcccggcaaacttgttcaggaaaatgctcatggagattgtgacaaataagaaagtgacgatctggaagaagatccatgtcatctacaactttttcttgatacgcaagatcattgcacatattatcaccttttcgttctactgcctcgtcatcccagcaacgatctttgtccccgaggtccgcataccgaagtggggctgtgtctacattccctcagccattacccttatgaactctgttggcactcccaggtcatttcacttgcttttcttctgggtcgcctttgagaacgtcatgtccctgcacagaacaaaagccacattgatcggcttgttagaggctggcagggcgaatgaatgggttgtgacagcgaagctcggcagcgctatgaagatgaaagcagctaataaagcgggactcaggaaacagttcatgaggatatgggagaggctgcacgttacggagctcggtgtggcagccttcctcttctcctgcggatggtatgattttgcatatgggagggaccattttttcatctacctcttcttccagtccgtagcattcttcattgtcggtatcggctatgtcggcacaatcgtcccgcagtcgtaacagaagcatgttcgaagcatgttcagatcatccgcctctggttttcgcattgtcttcagcaagtttcgtagtggataaccagtttgaagtaaagatcatgcggtcctctcttccatcgtctttttgggggaccgaccatgtagccttcggttgcatgtgcagtgctactgtaaaataggaaagcagtgttgcaagatcactgcaggaaagtttagagattggtgccatatgggcaggaaatgtcgtggtgtttttgcttatatattatagcaactatgtgctgtgttttaagggggggcaggatggctgcttccaatgtactagtaacatacagaaaaacaggttcaga

SEQ ID NO: 2878 - DNA, 2908 bp, Zea mays
tggagcagcgctgtcgctgtgagagctagcgcagcgcagtgaacatgctcggccacgactcgactgacgcgaccgacgggctcgcgttcgtcggtgctctctaatggcccggatcaatggacggccatgttctttctctacgacgcaaactggatctgcatctcaatttggcgccaatgccaaccgacacacacacacacttgcagtttcatcgagtccacgctaaaatatatatatatatatatatattcgtgctagtaggtaggtcgcagtaaaaaaaaacatctgaaaaatgcttgcgtgcttggtcttcagtagtagattcgaagagagagagagagaaaagaaataagtgcggtgggattgagggaggaggtattaggctattattagggcgtagtacagtgcatacacaaaaccctacggcgtccctctgatgcggcgctgagggctgaggctaagcacgtgggtggtggcctctataaaccccttcactccgggcactcgcatcccgcagcccgccccgtccgcccgcccgagtcacactcacacagagccgagccgagcccaggcaggcaggcaggcggcccaggcgcccagcccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcgtcatctccggggtgcgcctgctccgcctccgccccgaccgccgctaccgctgcgaccccctccccgaggacgacccggagctgggctcctccgcgttccccgtcgtgctcgtccagatccccatgttcaacgagcgcgaggtgtaccagctgtccatcggcgccgtgtgcgggctgtcgtggccggcggaccggctggtggtgcaggtgctcgacgactccacggacgaagtgattaaggagatggtgcggatggagtgcgagcggtgggctcggaaggggatcaacataacgtaccagatccgggaggaccgcaaggggtacaaggccggcgcgctgcgggcggggatgaggcacgcgtacgtgcgcgactgcgagtacgtggccatcttcgacgccgacttccagcccgacccggactacctcaagcgcaccatcccctacctcgtccacaacccggagatcgccctcgtccaggcgcgctggagattcgtgaacgcggacgagtgcctgatgacgaggatgcaggagatgtccctggactaccacttcaccgtggagcaggaagtgagctcctccgtctgcgccttctttggattcaacggcaccgccggcgtgtggcgcatctccgcggtgaacgaggctggggggtggaaggaccggaccacggtggaggacatggatctggccatccgggccagcctcaagggctggaagttcgtctacctcggtgacgtccaggtgaaaagcgagctgccgagtaccttcaaggccttccggttccagcagcacaggtggtcgtgcggcccggcgaacctgttcaggaagatgctcatggagattgtgacgaacaagaaagtgacgatctggaagaagatccacgtcatctacaacttcttcctgatacgcaagatcatcgcgcacatcatcaccttctcgttctactgcgtcatcatcccggcaaccatcttcgtccccgaggtccgcatacccaagtggggctgcgtctacatcccctcggccatcaccctcctcaactctgtcggcactcccaggtctttccacctgcttttcttctgggtcgccttcgagaacgtcatgtccctgcacagaacaaaggccacgctgatcggcttgctggaggccggcagggccaacgagtgggtggtgacggcgaagctcggcagcgccatgaagatgaaatcggctaacaaagcggggctcaggaagcagttcatgaggatatgggagaggctgcacgtcacggagctcggggtggcagccttcctcttctcctgcggctggtacgatcttgcgtacgggagggaccatttcttcatctacctcttcttccagtctgtcgcgtttttcatcgtcggcgtcggctacgtcggcaccatcgtcccgcagtcgtagcggaagcgtgtccagatcatccgcttctctctggttttcgcattgtgtcttgggtaagtttcgtagtggatgaccggtttgaggtaaagatcatgcatgcggtcctctcttccatcgtctttttttggggaccggccgtgtgtgcttcgtcgaccttcggctgcatgcgcggtgttttactgtaaaataggaaagcagtgttgcaagatcgctgcaggagaatttagagattggtgccacatgggcaggagatgtcctggtgtttctgcttatatgctatatcaactatgtgatgtgttttaagggggggtgcaggatggctgcttccaatgtactagtaacatacagagaaacaggttcagacatgtgttcagaaaaaaaagagtcaactattcagccttcttgtagcatgctacattttacatgcgttctcctgttatgtgggcgtattaattagtatgaagcagtagcctctattgagtagagatgagtagatgacaatgggacctgattccccgcgaggaatttccctattaggagacaggtatgagactaatttagtccccaccggatctaagtagggaaatttaatctccgtcaggttcgcgaggattcgcgaactgagaaccatcctctatccatgttccttgtgtacccgcgccatgaaacttttttatccaagttagtcaatttcttttactatattaaaacaccagt

SEQ ID NO: 2879 - DNA, 2056 bp, Saccharum officinarum
cgcgccccaacacagagccgagccccgcaggcagcagcccggccccggcagatacccaggcagccaccaccctgccggcggccacattgcgagctgctgcctctcagagccggacccgagcgaggcgatggacgcggcggcggcgctgccggaggcgtggtcgcaggtgcgcgcgccggtgatcgtgccgctgctgcggctggcggtggcggtgtgcctcaccatgtcggtgctgctgttcctggagcggatgtacatggccatcgtcatcgccggggtgcgcctgctccggttccgccccgaccgccggtaccgctgcgacccgttgcccgaggacgacccggagctggggtcctccgcgttccccgtcgtgctcgtccagatccccatgttcaacgagcgcgaggtgtaccagctgtccatcggcgccgtgtgcgggctgtcgtggccggcggaccggctggtggtgcaggtgctcgacgactccacggacgaaatggttaaggaactggtgcggctggagtgcgagcggtggggtcggaaggggatcaacatcacgtaccagatccgggaggaccgcaagggttacaaggccggcgcgctgagggcggggatgaagcacgcgtacgtccgggagtgcgagtacgtggtcatcttcgacgccgacttccagcccgacccggacttcctcaagcgcaccatcccctacctcgtccacaacccggagatcgccctcgtccaggcgcgatggagattcgtgaacgcggacgagtgcctgatgacgaggatgcaggagatgtccctggactaccacttcaccgtggagcaggaagtgagctcctccgtctgcgccttctttggattcaacggtaccgctggcgtgtggcgcatctctgcgattaacgaggccggagggtggaaggaccggaccacggtggaggacatggatcttgccatccgggccagcctcaaggggtggaagtttgtctacctcggtgatgttcaggtgaaaagtgagctgccgagtaccttcaaggcttttcggttccagcagcacaggtggtcgtgcggcccggcaaacttgttcaggaaaatgctcatggagattgtgacaaataagaaagtgactatctggaagaagatccatgtcatctacaactttttcttgatacgcaagatcattgcgcatattatcaccttttcgttctactgcctcatcatcccagcaacgatctttgtccccgaggtccgcataccgaagtggggctgtgtctacattccctcagccattacccttatgaactctgttggcactcccaggtcatttcacttgcttttcttctgggtcgcctttgagaacgtcatgtccctgcacagaacaaaagccacattgatcggcttgttagaggctggcagggcgaatgaatgggttgtgacagcgaagctcggcagcgctatgaagatgaaagcagctaataaagcgggactcaggaaacagttcatgaggatatgggagaggctgcacgttacggagcttggtgtggcagccttcctcttctcctgcggatggtatgattttgcgtatgggagggaccattttttcatctacctcttcttccagtccgtagcatttttcatcgtcggtatcggctacgttggcacaatcgtcccacagtcgtaacagaagcatgttcagatcatccgcctctggttttcgcattgtcttcagcaagtttcgtagtggataaccagtttgaagtaaagatcatgcggtcctctcttccatcgtctttttggggaccaaaccatgtagccttgggttgcatgtgcagtgctactgtaaaataggaaagcagtgttgcaaggtcactgcaggaaaatttagagattggtgccatatggggcaggaaatgtcgtggtgtttttgcttatatattatagcaactatgtgctgtgtattaagggggtgcaggatggctgcttccaatgtactagtaacatacagaaaaacaggttcagacatgtgttgagaaaaaaaaaatcaagtgttcatcct

SEQ ID NO: 2880 - DNA, 2098 bp, Oryza sativa
cattaattgcgcctcctccgctcgctcctccgcctcgtctcgtcgtcgtcggcgccggcgcggagagggagggagaccgacgagcggcggcgaggaggaatggaggtgaacggcggcggggcggcggggctgccggaggcgtggtcgcaggtgagggcgccggtgatcgtgccgctgctgaggctggcggtggcggtgtgcctgaccatgtcggtgctgctgttcctggagaggatgtacatggcggtggtcatctccggcgtcaagatcctgcgccgccgccccgaccgccgctaccgctgcgaccccatccccgacgacgaccccgagctcggcacctccgccttccccgtcgtcctcatccagatccccatgttcaacgagcgcgaggtgtaccagctgtcgatcggggcggtgtgcgggctatcgtggccgtcggatcggctggtggtgcaggtgctcgacgactccactgaccccgtcatcaaggagatggtgaggatagagtgtgagaggtgggcccacaagggggtgaacataacgtaccagatccgggagaaccgcaaggggtacaaggctggtgcactcaaggaggggatgaagcatggctacgtccgcgaatgcgagtacgtggccatcttcgacgccgacttccagccggaccctgatttcctccgccgcaccatccccttcctcgtccacaactccgacatcgccctcgtccaggcccgctggcgtttcgtgaatgcagatgagtgcttgatgacaaggatgcaggagatgtccttggattaccacttcacagtggagcaggaagtgagctcctctgtctgcgcattcttcggcttcaatggaactgctggtgtgtggcgcgtttccgcggtaaacgaggcgggaggatggaaggaccggaccacagtggaggacatggatctggcaatcagggcgagtcttaagggatggaagtttgtctaccttggagatgttcaggtcaaaagtgagctgccaagtactttcaaagcctttcggtttcagcagcacaggtggtcatgtgggccggcaaacctgttcaggaagatgctgatggagattgtgagaaataagaaagtgacaatctggaagaagattcatgtcatctacaacttctttttgatccgcaaaatcatcgcgcacatcgtgacctttgcgttctactgcttgattatcccggcaactatctttgtccctgaggtcaggataccaaagtggggctgtgtgtacattcccacaatcatcacccttctcaattccgttggaactcccaggtcttttcacttgcttttcttctggatcctctttgagaatgtcatgtcactgcatagaacaaaggccactctcatcggcctgttagaagccggtagggcgaacgaatgggtcgtcaccgagaagctcggcaacgctctgaagatgaaatcatcaagcaaatcatcagccaagaaatcgttcatgagggtatgggacaggctaaacgtcacggagctcggcgtggcggcattcctcttctcctgtggatggtatgatcttgcattcgggaaggaccatttcttcatctacctcttcttccaaggcgcggcgttcttcatcgtcggtatcggatacgttggcacaattgttcctcaatcataacagaagagaagcaaatatatatattttcgagatcggccgccttcaaattcaccatgtcttcagcaagagtctagtagttatataaatcagtttgaagtaaagatcatgcagcatttttttactctcatttttctctgtttcttttcttttctttttcttttcttctttgcctttttctctgttatgtgctattgtaaaaaatagtgcagtgtaaggtcactgcaggaagaaaaaactagggcaattggtgtgatctgggcaaggaggaggtgaggaggatatcgtgatgtgtttttgcttgtagcaaagtacgtgagtggtatgcttaaagaggagcaggatgactctgcttccgttgtactgtaataacatacagaaaaaaaaaaggtcagacaagtgctggacaaaaccaaaatgttcagccttctctcgc

SEQ ID NO: 2881 - DNA, 2151 bp, Oryza sativa
ccccgctctctcccacgctctcccaccactccactctccaatcccattaattgcgcctcctccgctcgctcctccgcctcgtctcgtcgtcgtcggcgccggcgcggagagggagggagaccgacgagcggcggcgaggaggaatggaggtgaacggcggcggggcggcggggctgccggaggcgtggtcgcaggtgagggcgccggtgatcgtgccgctgctgaggctggcggtggcggtgtgcctgaccatgtcggtgctgctgttcctggagaggatgtacatggcggtggtcatctccggcgtcaagatcctgcgccgccgccccgaccgccgctaccgctgcgaccccatccccgacgacgaccccgagctcggcacctccgccttccccgtcgtcctcatccagatccccatgttcaacgagcgcgaggtgtaccagctgtcgatcggggcggtgtgcgggctatcgtggccgtcggatcggctggtggtgcaggtgctcgacgactccactgaccccgtcatcaaggagatggtgaggatagagtgtgagaggtgggcccacaagggggtgaacataacgtaccagatccgggagaaccgcaaggggtacaaggctggagcactcaaggaggggatgaagcatggctacgtccgcgaatgcgagtacgtggccatcttcgacgccgacttccagcccgaccctgatttcctccgccgcaccatccccttcctcgtccacaactccgacatcgccctcgtccaggcccgctggcgtttcgtgaatgcagatgagtgcttgatgacaaggatgcaggagatgtccttggattaccacttcacagtggagcaggaagtgagctcctctgtctgcgcattcttcggcttcaatggaactgctggtgtgtggcgcgtttccgcggtaaacgaggcgggaggatggaaggaccggaccacagtggaggacatggatctggcaatcagggcgagtcttaagggatggaagtttgtctaccttggagatgttcaggtcaaaagtgagctgccaagtactttcaaagcctttcggtttcagcagcacaggtggtcatgtgggccggcaaacctgttcaggaagatgctgatggagattgtgagaaataagaaagtgacaatctggaagaagattcatgtcatctacaacttctttttgatccgcaaaatcatcgcgcacatcgtgacctttacgttctactgtttgattatcccggcaaccatctttgtccctgaggtcaggataccaaagtggggctgtgtgtacattcccacaatcatcacccttctcaattccgttggaactcccaggtcttttcacttgcttttcttctggatcctctttgagaatgtcatgtcactgcatagaaccaaggccactctcatcggcctgttagaagccggtagggcgaacgaatgggtcgtcaccgagaagctcggcaacgctctgaagatgaaatcatcaagcaaatcatcagccaagaaatcgttcatgagggtatgggacaggctaaacgtcacggagctcggcgtggcggcattcctcttctcctgtggatggtatgatcttgcattcgggaaggaccatttcttcatctacctcttcttccaaggcgcggcgttcttcatcgtcggtatcggatacgttggcacaattgttcctcaatcataacagaagagaagcaaatatatatattttcgagatcggccgccttcaaattcaccatgtcttcagcaagagtctagtagttatataaatcagtttgaagtaaagatcatgcagcatttttttactctcatttttctctgtttcttttcttttctttttcttttcttctttgcctttttctctgttatgtgctattgtaaaaaatagtgcagtgtaaggtcactgcaggaagaaaaaactagggcaattggtgtgatctgggcaaggaggaggtgaggaggatatcgtgatgtgtttttgcttgtagcaaagtacgtgagtggtatgcttaaagaggagcaggatgactctgcttccgttgtactgtaataacatacagaaaaaaaaaaggtcagacaagtgctggacaaaaccaaaatgttcagccttctctcgcattccacta

SEQ ID NO: 2882 - DNA, 1980 bp, Hordeum vulgare
ccgcccgacaaatcatggcctcgctttgcactgttaaatccccgccctttacttatcaccacgccgctgtaggagtgtaccctattccgcactcattttacactccttggaaacggaaggaatccatggcgcacaaaaccctactaccatgtgcagctgcgcctcccaccccttttataaaaccccgcacacacactccatcccccaaagcagctccccccagtcccccacccagctcgctccacactgcccgtcccgcagcccctggcgcgctagcttgctctagctaggccagcaaggtcgcgcgcgcgccattaatcttcctcgcccgcggcattgcctcgtcccggccggcggcgaggggatccagctttggccaagggcttagcaggcgagcgatggacgcggcggtggggctgccggacgcgtggtcgcaggtgcgggcgccggtgatcgtgccgctgctgaagctggccgtggcggtgtgcctgctcatgtcggtgctgctcttcctcgagcggctctacatggcggtggtcatcgtcggggtgaagctcctcggccgccgcccggagcggcggtacaaatgcgaccccatctccgaggacgacgacccggagctcggcagcgccgccttccccgtcgtgctcgtccagatccccatgttcaacgagcgggaggtgtatcagctgtcgatcggcgcggtgtgcgggctgtcgtggccgtcggatcggttggtggtgcaagtgctggacgactccacggaccccctcatcaaggaaatggttcggatggagtgcgagcggtgggcgcacaaggggatcaacatcacgtaccagatccgggaggaccgcaaggggtacaaggccggcgcgctcaaggcggggatgaagcacgggtacgtgcgcgagtgcgagtacatggtcatcttcgacgccgacttccagccggaccccgacttcctccaccgcaccatcccctacctccaccacaacccggagatcgccctcgtccaggcgcgatggaggtttgtgaacgccgatgaatgcttgatgacgaggatgcaggagatgtccttggattaccacttcaaagtggagcaggaagtgagctcctccgtctgcgccttcttcggcttcaacggaaccgccggtgtgtggcgcatttctgcagtgaatgaagcagggggctggaaggaccggaccaccgtggaggacatggatctggctatccgggccagcctcaagggatggaagtttgtctacctcggcgatgttcaggttaagagtgaactccccagcactttcaaagccttccggtttcagcagcacagatggtcttgtggtccggcaaacctgttcaggaagatgctgttggagattgtgacaaacaagaaagtgacaatctggaagaaattccatgtcatctacaacttcttcttggtgcgcaagatcgtcgcccacattgtgacattcaccttctactgcataatcatcccgacaaccatctttgtccctgaggttcatataccaaagtggggttgcgtctacattccaaccatcatcaccctcctcaattctgttggaactcccaggtctttccacttgcttttcttctggatcctcttcgaaaacgtcatgtcgctgcatagaaccaaggccacattgattggcttgttagaggcaggcagggcgaatgaatgggtcgtcacggagaagctcggcagcgccatgaagatgaaatccgctaacaaagcatcagccaggaagtcattcatgaggatgtgggagaggttaaacgttccggagctcggcgtgggagccttcctcttctcatgtggatggtacgatgtcgcgttcgggaaggacaatttcttcatataccttttcttccagtcgatggctttcttcgtcgtcggggttggctacgttggcacaatcgtcccaccgtcataactgaaagaacgtcgggatcatgcgc

SEQ ID NO: 2883 - DNA, 2114 bp, Hordeum vulgare
cagctccccccagtcccccacccagctcgctccacactgcccggcccgcagcccctggcgcgctagcttgctctagctaggccagcaaggtcgcgcgcgcgccattaatcttcctcgcccgcggcattgcctcgtcccggccggcggcgaggggatccagctttggccaagggcttagcaggcgagcgatggacgcggcggtggggctgccggacgcgtggtcgcaggtgcgggcgccggtgatcgtgccgctgctgaagctggccgtggcggtgtgcctgctcatgtcggtgctgctcttcctcgagcggctctacatggcggtggtcatcgtcggggtgaagctcctcggccgccgcccggagcggcggtacaaatgcgaccccatctccgaggacgacgacccggagctcggcagcgccgccttccccgtcgtgctcgtccagatccccatgttcaacgagcgggaggtgtatcagctgtcgatcggcgcggtgtgcgggctgtcgtggccgtcggatcggttggtggtgcaagtgctggacgactccacggaccccctcatcaaggaaatggttcggatggagtgcgagcggtgggcgcacaaggggatcaacatcacgtaccagatccgggaggaccgcaaggggtacaaggccggcgcgctcaaggcggggatgaagcacgggtacgtgcgcgagtgcgagtacatggtcatcttcgacgccgacttccagccggaccccgacttcctccaccgcaccatcccctacctccaccacaacccggagatcgccctcgtccaggcgcgatggaggtttgtgaacgccgatgaatgcttgatgacgaggatgcaggagatgtccttggattaccacttcaaagtggagcaggaagtgagctcctccgtctgcgccttcttcggcttcaacggaaccgccggtgtgtggcgcatttctgcagtgaatgaagcagggggctggaaggaccggaccaccgtggaggacatggatctggctatccgggccagcctcaagggatggaagtttgtctacctcggcgatgttcaggttaagagtgaactccccagcactttcaaagccttccggtttcagcagcacagatggtcttgtggtccggcaaacctgttcaggaagatgctgttggagattgtgacaaacaagaaagtgacaatctggaagaaattccatgtcatctacaacttcttcttggtgcgcaagatcgtcgcccacattgtgacattcaccttctactgcataatcatcccgacaaccatctttgtccctgaggttcatataccaaagtggggttgcgtctacattccaaccatcatcaccctcctcaattctgttggaactcccaggtctttccacttgcttttcttctggatcctcttcgaaaacgtcatgtcgctgcatagaaccaaggccacattgattggcttgttagaggcaggcagggcgaatgaatgggtcgtcacggagaagctcggcagcgccatgaagatgaaatccgctaacaaagcatcagccaggaagtcattcatgaggatgtgggagaggttaaacgttccggagctcggcgtgggagccttcctcttctcatgtggatggtacgatgtcgcgttcgggaaggacaatttcttcatataccttttcttccagtcgatggctttcttcgtcgtcggggttggctacgttggcacaatcgtcccaccgtcataactgaaagaacgtcgggatcatgcgctctgcagttcacagttccctgagaaatcagcaaaagattagttggccgtgcatagccagtttaaaagtaaagatcacgcagtcttctcggggtttctctctgttttccttcctctttggagactgatagtattgcagcattcccttgaatgtgctattgtaaaagaaagccaagtgcggtgtaaggtcactgcatgtgtatttgtggtgttctctttttgcttgtagcaagtacgtgccgtgattatggggagcaggatgtctctgcttccaagtcgaatgtaatactaatagtataagaaagaaaaaaaggttcaggcatgtgtgtgcaagatcgaattgttc

SEQ ID NO: 2884 - DNA, 2039 bp, Secale cereale
gctccacactggccagcccgcagcccctggcacggtagccagctctagctaagctagcaaggccgcctcgcgcgtggcattgcctcgtcccgaccgccggcgaggggatctagcttagcttggccaagggcaaggcgggcgatggacgcggcggtggggctgccggacgcgtggtcgcaggtgcgggcgccggtgatcgtgccgctgctgaagctggcggtggcggtgtgcctgctcatgtcggtgctgctcttcctggagcggctctacatggcggtggtcatcgtcggggtgaagctgctcggccgccggcccgagcgccgctacaaatgcgaccccatctccgaggacgacgaccccgagctcggcagcgccgccttccccgtcgtgctcgtccagatccccatgttcaacgagcgggaggtgtatcaactgtcgatcggcgcggtgtgcgggctgtcgtggccgtcggatcggctggtggtgcaggtcctggacgactccacggaccccctcgtcaaggaaatggttcggatggagtgcgagcggtgggcgcacaaggggatcaacatcacgtaccagatccgggaggaccgcaaggggtacaaggccggcgcgctcaaggccgggatgaagcacgggtacgtgcgcgagtgcgagtacatggtcatcttcgacgccgacttccagccggaccccgacttcctgcaccgcaccatcccctacctccaccacaacccggagatcgccctcgtccaggcccgatggaggtttgtgaacgcggatgaatgcttgatgacgaggatgcaggagatgtccttggattaccacttcaaagtggagcaggaagtgagctcctccgtctgcgccttcttcggcttcaacggaaccgccggtgtgtggcgcatttctgcagtgaatgaagcaggaggctggaaagaccggaccaccgtggaggacatggatctggctatccgggcaagcctcaagggatggaagtttgtctacctcggcgatgttcaggttaagagtgaactccccagcactttcaaagccttccggtttcagcagcacagatggtcttgtggtccggcaaacctcttcaggaagatgctggtggagattgtgacaaacaagaaagtgacaatctggaagaagttccatgtcatctacaacttcttcttggtgcgcaagatcgtcgcccacattgtgacattcaccttctactgcatcatcatcccgacaaccatcttcgtccctgaggttcatataccgaagtggggttgcgtctacattccaacaatcatcacccttcttaactctgtcggaactcccaggtcttttcacttgcttttcttctggatcctctttgaaaacgtcatgtcgctgcatagaaccaaggccacattgattggcttgttagaggcaggcagggcgaacgaatgggtcgtcacggagaagctcggcagcgctatgaagatgaaatctgctaacaaagcatcagccaggaagtcattcatgaggatgtgggagaggctaaatgttcctgagcttggcgtgggagccttcctcttctcatgtgggtggtacgatgtcgcgttcgggaaggacaatttcttcatataccttttcttccagtcgatggctttcttcgtcgtcggggttggctacgtcggcacgatcgtccctcagtcataactgaaagaacttcgggatcatccgctccggagttcacagttcccctgagaaatcagcaaaagttagttggccgtgcatagccagttcaaaagtaaagatcacgcagtcttctctgggtttctctctgttttccttcctctttggagactgatagtattgcagcattcccttgaatgtgctattgtaaaagaaagcgagggtgcagtggtaaggtcactgcatgtgtatttgtggtgttctctttttgcttgtagcaagtacgtgcccgtggttatggggagcagggtgtctgcttcccagtcgaatgtaatactaatagtataagaaagaaaaaaggttca

SEQ ID NO: 2885 - DNA, 2204 bp, Brachypodium distachyon
gtgccggctggcttagcttagcttagcttaagctcgcccttcccttttataaaaccccgcacacacactctcacttccccatcccccaaagcaaagctcccagctcgcactgctcacaccccagcagccactggccagtgctagcgaggctagcgaggtcgcgcgcgccattaattgcctggctgcaggccggtggcggggatctctctgaagcttagctaggtaggtggcaatggaggcggcggtggggctgccggaggcgtggtcgcaggtgcgggcgccggtgatcgtgccgctactgcggctggcggtggcggtttgcctggggatgtcggtgctgctgttcctggagcggctgtacatggccgtggtcatcgtgggggtcaagctcctgggccgccgccccgaccgccgctacaagtgcgacccaatctccgaggacgacgaccccgagctcggctccgccgccttccccgtcgtcctcgtccagatccccatgttcaacgagcgcgaggtgtaccagctgtcgatcggggccgtctgtgggctgtcgtggccgtcggatcggctggttgtccaggtgctggatgactccacggacgccgtcgtcaaggaaatggttcggatggagtgcgagcgatgggcgcacaaggggatcaacatcacgtaccagatccgggaggaccggaagggttacaaggccggggctctgaagcaagggatgaagcacgggtacgtgcgcgaatgcgagtacgtggtgatcttcgacgccgacttccagccggaccccgacttcctccaccgcaccatcccttacctccaccacaacccggagatcgccctcgtccaagcacggtggagattcgtgaacgcagatgagtgcttgatgacaaggatgcaggagatgtccttggattaccacttcacggtggagcaagaagtgagctcctctgtctgcgcctttttcggcttcaacgggactgccggtgtgtggcgcatttctgcggtgaatgaagcaggaggctggaaggaccggaccaccgtcgaagacatggatctggctatccgggccagcctcaagggatggaagtttgtctacctcggcgatgttcaggttaagagtgaactaccgagcactttcaaagctttccggtttcagcagcacagatggtcgtgtggtccagcaaacctattcaggaagatgctgttggagattgtgacaaataagaaagtgacgatctggaagaagtttcatgtcatctacaacttcttcttggtgcgcaagatcgtcgcgcatattgtgacctttacattctactgcattatcatcccgacaaccatttttgtccctgaggttcatataccaaagtggggctgtgtctatattcccacaatcatcacccttctcaattctgttggaactcccaggtctttccacctgcttttcttctggatcctgttcgagaatgtcatgtcgctgcatagaaccaaggccacactgattggcttgttagaggccggcagggtgaacgaatgggttgtcacggagaagctcggcaacgctatgaagatgaaatctgctagcaaagcatcagccaggaaatcattcatgaggatatgggataggttaaatgttcctgagcttggcgtgggagctttcctcttctccatcggatggtacgatgttgcatttgggaaggacaatttcttcatataccttttcttccaatccatggctttcttcattgtcggtgttggctacgttggcacaattgtcccgcagtcataactgaaaagcatgtcgtcgagatcatcggcctccggttcgcaattcctcaagaggattcagcaaaaaaaaacacaagcagtgcatagccagtttgaagtaaagatcacgcagtcttctctcgatttccgtcttttcttccctttttggagactgatattgcagcattctcttgtatgtgctattgtaatagaaagtgaggtgcagcgcagcgcagtgcaaggtcactgcaggaatattgtggtgtttttctttctttcttttttcttgtagcaagtacgtgccgtgattaaggggagcaggatggtcgcttcaaagttcatgtaatactaatagtataagaagaaaaggagaggttcagaaaagtgttgagaaaaatcaaattgttcgacccttctcgtctatgacactgcatttt

SEQ ID NO: 2886 - DNA, 3064 bp, Sorghum bicolor
gccatttttgctccctgttccttcagcttccgcctcctcctccctcccctcgcacccacggcagctttgcgtttgctggctacctccccctcctcttcctcctccctggatttgggcgacaaaagctagaggagagagagagaaggccaaagcaaagcaggcagccagcgcgagcagggatgtagagagagaaaaagagcagcacacacaagaagcctcactttctctctcctccaccaccccctttttctctcccctcccctgcacacaacacaagcactccgtccgttctctccccttgtcgtcgtcctcccctccgcctcctctgccaccccgtgtcctattcctcctagcacccaccacccagctcccccctgtaatctctccctctcagtcagtagtaggagcaagtactacgaggctacaagtagtaggccttggtaccgacgaatcccagctcccgcggtcgtccgtccgtcctagtagaggctaagctggcgaggagggtggcggcagctgcattgccggcaggggagattcccggcctgcgccgtttcctccccactggttggtcggctggcggctccgccttctgaaaaaagaagtcccaatcttggcgcgcgcgcctcgtggcgggcgggcgggtggccggccggccggctgattcggccttgcgccgtggctaattcggcctgagattcgaggatccccggtgaaagcctcgccgcgggtcttgagtggatcctggatttgaggcttcctgttgcttcaggaatcacggcttgaggaggtggcggcggcggcggcggcggggtgacagatccctcttccttctgcgccacctgctgagctcagcaggagctatgagacaatgacggaagagagcgccaagaagagcaagctttcatggtccaagtccctcgtgaggaagtggttcaacatccggcccaaggcgcaggacttccatgcggatttcgacgccagccaggcaagggatggtggtggtggatcatggaagcccagctgttcctcaagcgaagcaagcgcaagcactgctgccaagaaaagcagaactgaccgatcgtcgtcaaagcggagtgctgaacgcgctcgccgagggaagaataattttgatgcagcacgcctgacagaagtgcaagattacaggatctttgctgcaacgtggaacgtcggtggtaagtcaccaccaagggggctaaatttagatgaatggctccatacttctcctcctgccgatatctatgtcttagggtttcaagagattgtccctttgaatgcgggaaacgttcttggcactgaagataaccttccagccaagaagtgggtgtcccttattaggcggacactgaacaagaatcctggagctagtggttgtggtggctatcatacaccttcaccagtcctggatccagttgtagaactggatgctgattttgaggggtctgcaagaaggcaggagaacttctcattctttcatcgccggtcgttccacaacctcagccgtagtttaagaatggatggggacttcatgttcccacaaccaaggctagatcgcaggtttagcgtttgcgatccagtcaacttaggaggcagaccaagtgattttgatgggaatctgcgctgccctggatcacctgatgaggataacatagatatggaagtgagcgatggtgcacaaatttcaccattccctcatagctacagtgcatctgcaccttctgaacaaaatgatgatcaatcaaacagctctaggtattgcttggttgccagcaaacaaatggttggcatatttctcacagtgtgggtacgcaatgaaataagagatgatgtcagaaacttgaaagtttcttgtgtgggcagaggattgatgggttatcttggaaataagggttcaatttcaataagcatgtctttgcaccagacaagcttctgcttcatatgttgccatttgacatcaggggaaaaggagggggatgaactgcgcaggaattccgatgttctggaaattttaagaaagactagattcccacgggttcgtggtgctggtgatgttaagtcacctgaaacgattcttgatcatgatcggattatatggctaggggatttgaattatcggattgccctatcatattgttcagcaaaggctcttgtggaaatgcataactggaagcaattattggagaaagatcagctgcggatgcaacaaagatatggacgagttttccaaggttggagagaagggaggatctattttcctcccacatacaaatattcattcaactcagatcggtatgctggagagggtaggcaccctaaagagaagaggagaacaccagcatggtgtgatcgcattctctggtatggtaacggcctcaatcagctgtcttatgttcgtggcgagtctcgtttctccgaccacaggccggtgtacagtatcttcctggcagaggttgacattgtacaccaaaggaggagaaacatgggatatttcagctctagaatcgaggtggaagagctcttgccgcattctcagagctatagagaaataaagttttattgagtttgacttatagcatgatataaggttaggaggttggtcaaatgttctatatgtagggttccagattcagttctctagatgatcagatataccgaagacagaatgtgcaaatactaactgaatgaaaaggacattgggcaattttgctgctgatcaacagaaaacgatggctatgtcgtcggagatgtaccagcccatgtcgctaactatacatttcatccaactttagcccccttagttcctcctagtcctagcgacatatttgcttcatttttttttgttcgcttttttggtagttgaaccctggagtgtcaacaaacacaacaacatgttttctttttcttttcttttgctttgcttcttttccttcaagactagaaactttgtaaaaccagctaatgtttgtgtaccccagcaagtcgtggacccgttttaaggcagtgaatgatacatggaatgaattagcttcaggatgatatatat

SEQ ID NO: 2887 - DNA, 1652 bp, Pennisetum glaucum
tggaggccaagctgctccgcgagcgaagcaagttcaggcacggccaagaaaagcagaactgaccggtcgtcatccaagcggagtgccgaacgcgctcgccgagggaagaataattttgatgtagcacgcctgactgaagtccaagattacaggatctttgctgcgacgtggaatgtcggtggtaagtcaccaccaagggggctgaatttagatgaatggctccatacttctcctcctgccgatatttatgtattagggtttcaggagattgttcccttgaatgctggaaacgttcttggcactgaagataaccttccagccaagaaatgggtgtcccttatcaggcgaacactgaacaagaatcctggagctagtggttgtggtggctatcataccccttcaccggtcctggatccagttgtagaattagatgctgattttgagggtctgcaagaaggcaggagaatttttctttcttccaccggcggtcgttccacaacctcagccgtagtttaagaatggatggggacttcatgttcccacagccaagactggatcgcaggtttagcgtttgcgatccagtcaacttgggaggcagacccagtgattttgatggaaattcaagatgccctggatcccctgatgaggagattattgatatggaagtgagcgatgctgtgcaattttcaccatttcctcatagctacactgcatctgcaccttctgaacagaatgatgagcaatcaaacagctctaggtattgcttagttgccagcaaacaaatggttggcatatttctcacggtttgggtacgcaatgaaataagagatgatgtgagaaacttgaaagtttcttgtgttggcagaggattgatgggctatcttgggaataagggttcaatttcaataagcatgtctttgcaccagacaagcttctgcttcatctgttgtcatttgacctcaggggaaaaggaaggtgatgaactgcgcaggaattccgatgttctggaaattttaaggaagaccaggtttcctcgggttcgtggttctggtgatgttaagtcacctgaaactattcttgagcatgatcgtattatatggcttggggatttgaattatcggattgccctgtcgtattgttcagcaaaagctcttgtggaaatgcataactggaagcaattattggagaaagatcagctccgcatgcaacaaaggtatggacgagttttccaaggttggaaagaaggaaggatatattttcctcccacatacaaatattcattcaactcagatcggtatgctggagagggcatgcaccccaaagaaaagaggagaacaccagcatggtgtgatcgcatcctctggtatggtaatggcctcaatcagctgtcttatgttcgtggagaatctcgtttctccgaccacaggccggtgtacagcattttcttggcagaggttgacattgtacaccagaggaggagaaacatgggctatttcagttctagaattgaggtggaagagctcttgccgcattctcagagctacagagaaataaagttttactgagtggacctttagcttgatgtaaggttaggaggtgggtcaaatgttctatatgtagggttccagattcagctcactagatgatcagat

SEQ ID NO: 2888 - DNA, 3035 bp, Zea mays
ctcttccctccctgggggtttgggcgacaaggccgagagagagagaaaaaaaaaaggtggaggagagacaaggccaaagcaaagcagccagcgcgagcaggcgaggtagagagagagagaaaaaaagagcagcgccacgaacagaacaacaagcctcgcctcactttctctctcctccaccatccctttttttctctctctctactctctccccttgtcgtcctccggccctctccgcattcctctccccctgccacctcgtgtcctactactccaactcctagcacccccaccccacctccccctgtattctctctagtagtagcaactagcaagtgctacggggctacagcctacaagtagtaggccttggtacccagccgacgaatcccggctcccgcgtcgtcctagaggccggctaaagctggcgaggagggtggcggcgcggcggcagctgcactgccggcaggagagagcttctcggcctgcgccgtttgctgctccccactggtcgttggagggctggcggttccgccctctggaaaaaaaaaaaaaatccaatcttggctcggctcggctcgtggcggccggctgcctgatcgggcctcgccccgtggctagttcgatctgagattcgaagaccacccccgggtgaaaacctctccgcctctgaggagtggatcctggattcgagtcttcccgctgcagggagatcgcggcttgaggaggtacggtggtggtggtggcggcgcggcgacagatccccctatgcgccgcctgccgtgccgtgtgctgagcgcggagcaggagctatgagacaatgacggaagaaagcgccaagaagagcaagctttcgtggtccaagtccctcgtcaggaagtggctcaacatccggcccagggcgcaggacttccatgccgatttcgacgccggccaccaggcaagggacggcggcggcggcggcggtggatcatggaggcccagctgttcctcgagcgaagcgagcgcaagcactgccaagaaaagcagagctgaccggccgtcgtcgaagcggagcgccgaacgcgctcgccgagggaggaataatttcgacctagcacgcctgacagaagtgcaagattacaggatcttcgctgcgacgtggaacgtgggtggcaagtcaccacccagggggctaaatctagatgaatggctccatacttctccttctgccgatatctatgtcttagggtttcaagagattgtccctttgaacgcgggaaacgttcttggcactgaagataaccttccagccaagaagtgggtgtcccttatcaggcggacgctgaacaagaatcctggatctagtggctgtggtggtggctaccatacaccctcaccagtcctggatccggttgtcgagttagacgccgacttcgaggggtctgcgagaaggcaggacaacttctcattcttccaccgtcggtcgttccacaatctcagccgtagcttaagaatggacggggacttgatgttcccgcagccaaggctagatcgcaggttcagcgtctgcgatccagtcaacctaggaggcagaccaagcgattttgatggaagtctgcgttgccccggatcacctgatgaggatacaatcgatatggaaatgggtgacagcgtacaagtttcaccattccctcatagctacagtgcatctgcaccttccgaacagaacgatgaccaatcaaacagctccaggtattgcttagttgccagcaaacaaatggtcggcatatttctcacggtctgggtgcgcaatgaaataagagacgacgtcaggaacttgaaagtctcttgtgtgggtagaggattgatgggttatctcggaaacaagggttcgatttcagtgagcatgtgcctgcaccagacgagcttctgcttcgtatgttgccacctgacctcgggggagaaggaaggcgacgagctgcgcaggaactccgacgtcctggagatcctaaggaagaccaggttcccgcgggtccgcggcgccggtgacgtcaggtcacctgagacgatcctcgagcacgatcgggttatatggcttggggatttgaactaccggatcgccctgtcttactgctcggcgaaggctctcgtggaaatgcatagctggaagcagttattggagaaagaccagctgcggatgcaacagagatacggacgagttttccagggctggaaagaagggaggatctacttccctcccacgtacaaatactctttcaactcagaccggtacgccggcgagggcaggcaccctaaggagaagcggaggacgccagcatggtgcgaccgcatcctctggcacggcaacggcctgagccagctgtgctacgtccgcggcgagtcccgcttctccgaccaccggccggtgtacggcatcttcctggcggaggtcggcgtcgtgcgccagcggaggaggaacaacgccgggtacttcggatctagggtcgaggtggaggagctgttgccgcgctctcggagctatagactgagagatgatgaagttttgctgagctgacttatagcatgatataatagaaggtacccctcccccaacagcacccaagagagaatgtgcagacactaactggatgaaaaaaaaggacgctgggcggtattttttgctcaccaagagcaggcaggcaacagcgggacacgcacgacgagtatgtcgccgctcgtcgtcggagacgtagcagcagcaggcatgccgctgactggctatagagtttacccccagctttagccggcccacacttagttattcctcctcctagcaactgcatttgcttcaattttgttttcctcgtttttttggtaggtggaccttgggagtgtcagcaaacacaacatgttttcttcctcttctttttttgatgattcttttcgtttgtaagaaactttgtaaaaacctgctggtgtctgtgctgtgcttgccatgcaagtcgtggaacctttttaagataagctcagcatggctagagagcagtttggtt

SEQ ID NO: 2889 - DNA, 2833 bp, Oryza sativa
cgggcaagaactgctttgtccactccgctgccatttgtgctgctccctcctcctctcctcctcgctggattcgtggcgaccaggccgagaaaaagaagcagagatagagagagatagaagagagagagagaatcaaagcaaagcagccatagtgagagagagaagaggagaaaagagagggataaaaggagcttgagctcacaaacaacaagcctctctccttctcctccttcttcttcttctcaacgatgtcctagctaggaatagcttctcttgtttgtagcagtaggctgctacgcgagccaatcgcccaatctgagctccctaaggttggcagtgggctgcattggcggcagagagagagagagagagagatcccttggttggactcccaccgtcgaaaacccaatcttgggtggcaactgatttggctggttctttttgttccaagatttgtggtcagcggatcaaaaaaatccttccactttttttgaggcgatttggttccggatttgaaggtttcttgccgcgaagatcgcgggttggtactgttttgcctggtagatccctttcgtttggctgcagaggaggagctatgagacaatgagagaagagagcgccaagaagagcaagctttcatggtccaaatcgctcgtgaggaagtggttcaacatcaggaccaaggcacaggacttccatgctgattctgaaaccacaacccaaggtagggatggtggtggtggagcaggggggagggccagcttctcagcgagctctgcaagcacaagttcagccaagaaaagcagaacagaccggtcgtcgtcgaagcggagcgctgatcgcgtccgccgagggaggaatgatttcgatctagcacgcctgacagaggttcaagattacagaatctttgccgcaacatggaatgtcggaggcaagtccccaccaagggggctaaatttagatgagtggcttcactcttctcctcctgctgatatctacgtgttaggatttcaggagattgtccctttgaatgctggaaatgttcttggcactgaagataatattccagcaaagaagtgggtatctcttattaggaggaccctgaacaagaatcctggggccagtggttctggtgtctatcatacgccgtcaccagtccttaatccagtcgtagaactagaagctgattttgaggcatctgcaagaaggcaggagaactactctttctttcaccgtcgatcattccataatctcagccgcagtttaagaatggatgcagactacatgttcccacaaccaaagttggacagaagatttagcgtttgtgacccagtcagcttaggaggtagaccaagtgactttgatggtaatttgcggtggcttgggtcaccagatgaggagaacatcgatgaggaactctctaacgctgcacaatgttctccacttccttatagctgcaatacaacggcacctactgaagctaacgacgagcaacccaatggatcaaggtattgtttggttgccagcaaacaaatggttggcatatttctcactgtctgggtgcgcaatgaaataagagatgatgtgagaaacttgaaagtttcttgtgtgggtagaggattgatgggttatcttggaaataagggttctatatcaataagcatgtctttgcaccagacaagcttctgcttcatttgttgccatttgacctcaggggaaaaggaaggggatgaattgcgcaggaattctgatgttatggaaatattaagaaagacaaggtttccacgggttcgtggtgctaatgatgtcaaatcacctgaaacgattcttgagcatgaccgtataatatggcttggggatttgaactatcgtattgccctctcctattgttcagcaagagctcttgtcgaaatgcataactggaaacaattattagaaaaagatcagcttcgaatacaacaaagatacgggagagtttttcagggctggaaagaaggaaggatttattttcctcccacgtacaagtattcgttcaattcagatcgttatgccggagagggcatgcatcccaaagaaaaaagaagaacgcctgcatggtgtgatcgcattctctggtatggtaatggcctcaaccagctgtgctatgttcgtggggagtctcgcttctccgatcacaggccagtgtacagcattttcatggcagaagttgagattgtacaccataggaggaaaaacatgggatatttcagctctagaattgaggtggaagagctactaccccattctcagagctacagagaaataaacttttactgattttgagttaccaacatgttgtaagattagggtactggccaaaaatacaaacatgcagggttcaagagtcagctcattaggtgatcagatatactcaagcaagatgtgcaaatactaacttaaaggatattgggcaattttgcaggcaaccattatgtcaaatggagatgtatcagcccatgccactaactatacactcactccaactttagcttcttagtttctctgagcaagctaatgcttccttttttttttctttttctttttatctgcttagagtatcaataaacaccaatatattattttccccttccctttggaagctttgtaaaaccagctagtgtatcccatgcaagttgtggaattattgtaaaacattatacttagctttaggacaaactgttcctaggctgagggaggaatgatgagacatgtgagaagcttgcacagttacaatcatgtgtataacctttttattttggtgcctgaacagtcaagtaaggcatgcattagtact

SEQ ID NO: 2890 - DNA, 2879 bp, Oryza sativa
tttccattttcctcgggcaagaactgctttgtccactccgctgccatttgtgctgctccctcctcctctcctcctcgctggattcgtggcgaccaggccgagaaaaagaagcagagatagagagagatagaagagagagagagaatcaaagcaaagcagccatagtgagagagagaagaggagaaaagagagggataaaaggagcttgagctcacaaacaacaagcctctctccttctcctccttcttcttcttctcaacgatgtcctagctaggaatagcttctcttgtttgtagcagtaggctgctacgcgagccaatcgcccaatctgagctccctaaggttggcagtgggctgcattggcggcagagagagagagagagagagatcccttggttggactcccaccgtcgaaaacccaatcttgggtggcaactgatttggctggttctttttgttccaagatttgtggtcagcggatcaaaaaaatccttccactttttttgaggcgatttggttccggatttgaaggtttcttgccgcgaagatcgcgggttggtactgttttgcctggtagatccctttcgtttggctgcagaggaggagctatgagacaatgagagaagagagcgccaagaagagcaagctttcatggtccaaatcgctcgtgaggaagtggttcaacatcaggaccaaggcacaggacttccatgctgattctgaaaccacaacccaaggtagggatggtggtggtggagcaggggggagggccagcttctcagcgagctctgcaagcacaagttcagccaagaaaagcagaacagaccggtcgtcgtcgaagcggagcgctgatcgcgtccgccgagggaggaatgatttcgatctagcacgcctgacagaggttcaagattacagaatctttgccgcaacatggaatgtcggaggcaagtccccaccaagggggctaaatttagatgagtggcttcactcttctcctcctgctgatatctacgtgttaggatttcaggagattgtccctttgaatgctggaaatgttcttggcactgaagataatattccagcaaagaagtgggtatctcttattaggaggaccctgaacaagaatcctggggccagtggttctggtgtctatcatacgccgtcaccagtccttaatccagtcgtagaactagaagctgattttgaggcatctgcaagaaggcaggagaactactctttctttcaccgtcgatcattccataatctcagccgcagtttaagaatggatgcagactacatgttcccacaaccaaagttggacagaagatttagcgtttgtgacccagtcagcttaggaggtagaccaagtgactttgatggtaatttgcggtggcttgggtcaccagatgaggagaacatcgatgaggaactctctaacgctgcacaatgttctccacttccttatagctgcaatacaacggcacctactgaagctaacgacgagcaacccaatggatcaaggtattgtttggttgccagcaaacaaatggttggcatatttctcactgtctgggtgcgcaatgaaataagagatgatgtgagaaacttgaaagtttcttgtgtgggtagaggattgatgggttatcttggaaataagggttctatatcaataagcatgtctttgcaccagacaagcttctgcttcatttgttgccatttgacctcaggggaaaaggaaggggatgaattgcgcaggaattctgatgttatggaaatattaagaaagacaaggtttccacgggttcgtggtgctaatgatgtcaaatcacctgaaacgattcttgagcatgaccgtataatatggcttggggatttgaactatcgtattgccctctcctattgttcagcaagagctcttgtcgaaatgcataactggaaacaattattagaaaaagatcagcttcgaatacaacaaagatacgggagagtttttcagggctggaaagaaggaaggatttattttcctcccacgtacaagtattcgttcaattcagatcgttatgccggagagggcatgcatcccaaagaaaaaagaagaacgcctgcatggtgtgatcgcattctctggtatggtaatggcctcaaccagctgtgctatgttcgtggggagtctcgcttctccgatcacaggccagtgtacagcattttcatggcagaagttgagattgtacaccataggaggaaaaacatgggatatttcagctctagaattgaggtggaagagctactaccccattctcagagctacagagaaataaacttttactgattttgagttaccaacatgttgtaagattagggtactggccaaaaatacaaacatgcagggttcaagagtcagctcattaggtgatcagatatactcaagcaagatgtgcaaatactaacttaaaggatattgggcaattttgcaggcaaccattatgtcaaatggagatgtatcagcccatgccactaactatacactcactccaactttagcttcttagtttctctgagcaagctaatgcttccttttttttttctttttctttttatctgcttagagtatcaataaacaccaatatattattttccccttccctttggaagctttgtaaaaccagctagtgtatcccatgcaagttgtggaattattgtaaaacattatacttagctttaggacaaactgttcctaggctgagggaggaatgatgagacatgtgagaagcttgcacagttacaatcatgtgtataacctttttattttggtgcctgaacagtcaagtaaggcatgcattagtactactcattgcaatgacaaaaagattggctccctc

SEQ ID NO: 2891 - DNA, 3721 bp, Panicum virgatum
tccctggattcgggcgacaaggtcgagaaaagctagaggagagagacggccaaagcaaagcagccagcgcgagctgttggcgagggagagagcaacagaatagagagataaaataaaagagctccaaaaggagagagagtgagagcgcgcgcacaaacaagaacctcacctagctttctctctcctccaccccctcccttttctctcacctgcgcacaagcattccgttcgctctcccccttgtcgtcctcccttcctctgccacccccatgtcctagctcccagctcccattgtatctaccacctcagtactcctacttggctacaagtagtaggcctttggtactggcgaattccagctcctgcgtcctacactcctagaggctaaggactaaggtggcggggagggcggcggcagctgcactgccggcggggggagattctcgggttgttctgttctgtgagctcccactggttgcagggttggtgattccgccgccggaaaaaaatccaatcttggcgcggctcgtggcggccggccggctggttggttgggccttgtccgttggctaatttggtcagatatccgaggatcccccgcctctgctgaggattggatcctgattcaggtctcctgctacaaggatcacggcttgggggcggcggcggcggggtgacagacccctcttgctgcctgcggcctgcagagcaggagctatgacacaatgacagaggagagcgccaagaagagcaagctttcatggtccaagtctctcgtgaggaagtggttcaacatccggcccaaggcgcaggacttccatgctgattctgacggcggccagggaagggatggaggtggtggatcatggaggcccagctgctccgcccgcgaagcaagtgcaagcatggccaagaaaagcagaactggtatgtggtggaatgaaccatctgtaccatacgtccacacccctctctctgttcccgcagcaccagagatgcagctttcgctccccaccatggctgctggctgctcttcagttccactttatgggtcatcgtccaagcagagtgctgaacgtgctcgccgaggcaagaataatttcgatatagcacgcctgactgaagttcaagattacaggatctttgcggcaacgtggaatgtcggtggtaagtcaccaccaagggggctgaatttagatgaatggcttcatacttctcctcctgctgatatttatgtactagggtttcaggagattgtccccttgaatgctggaaacgttcttggaactgaagataaccttccagccaagaaatgggtgtcccttatcaggcagacactgaacaaaaatccgggagctagtggttgtggtggctatcataccccttcaccggtcctggatccagttgtagaactagatgctgattttgaggggtctgcgagaaggcagaagaattttcctttcttccaccggcgctcattccacaacctcagccgtagtttaagaatggatggggactacatgttcccgcaaccaagactggatcgcaggtttagcgtttgcgatccagtcaacttgggaggtagacctagtgattttgatggaaatttgcaatgccctggattgcctgacgaggagaacatatgtatggaagtgagtgatgctgcacaattttcgccgttcccgcatagttacactgcatctgcaccttctgaacaaaatgatgagcaatcaagcagcgcaaggtattgtttggttgccagcaaacaaatggttggcatatttctcacggtttgggtacgcaatgaaataagagatgatgtgagaaacttgaaagtttcttgtgtcggcagaggattgatgggttatcttggaaataagggttcaatttcaataagcatgtctttgcaccagacaagcttctgcttcatctgttgtcatttgacctcaggggaaaaggaaggcgatgaactgcacaggaattccgatgttctggaaattttaaagaagaccaggttcccacgggttcgtggtgccggtgatattaagtcacctgaaacaattcttgagcatgatcgtattatttggcttggggatttgaattataggattgccatgtcgtactgttcggcaaaagctcttgtggaaatgcataactggaagcaattattggagaaagatcagctccacatgcagcaaaggtatggacgagttttccagggttggaaagaagggaggatctattttcctcccacatacaaatattcattcaactcagatcggtacgccggagagggcatgcaccccaaagaaaagaggagaacaccagcatggtgtgatcgcattctctggtatggtaacggcctcaatcagctgtcttatgttcgtggagagtctcgtttctccgaccacaggccggtgtacagtattttcttggcagatgttgacattgtacaccagaggagaagaaacatgggctatttcagttctagaatcgaggtggaagagctcttgccacattctcagagatacagagaaataaaattttactgagttgacttatagcatgatgtaaggttaggaggctggtcaaatgttctatatgtagggttccagattcagctcactagatgatcagatatattgaagaaagaatgtgcaaatactaacataaaggacgttgggcaattttgctgcttgccactagaagatgacgcctgtgttgttggaattgaatcaagcccatgtcactaactatacagtccatccaactttaggctcttagttcctcctagcaaaatatttggttcaacttgttccgtcctcttcttctttttttttgggtcagaccttgtagtgccaacaaacaccaaatgttactgacttcccttctttcttttgttattttgagggtagaaactttgtaaaactcacaagtgtatcccatgcaagctgtggaattgttttaaagcaatgataccggaaattagctttaggatataataattgtccctaagcctgagggaggaatgatggggtgtgggagaggctttgcatggccacaaataatcatgtggatgccttttctgttgtgcttgagagcagtctagcgaggcatgcatttgctgcactcattgatgtgtctgtgtgtggcagaaggattggcttggtgccctccatgatgcttctccaatccatgaagttttcttttttttgaagagaaatccatgaaggcttgctagtttgctgtgtgcaatgcttcttgaaaggccttggtccataccatctgaatctcatgtgtattgtatgcatgtactgtggttcttgaatctagtgtgacagtgagcttaagctcctgttgatgtccatgtctaaatcatggagataatgacacacctctgtattgtgtagctgagtgacagtggagccaatttgcatggtctctgctgctgttacgggaacggcatgccgtgcagctcccactgtacccttttgacttgacagaaaacttgtggaattagcttgagtttgctgctgcctccccaaccattccaaattcaggttcagatcagctgcggctcggatgctcgctgatcctccctccccaacggttccaaattcaggttcatgagctaagagtggaaatttaccttgagttttaacgccttgctgatcataccagtgttgttttgcattgatcatctgctctgcacgtgaagcct

SEQ ID NO: 2892 - DNA, 3524 bp, Brachypodium distachyon
cgagtcccctgccatttgtgctccctcctgcgccttctcttcctcccacgaggccacagcgttgctccttccttccgttcctcttcctcctccagcccggattcgggcgacaaggccgagaaaaagagaagagagaacgagagagagaaagcaaattgcaagagagagatgaccagtgagggataaaagggcagcaaaaggagtgagcacacagcaaacgcagacagcaaagcccctctctccccccatcctcctccttcatcctctgctccctttctctcacctcaagacatttcgtccctccttcgttttcctcgtcgttctcctccagtactcttctcaagaaccagtacaagtagccgtagcccgtaggagtagacctcccactgtaccagcagtactagcccctgcatccttcgtgcctagcggccgaggcggcggggactagcgaggtggtggctgcattactccggccgcaagaatcgtgatcctgccatcggaatcccatcccggtacgagtttgcggcggaggcggccgatttggggggctaattcggcacaagatttgagtcccccggataaaaatcccttctttcgggggtgatccggtcctggatttgaggcttcttgctgcagaggtcgctcccagctcggggctggtgccgccggataggcagacccctctttgtttgctgcgcccctgcagaggagttatgagacgatgagagaagagagcagcaagaagggcaagctttcatggtccaagtccctcgtgaggaagtggttcaacatcagaaacaaggcacaagacttccatgccgatctcgatgccggccaccaaggaaggaatcatggtggtggtgaagcacggagggtcagcttctcagcgagcgaggcaagcacaagcacagccaagaaaagcagaaatgaccggtcatcaaagcggagcggcgatcgtttccgccgagggaggaatgatttcgatccggcacgcatgacagaggttcaagattacagaatctttgcggcgacatggaatgttggtggtaagtccccaccgagggggctaaatctggatgagtggctccattcttctcctcctgccgacatctatgttttaggatttcaggagattgttcctttgaatgctggaaacgttctcggtactgaagataacattccagcaaagaagtgggtatcgctcattaggaggacactgaacaaaaatcctggggccagtggttatggtggctaccacacgccatcaccggtccttgatccggttgtagaattggatgctgattttgaggggtctgcaagaaggcaggataacttttcattattccatcgtcgatcattccacgatctcagccgtagtttgaggatggatggagactttatgtcccagcaaccaagattagatcgaaggtttagtgtgtgtgacccagtcaacttggggggcagaccaagtgactttgatggaaattcacgatggattgggtcaccagatgatgagaacattgacgaggaagtgagcaccagcgcacaattttcaccgttcccatatacctacaacatgtcagggcccactgaagaaaatgacgggcaatcaaataactctaggtattgtttggttgccagcaaacaaatggttggtgtatttctcactgtttgggtacgcagtgaaataagggatgacgtgagaaacttgaaagtttcttgtgtaggtagaggactcatgggctatcttggaaacaagggttctatatcagtaagcatgtctttgcaccagaccagtttctgcttcatctgttgtcatttgacctcaggggaaaaggaaggggatgaattgcggaggaattgcgatgttatggaaattttgagaaagaccaggtttccacgggttcacggcactggagatgtgaagtcacctgaaactattcttgaccatgatcgtataatatggcttggggatttgaattatcggattgcattgtcctattgttcagcaaaagctcttgtcgaaatgcataactggaagcaattgctagaaaaagatcagcttcggatacaacgaagatatgggcgagtttttcagggttggaaggaaggaaggatttattttcctcccacatacaagtattccttcaactcagatcggtatgctggagagggcatgcattccaaagaaaagaggagaacacctgcatggtgcgatcgcattctctggtacggcaatggcctcaatcagctatcttacgttcgtggagagtctcgcttctccgaccacagaccagtatacagtattttcatggcagaggttgagattgtccaccagaggaagagaaacatgggctattttagctctaggattgaggtggaagagctgctaccgcattcgcagagctacagaggcataaacttctactgatttgacttattagcatgttgtaaggttaggaggttggccaaaagtactttatgtatggttcaagattcagagcccactagattatcagatatactcaagcaagaatgtgcaaatactaacttacaggatattgggcaattttgcaggcagccattttgtcaaatggagaagtaccagcccatgtcactaactatacttgagatccaactttagcctcttagtttctctgagcaagatattgcttccagttttttcttcttctttagttctattttgttcagactgtcaataaacaccatatattattttgttttttcatttcccctttgcaagttctgtaaacaaaccagtgtatcccatgcaagttgtgcaagaattattgcaaaacatgatgcctgaacttagctttaggagaagtgttcccggcctgagggaggaatgatgagtctgaagaggcttgcatagttacaatcatgtgtacacctttctccttctgttgtagtgctcgagcagttaagtgaggcatgcattttttttgtactcattactgctttgaccaaaaagcttggatccctccattatgctcccaggttgattaatttgccctctgtaatgttgcttgaaatattctgtttgccactggtttgttaatcgagcaagtttttgcttcgtttgaagtaccaaacaaactatttacttctagctcttggaaaaggttgcttaatttgctgcttgatgtccacaaaagaaagtgaatccactgtatgtagatggctcttggagtctgatgtttaacctattattagtctctagctgcatggcgtcacatgctgtgatctctcctccctaggttcatgcacaacattgctgttctgacttctgagtgctcttggagtattgtattgtagtaaatgtgtgttggcatgcagttgcatcaagtcattggcaggagagcatgcatgatatgccagttgatcaagattaggaaggaaatccagagttgtggatcagattgagagctttgactatctgcttctgcaaagttctggcaatgttgttctatcctaggtggaaattagagtatatgtatatt

SEQ ID NO: 2893 - DNA, 2728 bp, Panicum virgatum
cactgccatttgtgctccctgttccttctgcttcacctgttcaccaccaccacccgcagctttgccttgcctcgtcctctacttcttcccttttcctcccttcctcctggatttgggcgacaaggtcgagaaaagctagcggagaggggcggccaaagcaaagcagccagcgcgagctgttggcgagggagagagcaacagaatagagagagagaaaataaaagagctccaaaaggagagagagagcacacacaaacaagaacctcacctagctttctctctcttccaccacccctttttctctcatctgcgcacaagcgccaagaagagcaagctttcatggtccaagtctctcgtgaggaagtggttcaacatccggcccaaggcgcaggacttccatgctgattctgacgccggccagggaagggatggaggtagtggatcatggaggcccagctgctcctccggggaagcaagtgcaagcatggccaagaaaagcagaactgaccggtcatcgtccaagcagagtgccgaacgcactcgccgaggcaagaataatttcgatatagcacgcctgactgaagttcaagattacaggatctttgcggcaacgtggaatgtcggtggtaaatcaccaccaagggggctgaatttagatgaatggcttcatacttctcctcctgctgatatttatgtactagggtttcaggagattgtccccttgaatgctggaaatgttcttggcactgaagataaccttccagccaagaaatgggtgtcccttatcaggcagacactgaacaagaatccaagagccagtggttgcggtggctatcataccccttcaccggtcctggatccagttgtagaattagatgctgattttgagggatctgcgagaaggcaggataattttcctttcttccaccgccgctcgttccacaacctcagccgtagtttaagaatggatggggactacatgttcccgcaaccaaggctggatcgcaggtttagcatttgtgatccagtcaacttgggaggcagacctagtgattttgatggaaatttgcaatgccctggatcgcctgttgaggagaacataaatatggaagtgagtgatgctgcacaattttcgccgttcctgcatagctacactgcatctgcaccttctgaacaaaatgatgagcaatcaagcagccctaggtattgtttggttgccagcaaacaaatggttggcatatttctcacagtttgggtacgcaatgaaataagagatgatgtgagaaacttgaaagtttcttgtgtcggcagaggattgatgggttatcttggaaataagggttcgatttcaataagcatgtctttgcaccagacaagcttctgcttcatctgttgtcatttgacctcaggggaaaaggaaggcgatgaactgcgcaggaattctgatgttctggaaattttaaagaagaccaggttcccaccggttcgtggtgccggtgatgttaagtcacctgaaacaattcttgagcatgatcgtattatttggcttggggatttgaattatcggattgccctgtcgtactgttcggcaaaagctcttgtggaaatgcataactggaaacaattattggagaaagatcagctccgcatgcagaaaaggtatggacgagttttccagggttggaaagaagggaggatctattttcctcccacatacaaatattcatttaactcggatcggtacgccggagagggcatgcaccccaaagaaaagaggagaacaccagcatggtgtgatcgcattctctggtatggtaatggcctcaatcagctgtcttatgttcgcggagagtctcgtttctccgaccacaggcaggtgtacagtattttcttggcagaggttgacattgtacaccataggaggagaaacatgggctatttcaattctagaattgaggtggaagaactcttgccacattctcagagctacagagaaataaaactttactgagttgacttatagcatgatgtaaggttaggaggctggtcaaatgttctatatgtagggttccagattcagctcactagacgatcagtatactgaagaaagaatgtgcaaatactaacataaaaggacattgggcgattttgctgcttgccactggaagatgacgaatgtgttgttggaaaagaatcaagcccatgccactaactatacagtacatccaactttaggctcttagttcctcctagcaaaatattcggttcaacttgtttcgtcctcttcttttttttttcagtcagaccttgtagtgtcaacaaataccaaatgttactgtcttaccttcttccttttcttattttgagggtagaaactttgcaaaactcacaagtgtatcccatgcaagctgtgaattgttttaaggcagcggaattagctttaggttataattgtccctaagcttgagggaggaatgatgtgggggtgtgggagtggttttgcatggccacaacaatcatgtgcatgccttttctgttgtgcttgagagcaggtcagcgaggcatgcatttgctgcactcattgatgtgtctgtgtgtggcaaaaggattggcttggtgcctccatgatgcttctccaatccatgaagtttttttttctttttttgaagagaaatccatgaacgaaggctttgctgtgtgcgatgctaatccatgaacgaaggcttcg

SEQ ID NO: 2894 - DNA, 3001 bp, Setaria italica
acccagagctcggaggcagagagagaatggccacgcagcgagcgggataaaagagcgcagatcaggaggggccaggcccgcccgtaggccattgcgtttcgttttcgcactgcacgcaccaccatacgccgcactgccgagctctactcctgctacttcctagtcctgttcctgctgcctgtgccgctactcttcttaacccctagagcgcgaggcctacggaggaggagagcattcgggatttcaggagcaaagcggtggcgcctttgccataccgctacggggctaggctgctgttgcggagcagaggcaagcattcgttcctcccccattacgaggagaggagaagatttgctgggttttttggtttttgctgcaaggggaagatggattcttgatccccggagcggttgggttgttgcggcaagctcaagcatttggcccctgtactcggaagtcaatcgattcggccccggatttgcggcttctcgggtcagaatcttgccttgagagcggaaatttgtgcgggtctgcgggatttgaggcttccttccgccgagggcgcgccctgccttgtttgggggcagataggagactccgaagaggtggggtacggattcttccattgctgtggacggggaggtatgagacaatgagggacgagagcaacaagaagaagctctcgtggtccaaatcccttgtgaggaagtggttcaacatcaagtctaaggcgcaggatttccatgcggatcacgatgcgagccaaggaagggacgggcatggtgatgaatggaggaccagctgctcagagagggaggcaggcacagccaagaaaagcagaactgaccggttgtcgaaacggagtgtagaccgaatccgtggagtaaggaatgacttcgatccggcacgcctgacggaagttcagaattacagaatctttgcctccacatggaatgttggcggtaaatccccaccaaggggattaaatcttgatgactggctccattcttcacctccagctgatatctatgtgttaggatttcaagaaattgttcctttgaatgctggaaatgttcttggcactgaagataaccttccagcaaaaaagtgggtatcccttgttaggaggacattgaataagaatcctgggtgctgttatggtggctatcgcacgccctctcctgtccctgatccagttgtggaactagatgctgattttgagggatcatcgagaaagcaggataatttctcaattttgcatcgtcgatcattcaaccttagccggagtttaagagttgaagggaaccatatgtcatcacacccaagattggatcgcaggttcagtgtatgtgatccagttagcttgggaggcaggccaagtgattttgatggaaatttcccattcatgggatcaccagatgatcattgtattgaggaggattcaagtaatggagcatatttttcacccttcacatatggctatggtgcctcagcgcctacggaagaaaattatagtctgcaaaatacatctaggtattgtttggttgccagcaagcagatggttggtatatttctcaccatttgggtacgcagcgaaataagaaatgatgtgagaaacctgaaagtttcctgtgtgggcagaggactaatgggttaccttggaaataagggatctatatccataagcatgtctttgcaccacacaacgttttgttttatctgttgtcatttgacctctggggaaaaggagggagatgaactgcggaggaattctgatgttatggaaattctaaggaaaactagatttcctcaagtccgtggtgctggtgatgtcaagtcaccagaaacaattcttgagcatgatcgtgtcatttggcttggggatttgaattaccggatcgctctttcatactgctcagctaaagctcttgttgaaatgcataattggaagcaactattggagaaagatcagcttcgaatagaacgaagatgtgggcgtgttttccagggatggaaagaaggcaggatttattttcctccaacgtataagtactcattcaactcagatcgttattctggtgtgcgtcccaaagaaaagcggagaacaccagcctggtgtgaccgcattttgtggtatggtaatggcctcatgcaattgtcgtatgtccgtggagagtctcgcttctctgatcacagacccgtgtacagtattttcatggctgatgttgaaattgtccgccctagaagaaggaacatgggctatttcagctccagaattgaggtggaagagcttttaccatattcttacagctctggagaaaagttctactaatttggctcatattggcatatggagcttgttttctactttaacttaggttaccgggtccctgatgaacaatagctggggtcaaagattggttggatgatgaggtgtaaccttgactgatttttttatctggctttcattgctagatttcagtcagatgcttgagaagcacattgcgcaaaaactgacataaaggatagttgggcagttttgcaactaaccatttgcctgtgggcagccaatgctcaaacaaggatcatcccacatctgtacataactacacagctcaagaaacccttcgtttttctctctttttagggatgttaataaatgtatatcatttttcttctccctttgccttggggaaatctgctagttagtatgaggttttgggggtgtgcatgagtatgagcatgaggtgtagaatcattgcaaatcggcaaaaggtgaaatgatgcttgaattgaactgatcctggatcatgatctccggtgctgagggaacagtgatagattgatgtgacttaggaggtttgcaaaggtgtaatcatgtgcataacttttatccctgtggtgcagtacctgagaagcaaaatgatgcctgcatttgctgtgctcattgatgtggcagaaaaaaaaattgttcagttaaaattttactaattcttggtca

SEQ ID NO: 2895 - DNA, 2879 bp, Oryza sativa
ctcacttcttcacatcacgccaccattttttcactttagtgttgcgcagtagtacaccaccatcaccaccaccaatgcatgcaaactcaaccagcagtctcgtcttaacccctagcagctaccgcctaaaggcctagagctagaagaagcattcagagctcaggaaagggaggagcaagctggactgctgctgctggtggtggtggtggtgtgtaggctgcagctgcatttcatcccgggagaagatttcgttgggtttttctctgttacttgactaatacttgtgaagctggatttgtgatccccggtgcggttggtgcgcttcttggcgctcaattcggtccaagattgtaggctcccggatcaaaatctgttattggagccaaatttgttgcgagatttgaggtttccttgcgtgcttggagttgaaaatcattggagcctcgggagaggggaggcgtagattcttctgttgcttcagttaagttgctatgagacaatgagggaagagagcaacaagaagagcaagctctcatggtccaaatcccttgtgaggaagtggttcaacatcaagagcaaggcaaacgatttccatgcggactatgatgctagccaaggaagaaatggtcatggaggtgaatggaggaccagctgctcagagagggaggcaggcacagccaagaaaagcagaactgaccggatgccaaagaagaatgccgactgcattcgtcgaggaaggactgaatctgatgtgtcacgcctgactgaagttcaagattacagaatatttgcttcaacatggaatgtgggtggtaaatccccatcaaagggattagatttagatgagtggctccactcttcacctcctgctgatatctatattctaggatttcaagaaattgttcctttgaatgctggaaatgttcttggtactgaagataatgttccagcaaaaaagtgggtatccctcattaggaggacactgaacaggaatcctggggctagcagctatggtggctatcacacaccatctcctgtccctgatccagttgttgaactagatgctgattttgagggatcatcgagaagacatgataacttgtcatttttccatcggcgatcattccagaaccttagtcagagtttaagagtcgaaggaaattatatgtcatcacagccaaggttggaccgtaggttcagcgtttgtgacccagttagcttgggcggcagaccaagtgattttgatggaaatttcccatgtgcgggatcaccagatgatgaatatattgaggaggatggaagcaatggaacttatttttcaccgttcccatatggctacggtacctcaatagctatggaggaaaacgatgagcaaccaaatacctctaggtactgtttggttgccagcaagcagatggttggtatatttctcacagtttgggtgcgcagcgaattaagaaatgatgtgaaaaatcttaaagtctcttgtgttggtagaggtctaatggggtatcttggaaataagggttcgatatcaataagcatgtctttgcatcacacatccttttgttttatctgttgtcatttgacatctggagaaaaggagggggatgaattgcgcagaaattctgatgttatggaaatcttaagaaagactagatttcctcgggttcgtggtgctggtgacattaagtcaccagaaaccattcttgagcatgatcgtatcatatggcttggggatttgaattaccggatttccctttcatactgctcggcaaaagcactcgttgaaatgcataactggaagcaactgttggagaaagatcaactacgaatagaacgaagatgcggacgcgttttccaggggtggaaagaaggacggatttattttcctccaacatacaaatattcattcaactcagatcgctattctggggagtgtgtgcattcaaaggaaaagcgaagaacaccagcttggtgcgatcgtattctatggcatggtaatggactcattcagttatcttatgttcgtggagagtcgcgcttctccgaccatagaccggtgtacagcattttcatggcggaggttgaaattatccgccagaggagaagaaatatgggctgtttcaactctagagttgaggtggaagagcttctgccatattcttacagctttggagacatcaagttcaactaagtcagctcattatatgttatgctcaagttttctgctttgtgtttatgttgacaaatgaagggttcaaattctagtaaatgatcagatgtgaatgtgccaatatttttccatctggtttttttttgttagccttcagatgcacacttcttgtttaattgactatcaccaagcctgaagcatgtgcagatgcttgtgaaaaacattatccaaaaaactaacataaagggcagttgggcaatttcgcaactaaccaatttcctggaagtatcagcccacacaactaattatacagctcaaccagctctcatgttccagttcatttctacttttgttttaagactgataagtgccatcacttctctttttccctttgcattttgggaacttttgtaagctggccattgtatcagcatgaggtgtaaaatcattgcaaatcggcaaggggaatgaatgataacttggatcgaactaattccagataatgatttctagcgcaaggggagaatgataagttgatgtgacttgagagagttgcaaagttatgctaatcatgtgcatacctttctgatggtgtacttgtgaagctaaatgatgcttgcatttgctgccctcattgttgtggcatactactggagtattaaacaaaagcttaatcccattgttttacttggattacacagag

SEQ ID NO: 2896 - DNA, 2824 bp, Brachypodium distachyon
cagaaaccccgagagctcactcctacagttttcttttctctcgcttcccagtgttttttcgcacaccgaccagtacacacacacagagacctccagctagtactccttcgtagccttaaccccctgctagcagctagcggagagcctaggaggagtagcattcagtgattcaggggcaaggcggtgtccgttcgtcctgcgaggcttgttcgtagactgcagtagcggcattgcttcctcccgggatcagctcagctctcgtcgattcggttcagggtcgagttggattcgtgatccctggcgagtttggcggcggcggcgttgttggctggtttgcttcttcccggcgctgaatcagggccgagatttgggggtgaatccggatttggggccaaaataatttggagatttgaggtttccttgcgaagccgcaccttccatacatacaaaggagagagaggagggggtggagcagggaggagggaggggaggggctgagattggcttgattcttctgctgcttcaggaggaaggaggctggtgctatgagacaatgagggaagagagcaacaagaagagcaagctctcgtggtccaaatccctcgtcaggaagtggttcaacatcaagaataaggcgcaggatttccacgcggactacgatgctagccaaggaagggatggtggtgaacggaggaccagctgctcagagagggaggcagcaacagccaagaaaagcagaactgaccggtcgttgaagcggaatgttgatcgcattcgtagaggaaggaatgaatttgatatgtcacgtctgacagaaactcaagattacagaatatttgcctccacgtggaatgttggtggtaaatccccatcaagggggttagatttagatgactggctccattcttcacctcctgccgatatctatgtgcttggctttcaagaaattgttccgttgaatgctggaaatgttcttggtactgaagacaatgttccggcaaagaagtgggtatcacttattaggaggacactaaataagaatcctgagcctagcagccatggtggctatcgcacgccatcccctgtacctgacccagttgtggaattagatgctgattttgagggatcgtcgagaagacatgatagctcttcatttttccagcgccgatcattccagaaccttagccggagtttaagagttgaaggaaatgatatgtttccacaaccaagattggaccgtaggtttagtgtctgtggccctgttaccttgggaggcagaccaagtaattttgatggaaattttatgtgtaccggatcaccagatgaccaatatattgacgaggatgccaacaacggaccatatttttcaccgttcccatatggctatggtgcttcaccacctgcggaagaaaacaacgagcacccgaatactcctaggtattgtttggttgccagcaaacagatggttggcgtatttctcacagtttgggtacgcaatgaaataagaaatgatgttcgaaacctgaaagtttcttgcgtgggtagaggactaatgggttatctcggaaacaagggttctatatcaataagcatgtctttgcatcatacaaccttctgttttgtctgttgtcatttgacctccggggagaaagaaggagatgaatttcgcagaaactctgatgttatggaaatcttacggaagacaagattccctcgggtccgtggatgtggggatattaagtcaccggaaacaattcttgagcatgaccgtatcatatggcttggtgatttgaattaccggatttctctttcatacccatcagcaaaagctctcgttgaaatgcataattggaagcaactattggagaaagatcagcttcgcatagagcgaagatgcggacgtgttttccagggatggaaagaagggaagatttattttcctccaacatataaatattctttcaactcagatcggtattctggttatggtgtgcgtcccaaggaaaagaggcgaacaccagcatggtgtgatcgcattttatggtatggtaatggcatcattcagttgtcatatgtccgtggagaatctcgcttctctgaccacagaccagtgtacagtattttcgtggcggaggttgaaattcttcgccagaggagaagaaacatgggctatttcagctctagagttgaggtggaggagcttttgccatattctcacagctatgcagacataaagttctactagttcagctcttgcggtgctataagctcaatgattctctgcaatctatagcatggttccaagatctgttagatgagcagatatgaacatgacaatatttttccatctttttttgtgtgtgtgttctcgctttcgagaatcacacttggcactttagtaaccattgccaagatctaagatcagatgcgtggggaacacattcacattctgcaagaactaacatagaggatagtcgggcaatttagcaactaacaatttgcccgcgaatggcaacgttcatgggaagattcagccagcttacatcactgactatacaactctaccagctctttgccttccagttcatctcctttgtttagagccctcaacaacctacacccgtcacaccttttttttccattgaaaactctgtaattaagctggacagtgcatgtatcagcgtgagttgtaaaatcatcgcagatcggcgcagggaatgatacttggattgaactaaattccatatgatgattcctggtgtgaggggagaatgatatgtgttgatgtgacttgagaggtttgttgcgaaaagatgtgatcatt

SEQ ID NO: 2897 - DNA, 3531 bp, Sorghum bicolor
cagctcgtgccattactgcccattattaagcttaagcagcagcggcttggatttgagcgagcaggccgagagcggggcgtgattagattagaaaacccaaagcacggagacagagagatgggcacgcaggttgggggataaaagaggcaggggaacggggaaccagagagagagagaaagagagggcagcagatcaggggtgggcattgcatctcgctttcgcattgcacttgcacgcaccaccatacgccgcactgctgagctctacgcctactcctagtcctgtacaaaacctgctccggcgtctggctgtaccgctagccttaacccctagagcgagacggaggcctacggaggaggagggaggaggagagggcgttcaggatttcaggagcaaagtgcagactgcacagcggtgctgtgccttgccataccgctacggccgtgctaggctgtgctgccgcagaggcgccgaggcggggcattcgttcctctccgttacgaggagagggcgagaggaggaagatttggtggggggtttttcaccgcaaggaaagatggattcttgatccccggcgcggctggtttgttgcggcaagctgaagcattttgctcggcagtcgatccggtccaggattcgcggctcccgggtcagaatcttgccctgaggggcgaaatttctgcgggatttgaggtttccttcctccagcgacgcgccctgccttgtcaggagtcgaggagggacggtgggtaggaggagcgcggggttcttccattgctgtggttcgtggtttctgggagttattatgagacaatgagagaagagagcaacaagaagagcaagctctcctggtcgaaatccctcgtgaggaagtggttcaacatcaagagtaaggcgcaggaattccatgcggattgcgacgccgcccaagggagggacgggcatggcactgaatggaggaccagctgctcagagagggaggcaggcgcggccaagaaaagcagaactgaccggtcgtcgaagcggagtagtatggaccgaacccgaggaggaaaaaacgacgttgtcgatgtggcatgcctcacagaagttcagaattacagaatctttgcctccacatggaatgtcggcggtaaatccccaccaaggggattgaatcttgacgactggctccattcttcacctccagctgatatctatgtgttaggatttcaagaaattgttcctttgaatgctggaaatgttcttggcactgaagataatctcccagcgaaaaaatgggtatcgcttgtcaggaggacactgaacaagaatcctggctcatgctgttatggtggctaccgcacaccatctcctgtccctgatccagttgtagaacaagatgctgattttgagggatcatcgagaaggcaggacagtttatcctatttgcatcgtcggtcattcaaccttagccggagtttaagagttgaaaggaaccatatgctgtcacatccaaggttggatcgtaggttcagtgtctgtgacccagttagcttgggagggaggccaagtgattttgatgggaacttcccattcatggggtcaccagatgatcattgtatcgaggaggatacaagcaatggagcatatttttcacccttcccatatggctatggtgcctgcgcacctatggaagaaaatgattatcagacaaatacatctaggtactgtttggttgccagcaagcagatggttggtatatttctcaccatttgggtacgcagcgaaataagaaatgatgtgagaaacctgaaagtttcttgtgtgggtaggggactaatgggttatcttggaaataaggggtctatatccataagcatgtctttgcaccacacaaccttttgttttgtctgttgtcatttgacctccggtgaaaaggagggagatgaacttcggaggaattctgatgttatggaaattctaaggaagactagatttccacaggtccgtggtgctgctgatgtcaagtcaccagaaacaattcttgagcatgatcgtatcatttggcttggggatttgaattatcggattgctctttcgtactgctcagctaaagctcttgttgaaatgcatagttggaaacaactattggagaaagatcagctacggatagaacgaagatgtgggcgtgttttccagggatggaaagaaggcaggatttattttcctccaacatataaatactcattcaactcagatcgttattctggtgtgcgtcccaaagaaaagcggagaacacctgcttggtgtgatcgcattttgtggtatggtaatggcctcatgcaattgtcctatgttcgcggagagtctcgcttctctgaccacaggccagtgtacagtattttcatggctgaggttgaaagtatccgccacagaagaagaaacgtgggctatttcagctctagaattgaggtggaagagcttttgccatatccgtacagctctggagaaatgaagttctactaatttggctgacacaggcatatggctggagcttgttttctctttcaactcaaggttgctgggtccttgaacaataactggggatgtagattggttggatgatcaggtgtaaacctgcctatttttttcatctgactttcatagcttccagtcagacggttgacattgcacaaaaactaacataaaggatagttgggcaattttgcaagtaaccatttgcctgtggacagccatgttgaaacaaggatcggcccacatctgtacattaaccacacagctcagaagaaaaaaaaaaccttttcccccatttggttctcattttttagggatgttaatgaacatacatttttttttcttctccctttgccttcgggaaatctgttagaatgagatttttgggtgtatcagcatgagcatgacgtgtaaaatcattgcaaatcggcaaaaggtgaaatgatgcttgaattgaactgatccttgatcatgatctccagtgctgagggaacagttatagattgatgtgacttcagaggtttgcaaaggtgtaatcatgtgcataccctttttttatctttgtccctgtggtgtagtacctgagaagcaaaatgatgcctgcatttgccgtgctcattgctgtggcagggggagaaaaaaaatacagttctgttaaacctttttctaattctacaggtcagagccctgtttcctgtctggaatgcatggtgttatagtttatcagcttgcttgtcctctacatcagacaagctgtctgcactgatagcattcattcatgtagcctaagtgtttggttagtcttgtgatcttcctgatagaaataatctgtgcataggatcgactagtagtggatctagacgggtacaatctttaactggtaaacaacaaggtacatattctatacaagatctaaaatggaaacagtaaatacaattaaatgggtcgggattaataggattagaccgtcgagagaaggagcagcagaggcggcggaagacgatcccgaggcc

SEQ ID NO: 2898 - DNA, 2969 bp, Sorghum bicolor
gccatcgcctccataaaaaaatgttaaattgtgcagcgtaaaaagaagcaagaagcagctcactcccactcacactcctcgctctcctctctctcactggagctggagcggggaagaagtgaggcgagcggacacgagagagaaggggagggagatcgaagcagcgaggcagttcgagagctctccgatctgctgcggggatggggtgcacggcgtccaaggtggagcaggaggacacggtccggcgctgcaaggagcgccgccgccacatgaaggacgcggtggcggcgcgccagctgctggcctccgcgcacgctgactacctccgctccctccgcgtcaccgccgccgcgctctcgcgcttcgcgcagggccacccctcgctcgccgtttcgcaccacactgcccccgttctcctctccgccgccgcgccgccgcctgccccaagcgccgcccacgcgctccccacaccggcgccctccaccgccacgtcgtcatcgctcccgcctccgacgccgctcgctcagcacccgcacccgcacccgccgtcccagccgcagccgcagccggcagcggcgatggcggtgccgcaaccggcgccggcgagggcaccacgcccacggcggctcagggtgccccacatcctgtcggactccagcgtcgccagccccgcgcagtcgtcattccgcaagcagcctccggtgggcacgccgtcctcctcgtccgcgtgggactgggagaacttctacccgccgtcgccgccagactccgagttcttcgaccgccgcaaggccgaggtcgagcaggccagccgcctccgggagcttgacgaggaggagaaggcccgggcctacctccaccaccacacccactacaacctcaaggaagaagacgaggctgccgaagacgacgacggtgaggtggaccatgaaccagaggggatgcattgcggcggatgggaggacgacgagcactacgcgtccacgaccacgtcggagaccagatcggaggacgagggcgagatgggggacagatcggaatgcgggttcgcggccagatcggagtgcgggttcgtggccagatcggagtacggcgggacggcaccgtcagagtacgccgccgtaccattgcccctgaggagggatgagaggtcggaggctggcgactcctcctccacggtcacggcggtgacagagatgcggatggtggtgcgccatcgcactctcgcggaaatcgtggcggccattgaggagtactttgtcaaggcagccgactccggcaacgatgtgtccgagctccttgaggccagccgcgcacagctcgaccgcaacttccggcagctcaaaaagacggtgtaccattccaacagtgtgctatcagcattgtcgtcgacatggtcgtcaaaaccgccattggctgtacgatataagttggacactaatgcactggagatggagtcaacggaggggaagagccatggatccactctagagcggcttttggcttgggagaagaagctctatgaggaggtcaaggcaagagagagtgtgaagattgagcatgagaaaaagctttctactctgcagagcctggagtacagagggagggatagtgcaaagctggacaagaccaaggcctccataaacaagctgcaatcactgattgtagttacctcacaggctgccacaactacatcctctgctattgttagagtccgtgacaatgagcttgcaccacagcttgttcagctttgttttgcgctattgggtatgtggaggtcaatgaaccatttccatgagatacaaaatgagattgttcagcaagtccgcggtctggtggacaactccatggctgagtcaacatctgaccttcacaggcttgcaactcgtgatcttgaggctgctgttgcggcatggcactcgaacttcaaccgccttatcaagtaccagcgtgactacatccgctctctatatggctggctgaagctcacactctgccaagtggataacagtgtgccacaggaagcccatgcctcaatgatctcgcgtgaactcaccagcttctgtgacgagtggaagcaagcactggaccgtcttccagatgctgttgcttcagaggctatcaagagctttgtgaatgttgttcatgtcatttacactaagcaggcagaggagatgaagatcaagaagcggacagagacactttcaaaggagctagaaaagaaaaccaactcactcaggtccattgagaagaagtactaccaatcctactcgatggttggccttggccttcctggcagtggacgcgatggcattgaaagccacgcgtacgatgcccgtgatcctcttgcagagaagaaaactgagattgcccagtgtcgtcggaaggtggaggacgagatgacaaggcatgctaaggccgtcgaggtaacaagatcaatgacgctgaacaacatacagacaggcctgccaggaatattccaagccatagctggtttctcagggacagtggtcgaagctcttgatgtggtgtgccgccgagctgggtcagtgcggtagaagctcttgcccgccctatcagaattaccaagagaccgtttgctgcctcttttttttctgggtgattcagtagtttatttatataggcaaactgcaatatataatatatatatagctcaaagtagagtgatgaaatataggagaaggctccctggatgttttgccctgtcaggatggtttcagttgtagataatgtgattttgcccaggatttattggtctcgtttcacccttttctggcaagtgcgaggggagatatcagatatatgatgtacagacattaaggtcaccttgcactctagtgttaatcaatcaagcctgtgcttctgtctaacaaaagctctagttccctattttctttatatattatgtacctgagtgttctttgaagtggattactgtcttctgtggg

SEQ ID NO: 2899 - DNA, 2833 bp, Zea mays
agctcactcacacagtcacactcacactcctcgctctctcactggagtggggaacaactgaggccagcggaaaccagagaggggagggagatcatagcagtggggcagtttgagagctcgccgatctgctgcggggatggggtgcacggcgtccaaggtggagcaggaggacacggtccggcgctgcaaggagcgccgccgccacatgaaggacgcggtggcggcgcgccaactgctagcctccgcgcacgccgactaccttcgctccctccgcgtcaccgccgccgcgctctcgcgcttcgcgcagggccacccctcgctcgccgtttcgcaccacactgcccccgtcctcctctccgccgccgcgccgccgcccgcccccatcgccgtccatgcgttccccacaccggcgccctccaccgctgcgtcgtcatcgctcccgcctccgacgccgctcgtccagcgcccacacccgccgccccagccgcccacggcggcggcgatggcggcgccgcagccggcgctggcgagggcaccacgcccacggcggctcagggtgccccacatcctgtcggactccagcgtgaccagccccgcgcagccgtcattccgcaagcagccgccagtgggaacaccatcctcctcgtccgcatgggactgggagaacttctacccgccgtcgccgccagactccgagttcttcgaccgccggaaggccgaggtcgagcaggccagccgcctccgggagctcgaggaggaggagaaggcccgagcctacctccaccatcacacccactacaacctcaaggaagaagacgaggccgctgaagacgacgacggtgaggtggaccatgaaccagatgggatgcattccggcggatgggaggacgacgagcactacgcgtccacgaccacgtcggagaccagatcggacgaggagggcgagatgggggacagatcggaatgcgggttcgcggccagatcagagtgcgggttcgtggccagatcggagtacggcgggacggcaccgtcagagtacgccgccgtaccattgcccctgaggagggatgaaaggtcggaggctggcgacttctccactgtcatggcggcgacagagatgcggatggtggtgcgtcatcgcaccctcgcggaaatcgtggcggccattgaggagtactttgtcaaggcagccgactccggcaacgatgtgtccgagcttctggaggccagccgcgcacaactcgaccgcaacttccggcagcttaaaaagacggtttaccattccaacagcgtgctatcagcattctcatcgacgtggacgtcaaaaccgccattggctgtacgatacaagttggacactaatgcactggagattgagtcaacggaagggaagagtcatggatccactctagagcggcttttggcttgggagaagaagctctacgaggaggtcaaggcaagggagagtgtgaagattgagcatgagaaaaagctttctactctgcagagcctggaatacaaagggagggatagtgcaaagctggataagaccaaggcctccataaacaagctgcaatcactgattgttgttacctctcaggctgccacaactacatcatcagccatcgttagagtccgtgacaatgagcttgcaccacagcttgttcagctctgttttgcgctattgggcatgtggaggtcaatgaaccatttccatgagatacagaatgagattgttcagcaagtccgtggtctggtggacagctccatggctgagtcaacatctgacctccacaggcttgcaactcgtgaccttgaggctgctgttgcggcgtggcactccaacttcgaccgcctcatcaagtatcagcgcgactacatccgctctctgtatggctggctgaagctcacactctgccaggtggatagctgtgtgccacagggagcccatgcctcgatgatctcgcgcgaactcaccagcttctgtgacgagtggaagcaagcactagaccgtcttccagacgctgttgcttcggaggcgatcaagagctttgtgaacgttgtccatgtcatctacgccaagcaggcagaggagatgaaggtgaagaagcgggcagaggcatactcgaaggagctagaaaagaaaaccaactcgctcaggtccgtcgagaagaagtactaccagtcctactcgatggtcggccttggccttcctggcagcggcgggcacggtggcattgacagccacgcgtacgacgcccgtgatcctcttgcggagaagaaaaccgagatcgcccagtgccgtcggaaggtggaggacgagatggcgaggcacgctaaggccatcgaggtcacgcggtcaatgacgctgaacaacatccagacaggcctgccgggtatattccaagccatagctggtttctcagggacagtggttgaagctcttgacgtggtgtgccgccgagctgggtcagtgcggtaggacctcttgccccaccagaattaccaagagacagaccatttgctgcccccctttctctctctgggtgattcagtagtttacttatatagggaaactgcaaaatataatataatataatatatagctcaaagtagagtgatggaatataggagaaggctcctggatgtttttccctgtcaggatggtttcggttgtagataatgtgattttgcccatgatttgttgatctcatctggccctttctctgggaagtgggaagggagatacataatgtacatacattaaggtcaccttgcactctagcgttgatcaagcctgtgcttctgcctaacaaaagcgttaactttcttt

SEQ ID NO: 2900 - DNA, 2815 bp, Oryza sativa
gcaaagcgaagcagcagctgcagctcactcctcccactcgagtagagcagccaactcctctctctctctctcgccgcagcgaggagggagacgacggcgaatcggagagggcgttagatcgaatcggagaggaggggaagcgcgcgcgcgcgctcgcgtcgcgggtggggggcgatggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggccgcgcccgcgctggcgccgacgccgacgccgccgccgccgtcatccacggcgtcgtcctcgctcccgccaccgacgccgctgctccccaagcaccagcaggcgccgccgccgccaccgcccacgcagttgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaaagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgcgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacagatgctgtggtcacttcacctagcaaatctaacggcgagttatgcttgcacttctcccatggaagatagtaactaaccatttgttcttctg

SEQ ID NO: 2901 - DNA, 2869 bp, Oryza sativa
gcaaagcaaagcgaagcagcagctgcagctcactcctcccactcgagtagagcagccaactcctctctctctctctcgccgcagcgaggagggagacgacggcgaatcggagagggcgttagatcgaatcggagaggaggggaagcgcgcgcgcgcgctcgcgtcgcgggtggggggcgatggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggccgcgcccgcgctggcgccgacgccgacgccgccgccgccgtcatccacggcgtcgtcctcgctcccgccaccgacgccgctgctccccaagcaccagcaggcgccgccgccgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccgctgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaaagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgtgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacagacgctgtggtcacttcacctagcaaatctaacggcgagttatgcttgcacttctcccatggaagatagtaactaaccatttgttcttctgggaaaaaaatgtcagaattctgaactgaattagctatgtttccagtggt

SEQ ID NO: 2902 - DNA, 3113 bp, Hordeum vulgare
caaggaaaggcgcacgcacccacctcactctccccactcaagtacacactcctcgctgctcgctccccgccctgacggacggcagagtggggggagaggaagaagaagcccgagcagagagagcggcggcagccagaagacggagagagagagggaggaggggagggagatctgcgcgggggaggagcagcgatggggtgcgcggcatccaaggtggagcaggaggacacggtgcggcgctgcaaggagcgccggcgcaacatcaaggacgccgtgacggcgcgccagctgctcgcctcggcgcacgccgactacctccgctccctccgcatcacggccgccgcgctatcccgcttcgcgcagggccactcgtcgctcaccgtctcccaccacaccgcgcccgtcctcctcaccaccgccgcgccgccggccctgcacgcgcccggcccgaccgccgccacctcctccgtcgcctcgtcctcgctgccgccccccacgccgctccctcgccaccagccgccgccgccgccaccaccagtacagcagcagcagccgcaggcggccgccgctgcgctcagggtcgacatggatccgaggatgcggcggctcaaggtgccgcacatcctgtcggactcgagcgtcgcgtcgtcgttccggaagccgccggtggtggggacgccctcctcctcgtctgcctgggactgggagaacttctacccgccgtcgccgcccgactccgagttcttcgaccgccgcaagaccgatctcgaggaggcaaaccgcctccgcgagctcgacgacgaggccaaggcgcggggctacacccagcgccgccacgaccacctcaaagaagaggacgaggccgacgacggccagggagaagacgaggaggagacggagcgggaggatatgcattgcggcggatgggaggacgaggaggaccactacgcgtccacgaccacgtcggagaccagatcagaggaaggcgaggtggggaatagatccgagtgcggtttcgccgccagatcggagtacggcgggacggcgccgtccgagtacgccgccgtgccaatgcagctgaggagggccgagaggtcaggggtcggggactccttctccacggtcacgggggcgaccgagatgcggatggtggtgcgccaccgcacgctctcagagatcgtcgcggccatcgaggagtacttcgtcaaggcggccgacgccggcgacggcgtgtcggagctcctggaggccagccgcgcccagctcgaccgcaacttccggcaactcaaaaagacggtgtaccactccaacagcgtgctgtcagcactctcgtcaacatggacttcgaagccgccattggctgtgcgctacaagttggacaccaattcactggagatggggtcaatggaagggaagagccatgggtcaacactggagcggctcttggcctgggaaaagaagctatatgaggaggtcaaggctagagagagcgtgaagattgagcatgagaagaagctttctaccctgcaaagcttggaatacagagggagggatagtgccaagctggacaagaccaaggcctccataaacaagctgcaatcgctgatcgttgttacgtcgcaagcagccactaccacatcctcagccatcgtcagggtccgggacaatgagctcgcaccgcagcttgtcgagctttgttttgcgttgctgagcatgtggagatcgatgaactacttccatgagacccagaatgagatcgttcagcaagtgcgcggtctggtggacaactccatggccgagtcgacgtccgaccttcaccggcttgcgacccgtgatctcgaggccgccgtctcggcatggcactcgaacttcaaccggctcatcaagtatcagcgtgaatacatccgctctctgtatggctggctgaagctgacactcttccaagtggacagcatttccccacaagaggctcacgcgtcactcatctcacgcgagctcaccaccttctgcgacgagtggaagcaagcattggaccggcttccagacgctgtggcttcggaggccatcaagagctttgtgaatgtcatccatgtcatctacaccaagcaggcagaggagatgaagatcaagaagcggaccgagacgtactcaaaggagctggagaagaagaccaactcgctgagggccatcgagaagaagtactaccagtcgtactcgatggtaggccttgggcttcctggcagcgggcgtgacggcatcgaagggcacacgttcgacgcgcgcgaccctctctccgagaagaagaccgagatcgcccagtgccgccgaaaggtggaggatgagataacgaggcatgccaaggccgtggaggtgacaaggtccatgacgctgaacaacatccagactggcctgccaggaatgttccaggccattgctggcttctcgggcacggtcgtggaggccctcgacgtggtctgccggcgagccgggtcggtgcggtaggaggatgtcagcccccatctgagcatcattttggtgtgtgtctctctgtctgtctctttgggtggtccggtgatctatataggaaaaatgcaatatatatatagttaagttaaagcttagggatgaaacgtgggggagaagagaaggcttgtttgttggggattgatcattttggttgtagataatgattttgcccaggatcgccgctcgtcttgcttgtacaggcgctgtggccaccttgtcgcgctctcatggtggagtttacgcttgctcttattccctctcgcaacttgaaatccatgctcgtgtctgttgccaagctctgctgtttgaagtggttcagagctgttggggggaaggatccccaagtctcaagtctcaagtctgaagtgaaagcagctgctgtgttttccccggcggtgggcgctgctgtccctgcatcttttctgttgcctcgctgcctgcctggatgcaggacgtctcacgttgatttttgctgccccatttcggtccactgcagttaattgccctgctgcttccattgtgcaaagccgacaatgtcctctgctgagacatgtgctctcctcgccatacgccctgtgcaaggatat

SEQ ID NO: 2903 - DNA, 3223 bp, Hordeum vulgare
cggaaacgcgaaggcaaccagaaagtatactgaaaagaggcccgttaaagaagaagaagagcaaaaaataaaaagagcaacggaaaataaactaggcacagccgagccggagcaaggaaaggcgcacgcacccacctcactctccccactcaagtacacactcctcgctgctcgctccccgccctgacggacggcagagtggggggagaggaagaagaagcccgagcagagagagcggcggcagccagaagacggagagagagagggaggaggggagggagatctgcgcgggggaggagcagcgatggggtgcgcggcatccaaggtggagcaggaggacacggtgcggcgctgcaaggagcgccggcgcaacatcaaggacgccgtgacggcgcgccagctgctcgcctcggcgcacgccgactacctccgctccctccgcatcacggccgccgcgctatcccgcttcgcgcagggccactcgtcgctcaccgtctcccaccacaccgcgcccgtcctcctcaccaccgccgcgccgccggccctgcacgcgcccggcccgaccgccgccacctcctccgtcgcctcgtcctcgctgccgccccccacgccgctccctcgccaccagccgccgccgccgccaccaccagtacagcagcagcagccgcaggcggccgccgctgcgctcagggtcgacatggatccgaggatgcggcggctcaaggtgccgcacatcctgtcggactcgagcgtcgcgtcgtcgttccggaagccgccggtggtggggacgccctcctcctcgtctgcctgggactgggagaacttctacccgccgtcgccgcccgactccgagttcttcgaccgccgcaagaccgatctcgaggaggcaaaccgcctccgcgagctcgacgacgaggccaaggcgcggggctacacccagcgccgccacgaccacctcaaagaagaggacgaggccgacgacggccagggagaagacgaggaggagacggagcgggaggatatgcattgcggcggatgggaggacgaggaggaccactacgcgtccacgaccacgtcggagaccagatcagaggaaggcgaggtggggaatagatccgagtgcggtttcgccgccagatcggagtacggcgggacggcgccgtccgagtacgccgccgtgccaatgcagctgaggagggccgagaggtcaggggtcggggactccttctccacggtcacgggggcgaccgagatgcggatggtggtgcgccaccgcacgctctcagagatcgtcgcggccatcgaggagtacttcgtcaaggcggccgacgccggcgacggcgtgtcggagctcctggaggccagccgcgcccagctcgaccgcaacttccggcaactcaaaaagacggtgtaccactccaacagcgtgctgtcagcactctcgtcaacatggacttcgaagccgccattggctgtgcgctacaagttggacaccaattcactggagatggggtcaatggaagggaagagccatgggtcaacactggagcggctcttggcctgggaaaagaagctatatgaggaggtcaaggctagagagagcgtgaagattgagcatgagaagaagctttctaccctgcaaagcttggaatacagagggagggatagtgccaagctggacaagaccaaggcctccataaacaagctgcaatcgctgatcgttgttacgtcgcaagcagccactaccacatcctcagccatcgtcagggtccgggacaatgagctcgcaccgcagcttgtcgagctttgttttgcgttgctgagcatgtggagatcgatgaactacttccatgagacccagaatgagatcgttcagcaagtgcgcggtctggtggacaactccatggccgagtcgacgtccgaccttcaccggcttgcgacccgtgatctcgaggccgccgtctcggcatggcactcgaacttcaaccggctcatcaagtatcagcgtgaatacatccgctctctgtatggctggctgaagctgacactcttccaagtggacagcatttccccacaagaggctcacgcgtcactcatctcacgcgagctcaccaccttctgcgacgagtggaagcaagcattggaccggcttccagacgctgtggcttcggaggccatcaagagctttgtgaatgtcatccatgtcatctacaccaagcaggcagaggagatgaagatcaagaagcggaccgagacgtactcaaaggagctggagaagaagaccaactcgctgagggccatcgagaagaagtactaccagtcgtactcgatggtaggccttgggcttcctggcagcgggcgtgacggcatcgaagggcacacgttcgacgcgcgcgaccctctctccgagaagaagaccgagatcgcccagtgccgccgaaaggtggaggatgagataacgaggcatgccaaggccgtggaggtgacaaggtccatgacgctgaacaacatccagactggcctgccaggaatgttccaggccattgctggcttctcgggcacggtcgtggaggccctcgacgtggtctgccggcgagccggatcggtgcggtaggaggatgtcagcccccatctgagcatcattttggtgtgtctctctgtctgtctctttgggtggtccggtgatctatataggaaaaatgcaatatatatatagttaagttaaagcttagggatgaaacgtgggggagaagagaaggcttgtttgttggggattgatcattttggttgtagataatgattttgcccaggatcgccgctcgtcttgcttgtacaggcgctgtggccaccttgtcgcgctctcatggtggagtttacgcttgctcttattccctctcgcaacttgaaatccatgctcgtgtctgttgccaagctctgctgtttgaagtggttcagagctgttggggggaaggatccccaagtctcaagtctcaagtctgaagtgaaagcagctgctgtgttttccccggcggtgggcgctgctgtccctgcatcttttctgttgcctcgctgcctgcctggatgcaggacgtctcacgttgatttttgctgccccatttcggtccactgcagttaattgccctgctgcttccattgtgcaaagccgacaatgtcctctgctgagacatgtgctctcctcgccatacgccctgtgcaaggatat

SEQ ID NO: 2904 - DNA, 2926 bp, Brachypodium distachyon
aggcagtgctgtgctcctcctcacttcctcagtcctactcaagtacacactcctcgctcctcccactctctatctccctcggcagcacagtggggagaagaaggagaagaagtggagggacagacaagcagcagcagcaatagaagcaagagagagaggcggaggagatctgaggcgcgatggggtgcgcggcgtccaaggtggagcaggaggacacggtgcggcggtgcaaggagcggcggcggaacatcagggacgccgtcgcggcgcggcagcagctcgcctcggcccacgccgactacctccgctcccttcgcctcaccgccgccgcgctctcccgcttcgcgcagggccacccttccctcgccgtctcccaccacaccgcccccgtcctcctctccaccgccgcgccgccggccgctctcgcccccgcgccgccagcccccgccatttcctcctccgtcgccccgtcttcctcgctgccgccccccaccccgccgctccctcgccaccaggcccaccaccacccccctcctccgccccagcccccgcagcagcagcatgcggcggcggtttcggctagggagcgggatccgaggatgatgaggcggctcaaggtgccgcacatcctctccgactcgagcgtggccagcccggcgcagtcgtcgttccggaagccgccggtcgtggggacgccgtcctcgtcctccgcgtgggactgggagaacttctacccgccgtcgccgccggactcggagttcttcgaccgccgcaagaccgatctcgaggaggccaaccgcctccgcgagctcgacgaggaagtggacaaggcccggaccaggagctacctccaccccggcagccgcgaccgcctcaaggaagaagacgaagacgaggtcgccacggacgacgaggaagatgacgaagatgcgcattgcggtggatgggaggacgaggaggaccactacgcgtccacgaccacgtcggagaccagatcggaggagggcgagctggggaacagatccgagtgcgggttcgcggccagatcggagtacggcggcacggcgccctccgagtacgccgccgctgtgccggcgccgctgcagctgaggaggagggacgagcggtcggaggccggggactcctcgtccaccgtcacggcggcgaccgagatgcggatggtggtgcgccaccgcacgctgtcggagatcgtggcggccatcgaggagtatttcgtcaaggcggccgacgccggggacggcgtgtccgagctcctggaggccagccgcgcccagctcgaccgcaacttcaggcagctcaaaaagacggtgtaccactccaacagcgtgctatcagcactgtcatcgacatggacatccaagccgccattggctgtgcgctacaagctggacactaatgcactggagatggagtcaacggaagggaagagccatggctcgacactggagcggcttttggcttgggaaaagaagctgtatgaggaggtgaaggctagagagagcgtgaagattgaacatgagaagaagctttctactctgcaaagcttggaatacagagggagggatagtgccaagctggacaagaccaaggcctccataaacaagctgcaatcattaatcgttgttacttcacaagcggccacaaccacatccacagccattgtcagagtccgtgacactgagcttgcacctcagcttgtcgagctttgttttgcgttgttgagcatgtggagatcgatgaaccatttccatgagatccagagtgagattgttcagcaagtccgtggtctggtggataattccctggctgaatcaacgtccgaccttcacaggcttgcaacccgtgatcttgaggctgccgtttccgcatggtactcaaacttcaaccggctcatcaaatatcaacgtgactacatccgttctctctatggctggctgaagctcacactcttccaagtggatagtgttgccccacaacaggctcacgcctcgctgatctcacgtgaactcacctccttctgcgacgagtggaagcaagcactggatcggcttccagacgcggtagcttcagaagctatcaagagctttgtgaatgtcgtccatgtcatatatactaagcaggcggaggagatgaagatcaagaagcggaccgagacatatgcaaaggagctagaaaagaaagccaactcactcagggctattgagaaaaagtactaccagtcgtactcaatggtgggtcttggccttcctggcagtgggcgcgacggcattgaaggccactcgtttgatgcacgtgatcctctttccgagaagaaaaccgagattgcccaatgccgtaggaaggtggaggatgagataacaaggcatgccaaggctgttgaggtgacaagatcaatgacactaaacaacatccagactggtctgcctggcatgttccaagccatagctgctttctcgagcactgtcgctgaagctcttgacgttgtctgccggcgagctggatcggtgcggtagaagctcgccccatcagaactacgagaaatcattccctgtctgtcttctttgggtttgggtggtccagtaatctatatagggggaaatgccacatatatatagttaaaagttagcgacgaaatatagggagaaggctcccttgctgtttttgccttgtccgattgatcattttggttgtagataatgattttgcccaggattgcttgtgttcttccaccctgtctgggaagtgcgaaggaattatattatgtacataacctgggctcaccttgttaagctctcaaatggacaattttacgcttgtcccctccaagagcactggcctgcaagatggtcattgcaacttgagatcaacattgtagttaactctactgtttggagtctactagggg

SEQ ID NO: 2905 - DNA, 2396 bp, Panicum virgatum
ccacggccgcgtcgtcatcgctcccgcccccgacgccgctcgcccagcacccgcacccgccgccgccgccgcagtcggcgtcgtcgatggcggccccgcagcctgcgccggtgagggctccccgcccgcggcggctcagggtgccgcacatcctgtcggactccagcgtggccagccccgcgcggtcgtccttccgcaagcagccgccggtggggacgccctcctcctcctccgcgtgggagtgggagaacttctacccgccgtcgccgccggactccgagttcttcgaccgccgcaaggctgaggtcgaggaggctaaccgcctccgcgaactcgatgaggaagagaaggcgcgggcctacctccaccaccaacacccctacaacctcaaggaggaagacgaggtcgacgacgacgacgatggcgaggtggaccatgaaccagaggggatgcattgcggcggatgggaggacgacgacgagaattacgcgtccacgaccacgtcggagaccagatcggaggagggagagatggggaatagatcggagtgcgggttcgccgccagatcggaatgcgggttcgtggccagatcggagtacggcgggacggcaccctcggagtacgccgccgtaccgttgcctctgaggagggatgagaggtcggaggctggcgattcctcctccacggtcacggcagcgaccgagatgcggatggtggtgcgacatcgcactctcgccgaaatcgtggcggccattgaggaatacttcgtcagggctgccgaggctggcaacgatgtgtccgagctcctggaggccagccgtgcacagctcgatcgcaacttcaggcagctcaaaaagacagtgtaccactccaacagtgtgctatctgcattgtcgtcgacatggacttctaagccaccattggctgtccgatacaagttggacaccaatgctctggagatggagtcaacggaagggaagagccatggatccactctggaacgtcttttagcttgggagaagaagctctacgaggaggtcaaggcaagggagagtgtgaagattgagcatgagaaaaagctgtctactctacagagcctggaatatagagggagggatagtgcaaagctggacaagaccaaggcctctataaacaagctgcaatctctgatcatagttacctcacaggctgccaccactacatcttcagcaattgttagagtccgtgacaatgagcttgcaccacagcttgttcagctttgttttgcgctattgggtatgtggaggtcaatgaaccatttccatgagatccaaaatgagattgttcagcaagtccgtggtttggtggacaactccatggctgagtcaacatctgaccttcacagacttgcaactcgtgatcttgaggctgctgtagcggcatggcactcaaacttcaaccgccttatcaagtatcaacgtgactacatccgtgccttatatggctggctgaagctcacactctgccaagtggataacactgccccacaagaagcacatgcctcgatgatctcgcgtgaactcaccagcttctgtgacgagtggaagcaagcgctagaccggcttccagacgctgtggcttcagaggctatcaagagctttgtgaatgttgtccatgtcatctacactaagcaggcagaggaaatgaagatcaagaagcgggcagagacgtactcgaaggagctagaaaagaaaaccaactcgctcaggtccatagagaagaagtattaccaatcctactcaatggttggcctcggccttcctggcagcgggcgcgatggcattgagagccacgcgtacgacgctcgtgatcctcttgcggagaagaaaactgagatcgcccaatgccatcggaaggtggaggatgagatgacgaggcacgctaaggccgttgaggtcacccgatcaatgacgttgaacaacatacagacaggcctgccaggaatattccaagccatagctggtttctcagcaacagtggtcgaaggtctcgatgtcgtttgccgccgagctgggtcggtgcggtaaaaggctgtccccccatcagaattaccaagagaccatctgcgtgcctctttttttctgggtgattcagtagttcattatatagagaagatgcaatatatatatagtggatgagatatagtagaaggctccctggatgttttgccgtgtcaggatcgttttcggttgtagataatgtgattttgcccaggatttgttgggtctcgtctcgcccttttctgggaagtgcgagggtgagacatataatgtacagacattgtggtcaccttgctgcactctaatgtcgaatcaagcctgtgcttctatctaacaagggagctactttctccatat

SEQ ID NO: 2906 - DNA, 2397 bp, Panicum virgatum
gtcatcgctcccgcccccgacaccgctcgcgcagcatccgcacccgccgccgccgccgcagccggcggcgtcgatggcagcgccgcagcctgcgccggtgagggctccacgcccgcggcggctcagggtgccgcacatcctgtcagactccagcgtggccagccccgcgcggtcgtccttccgcaagcagccgccggtggggacgccctcctcctcctccgcgtgggagtgggagaacttctacccgccgtcgccgccggactccgagttcttcgaccgccgcaaggctgagctcgaggaggctaaccgccttcgcgaactcgatgaggaagagaaggcgcgggcctacctccaccaccaacacccctacaacctcaaggaggaagacgaggtcgacgacgacgacgatggcgaggtggaccatgaaccagaggggatgcattgcggcggatgggaggacgacgacgagcactacgcgtccacgaccacgtcggagaccagatcggaggagggagagatggggaatggatcggagtgcgggttcgccgccagatcggaatgcgggttcgtggccagatcggagtacggcgggacggcaccctcggagtacgccgccgtaccgttgcctctgaggagggatgagaggtcggatgctggcgattcctcctccacggtcacggcggcgaccgagatgcggatggtggtgcgacatcgcactctcgccgaaatcgtggcggccattgaggaatacttcgtcagggcggccgacgccggcgacgatgtgtccgagctcctggaggccagccgtgcacagctcgaccgcaacttcaggcagctcaaaaagacggtgtaccactccaacagtgtgctatctgcattgtcgtcgacatggacgtctaagccaccattggctgtccgatacaagttggacaccaatgctctggagatggagtcaacggaagggaagagccatggatccactttggaacgccttttagcatgggagaagaagctctacgaggaggttaaggcaagggagagtgtgaagattgagcatgagaaaaagctatctactctacagagcctggaatatagagggagggatagtgcaaagctggacaagaccaaggcctctataaacaagctgcaatctctgatcattgttacctcacaggctgccaccactacatcatcggcaattgttagagtccgtgacaatgagcttgcaccacagcttgttcagctttgttttgcgctattggatatgtggaggtcaatgaaccatttccatgagatccaaaatgagattgttcagcaagtccgtggtttggtggacaactccatggctgagtcaacatctgaccttcacaggcttgcaactcgtgatcttgaggctgctgtatcggcatggcactccaacttcaaccgccttatcaagtatcaacgtgactacatccgtgccttatatggctggctgaagctcacactctgccaagtggataacactgccccacaagaagcccatgcctcgatgatctcgcgtgaactcaccagcttctgtgacgagtggaagcaagcgctagaccggcttccagatgctgtggcttcagaggctatcaagagctttgtgaatgttgtccatgtcatctacactaagcaggcagaggaaatgaagatcaagaagcgggcagagacgtactcaaaggagctagaaaagaaaaccaactcactcaggtccatcgagaagaagtattaccaatcctactcgatggttggcctcggccttcctggcagcggccgcgatggcattgattgccacgtgtacgatgctcgtgatcctcttgtggagaagaaaactgagatcgcccaatgccgtcggaaggtggaggatgagatgacgaggcacgctaaggccgttgaggtcacccgatcaatgacgctgaacaacatacagacaggcctgccaggaatattccaagccatagctggtttctcagcaacagtggtcgaagctctcgatgtcgtttgccgccgagctgggtcggtgcggtaaaaggccgcccccatcggagttaccaagagaccatccgcgtgcctctctttttctgggtgattcagtagttcattatatagggaagatgcaatatatatatagctcaagttagtggatgagatatagtagaaggctccttggatgttttgccgtgtcaggatagttttcggttgtagataatgtgattttgcccaggatttgttgggtctcgtctcgcccttttcttgtaagtgcgagggtgagatatataatgtacagacattgtgatcaccttgctgcactctaatgtcgaatcaagcctgctgtgcttctatctaacaagcgcgctgctttcttctatgctt

SEQ ID NO: 2907 - DNA, 2000 bp, Panicum virgatum
gatcaccgacacagccgccgcctccaccacctcgtcgacgccggcgccgcctccgtcttcttcctcctcctcctccggctcgagaccccatggcgactgtcgcggcagggagcaacaagaggggcggcggccggggccgcaaggcgctcgtggccgtgctcgacaacgaggccaacatctccgccgggaaggccgccgcccaggccggggacctctcggcctcctccgcgcagaaggcgaagcgggcgccggccaggagcggcaaggccgccaaggctgcggcggccgtcgtggacgacgtggcggagctgcaggggatgctggagcggctgcggctggagaaggagaaggcggaggagatggtgcgggagcgggacgaggtcatccggaagaaggaggaggagatcgagaccaaggagaaggagcgggagcgcctccaggccgagctcaggaaggtgcagcgcgccaaggagttcaagcccaccgtgagccttcctctcgtcaagtcgctgcttgacaaggagcaggacgcggacgacaagggcaagaagaagaagggcaaggccggcctggagaggaagaagccctgccctgcgtatgttctctggatcaaggaccaatgggtcgagatcaagaaggagaacccggaggccgacttcaaggaggtgtccaacacgctgggcgccaagtggaaggcgctgggcgccgaggagaagcagccctacgaggagcggtaccggcaggagaaggaggcctacctgcaggtggtcggcaaggagaagcgcgaggccgaggccatgaagctgctcgaggagcagcagatgcagtggaccgccaatgagctgctagagcagtacctcaagttcaggcaggaggccgaggagggcgacggcaagaaggggaagaggaagaacagcaagaaggacaaggacccctccaagcccaagcagcccatgtcggcctacttcgtgtactcgcaggagaggcgcgccgcgctggtcgcggagaagaagaacgtgcctgagattggcaagatcacgggagaggagtggaagaacatgacagaggctcagaaggctccctatgaggaagtcgccaagaagcagaaggaggaataccacaagcagatggaggtgtacaagcagaagaagattgaggaagctgcgagcctggagaaagaagaggaggagcagaagaaaatcatgaagcaagaggctcttcagctgcttaagaaaaaggagaaggcagacaacatcatcaagaaaaccaaagaaaagcgccaaaagaagaagcaggagaacgctgatcccaacaggcccaagaagcctgcctcttccttcattcttttcagcaaggaagcgaggaagcaactgctcgaggagcgcgctggcatcaataactcaaccctgaacgccctcatctcggtgaagtggaaggagctgagcagcgaggagcggcagatgtggaacgataaggccgcaccagccatggcggcatacaagaaggagatggaggagtacaccaaggcccacagctcgtccgcttgacaggacaacagattccttcacctgccgcgatgcagttcaactgacggattgggttgaacttctctaataaggattctcttctctgaatcctggtgtggtagatgacttggtgtgagtcttagctttgggtcagtttagttggcgcagttgcagtagatgttgcttccttcattcttgaacaatttgaactggttaggtttttgtggcagtttatggttgcaacaggttgagaaatttcagcaaggttggcaagtcatcaaggtttcaggtttgcttaaaagttctgatcaactgaaatggtagtgaagacttgacacccccgtcctgcgttcgtacacatccataggactatgggagtaacttgtttctcataccaacaaggttctgtttggtatgaaaattttcactaacactgctaaatagtatatatgaaacaccacgtctgtgataagt

SEQ ID NO: 2908 - DNA, 2385 bp, Panicum virgatum
ggcgaccttgctcttgctcttgctcttgaggcgtgtacttgggccatggcaaatgtagggctcatttatgctaacgggccagggcccgtgtgtgcaagcccaaggcaacacttatttccagccgaatgatcgatcaatcttagcaatggaatggtacaaaggccagctagttactccgagccgaggcccatccgtgcagtcgagcccaagctactacttatttccacggcccatttagcgatcgaatcagcccattgactgacgcagcaagcccacaacgttcggaattcaaacaggaatagcgtggaatctgctgagcatggatggcaatcacagatccacagcagacgcgccttcctggcagcttcccatcgtctactaggcccacccgccagcgactcgtcgggttagccgttgcacgcgccgacgtcacctcccgttcaaatttcaaaatttctgcccgttgcctcctcccctctcgtcttcctcctccctccctataaagtcaagtcaaacggaatggaatcagatcacagacacagccgcctccaccccctcgccggcgccggcgccacctccgtccccgacttccttctcctccggctcgagaccaaccccccccccccccaatccatggcgaccgtcgcggcagggagcaagaggggcggcggccggggccgcaaggcgctcgtggccgtgctcgacaacgaggccaacatctccgccggggacctctcggcttcctccgcgcagaagtcgaagcgggcgccggccaggagcggcaaggccggaaaggccgcggcggcggccgtcgtggacgacgtggcggagctgcaggggatgctggagcggctgcggctggacaaggagaaggcggaggagatggtgcgggagcgggacgaggtcatccggaagaaggaggaggagatcgagaccaaggggaaggagcaggagcgcctccaggccgagctcaggaaggtgcagcgcgccaaggagttcaagcccaccgtgagccttcctctcgtcaagtcgctgcttgagaaggagcaggacggagacgacaagggcaagaagaagaagaaggggaaggggaagggcaaggccggcccggagaggaagaagccctgccctgcgtatgttctctggatcaaggaccaatgggtcgagatcaagaaggagaacccggaggccgacttcaaggaggtgtccaacacgctgggcgccaagtggaaggcgctgggcgccgaggagaagcagccctacgaggagcggtaccggcaggagaaggaggcctacctgcaggtggtcggccaggagaagcgcgaggccgaggccatgaagctgctcgaggagcagcagatgcagtggaccgccaaggagctgctggagcagtacctcaagttcaggcaggaggccgaggagggcgatggcggcaagaaggggaagaggaagaacagcaagaaggacaaggacccctccaagcccaagcagcccatgtcggcctatttcgtgtactcgcaggagaggcgcgccgctctggtcgccgagaagaagaacgtgcctgagattggcaagatcaccggagaggagtggaagaacatgacagaggctcagaaggctccctaccaggaagtcgccaataagcagaaggaggaataccacaagcagatggaggtgtacaaccagaagaagactgaggaagctgcgagcctggagaaagaagaggaggagcagaagaaaatcatgaagcaagaggctcttcagctgcttaagaaaaaggagaagacagataacatcattaagaaaaccaaagaaaagcgccaaatgaagaagcaggagaacgctgatcccaacaggcccaagaggcctgcctcttccttcattcttttcagcaaggaagcgaggaagcagctgcttgaggagcgccctggcattaataactcgacactgaatgcgctcatctcggtgaagtggaaggagctgagtggcgaggagcggcagatgtggaatgataaggccgcgcctgccatggcagcatacaagaaggagatggaggagtacaccaaggctcacagctcgtctgcttgacaggataacagattccttcgcttgccatggtgcagacgtgcagttcaactgttggattgggttgaacatttttctaataaggattctcatctctgaatcctggtgtggtagatgacttggtgtgagtcttagcaaggttagtttagttggcgtagttgcagtagatgtggcttccttcattctcgaacaatttgaactggttagctttttgtggcagtttatggttgcaacaggtcgagaaatttcagcaatgttgaaaggtcataaagtcattaaggtttgcttaaaagttctgat

SEQ ID NO: 2909 - DNA, 1786 bp, Saccharum officinarum
accacacgccacctccgcctcgtcgacgccgccgactcggtctccctctccctcagtccgtctccggctccaatccatggcgaccgccgccgcggcagggagcaagaggggcggcgcccggggccgcaaggcgctcgtggccgtgctcgacaacgaggccaacatctccgccgggaaggccgcccagaccgccgacctctcgggttcctcggcgcagaagaaggcgaagcgggcgccggcaaggagcgccaaggccaaggccgccaccgcggcgccggcggtcgtggacgacgtcgccgagctgcaggggatgctgcagcggctgcggctggagaaagagaaggcggaggagatggtgagggagcgggacgaggtcatccggaagaaggaggaggagatcgagaccaaagacaaggagcaggggcgcctccaggccgagctcaggaaggtgcagcgcgccaaggagttcaagcccaccgtgagcttccccctcgtcaagtcgttgctggagaaagaccaggacgcagacgacaagggaaagaagaagaaggggaagggcaaggccggccccgagaggaagaagccgtgcccggcgtacgtgctctggctcaaagatcagtggaccgaggtcaaggaggagaaccctgaggccgacttcaaggagatgtccagcacgctgggcgccaagtggaaggcgctgggcgccgaggagaagcagccctacgaggagcggtaccgccaggagaaggaggcctacctgcaggtggtcggccaggagaagcgcgaggccgaggcgatgaagcttctcgaggagcagcagatgcagtggaccgccaaggagctgctggatcagtacctcaagttcaggcaggaggccgaggagggtgactgcaacaaggggaagaggaagaacagcaagaaggacaaggacccctctaagcccaagcagcccatgtcggcctacttcgtgtactcgcaggagaggcgcgccgccctggtcgcggagaagaagaacgtacctgagattggcaagatcaccggggaagagtggaagaacatgacagaagctcagaaggctccctatgagaaggttgcgaggaagcagaaggaagagtaccgcaagcagatggaggtgtacaggcagaagaagattgaggaagctgcgaaccttgagaaggaagaggaggagcataagaaaatcatgaagcaagaggctctccagctcctcaagaagaaggaaaaggcagataatatcatcaagaaaaccaaagaaaagcgccagaagaagaagcaggagaacgctgatcccaaccggcccaagaggccagcctcttccttccttcttttcagcaaggaagcgaggaagcagctgctcgaggaacgcccgggcatcaataactcaaccctgaacgcgctcatctcggtgaagtggaaggagctgaacggtgaggaaaggcaggcctggaatgcaaaggccgcgcctgccatggctgcatacaagaaggagatggaggagtacaccaaggctcaaagctcatctgattgacagaatagctaattcctacaagcgaactttgattataaggattctcatctctgaatcctggtttggtagatgactttgtgtgatcattagcttttcgtcaccttagttgcatagttgcaatcggtttaataaagttcagcatttgctttagtggcagtttatatggttggcacaaattgagtaatctcggcaagtttcgtaagagttgtttcagttctgaaatgtggctcacaatttacc

SEQ ID NO: 2910 - DNA, 2842 bp, Sorghum bicolor
gcagcttccctccgcctctggccccacatgccagcaactccgtaggctagccgttgcacgcgccgacgtcacctgtcgttcaaatttcaaaaattctgaccgtttgatgctcccgctccccttcttctgctcctatataaacaagtcaaaccaatcgtagaccagatcaccgaccacacaccattcatctccgcctcggcctccctctcccctccctcggtccctctccgctccaaaccccatccatggcgaccgccgccgcggcagggagcaagaggggcggcgcccggggccgcaaggcgctcgtggccgtgctcgacaacgaggccaacatctccgccgggaaggccgctgcgcaggccgccgacctctcggcctcctccgcgcagaagaaggcgaagcgggcgccggcaaggaccaaggccgccgtcgcggcgtcggcggtcgtggacgacgtcgccgagctgcaggggatgctggagcgcctgcggctggagaaggagaaggcggaggagatggtgagggagcgggacgaggtcatccggaagaaggaggaggagatcgagaccaaagagaaggagcaggggcgcctccaggccgagctcaggaaggtgcagcgcgccaaggagttcaagcccaccgtgagcttgcccctcgtcaagtcgttgctggagaaagaccaggacgcagacgacaaaggcaagaagaagaaggggaagggcaaggccggccccgagaggaagaagccctgcccggcgtacgtgctctggctcaaggaccagtggaccgaggtcaaagaggagaaccctgaggccgacttcaaggaggtgtccagcacgctgggcaccaagtggaaggcgctgagcgccgaggagaagcagccctacgaggagcggtaccgccaggagaaggaggcctacctgcaggtggtcggccaggagaagcgcgaggccgaggcgatgaagcttctcgaggagcagcagatgcagtggaccgccaaggagctgctggatcagtacctcaagttcaggcaggaggccgaggaggagggcgacagcaagaaagggaagaggaagaacagcaagaaggacaaggacccctctaagcccaagcagcccatgtctgcctacttcgtgtactcgcaggagaggcgtgccgcgctggttgcggagaagaagaacgtacctgagattggcaagatcaccggggaagagtggaagaacatgacagaagctcagaaggctccctatgagaaggttgcgaggaagcagaaggaagagtaccagaagcagatggaggtgtacaagcagaagaagattgaggaagctgcgagccttgagaaggaagaggaggagcataagaaaatcatgaagcaagaggctctccagatgctcaagaagaaggagaaggcagataatatcatcaagaaaaccaaagaaaaccgccagaagaagaagcaggagaacgctgatcccaaccggcccaagaggccagcctcttccttccttcttttcagcaaggaagcgaggaagcagctgcttgaggaacgcccgggcatcaataactcgtccctgaacgcactcatctcggtgaagtggaaggagctgagcggcgaggagaggcaggcctggaatgcaaaggccgcgcctgccatggctgcatacaagaaggagatggaggagtacaccaaggctcaaagctcctctgattgacagaataactaattcctcgctcacagagccattctagcgctggtccactcatgacatgacaagcgcggatgtatctgcatccccaattcgaacggacgcctgataatgatatataaaaaggtacaaggctaagtacaaggctaatcagcactttacatgacccacttgagcaagatcactgtgataactttgaactttaacggttgagcaattgatcaggaaaagtataggataaaaagttccatagacacacacgcacacacacgctatacttagcccgtaggaacaatcaacagcaggcttctgccttccatcacacggcagaaagtgtacaacagcatgtgagcaaataaagagaaaccgcccagcttacaatggccaccggcttgggataaacatgaacttgaactaaaaacaccacattgtcagtgaagtgatgatgtcagaataagacaatgacaccaatggattccattgtggttatgaaaacctttttttttttccttttctgtagaagctctcgtgtgttaaccttgatttgttcgatttccctgctccacaagctgaattccctggccgttgtggctaaatctgttaccgatgtacacaaattcgacaattggcgaacaaacaagattgactaaaaatttctcagtatacaagagaaatgctatacaacactcaagtgggcccgcggcggcagtagagctccggcgagatcctacactctgttacataaacagatccgtatacaaaactacagatttggattctcttcctcgctgtacattaggtgtcaatcaagaatactcctatatacgtactgtattgacgtcgtcttcagtttggagccgcgcgcccgtccgataaactttgagatgcatggtcggcgataaggccgggattccgacctaaacaatggctgcctccccgagatcaggcgatcaacgacggcaagcgcgcacttgctccctccaaagtccaaatccatcgggaggtgagatcgatgaacggcggcggccaagaacacggaggagcggcgcgttccacgacgacacgacgcgcgtgaactgatcgaggcagatcgacagtgagcttgcatgctcagccatacgtgcgtgcgtgcgctg

SEQ ID NO: 2911 - DNA, 1481 bp, Echinochloa colona
tccatctccgcctcctcgccgccgccgacgccgtctccttctccggctccgagccccacccccatggcgaccgtcgcggcagggagcaagagggccggccggggccgcaaggcgctcgtggctgtgctcgacaacgaggccaacatctccgccgggaaggccgcccaggccgccgatctctcggcgtcctccgcgcagaaggggaagcgggcgccgtccaagagcagcaaggctgccgcggcggctgcggctgcagcggcaccgtccgtcgtggacgacgtggcggagctgcaggggatgctggagcggctgcggctggagaaggagaaggccgaggagatggtgagggagcgggacgaggtcatccggaagaaggaggaggagatcgagaccaaggagaaggagcaggagcgcctccaggccgagctcaagaaggtgcagcgcgccaaggagttcaagcccaccgtgagctttcctctcgtcaagtccctgcttgagaaggaccaggacgccgacgacaagggcaagaagaagaagggcaagggcaaggccggtccggagaggaagaagccatgccccgcgtacgtgctctggatgaaagaccagtggactgaggtcaagaaggagaacccggaggccgacttcaaggaggtgtccaacgcgctgggcgccaagtggaaggcgctgggcgccgaggagaagcagccctacgaggagcggtaccggcaggagaaggaggcctacctgcaggtggttgggcaggagaagcgcgaggccgaggccatgaagctgctcgaggagcagcagatgcagtggaccgccaaggagctgctggagcagtacctcaagttcaggcaggaggccgaggagggcgacgccaagaagggaaagaggaagaacagcaagaaggacaaggaccccgccaagcccaagcagcccatgtccgcctacttcgtgtactcgcaggagaggcgcgccgcgcttgtcgcggagaagaagaatgtgcccgagattggcaaaatcaccggggaggagtggaagagcatgacagaagctcagaaggctccctacgaggaggttgccaagaagaagaaggaagagtaccacaagcagatggaggtgtacaagcagaagaagatggaggaagctgctagccaggagaaggaagaggaggagcagaagaaaatcatgaagcaagaggctctccagctgctcaagaagaaggagaaggcagataacatcatcaagaaaaccaaagaaaagcgccagaagaagaagcaggagaacgcagatccgaacaggcccaagaagcctgcctcttccttcattctcttcagcaaggaagcgaggaagcagctccaggaggagcgccctggcatcaataactccactctgaacgctctcatctcggtgaagtggaaggagctcagcggcgaggagcggcaggcgtggaacgataaggccgcacctgccatggcagc

SEQ ID NO: 2912 - DNA, 1483 bp, Echinochloa colona
ccgcctcctcgccgccgccgacgccgtctccttctccggctccgagccccacccccatggcgaccgtcgcggcagggagcaagagggccggccggggccgcaaggcgctcgtggccgtgctcgacaacgaggccaacatctccgccgggaaggccgcccaggccgccgacctctcggcctcctccacgcgcaaggggaagcgggcgccgtccaagagcagcaaggccgccaaggcggcgttggcggcggcgtcagcgccgtccgtcgtggacgacgttgcggagctgcaggggatgctggagcggctgcggctggagaaggagaaggccgaggagatggtgagggagcgggacgaggtcatccggaagaaggaggaggagatcgagaccaaggagaaggagcaggagcgcctccaggccgagctcaagaaggtgcagcgcgccaaggagttcaagcccaccgtgagctttcctctcgtcaagtccctgcttgagaaggaccaggacgccgacgacaagggcaagaagaagaagggcaagggcaaggccggcccggagaggaagaagccgtgtcccgcctacgtgctctggatgaaggatcagtggaccgaggtcaagaaggagaacccggaggccgacttcaaggaggtgtccaacgcgctgggcgccaagtggaaggcgctgggcgccgaggagaagcagccctacgaggagcggtaccggcaggagaaggaggcctacctgcaggtggttgggcaggagaagcgcgaggccgaggccatgaagctgctcgaggagcagcagatgcagtggaccgccaaggagctgctggagcagtacctcaagttcaggcaggaggctgaggaggcagacggcaagaagggaaagaggaagaacagcaagaaggacaaggaccccgccaagcccaagcagcccatgtccgcctacttcgtgtactcgcaggagaggcgcgccgcgcttgtcgcggagaagaagaatgtgcccgagatcggcaaaatcaccggggaggagtggaagagcatgacagaagctcagaaggctccctacgaggagtttgccaagaagcagaaggtagagtaccacaagcagatggaggtgtacaagcagaagaagatggaggaagctgctagccaggagaaggaagaggaggagcagaagaaaatcatgaagcaagaggctctccagctgctcaagaagaaggagaaggcagataacatcatcaagaaaaccaaagaaaagcgccagaagaagaagcaggagaacgcagatcccaacaggcccaagaagcctgcctcttccttcattctcttcagcaaggaagcgaggaagcagctccaggaggagcgccctggcatcaataactccactctgaacgctctcatctcggtgaagtggaaggagctcagcggcgaggagcggcaggcgtggaacgataaggccgcacctgccatggcagcgtacaa

SEQ ID NO: 2913 - DNA, 1748 bp, Zea mays
accgaaaacacaccatctccacctcgccgccgccgctcggatttccctctacctcaccctgtccggctccatggcgaccgccgcggtggagagcaagaggggcagcgcccggggccgcaaggcgctcgtggccgtgctcgacaacgaggctaacatctccgccgggaaggccgcccaggccgccgatctctcgtcctgctcagcgcagaagaaggcgaagcgggcgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcgataccgccaggagaaggaggcctacctgcaggtggttggccaggagaagcgcgaggccgaggcgatgaagcttctcgaggagcagcagatgcagtggaccgccaaggagctgctggatcagtacctcaagttcaggcaggaggccgaggagggtgactgcaagaaggggaggaagaagaagagcaagaaggataaggacccctccaagcccaagcagcccatgtcggcctacttcgtgtactcgcaggagaggcgtgccacgctggtcgcggagaagaagaatgtacctgagattggcaagatcaccggggaagaatggaagaacatgacagaaggtcagagggctccctatgaggaggtcgcgaggaagcagaaggaagagtaccacaagcagatggaggtgtacaagcagaagaaggctgaggaagctgctagtcttgagaaggaagagcaggagcataagaaaatcatgaagcatgaggctctccagctgctcaagaagaaggagaaggcagataatatcatcaagaaaaccaaagaaaagcgccagaagaagaaacaggagaacgctgatcccaaccggcccaagaggccagcctcttcctttcttcttttcagcaaggaagagaggaaacagctgatcgaggaacgcccgggcatcaataactcaaccctgaacgcgctcatcacggtgaagtggaaggaactgagcggcgaggagaggcaggcctggaatgcaaaggccgcgcctgccatggctgcgtacaagaaggagatggaggagtacactaaggcccaaagctcatctgcttgacagaataactaattcctgcgagtgagctttggttacaaggatcctcatctctgaatcctggtgtggtagattacttcgtgtgatctttagctttgtgtgaccttattagtcgcagcaatcagtgtaatggcggttcatatggtttagtggcagtttatattgttgccacgggcccaggaattgagtaatctttcagttctgacatttgctgaaa

SEQ ID NO: 2914 - DNA, 3374 bp, Sorghum bicolor
taagaggcctaatgctagctagcaaaactctaccagcccatcgcagcccagcttacactttctaggcccgacggatttgttcgtatgggcctgatcggaagcctcgcacggcccaccagatataccacatcgctgcaaacaaaagtacagtggcaacgacggacggacggaacggacctgaccaacacacgagacacgacgagacaatcatacggatgctgtcatcttgtccgccacctgcgactgcgagctcgttgccagctccgctagttcactcgccgcgatggcgcccaaccaccagctccgcctcgccacggctcttcctctgctgctggttctgcttctccccgcggcttcccgcgccagggacaccatcgcgccgggccagccgctccgggggaacgacacgctcgtctcctccggcgccggcagcttcgtgctcggcttcttctccccgctgggctccaacaacacctatgtcgggatctggtacgccaaggtgcccatccgcaccgtcgtctgggtggccaaccgcgccgcccccgtccgcggcgccgccacggacaacgccggcgccacgctctccgtatccagccaagaatgcgcgctcgccgtcgcggacgccaacgccacggtggtgtggtcgtcggcgtcgtccccgcggcccgccggatcctctgcggcgtcgggcggcggctgcacggcgcggatccgcgacgacggcaacctggtggtgacggaccagcgcgggcgcgtggtgtggcaggggttcgaccatcccaccgacacgctgctccccgggatgcggctcggggtggacttcgcggccgggacgaacatgacgctgacggcgtgggcgagcccgtccgacccgtcgccgagccccgtggtggcggcgatggacacgtcgggggacccggaggtgttcatctggaacggcgggaccaaggtgtggcggtcggggccatgggacggcgtgcagttcacgggcgtcccggacaccatcacttacaagggcatgggcttcagcttccgcttcgtcaacgacgggcgcgaggccacctacagcttccaggtccgcgacgccggcatcgtctcccggctggcgctcaacagcacggcggggggcatcatcggcggcggtgggctgctgcagcggtggacgtggctggagtccgccgccgcgtgggggctctactggtacgcgcccaaggaccagtgcgacgccgtgtccccgtgcggacccaacggggtgtgcgacaccaacaaggtgcccgcctgctcctgcctccccgggttcacgccgcggtcgccggcgtcgtgggcgatgcgggacggccgcgacggctgcgtccgcgccacgccgctcgactgcggcggcaacgccaaccgcagcagcagcaccgacgggttcgcgccgctgccgcacgccaaggtgcccgacacgacgcgggcggtggtggactacggctccagcctggaccagtgccggcagcggtgcctcaggaactgctcctgcacggcgtacgccagcgccaacctcaccggcgcggcgggccaccgcggctgcgtcatgtggaccggcggactcgaggacctccgcgtgtacccgtccttcggccaggatctctacttccggctcgccgccgctgacctcgcttcaataggcaagtcaaagaaaaaggtcagtatggcgatttcagttgttgtgagcataacagctgccctggcagttcttctagcaatcacagggcttttgatttggagagcaaagaaaacaaaagcaagaaaaccaggatcaaccatatggacagctagttcacgcaataaggatgggagtgaaggtaaggatcatggggatgacctggagctaccagtatatgattttgagacaatagcagcagccacggagggtttctcaactgagaataagcttggtgaaggcggctttggacctgtatataagggtaagcttgaggatggacaagaaatagctgttaaaacactttcaagaacatcaacacagggtcttgaggaattcaagaatgaggttttgttgatagctaaactccagcatcggaatcttgttcgactaattggatgcagcatttctggaccagaaaagatacttatatatgaatacatggaaaacaagagcttggacttctttatgtttgacacaaccaagagcaagctacttgactggcaaacacgataccgtataattgagggaattgctcgaggtttactgtatcttcaccaggactcgagatatagaatcatccacagagatctcaagacaagcaacattcttttggataaggatatgactcctaaaatttcagacttcggcatggctagaatgtttggcagtgatgacacagagatcaatactctcagagtagttggcacatatggttatatggctcctgaatacgcaatggatggggtgttctcggtgaaatcagatgtatttagctttggtgttatagtgctggaaatcattgctggtaaaaggaaccgaggtgtctacagctactccggccacctcaaccttctagcacatgcctggagcttattgaatggtgggaatggcttagatttagtcgacgaaaatctgaatggctcctacaactcagatgaagtgttaaaatgcctcaaagttgggcttctatgcgtgcaagagaacccagatgaccgtcccctgatgtcccaggtgttgatgatgtttgccagcactgacactgcctcgttgccaactcccaagcagccaggcttcgctgcaagaagagctgcggctgaagatacatcgtggagcaagcctgactgcagcatcgtggacagcatgaccatcacgatggttgaaggtcggtagaaaggtatgtcctatatatcagagcacaacatgatactgtagagtactagagtggaatctctgctttgttatcttgtttgacagataacaaaaaaaattagagttttgtgggttgtgattgtttatttctaggaacgaatgtaatgtgcaaaagatgtacaattcatcctaatattgaaaagaatatacagattgtatagcaaaatgaagggcaacctcaactcacattgcattgcaggcagtgcgccggtgccaagagaccaacaatccgcttatccccgtatcaccactgatctacatgagaggttttcgaaactgcaaaacgacactgacattcgagcgaatcctcagaacggcatgatgatctaaaacgtacgtcggatgagacacgcacctccgctgctcgcctcctcgcctcgcgcctccgcaccctgctgccccgcagccgcaggcacatgccacatccctctccgatgtgcgcccacatcatgcgtccaat

SEQ ID NO: 2915 - DNA, 3670 bp, Zea mays
cacttaagccgacgggtctgttcgtatgggcctgatccgaagcccagatctaccactaaaactgcagtgtccgtcccaatggcaatgacggactgaccagacgcctgaccacgacacgagccaaccatacgggtgctgtcatcttgtccaccccgtgcgactgcgagctcgttgctccgctagttcactcgccgcgacgcgatggttctgactctgctgctgcttctgcttctccccgcggcttcccgcgccagggacaccatcacgccgggccagccgctgcggggaaacgacacgctcgtatcgtccggcgccggcagcttcgtgctcggcttcttctccccgccgggctccaacagcacctacgtcgggatctggtacgccaaggtgcccgtccgcaccgtcgtctgggtggccaaccgcgccgcccccgtgcgcggcgcggcgagcgagagcgccggcgccacgctctccgtgtccagcgagtgcgcgctcgccgtggcggacgccaacgccacggtggtgtggcggtcgttgtcgtcgtcttccccgcggccgtgcgcggcgcggatccaggacgacggcaacctggtggtgtcggaccagcgcgggcgggtggtgtggcaggggttcgaccaccccaccgacacgctgctcccggggatgcggctcggggtggacttcgcggcgggggcgaacatgacgctgacggcgtgggcgagcccctccgacccgtcgccgagccccgtggtggcggccatggacacgtcgggcgacccggaggtgttcatctggaacgggccggccaaggtgtggcggtcggggccctgggacggcgtgcagttcacgggagtcccggacaccgtcacctacaagggcatgggcttcagcttccgcttcgtcaacgacgggcgcgaggccacctacagcttccaggtccgggacgcgggcatcgtctcgaggctggtgctcaacagcacgggcgtcggcggcgggctgatgcagaggtggacgtggctggatgtcgccggcgcgtgggccctctactggtacgcgcccaaggaccagtgcgacgccttgtccccgtgcgggcccaacggggtgtgcgacaccaacaaggtcccggcctgctcctgcctccccgggttcacgccgcggtccccggcgtcgtgggcgatgcgggacgggcgggacggctgcgtccgggccacgccgctggactgcgccaaccgcaccgacggcttcctggtgctgccgcacgccaaggtgcccgacgcgacgcgggcggtggtggacttcaactccagcctggagcagtgccggcagcggtgcctgaggaactgctcctgcacggcgtacgccagcgccaacctcaccgccgcgccggggcgccgcggctgcgtgatgtggaccggcggcctcgaggacctccgcgtgtacccctccttcggccaggaactctacttccggctcgccgccgcagacctcgcttcaaaaggcaagtcaaagaaggtcagtattgtggttgcaattgctgtcagcataactgctgccctggccgttcttctagcaatcacagggttttacatttggagagcaaataaaacaaaagcaagaaaatcaggtgacatactatcgctacagaatgttgatctccccaaaggggatggaaaaacatattttattgtatcaatgtaaattttttggttgatgcaattctaacttcggtattttcataggatcatccatatgggcagctggttcacacaataaggatggcagtgaaggaaaggataatggggacgacctggaactgccagtatatgatttcgagacaatagcagcagccacggagggtttctcagctgagaacaagcttggtgaaggcggctttgggcctgtatacaagggtaagcttgaggatggacaagaagtagctgttaaaacactttcaagaacatcaagacaaggtcttgaggaattcaagaatgaggttttgttgatagctaaactccagcatcggaatcttgttcgactaattggatgcagcatttctggaccagaaaagatacttatatatgaatacatggaaaacaagagcttggacttctttatgtttgacacgaccaggagcaagctacttgactggcaaacacgatatcgtataatcgagggaattgcccgaggtttactgtatcttcaccaggactcgcgatatagaatcatacacagagatctcaagacaagcaacattcttctggataaggatatgactcccaaaatttcagacttcggcatggctagaatgtttggcagtgatgacgcagagatcaatactctcagagtagttggcacatatggttatatggctcccgagtacgcaatggatggggtgttctcggtgaaatcagatgtatttagctttggcgttatagtgctggaaatcattgctggtaaaaggaaccgaggtgtctacagatactctggccacctcaaccttctagcacatgcctggagcttattgaatgaggggaatggcttagatttagtcgacgagaatctgaatggctccttcaactcagatgaagtgctaaaatgcctcaaagtggggcttctttgcgtgcaagagaacccagacgaccgtcccctgatgtctcaggtgctgatgatgctggccagcactgacactgcctcgttgccgactcccaaacagccaggcttcgctgcaagagctgcggccgctgaagacacgtcgtggagcaagcctgactgcagcatcgtggacagcatgaccatcacaatggtcgaaggtcggtagaaagctactccctccgtctcgttttagttgtcgctggatagtgcaaaattgaactatccagcgacaactaaaaagaaacggagggagtatatcagagcacaagatgtatgtatactcatgatatcagagcaaaagatgtatactgtagagtagtagagtggcatctcttcctttgttatcttatttgacaagtgtataaatgtttcctcgagaaaaatgaagaaatcagggaaactaaagttttgcgggttgtgatcgtttacttctgataacgaatataatgtacaatcaatgctaatattgaaaggaacatatagattgtagagtaaaactgaaggcgttgtcagagtgaaacctcaactcatattgcattgcaggcggtgccaagagaccaataatccgctatctcctggattcagttccccgtctcatcaaccgatctacacaatgagaagctggcgaaattgcgaaacgacattgatattcgagcgaatcgggatacctcctgcgcatccccagaactgcatgatattcgagcgaatgagacgcgcacctcagctattcacctcctctcctcgcgcctccgtctcctgccccgcagccacatccctctcgatgtgcgccacaatccaacatcatccatccaaacatccccccccccccaaaaaaaaaaaacaacaatgtgccacagtcgtgcccagcgacgggtgttggtccctggcgcgttggactgcgggcagtggcgtgaggccactggcgcattgaagtaggggtggaaaggagtatcataatttgttagattctaaattaatttaaattcaaaaataataaaaataaagcatcgtccaaaat

SEQ ID NO: 2916 - DNA, 1962 bp, Panicum virgatum
gcctccgccagcctcgctccctcgcgtcggatgccgccgccctgccgcaggtaatgccgtgaccggccgccgagcgacggacgacggtcgacgaggctgcgcgccaccgacgccgcgacgcgatgggcgagaggaggaggcgcgggagcgctgctgccgccgccgcccccggaggtggcgtcgcgcgggttgctgaggaggagaaggccgcggcggcggcgccggggaaggggccgccgccgacggtgtggttcgcgctcaagcggtcgctgcactgccgctcggagccgtcggaggtccacgtgccgagggccaaggcggccggccccgccgcgggcgccgggcacctgtcgtcgatcgccaccaagcgcgccgcgccgcggtcggggtgctcgcgctccatcgccaacctgcgggacgtcatccacgggagcaagcgccacccggggcagccgcccagctgcagcccgcggtccatcggcagcagcgagttcctcaaccccatcgcgcacgaggtcgtgctcagcaccaactcccgctgcgagctcaagatcaccggcttcggcggctgcggggggctcggcgccgtcgggaccgccgcgcaagccgccgacggcgccgtcgtgtcgtcgttcgtcggcacgctccgcccgggcaccccgggccccgcctgggccggccacggcctccactactgcggctccatgcgggccggcggcgtgcgctgcacgccgccgaggtccccgaacgtgctgctggagcggaacggctccgtgccggcggccggccaccgcgcgtcctgcgaggaggccgccaaggccgacgccggcaagggctccggcgggctgagctgccaccggtgcggcgagcagttcggcaagtgggaggcgctggaggcgcaccacctctccaagcatgcagtgacggagctggtggaaggggactcgtcgcggaagatcgtggagatcatctgccggacgagcctgctcaagtcggagagcagctgcgtgcggatcgagcgggtgttcaaggtgcacaacacgcagcgcacgctgtcccgcttcgaggagtaccgcgaggccgtgaagctcaaggccagcaagctgcccaagaagcacccgcgctgcctcgccgacggcaacgagctgctgcgcttccacggcgccacgctttcgtgcgcgctcggctccggcggcggcgcctcctcgggcagcagcagcagcctctgcgcctccgacaagtgcgccgtgtgccgcatcatccggcacggcttctccgccaggaaggagggcaaggccggcgtgggcgtgttcaccacgtccaccagcggccgcgcgttcgagtccatcgaggcgccgccccccgccggcgacgacggggagcccgccgcggcgcgcaaggcgctgctggtgtgcagggtcatcgcggggcgggtgcacaagccgctggagaacctcagggagttcgccgggcagacgggcttcgactcgctcgccggcaaggtcgggccctacgccaacatcgaggagctctacctgctgaacccgagggcgctgctcccgtgcttcgtggtcatctgcaaaccgtagcccagcatagcgagctcgagagctgggacacacctcgttgttactactagcaattaaccattcttttttcttctttttatatcttgtgctctctgtagtgcgtctcggttgccacttcgttgccgtttgttgcagctaggctatcgatgggatcggatgtggccatgtgggtgtccatgtttcagtgtaggtacatgcttgccttcatgtgtgcctcccattcaccatcgtcttcagagcaaccaagcaccccgcgtactggcctgttcgtctctgaatttgtgaatagactacagtaggttccagtttcgcggcaactgctgacccttttcttttcaaattttgtgcttcaaggtttgtgtttcaatttcaa

SEQ ID NO: 2917 - DNA, 2094 bp, Zea mays
cccgagtcgagcagttggtttttgtttggtggtgcgccattactgcgcccgcccagcacaacactttcccagggagcgtttaattgcctccgcctgcctcgctctcgcttccttcggatgccgctctgcctctgccgcgcccgccagctgcactgaccggcaggccgagcgaccgagtcacgcagttcagcaacgcgcgcgccacggcccgcgacgcgatgagcgagaggaggaggcgggcgagcgctgcttccctcgggggtggaggtggcggcggcgttggtggtgttgcgcctgcgcgggccgaggaggacaaggtcgcggcgccgggtaaagcgcctccgccgacggtgtggttcgcgttcaagcggtcgctgcactgccgctccgagccgtcggaggtccacgtgccgcgtgccaaggccggtcccgtcgcgggcgggggcgccggcgcggctgtcggcggcggccacctgtcgtcgatcgtcaccaagcgcgccgcgcggtcggggtgctcgcgctccatcgccaacctccgggacgtcatccacgggagcaagcgccacccggggcagccgcccagctgcagcccgcggtccatcggcagcagcgagttcctcaaccccattgcacacgaggtcgtgctcagcaccaactcccgctgcgagctcaagatcaccggcttcggcggctgcggggggctggcggccgtcggggtggggaccggcgccgcgaacgacgccgacggcgggggcgacggcggcgtcgtgtcgtcgttcgtcggcacgctccgccctggcacgccgggcccagcgtgggccggacacggactgccgtacagcggctccgtgcggggcagcgtgcgctgcacgccgccgaggtcgccgaacgtgatgctcgagaggaatggctcagtggtgaacggccaccgcgcgtcatgcgacgaaaccgctaaaaacggcgccagcaagggctccggtgggctcagctgccacaagtgcggcgagcagttcagcaagtgggaggcgctggaggcgcaccacctctccaaacacgcagtgacggagctggtggaaggggactcgtcgcggaagatcgtggagatcatctgccggacgagcctgctcaagtcggagagcagctgcgtccggatcgagcgcgtgttcaaggtgcacaacacgcagcggacgctgtcccgcttcgaggagtaccgcgaggccgtgaagctcaaggcgagcaagctagccaagaagcacccgcgctgcctcgccgacggcaacgagctgctgcgcttccacggcgccacgctctcgtgcgcgctcggcggcggctccggctcttccagcctctgcgcctccgacaagtgcgccgtgtgccgcatcatccggcacggcttctccgccaggaaggagggcaagggcggcgtgggcgtgttcaccacgtccaccagcggccgcgcgttcgagtccatcgttgaggcgccccccgccatcggcgtcggcgacgacgacggagcgggccagctgggcctgggcaccgcgcgcagggcgctgctggtgtgcagggtcatcgccggccgcgtgcacaagccgctggacaacctcaaggagttcgtggggcagacgggcttcgattcgctcgccggcaaggtcggaccctactccaacatcgaggagctgtacctgctgaacccgagggcgctgctcccgtgcttcgtcgtcatctgcagaccgtagcctactactagctaaacacaccgtctcattcttctctcttcccacttttctctttcgattgctactctagtgtacgtagttaacacggacacggcatagctatcgcctatcggttggaaggtcggatggatttgtccatgtttccgtgcaggtgcgtgcgtgccttcatgagctcgtggttcggttgcctggttcaccgtcggcttcgaccagctgagcagacgacatcgaaccagaaccaatcaacactcgtaggtagcacaaagagtagctcatcatcactcgtagagtcgtttctcatgaacagactaggttcaagcatggtgtttaaactctgccacgaagttaccaatcgggc

SEQ ID NO: 2918 - DNA, 2171 bp, Oryza sativa
cctctggttggaagttggaactaacctcgctgtcttggctgagctactccatatctcccacgcgagtcacaagacagcagaacgcgcgcgaaaccaaagagagagagcgctcagcgtgcagagcgagcagttggtggtgagcctttactaccgccaaccccaagatttaattgcgtcctcctcctgtgccgccgcgctctctctctctctcgcttcggatgccgctattgctgctgctgcgcctgtggctgccataagtatatcgcactccacggtgaccgaccgaccgacgcagtcgtcacgggcgcggcagatagctggctagtggctagcaccgcgcgtcgagacgggatgggcgagaggaggcgccgtgccagcgctgtcgccggcggccgggctgaggatgagaaggctgcttcggcgcctgcggccgcggccccggcaccgacggtgtggttcgcgctgaagaggtcgctgcactgccggtccgagccgtcggaggtgcacgtgccgaggcccaaggccgtcgccgccgccgctgcgggcggtggcgggcacctctcggcgattgtgaccaagcgcgcggcgccgcggtcgggttgctcccggtcgatagccaacctgcgggacgtcatccacgggagcaagcgccacccggagcggccgccgagctgcagcccgaggtccatcggcagcagcgagttcttgaaccccatcgcccacgaggtggtgctcagcaccaactcccgctgcgagctcaagatcaccggcttcggtggctgcggcggcctcgcggcggcggcggcggcggggggcggcgtactcgcgtcgccgcacgaggcggacggcgacggcgccgtggtgtcgtcgttcgttggcacgctccggccgggcaccccggggcccggctggagccacggcctgcagtacagcggctcgtgccggggcagcatgcggtgcacgcctccgaggtcgccgaatgtgctgctggacagcagggacgccgccgcggccggggtgaccgctcaccgcgcgtcctgcgaggacgccgtcaagagctttggcaagggcggcggcctaagctgccaccgttgcggtgagcagttcagcaagtgggaggcactggaggcgcaccacctttccaagcatgcagtgacggagctggtggaaggggactcgtcgaggaagatcgtggagatcatctgccggacgagcctgctcaagtcggagagcagctgcgtgcggatcgagcgtgtgttcaaggtgcacaacacgcagcggacgctggcgcgcttcgaggagtaccgtgaggcggtgaagctgaaggcgagcaagctgcccaagaagcacccgcgctgcctcgccgacggcaacgagctgctccgattccacggcgccacgctctcctgcgcgctcggcggcgcggcgggctcctccagcctctgcgcctccgacaagtgcgccgtctgccgcatcatccgccacggattctccgccaagaaggaaggcaaggccggcgtcggcgtcttcaccacgtccaccagcggccgcgcctacgagtccatcgaggcctccgccggcgccgtcgtcggtggcgacgacccggcggcgacgcgcaaggcgctgctggtgtgcagggtcatcgccggcagggtgcacaagccgctcgagaacctcaaggagttcgccggacagaccggcttcgactcgctcgccggcaaggtcgggccctactccaacatcgaggagctctacctgctgaacccgagggcgctgctcccgtgcttcgtggtcatctgcaaggcttaactccagagtcatgcattgcaaacgactaattaatcaagtaattaaccattctttccttcgtgtactagctaccgatcggttgccagcttgttgccgtctcttctgtatgagctagtatccatcagatgcatttgtccatacttgtgtgagcgtacgtggggggtcacgtgtaagagtggatcgattcgccatctacttgcatgcttaccagacgacagcgaatcaaccatgcaccgtgaagcgaaactaaccattagttttgttacttactcattttcggttacttggaatacttttcatgcgtgctcttcgatcttgtcttctttctctagtagctactggctactggcataacattctcc

SEQ ID NO: 2919 - DNA, 2069 bp, Oryza sativa
gttggaactaacctcgctgtcttggctgagctactccatatctcccacgcgagtcacaagacagcagaacgcgcgcgaaaccaaagagagagagcgctcagcgtgcagagcgagcagtgggtggtgagcctttactaccgccaaccccaagatttaattgcgtcctcctcctgtgccgccgcgctctctctctctctcgcttcggatgccgctattgctgctgctgcgcctgtggctgccataagtatatcgcactccacggtgaccgaccgaccgacgcagtcgtcacgggcgcggcagatagctggctagtggctagcaccgcgcgtcgagacgggatgggcgagaggaggcgccgtgccagcgctgtcgccggcggccgggctgaggatgagaaggctgcttcggcgcctgcggccgcggccccggcaccgacggtgtggttcgcgctgaagaggtcgctgcactgccggtccgagccgtcggaggtgcacgtgccgaggcccaaggccgtcgccgccgccgctgcgggcggtggcgggcacctctcggcgattgtgaccaagcgcgcggcgccgcggtcgggttgctcccggtcgatagccaacctgcgggacgtcatccacgggagcaagcgccacccggagcggccgccgagctgcagcccgaggtccatcggcagcagcgagttcttgaaccccatcgcccacgaggtggtgctcagcaccaactcccgctgcgagctcaagatcaccggcttcggtggctgcggcggcctcgcggcggcggcggcggcggggggcggcgtactcgcgtcgccgcacgaggcggacggcgacggcgccgtggtgtcgtcgttcgttggcacgctccggccgggcaccccggggcccggctggagccacggcctgcagtacagcggctcgtgccggggcagcatgcggtgcacgcctccgaggtcgccgaatgtgctgctggacagcagggacgccgccgcggccggggtgaccgctcaccgcgcgtcctgcgaggacgccgtcaagagctttggcaagggcggcggcctaagctgccaccgttgcggtgagcagttcagcaagtgggaggcactggaggcgcaccacctttccaagcatgcagtgacggagctggtggaaggggactcgtcgaggaagatcgtggagatcatctgccggacgagcctgctcaagtcggagagcagctgcgtgcggatcgagcgtgtgttcaaggtgcacaacacgcagcggacgctggcgcgcttcgaggagtaccgtgaggcggtgaagctgaaggcgagcaagctgcccaagaagcacccgcgctgcctcgccgacggcaacgagctgctccgattccacggcgccacgctctcctgcgcgctcggcggcgcggcgggctcctccagcctctgcgcctccgacaagtgcgccgtctgccgcatcatccgccacggattctccgccaagaaggaaggcaaggccggcgtcggcgtcttcaccacgtccaccagcggccgcgcctacgagtccatcgaggcctccgccggcgccgtcgtcggtggcgacgacccggcggcgacgcgcaaggcgctgctggtgtgcagggtcatcgccggcagggtgcacaagccgctcgagaacctcaaggagttcgccggacagaccggcttcgactcgctcgccggcaaggtcgggccctactccaacatcgaggagctctacctgctgaacccgagggcgctgctcccgtgcttcgtggtcatctgcaaggcttaactccagagtcatgcattgcaaacgactaattaatcaagtaattaaccattctttccttcgtgtactagctaccgatcggttgccagcttgttgccgtctcttctgtatgagctagtatccatcagatgcatttgtccatacttgtgtgagcgtacgtgggggttcacgtgtaagagtggatcgattcgccatctacttgcatgcttaccagacgacagcgaatcaaccatgcaccgtgaagcgaaactaaccattagttttgttacttactca

SEQ ID NO: 2920 - DNA, 2489 bp, Sorghum bicolor
ttattaaatagaaacgaaagtactactattcacattttgcaaaattttttagaagtaaacaaggcccaggcctaaccagcacccgccggagatgcgagaactcacctcgctgtcgagctggtgagcgtgagccccgccgagtcacaggtcgcgcgcaaacacccaccgccctcgtctctattcattgaggtcgtcaggctcggcgggcaacacgccaacacgccaggcaacacagagcagcgacgcagcgtagagctgggcagacggcagagccccgagccgagcagttggtttggtggtgcgcctttactgccgcccagcccgacccgggtttaattgccggtccgcctgcctcgccctcgcgctcgcctccttcggatgccgctctaccgcgcgcgccagccgcactgaccgaccggctggccgagcgaccaagtcaggcggctcagctacgctacgcacgcacgcgccacggcccgcggcgacgcgatgggcgagcggaggaggcgcgcgagcgctgcttccttcggtggcggcggtggcggtggcggcggtggtagtgtggtgcccgcgcgtgccgaggagggcaaggccgcggcgccagggaaggcgccgcctccgacagtgtggttcgcgctcaagcggtcgctgcactgccgctccgagccgtcggaggtccacgtgccgcgcgccaaggccgccggacccgtcgccgccggaggcgcggccgtcggcggcggcggccacctgtcgtcgattgtcaccaccaagcgcgccacgcggtcggggtgctcgcgctccatcgccaacctccgcgacgtgatccacgggagcaagcgccacccggggcagccgcccagcagctgcagcccgcggtcgatcggcagcagcgagttcctcaaccccatcgcgcacgaggtcgtgctcagcaccaactcccgctgcgagctcaagatcaccggcttcggcgccggctgcggggggctggcggccgtcggggtcggaggcgggaccggcgccggcgcaggcgcaggcggcgcgcacgacgcggattccggcggcgtcgtgtcgtcgttcgtcggcacgctccgccccggcacgccgggccccgcgtgggccggagccggaggacacggcctgccgtacagcggctccgtgcggggcggcggcggcgtgcgctgcacgccgccgaggtccccgaacgtgctgctcgagaggaacggctccgtggtgaacgggaacggacaccgcgtctcctgcgacgaaaccggcaccaagcacggcgccggcaagggctccggcgggctcagctgccacaggtgcggcgagcagttcagcaagtgggaggcgctggaggcgcaccacctctccaagcatgcagtgacggagctgttggaaggagactcgtcgcggaagatcgtggagatcatctgccggacgagcctgctcaagtcggagagcagctgcgtccggatcgagcgggtgttcaaggtgcacaacacgcagcggacgctgtcccgcttcgaggagtaccgcgaggccgtgaagctcaaggcgagcaagctgcccaagaagcacccgcgctgcctcgccgacggcaacgagctgctgcgcttccacggcgccacgctctcgtgcgcgctcggcggtgccggctccggcaactccagcctctgcgcctccgacaagtgcgccgtgtgccgcatcatccggcacggcttctccgccaagaaggaaggcaaggccggcgtgggcgtgttcaccacgtccaccagcggccgcgcgttcgagtccatcgaggcggcccccggccccggcgccggggacgacggagcggaccagctgcagctgggcaccacgaccacgcgtaaggcgctgctggtgtgcagggtcatcgccgggcgcgtgcacaagccgctggacaacctcaaggagttcgtggggcagacgggcttcgactcgctcgccggcaaggtcggcccttactccaacatcgaggagctgtacctgctgaacccgagggcgctgctcccgtgcttcgtggtcatctgcaaaccgtagcctactgtactagtactagctaaacacaccatctcattgttagtaccagtaattaaccattcttttctcctttcaccctctgtctctctctccgtcgtgcgtttcgattgctactctgttgtctgagctactactagtgtaacacagcatagctatcggatgggtttgggtcggatgtatttgtccatctttctgtgcaggtgccgaggtgcgtgcgtgcgtgccttcatgtgctcgtggctgcttgggtgtctggttcaccgtcggcttacgaccagctgagcagacatcgaaccagtcaacagtcatgctttgtctagtgtcgatgtagagtcgtaaacagactacggagtacagtaggttccagtttggcgtttaaactcctaatataccacgaaattaccaatcaggcaaccactggtctcttg

SEQ ID NO: 2921 - DNA, 2270 bp, Zea mays
cgtcaggctcggcgggcaacacgccagggccaggcaaacagcagcgtagagctgggcctgggcagagcccccgagccgagcagttggtttggtggcgcgcctttactgccgctgccgctcactttcccagggaggggttaattgcctccgcactgaccgcgaccaagtcacgcagctcagccgcgcgccgcgatgggcgagaggaggaggcgtgcgagcactgcttccctcgggggtggaggtggagctggaggtagcggtgctgtgcccgcgcggaacgaggaggacaaggccgcggagccgcctccaccgacgttgtggttcgcgctcaagcggtcgctgcactgccgctccgagctgtcggaggtccacgtgccgcgcgccaacaaggcctccggtccagtcgtcgcgagcggtggccacctgtcgtcgatcgtcaccaagcgcgcctccgcgcggtcggggtgctcgcgctccatcgccaacctgcgggacgtcatccacgggagcaagcgccacccggggcagccgcccagctgcagcccgcggtccatcggcagcagcgagttcctcaaccccatcgcgcacgaggtcgtgctcagcaccaactcccgctgcgagctcaagatcaccggcttcgggggctgcggcgggctggcggccgtggggaccggcgccgcggccgcgcacgacgcctgcggcgggggcgacggcggcgtggtgtcgtcgttcgtcggcacgctccgccccggcacgccgggccccgcgtgggccggagccgggcacggcctgccgtgcagcggctccgtgcggggcggggtgcgctgcacgccgccgcggtccccgtgcgtgctgctcgagaggaacggttccgtggtcagcggccaccgcgcgtcctcctgcgaggagaccgcaaaggacggcggcgccggcaagggttccggcgggctcagctgccacaggtgcggcgagcagttcagcaagtgggaggcgctggaggagcaccacctctccaggcatgcagtgacggagctggtggaaggggactcgtcgcggaagatcgtggagatcatctgccggacgagcctgctaaagtcggagagcagctgcgtccggatcgagcgggtgttcaaggtgcacaacacgcagcggacgctgtcccgcttcgaggagtaccgcgaggccgtgaagctgagggcgagcaagctgcccaagaagcacccgcgctgcctcgccgacggcaacgagctgctgcgcttccacggcgccacgctctcgtgcgcgctcggcggcggcggcggcggcggcggcggttcgtcccgcctctgcgcctccgacaagtgcgccgtgtgccgcatcatccggcacggcttctccggcaggaaggagggcaagaccggcgtgggcgtgttcaccacgtccaccagcggccgcgctttcgagtccatcgaggctgccggcgccgacggggctggcgctggcagtgtcagtggcaccacgcgcagggcgctgctggtgtgcagggtgatcgccggccgcgtgcacaagccgctggacaacctcaaggagttcgcggggcagacgatgggcttcgactcgctcgccggcaaggtcggcccctactccaacatcgaggagctgtacctgctgaacccgagggcgctgctcccgtgcttcgtggtcatctgcaaaccctagcctactagtacttgcttaaacacaccgtctcattgttagtgctggtaaattaaccaaccaaccattcttctctcctttcgactgctgctgctctgtttgtgtgagtgagctacacgttgggtcggatgtatttgtccgtccatgtttctgtgcagaggtgcgtgcgtgccttgggtgtctcattcaccgtcgggcttcggaccagctgagcagacgacatcggagaaagatgtgtcgatgtaggtagcacacaaagagtagctagctcatcactctctagtatgtacagtcgtctcgtctggtgtttaaactctaccacgaagttaccagtcaggcatccactggtcccttgaatgctgacttgctgcgtatagctatagccccgtcgtccagctctcgtttcagattttgtcctgccttgacagacttgtgttaaataaacaccgcggaagaaggcaagaagcatcgaaagtatcttggatgctataaattgggaagaaaaaacacacattggatataacacaacagagaactcaacaagaaactggatggaacatagaaaaaattcagca

SEQ ID NO: 2922 - DNA, 2311 bp, Pennisetum glaucum
tgtgggagtcatgggttcttctccctccaaagctactggggaggatgccctggttctgtgcaaggatcggatgcgccatatcaggcgagccattgactccagggatgcactgtcagcagcgcacttatcgtatacccaatccctccgtactgtggggacggcactgcggcggtatgctgagtccgagatttcaccagaatcatcactctctatttcagaagtggataagtcgccatcacattcctctatggcatctccctcgccttcgcatgcagtagacaatgttgcctctccgatgcatcgagcaagtccattgactactactccctcaacacgaatccattgcatgaaagcgtcgggaactacacctttgacattcatgattgatccatctgctgctgaatttgttgggcaagaatccccagtctcagcttttgtgccgcccccgccaccattacctccagaattatgtacctcatgggacttctttgaccccattgatgctgctggtagctcgtcttccaacaatgagaatgggctaacattgaacttcaatagattgaagggtttgagagagtcaagggaagctgaagttgcgccgctgaaagaagaagaagaagcagtcatgtctgaaagaaggcatacagaacttcctgatagtaatgcactacctgagcaggaaagagggatcagtaaaccaaggcaatcgatggatgcttcatccaaagctacttcctctgagcaggttgctgcaaaggtggaggaaagtgaaatggaaaaagaattgtgtgcagagacagaagatccttcggagttcatcactcatcgagcaaaagattttgtggcaagcatgaaggacattgaaactcggtttatacgtgcagctgaagcagggaatgaggtttcccgtatgctggagacaaagaagatcagactggacatatgtcctaaaataccaggttctccaggcaagctaccaactgcccgatttgtgtcagcacttcgagtctgctgcaatcgtgatattattctcaaccaggagactgcacaacatgtctcaaaggttgtcacatggaagcgttctgtctcatctctatcatcatcatctaagagtgcactcatgacatcaataattaaagacgatgtggatgacagtaatagtgattttgttgaggaatttgccatggtatctggaagccactcttctacattggacaggctacatgcatgggagagaaaactatatgatgaaatcaaggcaagtgaaaatgtgagaaagacctatgatgagaaatgtaacctcctccggcgccaatttgcacgaggcctaaacgcgcaggtgattgataagactagagctgttgtaaaggatctccattccagggtatctgttgcaattcaagcagttgatgcaatctccaaaagaattgagaagataagggatgaagaactgcagccacagcttgttgagctgattcaagggttaatcagaatgtggaagtctatgttggaatgtcaccacaaacagttcatcacaatcacactggcgtaccatgtgaaaagctctacctcggcgcaacaaggcgagcaccaccgtcaggcggcgatgaatctgtggaacgagatggacagcttttgctccagcttcaggaactgggtcactgctcatcagtcgtatgtcgaggccctcaacgcatggctgcagaaatgcgtcctgcagccaccacaagaccgacgcaggcgcaagcgcaaggtctcattcccaccccgccaggccgtctccccaccaatattcgtcctatgccgagactggctcaccctgacggagtcactccctgctgaagaggtatgcaagtccatcaaagatgtgatgcagctcctccgtgactcatttgaccaccaggatgatcagaacaaacccaaaagtgagtcacaggagtgtgggatgctggagaacaacgagcaggaggaggcaaggagcggaagtgtacccgcagctgaagggctgcagtcaagactgacgatggttcttgatcgcctgacaaagttctccgaggcatcgctaaagtgctacgaggagctcaagcagaactatgagatagctcacgatgattacaagagagttggacctattgctcaacttgcttagccctatatggatggtggcatgaaatctttcagaaataatgtggatggtggcatgtgtccttttcatctgttctggattctggatgacaaattctagtgttttggtatatattttgtggatgatcagattatagtacaacctttggcctaatatttagtgaca

SEQ ID NO: 2923 - DNA, 3807 bp, Panicum virgatum
ggtggtttttattttttttctttcttacagttgcttgatgccttgatcagaggttggaattagggaaaggtctctgctttgctggttccttttctcactcttttggtccagcttatctgctcgcacagctcctgcttgctttaatcatagaactgcctgctttaatcatggttcaggccttcaagaaatacactttgaccattggcttctgatgtgtagagtattttcaggttagcaagtgaaggaataaaagagtttggttgccttttccttccctttggatgtatgattggtaggttcttagacctgcaccatgtttcagtttgagctcttggagcaatggcaattcttctaccttgttttctctcttttgtgtagtagattaattgcctagctaaaattagtaaattactgttttcaggctctgttgtggctgaaatgactacatcagctcaagttggcagcaaatgtgatcagctttggggatatgaagtatttttagttagttttattgatgtgccctgaagtttgttttaggccaatgctgttaaatttggttctgcattttatatattatataccctgataaccattatttttgttattgataggatctgaggagcaaagatcactgctgatcccaagcaagatttctaattggtggaagctgttgacagtagttggattttgatgagtctactggtatctagtatagtgcagtaggggatctgcagtttcgtgggactcatgggttcttctccctccaaagccactggagaggatgccctggttctgtgcaaggatcggatgcgccatatcagacgagccattgactcaagagatgcattgtcagcagcacacttatcatatactcaatccctcagtactgtggggactgcactgcggcggtatgctgaatctgagatctcaccagaatcatcactctccatttcagaagtggataagtccccttcacattcgtctatggcatctccctcgccttcgcgtgcagtagagaatgttgcctctccaatgcatcgagcaagtccattttctactcctcccgcaacgagaatccactgtatgaaagcggcaggaaccacacctttgaccttcatgattgatccatctgctgctgaatttgtggggcaagaatccccagtctcagcttttgtgccacccccaccaccattacctccagaattatgtacctcatgggacttctttgatcccattgacactgctggtagctcgtcctccaacaatgagaatgggctaaccttgaactttagtagattgaagggtttgagagagtcaaaggtagctgaagtagtgccactgaaagaagaaggtgaagaagaagaactagttatgtctgaaagaaggcacacagaatttcctggtgttaattcaccatctaagcaggaaagagagccagagcaaagtgtgatcagtaaaccaagtgaattggtggatgtttcatccaaagctaaatcttctgagcaagttgctgcaaaggtggaagaaagcgaaatggcaaaagaattgtgtgcagagacagaagatccttcggagttcatcactcatcgagcgaaagattttgtgtcaagcatgaaggacattgaaacgcgatttatacgtgcagctgaagcagggaatgaggtttccagaatgctggagaccaagaagatcagactagacatatgcccaaaaatgccaggttctccaggcaagctacctactgcccgatttgtgtcagcgcttcgagtctgctgcaatcgtgatattattctcaaccaggaaactgcacatgtttcaaaggttgtcacttggaagcgttccgtctcatctctatcgtcatcatctaagagtgcactcatgacatcgataattaaagatgatgtggatgacagtaacagtgattttgttgaggaatttgccatggtatctggaagccactcttctacattggacaggctacatgcatgggagagaaaactatacgacgaaatcaaggcaagtgaaaatgtcagaaaggcctatgacgagaaatgtaacctcctccggcgtcaatttgcacgtggcctaaatgcacagctgattgacaagactagagctgttgtaaaggatctacattccagggtatctgttgcaattcaagctgttgatgcaatctccaaaagaattgagaagataagggatgaagaactgcagccacaactcattgagctgattcaagggctaatcagaatgtggaaatctatgctggaatgtcaccacaaacagttcatcacaatcacactggcataccatgtgaaaagctcaaccccggtgcagcaaggcgagcacgaccgccaggccgcattgaatctattgtacgagatggacatcttttcctcaagcttcaggaactgggtcactgctcatcagtcttatgttgaggccctcaacgcatggctccagaaatgtgtcctgcagcctccccaagaccgacgcaggcgcaagcgcaaggtctcattccctccccgccaggctgtctccccaccaatattcatcttatgcagagactggctcaccctgacggagtcactccctgccgatgagctatgcaagtccattaaagatgtgatgcagctcctccgtgactcgtttgagcaccaggatgaccagaacaagcccaaaagtgagtcgcaggagtgtgggatgctggagaacaatgagcaggaggaggcgaagagcggaagtgtgccagcagctgaaggactgcagtcaagactgacaatggttcttgatcgcctaacaaagttctcagaggtgtcgctgaagtgctacgaggagctcaagcagaactatgagatagctcgtgatgattacaagagagttggaccatatgctcaacttgcttagccccatgtggatggtagtgtatgccttttttcctatctgttctggatggcaaattctagtgttttggtatatattttgtggccgaccagattctagtacaatgttttgcctgatatttagtgacattgcctcaatctttggcatatttaagcttcgtcaactgtccttgatgttggctgggcatatcagaactttaacctttatcacaacaatgatagaacaagcaatctgtagttcatgagctcaccttgcaggcataatttttgcaaaattaaggaaaacaagttatttttgagatttttttggcaggcaaccaagcagacatcaaggctgcacattcaagttttggactgattaaaacaattgtgccaaaaaaataatatgatagtttattcacagaaggttcgactttacagtttacgtatacaagcaccgataagcttattttcccatctatacacttcattgcaacttggtgtacatatgaacttatcccagctatgttaatatttatatcatttagaagccaacatattgagtatactgtgcataggcctctgattgcatgccaattggggcacgaatgatgagatctggaagatcaaatgcgtcgacgagttcttttgccacaagcctcacttggtagctaaggtagtctgtcaacttgtgaatagcctacatacatacaagggaatactgctgtcagattccgaacttccggttccagcgtgaatttagaactgaaattgctgcatgagagtgacaagcacaaacctttgctttgtttggggcaacatagtctacattccgatatgttccaatatctttccagatcctatcaagcgcgtaaaggtcacacacgagctttaggacctctcgtgttttttcatcagggcaact

SEQ ID NO: 2924 - DNA, 2953 bp, Sorghum bicolor
tgcagcgcagcgccgacgctcatctccctggcagcgccgctcggctcggtccctcagcgcagatcttctgctccttcccacactcgcgctcctcggtcccaaggaccggatcttccgcgcgtcggcggctccccctcggcggcgtccagcgaggaggggcagtcccaggctcggcggcggcgtcggcggctccccccaccttctctcgccagtcgcctcgcgccctcgcctgcgtcctccgagcaccggccgacgaccctgcgatcagaggagcaaagaccattacttatcataagaaagattctagttggtggaagcttttatctgtagttggactgtgatgaatttactggtcttgagtatagagtaggcaatctgcagtttagtggaactcaatgggttcttctccttccaaagccactggagaggatgcccttgttctgtgcaaggatcggatgcgccatatcagacaaaccattgactcaagggatgcactgtcagcagcacacttatcttacacacaatccctccgtactgtgggtactgcactgcggcggtatgctgagtctgagatctcaccagaatcatcactctccatttcagaagtggataagtcaccatcgcattcctctatggcatctccctcaccttcgcgtgcagtagagaatcttgcctctccagcacatcgagcaagtcccttgactactcagccctcaacaagaatccattgcatgaaagcagcagcaaccgctcctttgacctttgtgatagatccatctgctgctgaatttgtggggcatgaatctccagtctcagcttttgtcccacccccgccaccattgcctccagaattgtgtacgtcatgggacttctttgatcccattgatgctgctagtagctcttcctccaacaatgagaatggagtaaccttgaacttcagtagattgaagggtctaagagagtcacgggtagctgaagtagttccattgaaagaaggtgaagaagaaatcatgtctgaaagaaagcatacagagcttcctgatgataatgcaccatctaagcaggaaagagaaccaaagcaaggtgggactaggaaaccaagtcagttggtggatacttcaaccaaagctacttctgagcaggttgctgcaaaattggaggaaagcgaaatggaaaaagaattatgtgcggaggcagaggatccttcagagttcatcactcatcgagccaaagattttgtgtcgagcatgaaggacattgaagcccggtttatgcgtgcagctgaagcaggaaatgaggtttccagaatgcttgaaaccaagaagatcagacttgacatatgtgctaaaatgccaggttctccaggcaagctacctactgcccgatttgtgtcagcacttcgagtgtgctgcaatcgtgatgttattctcaaccaggaaactgcgcagcatgtctcaaaggttgtcacatggaagcgttctgtctcatctctttcatcatcatctaagagtgcacttatgacatcgataattaaagatgatgtggatgacagtaatagtgattttgttgaggaattcgccatggtatctggaagccactcttctactttggacaggctacacgcatgggagagaaaactatatgatgaaatcaaggccagtgaaaatgttagaaacgcctatgatgagaaatgtaacctcctccggcgtcaatttgcacgaggcctaaatgcgcagctgattgataagactagagctgttgtgaaggatctccattccagggtatctgttgcgattcaagctgttgatgcaatctctaaaagaattgagaagataagggatgaagaactgcagccacaacttgtcgagctaattcaagggctaatcagaatgtggaaattgatgctggaatgtcaccacaaacagttcatcacgatcacattggcataccatgtgaaaaactcaaccccagtgcatcaaggcgagcaccgccgccaggcggcaatgcatctgtgcaatgagatggacagcttctcctccagcttcagaaactgggtcactgctcacaaatcgtatgttgaggccctcaatgcatggctgcagaagtgcctcctgcagccaccccaggaccgccggaggcgtaagcgcaaggtctccttccctccccgtcaggccgtctcccctcccatatttgtcctctgcagggactggcttgccatgacagaatctcttcctgctgacgaggtatgcaagtccctcaaagatgtgatgcagctcctccgtgactcgtttgagcaccaggatgagcagaacaagcccagaagtgagtcgcaggagtgtgggatgctggagaacaacagcgaaccagaggcggcgaagagtgggagtgggagtgtagcgtcagctgaagggctgcagtcgagactaacagcagttcttgaccgcctgacaaagttctcggaggcatcactgaagtgctacgaggagctcaagcagaactatgagatggcttgtgatgattacaagagagttggaccaaatgctccacatgcttaagatatgtcgattgtggtgtatgacttcttcctatctgttctggatgacaaattctagtgttttggtatatattttgtgaacaatcaggttgtagtacaatcttttgcctaatattagtgatagtgcagtcagttatgtatgcctcagtgttacagattttaagcttcgtcacctgtccctgatgcttggaaaggcgtatgagaaccgttgtgacaaagatatatcaggcagcgtatcatgagttatgcgcgcatgtaatctgtgtctcaccttgcagatatggcatatgtactggcactctggcattattatttagaaaagttctgcactcatgtatctcctagtcacctgtagctgtgggctgtggcataggttctggcattattttttacaatgat

SEQ ID NO: 2925 - DNA, 2709 bp, Oryza sativa
tgcgcatgtgacccggatcgatcgacagcggtcgcccgcaccgcattgccgctgctcccgtttagtccagccgccgcctcctcctcctcctccgccgccgccgcctgttcaggctccgatccaaggactgaagactactgccagtttcagggaggaattctactcagtggtagcttgtggttgtagctggtcttttgatgaatctgttggtctcaaaaacattgtagaatagtatttgttggttcgttgaacacaatgggttcttcgccatccaaagccactggtgaggatgccctagttctatgcaaggagcgaatgcgccatatcaggcgagctattgattcaagagatgcactgtcggcatcacacctatcatatactcagtccctccgtagtgtgggtactgcattgcggcggtatgcagagtctgagatctcaccagaatcatcactgtccatttcagaagcagataagtcaccatcacattcttctatggcttctccatcaccttctcgagcagtagagagcactggctccccagtacatcgaggtagtcagctgactcctccctcaacaaagatccattacatgaaagcagcaggaacaaaacctttgacgttcactattgatccatctgctgctgactttgtggggcaagaatccccggtatctacctttgtgccaccaccaccaccattgccccctgaattatgtacctcgtgggacttcttcgattccaattatacttctggtagtgccacctcaaataatgagaatggagtgacattaaattttagtagattgaagggcctgagagattcaagggaatctgaagcagtctcgctgagagaagaaacaacaaacaggtctgatcgaatgcacccagagcttcctggtgataatgcagcacctaagcaagaagcccaagcaaagaaaggtgggatgagtaagccaagtggatcggttgaggttacaactgaagctactacttctgggcaagttggagcaaaggtggaggaagatgacatggaaaaagaattgtgcacagaagcagaagacccttcagagttcatcactcatagagcaaaagattttgtgtcaagcatgaaagacattgaaactcggtttgtacgtgccgcagaagctgggaatgaggtttccagaatgcttgagacaaagaagatcagacttgatatatgtgctaagattccaggttctccaggcaagccacctactgcccgatttgtgtccgcacttcgagtctgctgcaatcgtgagaatattctcaaccaggaaactgcacagaatatctcaaaagttgtcacttggaagcgttctgtatcatctttgtcctcatcatctaagagtccacttacagcagcaatgattactgatgatgtgggtgatagtaacagtgattttgttgagcaattcgccatggtatctggaagccactcgtctaccttggataggttacatgcttgggagagaaaactacatgatgaaatcaaggctagtgaacatgttagaaagacttatgatgagaaatgtaaccttctccggcgccaatttgcacgaggtctaaatgctcaactgattgataagaccagagctgttgtgaaggatcttcattccagggtgtctgttgcgatccaggctgttgatgcaatatcaaaaagaatagagaagataagggatgaagaactgcagccacaacttgtcgagctgatccaagggttaatcagaatgtggaaagcaatgttagaatgccaccacaaacaattcatcacaatatcactggcataccatgtcaagagttcgaccatggtgcagcaaggtgagcaccaccgcagggccgcagcgcatctctggaacgagttggactgcttctcgtccagcttcaggatctgggtcactgctcacaagtcctacgtcgagtccctcaacgcgtggctccagaagtgtgtcctgcagccagcccaggacagacggaggcgcaagcgcaaggtctctttccctccccgccacgcgctctcccctccgatctttgtcctctgcagagactggcttgccatgatggagtcacagtcactccccacagatgagctctgcaagtccatcaaagaggtgatgcagctcctgcgcggttcgtttgaccacccggccgatcatcaggacaaaacgacgaccgaatcgcagtctagaaacgagtcgcaggaatgtgggatgctggagaataacgagcaggaggtgagtggaagcgtggaagcagtggaagggttgcagtcaaagctaactacggttctggatcgcctgacaaagttctcagaggcttcactgaagcactacgaggagctcaagcagaattatgagatagctcgtgatgactaccagacgggtcgatcaaatgcccatcttgtttagtctgatgatgatcctaggtctacaattttcaaccctatgattctattcctactagtagtattctagttgaacatctgagagtattttggtacatatagtacgttaatgatgaggttgtaatacatatatgttgggttaagggttacagttgcaaaaatatacttcggtactatatttgccaaagctcaaggattgtcagaatggcccaacagattgttcattaggatgcatcttgtctccttttagttttgcaaagattgctggtagatttctgcatggtgaaag

SEQ ID NO: 2926 - DNA, 2828 bp, Oryza sativa
aactctccagtctccacccacctcactccacagtccacaccactgcaccgcactctctctctctccaccgccattaacggttacttatctctctagtactcctactactgctagtgtgctagtggtaggagtagtctaccaggactagtactccactctccgagaaccaaacaaatcgacaggaggcggctggtgtgcgcatgtgacccggatcgatcgacagcggtcgcccgcaccgcattgccgctgctcccgtttagtccagccgccgcctcctcctcctcctccgccgccgccgcctgttcaggctccgatccaaggactgaagactactgccagtttcagggaggaattctactcagtggtagcttgtggttgtagctggtcttttgatgaatctgttggtctcaaaaacattgtagaatagtatttgttggttcgttgaacacaatgggttcttcgccatccaaagccactggtgaggatgccctagttctatgcaaggagcgaatgcgccatatcaggcgagctattgattcaagagatgcactgtcggcatcacacctatcatatactcagtccctccgtagtgtgggtactgcattgcggcggtatgcagagtctgagatctcaccagaatcatcactgtccatttcagaagcagataagtcaccatcacattcttctatggcttctccatcaccttctcgagcagtagagagcactggctccccagtacatcgaggtagtcagctgactcctccctcaacaaagatccattacatgaaagcagcaggaacaaaacctttgacgttcactattgatccatctgctgctgactttgtggggcaagaatccccggtatctacctttgtgccaccaccaccaccattgccccctgaattatgtacctcgtgggacttcttcgattccaattatacttctggtagtgccacctcaaataatgagaatggagtgacattaaattttagtagattgaagggcctgagagattcaagggaatctgaagcagtctcgctgagagaagaaacaacaaacaggtctgatcgaatgcacccagagcttcctggtgataatgcagcacctaagcaagaagcccaagcaaagaaaggtgggatgagtaagccaagtggatcggttgaggttacaactgaagctactacttctgggcaagttggagcaaaggtggaggaagatgacatggaaaaagaattgtgcacagaagcagaagacccttcagagttcatcactcatagagcaaaagattttgtgtcaagcatgaaagacattgaaactcggtttgtacgtgccgcagaagctgggaatgaggtttccagaatgcttgagacaaagaagatcagacttgatatatgtgctaagattccaggttctccaggcaagccacctactgcccgatttgtgtccgcacttcgagtctgctgcaatcgtgagaatattctcaaccaggaaactgcacagaatatctcaaaagttgtcacttggaagcgttctgtatcatctttgtcctcatcatctaagagtccacttacagcagcaatgattactgatgatgtgggtgatagtaacagtgattttgttgagcaattcgccatggtatctggaagccactcgtctaccttggataggttacatgcttgggagagaaaactacatgatgaaatcaaggctagtgaacatgttagaaagacttatgatgagaaatgtaaccttctccggcgccaatttgcacgaggtctaaatgctcaactgattgataagaccagagctgttgtgaaggatcttcattccagggtgtctgttgcgatccaggctgttgatgcaatatcaaaaagaatagagaagataagggatgaagaactgcagccacaacttgtcgagctgatccaagggttaatcagaatgtggaaagcaatgttagaatgccaccacaaacaattcatcacaatatcactggcataccatgtcaagagttcgaccatggtgcagcaaggtgagcaccaccgcagggccgcagcgcatctctggaacgagttggactgcttctcgtccagcttcaggatctgggtcactgctcacaagtcctacgtcgagtccctcaacgcgtggctccagaagtgtgtcctgcagccagcccaggacagacggaggcgcaagcgcaaggtctctttccctccccgccacgcgctctcccctccgatctttgtcctctgcagagactggcttgccatgatggagtcacagtcactccccacagatgagctctgcaagtccatcaaagaggtgatgcagctcctgcgcggttcgtttgaccacccggccgatcatcaggacaaaacgacgaccgaatcgcagtctagaaacgagtcgcaggaatgtgggatgctggagaataacgagcaggaggtgagtggaagcgtggaagcagtggaagggttgcagtcaaagctaactacggttctggatcgcctgacaaagttctcagaggcttcactgaagcactacgaggagctcaagcagaattatgagatagctcgtgatgactaccagacgggtcgatcaaatgcccatcttgtttagtctgatgatgatcctaggtctacaattttcaaccctatgattctattcctactagtagtattctagttgaacatctgagagtattttggtacatatagtacgttaatgatgaggttgtaatacatatatgttgggttaagggttacagttgcaaaaatatacttcggtactatatttgccaaagctcaaggattgtcagaatggcccaa

SEQ ID NO: 2927 - DNA, 996 bp, Zea mays
ctgacaaaaatttcgagcagcagagtaaacatggcgggaatttttggcgccatccattctcccgccgccgcctgcctatttagcccccggcgcccgccgtctcttcgtccactcagcccactaccttccatattttccctcatctcccgccgcctgcacccaacaagcctctcgacgctagtcatggccgcttccaacggcgccgccgcggtcgacgagaccgtcgccgccaccgactccgtgcaggagcctccccagaagatctccaagatctctcccctgctcaaggtgaagaagctctccgagaaggccgtgctgccgtcccgcggctccgctctcgccgccggctacgacctctcgagtgccgaggagatggtggtgccggcgcgtggcaaggcgctcgtgccgaccgacctcagcgtcgccatcccgcacggaacctacgcgcgcatcgcgcccaggtcggggctggcgctgaagcactccatcgacgtgggcgccggcgtgatcgacgcggactaccgaggccccgtcggcgtcatcctcttcaaccactccgacgccgacttcgccgtgaagcccggcgacaggatcgcgcagatgatcatcgaggtgatcgcgacgcccgaggtcgcggaggtggaggacctcgacgccaccgtccgtggggacggagggttcgggtccaccggcgtctgaagggattcggtgtctaggttaggatggcgatgcaagccttggtgtcttttgttggctctaagaaatcgtgatgttcaccatcactatcctgctatcgataattagtattgagattagtacgtaggttgcgtagttagctcgatgcacgtactattgtcgagaactcgctattctgtgatgttgaaaatgtctaatgatcctgcagtactgtcgcattagacccatgaagaagcccaatttgacggcggatatggcctgatacccaaattactaacaacttgaggcggctatcgataa

SEQ ID NO: 2928 - DNA, 998 bp, Oryza sativa
actgccccgcacgcgcacgcatccatatccatgcatttaaaacagcagcgaccgcgtgggagaccaaaccctcctctatttaactcgggcgcggcgttggtgggaggagaaatatggcgggaaaacttggcgccatctgttcccgcctcatctcccctctatttaaccaccattgccgcctccgccgcttcccccaaatccactcacctcctccaccgttcgtccccttctcgcgccaccaccgcctgccgccgagagctctctcagccgtcgccatggccaccgctaccaacggcaacgcctccgccgccgccgccgccgctgactccgccgtccaggagcccccgcacaagatcgccaaggttgctcccttgctcaaggtcaagaagctctccgagaacgccgtcctgccgtcccgcggctccgccctcgccgccggctacgacctgtcgagcgcggcggaggtcgtcgtgccggcgagggggaaggcgatggtgccgacggacctcagcatcgccatcccggagggcacctacgcgcgcgtcgcgccgaggtctgggctggcgttgaagcactcgatcgacgtaggcgccggggtgatcgacgccgactaccgtggcccggtaggggtcatcctcttcaaccactccgacaccgacttcgccgtgaagcccggcgaccggatcgcgcagatgatcatcgaggtgatcgtgacgccggaggtcgccgaggtggaggacctcgacgccaccgtcaggggagagggagggttcggatccaccggcgtctgaatgaatgaagcatcgtcgtcgttagctccaggaagttgggggagttcatttggtctgtgatggatggatgggtgatgtcgtgatgaaacacttgtatcctcttaatgcctcggatgcttttgtggtgtcgaatggaatcatctagcctaatgaatctaatgaaattcgtatgcttttgcggtgttgaatggaataatctagtctaat

SEQ ID NO: 2929 - DNA, 1254 bp, Brachypodium distachyon
accatcaacgcgaagactggaaccacacccgagtagacgttcggcatccccacgggccacgccgcccgcgaaaagagaggggggataggagacgacgacgcgttgaagaccgaaccaccccgcagcccggccgatgcatactggagcgggaaaattatatggcgggagaatttggcgccatctcttccacttcccgccccgtcgcctccctatttatctcccggaacaacctcgtcgcctcaattcctcaaatcaaacccctcctccacaactccctttctcccgtagccgccgcccaagaatccccacatccatcgccatggccgccaccaacggcgccgctgccgactctgtgcaggaaccgcctcacaagatcaccaagatcgcgcccctgctcaaggtgaagaagctctccgaaaaggccatcctgccgtcccgcggatccgcctctgccgccggctacgacctctccagcgcggcggacgcggtcgttccggccaggggaaaggcgttggtgcctactgacctcagcatcgccatcccggaaggcacctacgcgcgcgtcgcgccaaggtcagggctagcgttgaagcattccatcgacgtgggcgctggagtgatcgacgcggattaccgtggcccggtgggcgtcgtgctcttcaaccactcggaggtggacttcgttgtgaagcctggcgaccgcatcgcgcagatgatcatcgaggttatcgtgacgccagaggtcgctgaggtggaggacctcgacgccaccgtcaggggagagggaggcttcgggtccactggcgtctgaactctgaaccttgctagttttacctctagagtcctgctctgtttgggatggttatggaacccttggtgtcttttgatgcttgcgtgcgtgtgatgaagaatggaatcttatgatctcttcctagagaagattgtgtttcgtccattaatgctgcaaatgataagatggttgtgatcggagtttgtctgcactgcctgtttgcctccacatatactagcaattttgtagctatctactccgtacaaaccagcaacacataaaacatttaaacagtagtttttcttttgcggggaaggcttaacagcagcagtagtagaatttccaagtttagtcagtcagtcagtcactatcaaggttataaactgctcgcatgcttggcctgtttggggccagttctggatattgacctggacaataggtgcggtgataaggattggtgagag

SEQ ID NO: 2930 - DNA, 1607 bp, Sorghum bicolor
aacgggcaacggccaaaacccaacaagaacagagcagtagcaccaggcacgaaccctaggaaatctacccagaaattccacccgaatcggggctgtatcgtagggagtagtcggcgcggggattggatcgaagcggaccgggcaggagccgagcaaatcatctgaagaagggtaaggattgccgtgcgggttccgagctgtgggaatctttctgaggtaggcatctttagatcttatagtcatagtgaaagagcagaagctaggctgggaacaaacagaaaggagaaaatttcttgtgtcgatccaggagaagagaaacaggactcagggcaccaagaataggaaagagcagagaccaggacaaccgtataacaacaagatgcatgaatcgaggactgcccgcaggccggctctcgccgacatctctggtggtgggttctttatcaggagagtagaatcgccaggagctgtgctggtgaaaggtgctgtcaagccgctggctcgacgcgccctgtcacagtcaagcaacaaggagaatgtgccaccagtgggagctgtgaggggtgcaccaaagaggaagagcccgttgcctgactggtacccgaggactccactccgtgacatcacatcaatcgtcaaggcaattgaaaggagaagtcgtctgcagaatgctgcaactgagcagacgatcctgtggacagaagattcttcccaatctgtggatccaataactccagcatctgcagagcagggtgtgccaacaattgagggaggtcaagctgttgcacgccatgcaacttctttgggggatggcaagctgaagacatcttcctctccatttgactgctccttgcaggccactccatccaaaccaaatgatccagctctcgcagatctcatggagaagaagctgtccaactcgatagagcagatcgaaaagatggtcaggcgaaacctgaagaaaactccgaaggccgctcagccttccaagaggaccatccagagtcgcatcctgatgtccatgcgatgagctgaggaagctgtgctctgtcatggtttccagagtcgcatcctgatgtccatgcgatgagctgaggaagctgtgctctgtcatggtttcctcttgtctgctgctttcttagcggctagtcctaaccaatcattatttcagttttgcctgaaggagggtgagggttcctggttctctgcttgaggaccccaggggtatgcggcttactatagctctctgcttgagggtacatagtattatggtgactacgatttctatacgtttatagcttgaactgtgtatagcctctctacaattttaagcaccatgaataagtgatgcatggtctttttagtttgagaaattagtagttcctctgtatagttatggtgtagaacggatgtgagaagtgttaaacttgtcgcaatgactgacagattgaatactgctgttgctgagtagttcctctatactgctgttgccgagtaacatagcaaaattttggcaatcagtaatgaatcaccttactgatgtcagttatgaatatttgtgactctgattgcttgttttactactattttggtattttattgtctca

SEQ ID NO: 2931 - DNA, 2227 bp, Brachypodium distachyon
ataaaaaaccaagggagagggcgctggttagccagaggggaagaagagcgtttgccttggactcagtaccgccttcgcactgggtggccggggtgaccactgcacagagggcggcagcagccatggcgaccagaccggggcctttgactgagtggccatggcagaggctcggcaacttcaagtacctggtgatggcgcccgtggtggtccatggcgcgcaccgggtgatgaccaagggttggggcgacatcgacctcgcctacgcgctcatcctgccgtcgctgctgctccggatgatccacaaccagatctggatcagcctctcccgctaccagaccgcccgcagcaagcaccgcatcgtcgaccgcggcatcgagttcgaccaggtcgaccgcgagcgcggatgggacgaccagatcatcttcaacgggctgctgttctacgcggggtacctggcgatgccgagcgtgagggggttcccgctgtggaggacggacggcgccgtcatgacggcgctgctccacgccgggccagtcgagttcctctactactggttccaccgcgcgctgcaccaccatttcctctactcgcgctaccactcccaccaccacgcctccatcgtcaccgagcccatcacctcggttatccatccttttggcgaacacgtggtctatttcacgctctttgcaatcccgatgttgtccacaatttacatgggaaatggttctgccctcgtctttgtgttgtatattgtttacattgacttcatgaacaacatgggacattgcaattttgagttggtgccgaagtgggcttttcaagtctttcctcctctcaagtacctcatgtacactccatcgtttcattccctacaccacacacagttccgcacaaactattcactgttcatgccattttatgactacatatacagcactatggacaagtcatcggacgagctgtatgagaactcactcaaaggaacagaggagacacctgaccttgttcatctcacacatatgacgaacttgcaatcggcatatcatctaaggataggcttcgcctccatagcgtccaaaccatctgaaaactctgagtggtatatgtggacgctgtggcccttggcatggctgtcaatggtagttgcatggatgtatgggtcatctgcattcgtggttgagagaatcaaactaaagaagctgaagatgcaaacatgggtgataccaagatacaacttccagtatgccctgacgtgggaaagagaatcgatcaatgacttaattgaaaaggcgatactagatgctgatgtaaggggggttaaagtgctgagtcttggactattaaatcagacaaaagagctcaatggagcaggagaattatttagacaaaaatatccaaaattaggggttcaacttgtcgatggaagtggcttggcaactgcagtggtgctaaaaagtatccctttagatgcaaagcaagtcttcctccagacagggacttccaagatagcccgtgctattgctataacattatgtggtaggggtatccaggtgatcatgaatcgaaagaaagagtatgatatcctcaagccacagattccagagaacagagcaagctatttgaaatgttccagcgatgacatgcccaagatttggctagtagattgcatcgatgctaaagaacaactggtggcaccaaaaggaacagtattcattcccatatcacagttccccactaagaaagttcgcaaggactgcacttacctgagtactccagcaatgaagatcccagaggcgatgcagaacatacactcctgcgagaattggctgccgagaagggtgatgagcgcgtggcatattgccggaatacttcacgtcctggaagggtggagcatgcatgagtgtggagatagcatgatggacatcgagaagacatggtcggctgctacaagacacggattcgtccctctgacgaaagcttgatgacggccggggagatgatgatgctaagatggcactggaaattgaaccgtagtacagtagtactatctttgcttggtaggaattccataacccataggctatgatctatcagccatctacggctgggtttggatcttacgaaggcgcaatgtgaacgtcgaccttaattacattatattactatacctttggtgtcttgagtgcagtgggacaagatcgaaacgccagtcagcctcggaaaagag

SEQ ID NO: 2932 - DNA, 2233 bp, Secale cereale
tcaggggttgaaagggtgccgtgtgagttccaaactgtgacgcttataaaaaaccaaggagagcctagactcggtaccattttcgctctgattggccattgtggtggccgggtgggaaggaaggaagtaaggaaggaggcgagcacagccagccatggcgaccaggccggggcctttgactgaatggccatggcagaggatgggcaacttcaagtacctggtgatggcgccggtggtcgtccacggcgcgtaccgggtgatgaagaagggctggggcgacatcgacgtggcgtacgcgctgatcctgccgtccctgctgctgcggatgatccacaaccagatctggatcagcctgtcccgctaccagaccgcgcgaagcaagcaccgcatcgtggaccgcggcatcgagttcgaccaggtggaccgcgagcgcggatgggacgaccagatcgtcttcaacgggctgctcttctacgtggggtacctggccatgccgagcgtccggaggttcccgctgtggcggacggacggggcggtggccacggcgctgctgcacgcggggcccgtcgagttcctctactactggttccaccgcgcgctgcaccaccacttcctctactcgcgctaccactcccaccaccacgcctccatcgtcaccgagcccatcacatctgtcatccatccatttggtgaacacatcgtctatttcacgctctttgcaatcccgatgttgtccacagtttatatgggaaatggctccgccctcgtatttgtgttgtatatcgtttacattgacttcatgaacaacatggggcactgtaattttgagttggtgccaaaatggatgttccaagtctttcctcctctcaagtacctcatgtacaccccatcgtttcattctcttcaccacacgcagttccgcacaaactattcactcttcatgccattttacgactacatatacagcactatggacaaggcatctgacgagctgtatgagagctcactgaaaggaacagaggagatacctgaccttgttcatctcacacatatgaccaacttgcaatcggcttatcatctaagggttggattcgcctccatagcatccaaaccatctgataactccgagtggtatatgtggacgctgtggcccttggcatggctgtcaatggtagtagcatggatttatgggtcatctgcatttgtggtcgagagaatcaaacttaagaagatgaggatgcaaacatgggtcgtaccgagatacaacttccaatatggtctgacatgggatagagaatcgatcaacgacttaattgaaaaggcgatattggatgctgatgtaagaggggttaaagtgctcagtctaggactactgaatcaggcaacacagctcaatgggaatggtgaactatttagacaaaaatacccaaaattaggacttcgaattgttgatggaagtggcttagcaactggagttgtcctaaaaagcatcccttcagatgcaaagcaagtttttcttcatacagggacttctaagatagcccgtgccgttgctatggcattatgtggcaggggcatccaggtgatcatgaatcgtaagaaagagtatgacatgctcaagtcacagatgccagagaacagagcaagctacttgaagtgctccagcaatgacataaccaagatttggctagtagagaggatcgacgacaaagaacagaggatggcaccaaaaggaacagtgttcatcccaatatcgcagttcccccttaagaaagtccgcaaggactgcacttacttgagcaccccggcgatgaagatcccggacaccatgcagaacatccactcctgcgagaactggttgccgagaagggtgatgagcgcgtggcatatcgccggaattcttcacgtcctggaagggtggagcgcgcacgagtgcggggacgacatgatggactctgagaaggcatggtcggctgctatcaggcacggcttcgtccctctcaccaatgcttgactgccaaatgtggcgtccgtcggatgctaagatggtgccgagaattgatgcaaaaactgcagtttttttcttctttctttcttttcgggaacacgcaggagatatgtttggcagggcagctaagtccttaaatctatcagtgtgaacatcgacattaactccattaacttactgcttatggggtactgtacttttgtttgcataacgtctggtataaga

SEQ ID NO: 2933 - DNA, 2393 bp, Triticum aestivum
ggaaggaaggaaggaaggaggcgaccacaggcagtcatggcgaccaggccggggcctttgactgaatggccatggcagaggatgggcaacttcaagtacctggtgatggcgccggtggtcgtccacggcgcgtaccgggtgatgaacaaggggtggggcgacatcgacctggcctactcgctgatcctgccgtccctggcgctgcggatgatccacaaccagatctggatcagcctgtcccgctaccagaccgcgcgcagcaagcaccgcatcgtcgaccgcggcatcgagttcgaccaggtggaccgcgagcgcgggtgggacgaccagatcgtcttcaacgggctgctcttctacgtggggtacctggcgatgccgagcgtgcggaggttcccgctgtggcggacggacggggcggtggcgacggcgctgctgcacgcggggcccgtggagttcctctactactggttccaccgcgcgctgcaccaccacttcctctactcgcgctaccactcccaccaccacgcctccatcgtcaccgagcccatcacctctgtcatccatccttttggcgaacacatcgtctatttcacgctctttgcaatcccgatgttgtccacagtttacatgggaaatggctccgcccttgtatttgtgttgtatatcgtttacatcgacttcatgaacaacatggggcactgtaattttgagttggtgccaaaatggatgttccaagtctttcctcctctcaagtacctcatgtacaccccatcgtttcattctcttcaccacacacagttccgcacaaactattcactgttcatgccattttatgactacatatacagcactatggacaaggcatctgacgagctgtatgagaactcactgaaaggaacagaggagacacctgaccttgttcatctcacacatatgactaacttgcaatcggcttatcatctaagggttggattcgcctccatagcatccaaaccatccgataactcggagtggtatatgtggacgctgtggcccttggcatggctgtcaatggttgtagcatggatttatgggtcatctgcattcgtggtcgagagaatcaaactgaagaagatgaagatgcaaacatgggtcgtaccgagatacaacttccaatatggtctgacatgggatagagaatcgatcaatgacttaattgaaaaggcgatattggatgctgatgtaagaggggttaaggtgctcagtctagggctactaaatcaggcaaaacagctcaatgggaatggtgaactatttagacaaaaatacccaaaattaggagttcgaattgttgatggaagtggcttagcaattggagttgtcctaaaaagcatcccttcagatgcaaagcaagtttttcttcatacagggacttgtaagatagcccgtgccgttgctatggctttatgtggcaagggcatccaggtgatcatgaatcgtaagaaagagtatgacatgctcaagtcacagatgccagagaacagagcaagctacttgaagtgctccagcaatgacataaccaagatttggctagtagagaggatcgacgacaaagaacagaggatggcaccaaaaggaacagtgttcgttccaatatcgcagttcccccttaagaaagtccgcaaggactgcacttacttgagcactccggcgatgaagatcccggacactatgcagaacatccactcctgcgagaactggttgccgagaagggtgatgagcgcgtggcatatcgccggaatacttcatgtcctggaagggtggagcgagcacgagtgcggtgaccacatgatggactctgagaaggcatggtcggctgctatcaggcacggcttcatccctctcaccaaagcttgactggggaaatgttgctaagatggtactaccgagaatttatgctaaaactgcagccttttttcttttcttttgggaccacgcaggagatctgtttggtcggacagctaagtctgtaagatttatcagtgtgaacatcgaacatcaattcaattaacttactgcttatggagtgctgtacttctgatcatggtagatgatgtttggcgtttgagttcaagtaggaaataatcggaacgcctgatttgactgacggaccgctgggtgcggggccggagatgaggtgaacgaaagaaggcaagctgagaactacctggactcacttctcccctgagtttgaatctgtacgaagtgtaacaaaagagtttgaattggcagtgtccttcatttggcctacggggttggagttggatctcccgagtaatcctgtgcaatgttccactttgcgcagagtgtacgaagtgtaacaaaagagtttgaattggcagtgtccttcattt

SEQ ID NO: 2934 - DNA, 2176 bp, Triticum aestivum
cttccttctgattggccattggggtggccgggtgggaagcaagcaaggaaggaggcgaccatagccagccagccatggcgaccaggccggggcctttgactgaatggccatggcagaggacgggcaacttcaagtacctggtgatggcgccggtggtcgtccacggcgcgtaccgggtgatgaccaaggggtggggcgacatcgacctggcctactcgctgatcctgccgtcgctggcgctgcggatgatccacaaccagatctggatcagcctgtcccgctaccagaccgcgcgcagcaagcaccgcatcgtggaccgcggcatcgagttcgagcaggtggaccgcgagcgcgggtgggacgaccagatcgtcttcaacgggctgctcttctacgccgggtacctggcgatgccgagcgtgcggaggttcccgctgtggcggacggacggggcggtggcgacggcgctgctgcacgcggggcccgtggagttcctctactactggttccaccgcgcgctgcaccaccacttcctctactcgcgctaccactcccaccaccacgcctccatcgtcaccgagcccatcacctcggtcatccatccttttggcgaacacatcgtctatttcacgctctttgcaatcccgatgttgtccacagtttatatgggaaatggctccgccctcgtgtttgtgctgtatatcgtttacattgacttcatgaacaacatggggcactgcaactttgagttggtgccaaagtggatgttccaagtctttcctcctctcaagtacctcatgtacaccccatcgtttcattcccttcaccacacgcagttccgcacaaactattcactcttcatgccattttacgattatatatacagcactatggacaaggcatctgacgagctgtatgaaaactcactgaaagggacagaggagacacctgaccttgttcatctcacacatatgaccaacttgcagtcggcttatcatctaagggttggattcgcctccatagcatccaaaccatctgataactccgagtggtatatgtggacgctatggcccttggcatggctgtcaatggtggtagcatggatttatgggtcatctgcattcgtggtcgagagaatcaaactgaagaagatgaagatgcaaacatgggtcgtaccgagatacaacttccaatatggtgtgacatgggatagagaatcgatcaatgacttaattgaaaaggcgatattggatgctgatgtaagaggggttaaggtgctcagtctagggctactaaatcaggcaaaacagctcaatgggaatggtgaactatttagacaaaaatacccaaaattaggagttcgaattgttgatggaagtggcttagcaactggagttgtcctaaaaagcatcccttcagatgcaaagcaagtttttcttcatacagggacttctaaggtagcccgtgccattgctatggcattatgtggcaggggcatccaggtgatcatgaatcgtaagaaagagtatgacatgctcaagtcacagatgccagaggacggagcaagctacttgaagtgctccagcaatgacataaccaagatttggctagtagagaggatcgacgacaaagaacagaggatggcaccaaaaggaacagtgttcattccaatatcgcagttcccccttaagaaagtccgcaaggactgcacttacttgagcactccagcgatgaagatcccggacactatgcagaacatccactcctgtgagaactggttgccgagaagggtgatgagcgcgtggcatatcgccggaatacttcacgtcctggaagggtggagcgtgcacgagtgcggtgacgacatgatggattctgagaaggcatggtcggttgccatcaggcacggcttcgtccctctcaccaaagcttgactggggaaatgttgctaagatggtactaccgagaatttatgctaaaaccgctgcctttttcttttcttttcgggaatacgcagctaagtctgtaagatttatcagtgtgaacatcgaacatcaattccattaacttactgcttatggagtactgtacttttgttggcataacgtgtgtaagatcatgggagatgatgtttggcgtttgagttcagtataggaataatcggaacgcctgattt

SEQ ID NO: 2935 - DNA, 2261 bp, Triticum aestivum
aggaattcggcacgaggggtaccctcttccttgtgattggccttggggtggccgggtgggaagcaaggaaggaaggaaggaaggaaggaggcgaccacaggcagtcatggcgaccaggccggggcctttgactgaatggccatggcagaggatgggcaacttcaagtacctggtgatggcgccggtggtcgtccacggcgcgtaccgggtgatgaacaaggggtggggcgacatcgacctggcctactcgctgatcctgccgtccctggcgctgcggatgatccacaaccagatctggatcagcctgtcccgctaccagaccgcgcgcagcaagcaccgcatcgtcgaccgcggcatcgagttcgaccaggtggaccgcgagcgcgggtgggacgaccagatcgtcttcaacgggctgctcttctacgtggggtacctggcgatgccgagcgtgcggaggttcccgctgtggcggacggacggggcggtggcgacggcgctgctgcacgcggggcccgtggagttcctctactactggttccaccgcgcgctgcaccaccacttcctctactcgcgctaccactcccaccaccacgcctccatcgtcaccgagcccatcacctctgtcatccatccttttggcgaacacatcgtctatttcacgctctttgcaatcccgatgttgtccacagtttacatgggaaatggctccgcccttgtatttgtgttgtatatcgtttacatcgacttcatgaacaacatggggcactgcaactttgagttggtgccaaagtggatgttccaagtctttcctcctctcaagtacctcatgtacaccccatcgtttcattctcttcaccacacacagttccgcacaaactattcactgttcatgccattttatgactacatatacagcactatggacaaggcatctgacgagctgtatgagaactcactgaaaggaacagaggagacacctgaccttgttcatctcacacatatgaccaacttgcagtcggcttatcatctaagggttggattcgcctccatagcatccaaaccatctgataactccgagtggtatatgtggacgctatggcccttggcatggctgtcaatggtggtagcatggatttatgggtcatctgcattcgtggtcgagagaatcaaactgaagaagatgaagatgcaaacatgggtcgtaccgagatacaacttccaatatggtgtgacatgggatagagaatcgatcaatgacttaattgaaaaggcgatattggatgctgatgtaagaggggttaaggtgctcagtctagggctactaaatcaggcaaaacagctcaatgggaatggtgaactatttagacaaaaatacccaaaattaggagttcgaattgttgatggaagtggcttagcaattggagttgtcctaaaaagcatcccttcagatgcaaagcaagtttttcttcatacagggacttgtaagatagcccgtgccgttgctatggctttatgtggcaagggcatccaggtgatcatgaatcgtaagaaagagtatgacatgctcaagtcacagatgccagagaacagagcaagctacttgaagtgctccagcaatgacataaccaagatttggctagtagagaggatcgacgacaaagaacagaggatggcaccaaaaggaacagtgttcgttccaatatcgcagttcccccttaagaaagtccgcaaggactgcacttacttgagcactccggcgatgaagatcccggacactatgcagaacatccactcctgcgagaactggttgccgagaagggtgatgagcgcgtggcatatcgccggaatacttcatgtcctggaagggtggagcgagcacgagtgcggtgaccacatgatggactctgagaaggcatggtcggctgctatcaggcacggcttcatccctctcaccaaagcttgactggggaaatgttgctaagatggtactaccgagaatttatgctaaaaccgcagcctttttttcttttcttttgggaccacgcaggagatctgtttggtcggacagctaagtctgtaagatttatcagtgtgaacatcgaacatcaattcaattaacttactgcttatggatttgaattccccgcaaacaaaaagtttgaattggtagtgtccttcatttcgcctacgggtttggatgtaccgagtaatcctggtgtcaaacctagtgcaatgttccacttcgtgcagagtgatcc

SEQ ID NO: 2936 - DNA, 2363 bp, Hordeum vulgare
ggagagagccgagactcggtatcctattcgttctgattggccattggggtgggtaggaaggacggaaggaaggagacgaccgcagccatggcgaccaggccggggcctttgactgaatggccatggcagaggatgggcaacttcaagtacctggtgatggcgccggtggtggtgcacggcgcgtaccgggtgatgaacaaggggtggggcgacatcgaccttgcctacgcgctcatcctgccgtcgctggcgctgcggatgatccacaaccagatctggatcagcctgtcccgctaccagaccgcgcgcagcaagcaccgcatcgtcgaccgcggcatcgagttcgaccaggtcgaccgggagcgcggatgggacgaccagatcgtcttcaacggcctgctcttctacgtggggtacctggccatccccaacgttcgggggctcccgctgtggcggacggacggcgcggtggcgacggcgctgctgcacgccgggccagtggagttcctctattactggttccaccgcgcgctgcaccaccatttcctatactcgcgataccactcccaccaccacgcctccatcgtcaccgagcccatcacctcggttatccatccttttggcgaacacatcgtctatttcacgctctttgcaatcccgatgttgtccacactttatatgggaaatggctccgccctcgtatttgtgatgtatatcgtttacattgacttcatgaacaacatggggcactgcaattttgagttggtgccaaagtggatgttccaagtctttcctcctctcaagtacctcatgtacaccccatcgtttcattctcttcaccacacgcagttccgcacaaactattcactcttcatgccattttatgactacatatacagcactatggacaaggcatctgacgagctgtatgagaactcactgaaaggaacagaggagacacctgaccttgttcatctcacacatatgaccaacttgcaatcggcttatcatctaagggttggattcgcctccatagcatccaaaccatctgataactccgagtggtatatgtggactctgtggcccttggcatggctgtcaatggtagtagcatggatttatgggtcatctgcattcgtggtcgagagaatcaagctaaagaagctgaagatgcaaacatgggtcgtaccaagatacaacttccaatatggtctgacatgggatagagaatcgatcaacgacttaattgaaaaggcgatattggatgctgatgtaagaggggttaaagtgctcagtctagggctactaaatcaggaaaaacagctcaatgggaatggtgaactatttagacagaaatacccaaaattaggacttcgaattgttgatggaagtggcttagcaactggtgttgtcctaaaaagcatcccttcagatgcaaagcaagttttccttcatacagggacttctaaggtagcccgtgccgttgctatggcattatgtggcaagggcatccaggtgatcatgaatcgtaagaaagagtatgacatgctcaagtcacagatgccagagaacagagcaagctacttgaagtgctccagcaatgacataaccaagatttggttagtagagaggatggacgacaaagaacagaggatggcaccaaaaggaacagtgttcattccaatatcgcagttccccctgaagaaagtccgcaaagactgcacttacttgagcactccggcgatgaagatcccggacactatgcagaacatccactcctgcgagaactggttgccgagaagggtgatgagcgcgtggcatatcgccggaatacttcatgtcctggaagggtggagcgtgcacgagtgcggggacgacatgatggactctgagaaagcatggtcggccgctatcaggcacggctttgtccctctcacgaaagcttgactgagaaatgttgcctccgtccgatgctaagatggtactaccgagaattgatgctaaaactgcagttttttttttcatttcgggaacacgcaggagatatatgtttggcagggcagctaagtccttaagatttatcagtgtgaacatcgacatcaattccattaacctattgcttatggagtattgtacttttgtttgtataacgtctgtaagatcatggaagatgatgtttggcgtttgagttcagtaggagataatcggaacgcctgatttgactgatggaccgcagggttcgggaccggaaatgaggtgaaggaaagaaggtaagtaagctgaggaccacctgggctcacttctcccctgagtttgaatctgtacaaagtgtaacaaaagagtttgaattggcaatgtccttc

SEQ ID NO: 2937 - DNA, 2257 bp, Hordeum vulgare
caaggagaggcgcgagtagctggagagagccgagactcggtatcctattcgttctgattggccattggggtgggtaggaaggacggaaggaaggagacgaccgcagccatggcgaccaggccggggcctttgactgaatggccatggcagaggatgggcaacttcaagtacctggtgatggcgccggtggtggtgcacggcgcgtaccgggtgatgaacaaggggtggggcgacatcgaccttgcctacgcgctcatcctgccgtcgctggcgctgcggatgatccacaaccagatctggatcagcctgtcccgctaccagaccgcgcgcagcaagcaccgcatcgtcgaccgcggcatcgagttcgaccaggtcgaccgggagcgcggatgggacgaccagatcgtcttcaacggcctgctcttctacgtggggtacctggccatccccaacgttcgggggctcccgctgtggcggacggacggcgcggtggcgacggcgctgctgcacgccgggccagtggagttcctctattactggttccaccgcgcgctgcaccaccatttcctatactcgcgataccactcccaccaccacgcctccatcgtcaccgagcccatcacctcggttatccatccttttggcgaacacatcgtctatttcacgctctttgcaatcccgatgttgtccacactttatatgggaaatggctccgccctcgtatttgtgatgtatatcgtttacattgacttcatgaacaacatggggcactgcaattttgagttggtgccaaagtggatgttccaagtctttcctcctctcaagtacctcatgtacaccccatcgtttcattctcttcaccacacgcagttccgcacaaactattcactcttcatgccattttatgactacatatacagcactatggacaaggcatctgacgagctgtatgagaactcactgaaaggaacagaggagacacctgaccttgttcatctcacacatatgaccaacttgcaatcggcttatcatctaagggttggattcgcctccatagcatccaaaccatctgataactccgagtggtatatgtggactctgtggcccttggcatggctgtcaatggtagtagcatggatttatgggtcatctgcattcgtggtcgagagaatcaagctaaagaagctgaagatgcaaacatgggtcgtaccaagatacaacttccaatatggtctgacatgggatagagaatcgatcaacgacttaattgaaaaggcgatattggatgctgatgtaagaggggttaaagtgctcagtctagggctactaaatcaggaaaaacagctcaatgggaatggtgaactatttagacagaaatacccaaaattaggacttcgaattgttgatggaagtggcttagcaactggtgttgtcctaaaaagcatcccttcagatgcaaagcaagttttccttcatacagggacttctaaggtagcccgtgccgttgctatggcattatgtggcaagggcatccaggtgatcatgaatcgtaagaaagagtatgacatgctcaagtcacagatgccagagaacagagcaagctacttgaagtgctccagcaatgacataaccaagatttggttagtagagaggatggaggacaaagaacagaggatggcaccaaaaggaacagtgttcattccaatatcgcagttccccctgaagaaagtccgcaaagactgcacttacttgagcactccggcgatgaagatcccggacactatgcagaacatccactcctgcgagaactggttgccgagaagggtgatgagcgcgtggcatatcgccggaatacttcatgtcctggaagggtggagcgtgcacgagtgcggggacgacatgatggactctgagaaagcatggtcggccgctatcaggcacggctttgtccctctcacgaaagcttgactgagaaatgttgcctccgtccgatgctaagatggtactaccgagaattgatgctaaaactgcagttttttttttcatttcgggaacacgcaggagatatatgtttggcagggcagctaagtccttaagatttatcagtgtgaacatcgacatcaattccattaacctattgcttatggagtattgtacttttgtttgtataacgtctgtaagatcatggaagatgatgtttggcgtttgagttcagtaggagataatcggaacgcctgatttgactgaaaaaaaaaaa

SEQ ID NO: 2938 - DNA, 2249 bp, Setaria italica
cgagggacgacgcgcagtacctgggcagctgggctacgttgggggcggggtacctttggctttgggtggccacaggagcaagagcaaggggcgtctagccatggccaccaggccgggccctttgaccgagtggccatggcaaaggctcggcaacttcaagtacgtggtgatggcccccgtggtggtccacggctcgcggcgggtggccggcgccggcggctggggcgagctcgacctcgccttcgcgctcatcctgccgtcgctgctgctccggatggtccacaaccagatctggatcagcgccgcccgctaccagacggcgcgcagcaagcaccgcatcgtcgaccgcggcatcgacttcgaccaggtcgaccgcgagcgcggctgggacgaccagatcatcctgaacgggctgctgttctacgtggcgtacctgctgatcccgagcgcgaggcacatgccggcgtggaggaccgacggcgccgtggcgatggcgctgctgcacgccgggcccgtggagttcctctactactggttccaccgcgcgctgcaccaccacttcctctactcgcgctaccactcgcaccaccactcctccatcgtcaccgagcccatcacctcggtgatccatccctttgctgaacacatcgtctactacatcctgttcgccatccccatgctgacgacgatttacatggggaacggctccgttctgggaatcgtgctctacatcgcctacatcgacttcatgaacaacatgggtcactgcaacttcgagctggtgcccaagtggatgttccaagtcttccctcctctcaagtacctcatgtacacgccgtcgttccattccctgcaccacacgcagttccgcacgaactactccctgttcatgccgttctacgactacatctacaacactatggacaagtcatctgaccagctgtacgagagctcgctcaaggggacagaggaaacacctgacctcgttcatctcacgcacatgaccaacttgcaatcggcctatcatttgcggattgggttcgcctccatagcatccaaaccatctgacagctctatgtggtatatgtggacgctgtggcccttggcatggctgtcaatggtgcttgcatgggtttatgggtcatctgcgtttgtggttgagagaatcaagctaaacaagctgaagatgcaaacatgggcagtaccaagatacaacttccagtatggacttaactgggaaagagaatcgatcaacgacttaattgaaaaggcaatactagatgctgatgcaagaggtgttaaagttctcagtctaggattattaaaccaggcgaaacagctcaatggtggtggtgaattatttagacaaaagtatccgaaattaagagttcgccttgtcgatggaagtggcttagcaaccgccgtggtgctcaaaagcattcctcacgatgcaaagcaagtttttcttcacgcaggcccttctaagatagcctatgccacagcttttgcattatgtgagaagggcgtcaaggtgatcatgaatccaaataacaaatatgatatgcttaagtcacagattgcagatagcagagcaagctatttgaaacactccagcaaccacatgcctcagatttggctagtggacaacattgatgacaaagaacagaagatggcaccagaaggagctatattcattcctatttcacagttccccatcaagaaaattcgcaagaattgcacttacttgagcaccccagcaatgaagatcccggaaactatgcagaatgtccatgcctgcgagaattggctgccaagaaaggtgatgagtgcttggcgcattgctggaatacttcacgctctcgaaggatggaccaagcacgagtgtggggatgccatgatggacgctgagaaagcatggtcagctgctataaggcacggattcgttcctctgaataaagcttgagagatttcgaagcctggattatgtagctgggggatgtatgcagctctatatggcacttgacgatgttgggaaactatgtttcagcgtttagtagttcaaattctgcctgatataaaggccaactacgatcttgtagaagataagggagggcacaatatgaatgccaacattgattcggatagctttactagtaactacatatttgttatttgtatgatgccagtgtgcgaagttaagaaaaatatcggtttgggtttttatgcttgagtttaaaattatctggacg

SEQ ID NO: 2939 - DNA, 2814 bp, Sorghum bicolor
agcaagaccgacgagcgcttggcgaggtggtgctcttggtcttggggtcctgggacactactagcgcgcacagcaaagggaggcggctgcctgggcgtctcgctctcgccatggccaccaggccgggccctttgactgaatggccatggcagaggcttggcaacttcaagtacttggtgatgggtcccgtggtggtggacggggcgcggcgggtggtggcgcggggctggggcgacatcgacctggcgttcgcgctcatcctgccgtcgctgctgctgcggatggcgcacaaccagatctggatcagcgcggcgcgctaccagacggcgcggagcaagcaccggatcgtggaccggggcatcgagttcgagcaggtggacagggagcggggctgggacgaccagatcatcctcaacgggctgctcttctacgcgggctacctggccatcccgagcgcgaggcacctgccggcgtggaggacggacggcgccgccgtgatggcgctgctccacgcggggcccgtcgagttcctctactactggttccacagggcgctgcaccaccacttcctctactcgcgctaccactcgcaccaccactcctccatcgtcaccgagcccatcacctcggtgatacatccctttgctgaacacatggtctactacgtcctgtttgcgatccccatgctgtcgactgtttacattgggaatgcctctgttctgggtattgtggtctacatcgcctacatcgacttcatgaacaacatggggcactgcaatttcgagctggtgcctaagtggatgttccaagtcttccctcctctcaagtacctcatgtacacgccatcgtttcattctctgcaccacacgcagttccgcacaaactactcgctgttcatgccgttctacgactacatatacaacaccatggacaagtcatctgaccagctgtatgagagctcactcaggggaacagaggaaacacctgaccttgttcacctcacgcacatgaccgatctgcaatcggcctatcatctacggattggattcgcctccatagcgtccagaccgtctgacagctccatgtggtatatgtgggtgctatggcctgtggcgtggctgtcaatggtgcttgcatgggtttatgggtcctctacgtttgtggttgagagaatcaaactagggaagctgaagatgcagacatgggcagtaccaagatacaacttccaatatggcctgagctgggagagagaatcgatcaacgacttaatcgaaaaggcgatattagatgctgatgcaagaggtgttaaagtgctcagtctaggactattaaaccaggcgaaacaactaaatggtggtggtgaactatttaggcagaagtatccaaaattaacagttcgccttgtcgatggaagtggcttagcgactgcggtggtgcttaaaagcattcctcatgacgcaaagcaagtttttcttcatgcaggcccttctaagatagcgtgtgccacagctttcgcattatgtgagaggggcgtccaggtgatcatgaatccaaagaaggaatatgatatgcttaagtcacagattgcagatagcaaagcaagctatttgaaacactccagcaaccacacgcctcagatttggctagtagacaacattgacgataaagaacagaagatggcaccacaaggagctatattcgttcctatctcacagttccccatcaagaaaattcgcaaggattgcacttacttgagcactccagcaatgaagatccctgaaacaatgcagaatatccatgcctgcgagaactggctgccaagaagggtgatgagcgcttggcgcatcggaggaatacttcacgccctggaagggtggaccatgcacgagtgtggggatgccatgatgcatactgagaaagcatggtcagctgctattaggcacggattcattcctctgactaaagcttgagattgagagctttcgaaacccggattcgtggagctaggagatgtatgcactgcaactctagatgggcattcgacaatgctggcaaactatgtttcagcgtgattctgcccggtataaaagccaactatggtcttgatgagtcgtcagggacggggaggcacatcatgaacgcctaccttgattccaaaagcttagtaattatacatatgctgtatcattgtatgatgcaagtgtgagaaactacttttatggctgtgtgggtgacgtatacaattattataataaaatgacggtttgggttgtccctttggaatttgaacccgccgaagaatggctgaaaaacaggtaaggaatttttgatacgcaatcttaatctcggcggtaagagctgacttctatttcagcctttcagggattcaggaaatggtacacacgcagtcatccatccatagtccaaaagagcatactggtatgttcctgcttcagaacctgtatatccaggcacgatgcaatctagatagattgtcgttgatccgacgaaagagatgcagtgcgagaaccgagagatgcagttgagcgaggaaacctgcaacggatttggtatacgttggtgcaaagatcgtagctcgctgaagatcatcgagttcgagtccagagtttcctttgactgcggagatcggcgcaggggcgaagacaaagagaggcaggggcacagtcttcacaagtacttctcattatagttatcactaatcactagtcaactaattctagatttttttttctaaaatgcatatcttgatcggttaatgttaagcgcttaaataaagtaaatataatatttttt

SEQ ID NO: 2940 - DNA, 2755 bp, Panicum virgatum
gagtgctggtggccgctgtggcgctgtgcgtgctcgccgggcgcaagcgcatcaaagcacggcggcttgcggtggatcggagtcttgcctccgtctactgcgcggggcggtgtccagcccgtggccacacgtgccgtgtctcgactggctgccggccccgcccagacggtgcggcgcagcggtcagccgagcagcatatgcatacgggccccggtgagcaggccggctgacatctcgcagcgaccgagagagagagagagagagagaggcgtgcggtgcgccaccgcgcgccgagctaggtgccaagcacaccctaggtgcgtgacttggcttcgctgcgcgcggttataaaacggcaggagagggcgcctggcgaggggtgcgcagagcctgggttacgttgggggagcacattgggctcggccgctcggggagacggggacttggggccggggtggtgaccggcacaggagcaaggagcatcgctcgccatggccaccaggccgggccctttgactgagtggccatggcagaggctcggcaacttcaagtacgtggtgatggctcccgtggtggtccacggcgcccggcgggtggccggcggcggctggggcgacatcgacctcgccttcgcgctcatcctgccgtcgctgctgctgcggatggtccacaaccagatctggatcagcgccgcccgctaccagacggcgcgcagcaagcaccgcatcgtcgaccgcggcatcgagttcgaccaggtcgaccgcgagcgcggctgggacgaccagatcatcctcaacgggctcttcttctacgtgggctacctgctcatcccgagcgcgaggcacctgccggcgtggagggccgacggcgccgcggcgatggcgctgctgcacgccgggcccgtggagttcctctactactggttccaccgcgcgctgcaccaccacttcctctactcgcgctaccactcgcaccaccactcctccatcgtcaccgagccaatcacatcggtgatccatccctttgctgagcacatggtctactacttcctgtttgcgatccccatgctgacgacggtttacatggggaacgcctccgtcctgggctttgtcctctacatcgcctacatcgacttcatgaacaacatggggcactgcaacttcgagctggtgcccaagtgggtgttccagctcttccctcccctcaagtacctcatgtacacgccgtcgtttcattccctgcaccacacgcagttccgcacgaactactcgctattcatgccgttctacgactacatttacaacaccatggacaagtcatccgaccagctgtatcagagctcgctcagggggacagaggaaacgccggaccttgttcatctcacgcacatgaccgacttgcagtcggcctaccatttacggatcggattcgcctccatcgcgtccaaaccatctaacaggtctatgtggtacatgtggacgctgtggcccttggcatggctgtcaatggtgtttgcgtgggtttatgggtcctctgcgtttgtggttgagaggatcaagctaaagaagctgacgatgcaaacatgggccataccaagatacaactttcaatatggcctgaactgggagagagaatcgatcaacgacttgattgaaaaggcaatactagatgctgatgcaagaggcgttaaagttctcagcctaggattattaaatcaggcgaagcaactcaatggtggtggtgaattattcagacaaaagtatccgaaattaagagttcgccttgtggacggaagtggcttagcaaccgcagtggtgctcaaaagcattcctcatgacgcaaagcaagtttttcttcaggcaggcccttctaagatagcctgtgccacagcttctgcattgtgtgagaaaggcgtgaaggtaatcatgaatccaaagaaggaatatgatatgcttaagtcacagattgcagatagcagagcaagctatttgaaaaactccagcaaccacatgcctcagatttggctagtggacagcattgatgacaaagaacagaagatggcaccacaaggaactatattcatccctatctcacagttccccatcaaaaaaattcgcaaggattgcacttacttgagcaccccagcaatgaaaatcccagaaaccatgcagaatatccatgcctgcgagaattggctgccaagaaaggtgatgagtgcttggcgcatcgctggaatacttcacgccctggaaggatggaccatgcacgagtgtggggatgccatgatggacgctgagaaagcatggtcagctgctataagccacgggttcgttcctctgactaaagcttgagagctttcggagcatggattctgtaactgggtgacgcatgcaactctagatggcacttgacgatgctggaaaactatatctcaaagtttagtaggagtaggacaaattctgcctggtataagggccaactatgatctcgaagataagaggggaacaatatgaatgccgaccttgattccaatagcttactataactacatgtttgtatgatgccagtgtgcgaagttgatgtatgattgtggggattgtataataaagaaatatcggtttggtttttatgcttgagtttaaacttagattgatcgttcagatttcccgaagaattcagaattctctcgctgaaaatggctgggagttttgatacgcggtcttgaatttccgaggtaaaatctgttgtttcaggt

SEQ ID NO: 2941 - DNA, 2306 bp, Saccharum officinarum
cctgagtttagggaacgacccacgcgtccggagagcgcttggcgaggagcggacgcgaggtgctctggcctctgggggtcctgggtgtctaaccacactagcgcgcacaggagcaaagggaggggggcatctcgccatggccaccaggccgggccctttgactgaatggccatggcagaggcttggcaacttcaagtacttggtgatgggccccgtggtggtccacggcgcgcggcgggtgctcgcgcggggctggggcgacatcgacctggccttcgcgctcatcctgccgtcgctgctgctgcggatggtgcacaaccagatctggatcagcgccgcccgctaccagacggcgcgcagcaagcaccgcatcgtcgaccgcggcatcgagttcgaacaggtcgaccgggagcgaggctgggacgaccagatcatcctcaacgggctgctcttctacgtgggctacctgacgatcccgagcgcgaggcacttgccggcgtggaggacggacggcgccgccgtgatggcgctgctccacgccgggcccgtggagttcctctactactggttccaccgggcgctgcaccaccactttctctactcgcgctaccactcgcaccaccactcctccatcgtcaccgagcccatcacctctgtgatccatccctttgcggaacacatggcctactacttcctgttcgcgatccccatgctgtcgactatttacattgggaatgcctctgttctgggcattgtggtctacatcgcctatatcgacttcatgaacaacatggggcactgcaatttcgagctggtgcccaagtggatgttccaagtcttccctcctctcaagtacctcatgtacacgccatcgtttcattctctgcaccacacgcagttccgcacaaactactcgctgttcatgccattctacgactacatatacaacaccatggacaagtcatctgatcagctgtatgagaactcactcaagggaacagaggaaacacctgaccttgtttacctcacgcacatgactgatctgcaatcggcctaccatctacggattgggttcgcctccatagcgtccagaccgtctgacagctccatgtggtatatgtgggtgctgtggcctgtggcgtggctgtcaatggtgcttgcatgggtttatgggtcctctacgtttgtggttgagagaatcaagctaaggaagctgaagatgcagacatgggcagtaccaagatacaacttccaatatggcctgagctgggagagagaatcgatcaacgacttaattgaaaaggcgatactagatgctgatgcaagaggtgttaaagtgctcagtctaggactattaaaccaggcgaaacaactaaacggtggtggtgaactatttaggcagaagtatccaaaattaggagttcgccttgtcgatggaagtggcttaacgactgctgtggtgctcaaaagcattcctcatgacacaaagcaagttttccttcatgcaggcccttctaagatagcttgtgccatggcttttgcattatgtgagaggggcgtccaggtgatcatgaatccaaagaaggaatatgatatgcttaagtcacagattgcagatagcaaagcaagctatttgaaacactccagcaaccacacgccccagatttggctagtagacagcattgacgataaagaacagaagatggcaccgcaaggagctatattcgttcctatctcacagttccccatcaagaaaattcgcaaggattgcgcttacttgagcactccagcaatgaagatccctgaaacaatgcagaatatccatgcctgcgagaactggcttccaagaagggtgatgagcgcttggcgcatcggcggaatacttcacgccctggaaggatggaccatgcacgagtgtggtgatgccatgatgcatactgagaaagcatggtcagctgctattaggcacggattcattcctttgactaaagcttgagacagagagctttcgaacccggattctggagctggaagatgtatgcaactctagatggcagcattccacgatgctgggaaactatgtttcagcatccagtaggacaaattctgcccggtataaaagccgactatggtgttgacgagtcgtcgggggaggcacagcatgaatgccgaccttgattccaatagcttattaactatatatatgttgtatcattgtatgatgcaagtgcgagaaactgctttatagctgtgtgggtgacgcatacaattataataataaaatgccgatttaggttgtccgtttg

SEQ ID NO: 2942 - DNA, 3585 bp, Oryza sativa
ctccatttaactgtttgtggttcaggtccacctttatatgactgagaaaaccaatgccaagagatatgccattcttctccgcaatcttctggacaacttcagcattaacaaaagtgccatcactttgcttcacattgaaagcaacagcagctcccctttcgtacttaatctttgggccataaatgtggacaagggggtctccatcaccaccttttgagcctggtaacctcagctgcaacagtgaagttactagccaattgatcaggtatcttaatctaagagtagttctgttaagccccatcatatcaacatgatcaatgtgcctgcatattatctccggctctctcctgccccagtcctgagcattatcatacccatcacttacacaaccatcatcatcacggaatgcatatccagaagcttcagcagcatctgaggcccggtgtagtctatccgcaataatatttgcttcagtgctgaatgaaaccctacggcccatgcttaaacctgcatcaatctcttcaacaccgaagagccgacccccagcaaatctgctgtttccatccctccctcccaaaagccgaaattccccttcagtctcccttcttatcgcactttctttgtgatccccaccgccattcatagcatgttgacatacaacttcttcaacctctggctcctcttgaatttcactaacttgcctgaagtgattccgccgaccattctcatagatttcttcttcagggtcttccttgaggcagtccgcgtcatgtgaaactgataatacagctgcatcaaaagatatcacctgaccatcataaagagggcttcttgatatcctggatgttaggttcggtgacatcctcttgttactctttctgccagcgaaccaagaagatggtaatggggatccaagtttccctttcttgaaatgaccacccttctccgaccccaatgggctttggccaacatcaacccagaaagaattctctgaagagcaatcttcgctgaaagccgggctcctcatgacctcaccaactgagatgctctcagtttcttcaaaaatggtgctcgccccatccctgtccgagctgctgtcacggccaggatcactctcaaatgcctctctgacctgagcagatgtgtacacacctgaaaatgctggcagctgcgaaccattacgggcatcagacgctggcttctcatctttgtggacaccagaatcatcttcgagaccatccattgcatcaaatccatcaacagaatcacttagatattgcggaaacactggaacaatcctcaccatcccagaagcattacacccattcctcccctgcaagctcccaataactgatttcttaatcagaaggcaaccaaacccagttgggtctgcaccgaaaacccggtagaacgaggttatgatgaaatccggcctgaacagcgagagccccagagaatccatgtccttggggcccagtgcgcctgcatcaagcatcacatgccagccattctgctgcgccagcgccatccactggtaggagtacttggcgccggtcacccgagattgtgcagggaacacaaacaaaccaaccgcagaatcccgtcgccgccctctcctcttaccgacgatctccttcctcagctccgtcgagcagagcttcaatgtcggccaccggaaccacgcggtgcgcgtcttggcacccttcgcccgcgcgctctgcgccatccagctcacggactggctctcgtggtcgaacatggtgagcagcctccggttggtctcgaacgggtagcactcggcgaggagccggaacgccgagccccggctcacggtgaacaccagcgcgtactcgctcgccggcacgttcaggtactcgaggatcctctccttgatgtcgttctccaccgtgccggcctcggcgccgccgtagagcgcgtggttgctgaggttggcattgagctcggacaatgtgaaggacgaggaggaggagtcccagccggagtcgaagaggccgaaaccacagtagtcgaggcagaccctgccgcccgcgccgccgccgggggcggcggcgtcgaggtgggagtagtgctcgacgcggaggcggtcgacgtcggacgtggtggcgtagtccgggtacatggcgaggaacccggcgatggcggcggggaggagcgggatgtcggagggcgagcggaacgggccgcccgccgcggcgagcgcggtggcgcggaggaagtcgcgctgcgcccggagccgcgcgagcgagcgggagcgcgacacggcggcgtccgcgtcggcgtccgcgcccgcgcccgcggcgtccgggggcgggcacagcgagccgtcctccgacgcggcgtcgagcgcgtcgcgcagctggcggaggaacgacgccgggtcgtcaccgcggtggccattgcttccgccgccgccgccgcggcggcggtggttcttggcgaggaggacggcggcgcagtgggagaggggcttccatagggagagatgcatagggaatcgagcgacctgagaaatcgcagcttctccttcttcttcgtggcgattttggatcaacgaggcatcgaggaggagaaaaaatgagagattttcgtggagagatttcagaaaattggatctttggagaactatggatcagaaaatgagcatttcttgaatcaagaacactggcagaatggcaatggagaagtggggagaagaaatctgagagggtttgtttggtggtgggggtgaaatcaaatggatttggaggaaaagatggggatttttgtggtaaaaattggagatttttggtttgaaggagtttggagggggatggagggtttgagttgagatgcaaggaggacaagccttcaccttttccttttggacttctctcctcagctaaaagtgaggggcttttgcttttggcaggatcaagaactcaaattaaagaaaagagcatcaaagaggaggaagcaaaaaagaaagaaatatgtaaataaaaactaaagatttgactctgtcttttctgctttgcagcaagcaagaaacaatgctccccaacaaaccagtgatgaactggcctggctctagtctctccaaatctagggaagaagaagaagaagaagcttaaggtcagatgcagaacaaatctcacacagagcctccctcctctcaccaaactcttgcaagtgttttgaatgccctcactaaatgcatttgcatcatgagggagggctctgcattcatttccaagaactactactactactactagcagcaagcaccaacttttttattagttttggttttgttcctacacttcactttggagcaaagtactggcactattttagtgtggctcagtgtgtgcctgcttttttagtactatccaccaagtaaaaacaaagtgtttggtactcttattattggcttttcctattatttttattattattatatattttctttctcctccatggggctcacattgggctgtaaagtagtgttgcaagaaagtatttgggcattgacttttttcaccatttaaatgcagtgttattgggtgcttttggtcatgatttttc

SEQ ID NO: 2943 - DNA, 1853 bp, Zea mays
gcttcggttgccatctcactctcgccatcacgtcggcctcttccacggccgccgccgtcgtcgccgccgccgccacctcgccgccgaccaccataccatcagatatttcagagctcgcgcccctcacgcatggttcttggcttcttgcttcttgctcgacgtgcgccgtaactaatcgactataagcgtggtgacacgtctgacgagatgatgccggtggcggcggtggatgactggtcggagcgcggtttctcgctgacctgcgaggaagactgcgccgacctcggcaacggcgtcgtagacgacgacgagttcctcccgctctacaatgccggcgaagaggaggaagaggagtatttggagcagctggtgtttaaggagaccagcctctgctcctcctccgactcagccgcggactgcgacggcgacggcgaaggagacgaagaatacccctcgctcgcctctgaggagtggtttcggcaagctcgcctcgccgccgtcaagtggattcttgaaacccgcgggtgcttcggcttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcggatggcgcatgggcgccgtcacgcccttggacttcctcccctgcttctcctcccgggtccacccgcacggcggcgccggcgccggcggccacgtcgcccacaaggccatcggtttcatctttgccacggctgaagctggtagcgtgcttgatcacaggccgtccactgtggctgcagctgcaatcttggctgcaacctatggacctctactgaccaaagaagcactcgattccaagatgagctacctttctccatcttgtcttattgagaaggaacatgtacatgcctgctacagtatgatggttggggacaataacaggagaggtagcaagagatcattgccatgttcagtctccaacgagattgccactagtacatatcattctgttcttgttgatgatgttacggacaccgccgccgcctttgccacggcggtatcggccaggaataagcggatcaggctggagctgacgggcatcagttgagaaagctagcaccaccggggacacagtttttagccagatgtctaggggggcttggtttgatcttccctttcattttcttcccttctttttgaacttatatgtttgcgaaaaagaagatatttttttaggttctttgagccattgccatgggttggcattggctgttgtcagatttgattggtttggtttgtgagaggtggaagagatgaacaaagcagagggctgagctttcctatggagaggagagcttaggttaataagcccaatgccagcgcccaaacagggcacacttcacattcagtgaactttacttcaaaggttgatgcaatgttgcattgcatgtggtgagagatgctgctgcagagaagatgcaaaacaagtggtaacaacactgagaggttgagggttttgccattgtttatagaacgagtgagcgagagagggagatgtttccctttttcacctgtgcaagtggatgtgagagtggtgtttcactctgcacttgcgagggttacatcggtttgtaacaaaccctgtgtacttgtgtaaccccctcttgttcctgaggaatggaatcagattgcgttttgcgtcaa

SEQ ID NO: 2944 - DNA, 2055 bp, Zea mays
cactctcgccgtcactccggcctcttccacggccgcctccgccgccgccgccgaccaccatagcaacagatatttcggagctcgcgccttacgcgcatggtttgctcgacgtgcaccgtaactaatcgactataagcgtggtgcctattgacgagatgatgccggtggaggaggcggcggcggatgactggtcggagtgcgcgttctcgctgacctgcgaggaagactgcgccgacctcggcgacggcgagctattcccgctctacagtgccggcgacgaggaggaagatgagtacttggagcagctggtgttcaaggagaccagcttctgctcctcctccgactcagctgccgactgcgacggcgatgaagaaggagacgaagaatactcttcgctcacctcagaggagtggttccgccaagctcgcctcgccgccgtcaagtggattcttgagacccgcgggtgcttcggcttcggccaccggacggcgtacctcgccatctcctacttcgatagcttcctcctccggcgacgcatcgatagggagacgatgccgtgggcggcgcagctgctgtccgttgcgtgcgtgtccgtggccgccaagatggaggagtgccaggcgccggcgctgtcggagttccacgccggcggcttcgacttcgactcggcgtccatccggcggatggagctgctggtgctgtccacgctcgggtggcgcatgggcgccgtcacgcccttggactttctcccctgcttctcctcccgcgtccacccgcatggcggcgccggcgccggcgccggcggccgcgtcgccatcggtttcatctttgccacggccgaagctggtagcgtgctcgatcacaggccgtccactgtggctgcagccgcaatcttggctgcaacctacggacctctgctgaccaaagaagcactgagctccaagatgagctgcctttctccatcttatcttattgagaaggagcatgtacatgcctgctacagcatgatggttggggacatgagcaggagaggcagcaagagatcattgccatgttcaggccccgacgagattgccactagtacatatcattctgttctagttgatgatgccacggacaccgccgccttcgcctcggcggtggccgcggcgaggagtaagcagatcaggctggagctgacgggcatccattgaggaagctagcaccaccggggacacgatttttagccagatgtctagggggggcttggtttgatcttccctttcgttttctttccttcttttttttaacctatatgtttgcaaaaaaagaagagatttttttaggttcttttagccattgccatggggttggcgtttggctgctgtcagattggtttgatttggtttgtgagaggtggaagagatgaacaaagcagagggctgagcttccctatggagaggggagcttaggttaataagcccgctgcacagtgctccaacagggcactcgtttccagtgaactttatttcgaagttgcactgtttgataaaccattgttgatgcaatgctgcattgcatatggtggtgagatgcagagaagatgcaaaacaagcgaggttgagggttttgccattgtgtatagagagagagagagagatgtttccctttttcacttgtgcaagtgggtggtatttcactctgcacctgcaagggtcacatcggtatgaacagaccctgtgtacttgtgtaaaaactcctcttgttcttgaggaactgagagagaatcagattgcatcaagctttgcctgcctgtgtgagtgtgtgtgtgtatgtcgcgacatccctgtaggtttcttgatcagttccgctggccgctgcagattttgaatgccactcattcagttctggctgcggctgggccatgccagcacttgttgctctgcttttttcttcaggatcagggaaggaggatccaatgcaaccctttccctgttccattgcagccagttcagctcagcacatgctaattgaatctcggccaaaccccactgttgcacagcacttgcacaaccc

SEQ ID NO: 2945 - DNA, 2415 bp, Setaria italica
tcccctccggcctctgccacggcccgccaccgccgccgccacctcgccggcgaccaccgcagcatcggagattccagagctcgcgcccctcgcgcatggttcttggcttctcgcttgctcgacgtgtcctgtaactaactgactaaccgtggtgacgagatgatgccggtggaggcggcggcggcggaggactggtcggcgtgcgcgttctcgctcacctgcgaggaagacggcgccgacctcggcgacggctccgtcgacgacggcgtgctcttctcgccctacaatgccggtgacgaggaggaagaggaggagtacttggagcagctggtgttcaaggaggccagcttctgctgctcctcctccgactccgccgccgactgcgacggcgacggcgacgtggacggcgagtgccagtccgtcgtctccgaggagtggttccggcaagctcgcctcgccgccgtcaagtggattcttgaaacgcgcgggtacttcgggttcggccaccggacggcgtacctcgccatcgcctactttgacagcttccttctccggcgacgcgtcgacagggaggcgatgccgtgggcggcgcggctgttgtccgtggcgtgcgtgtccgtcgccgccaagatggaggagtgccaggcgccggcgctgtcggagttcgacgctggcggctacgacttctgcccggcgtccatccgccggatggagctgctcgtgctgtccacgctcgggtggcgcatgggcgccgtcacgcccttggacttcctcccctgcttctcctcccggctccacccgcacggcggcgccggcgccggcgccgccctcaaggctatcggcttcatcttcgccacggcccaagctggtagcgtgcttgatcacaggccgtccactgtggctgcagctgctatcttggctgcaacctatggacctctgctgaccaaagaggcactggattccaagatgagatacctttctccatctcgtcttattgagaaggagcatgtacacgcctgctacagtgtgatggttgggggcatgaacaggaggggtaacaagagatcattgccatgttcaggctccgacgaggttgccactagtacatatgattctgttcttgttgatgatgttaccgacaccgccgcctttgcgacggtggtggcggcgaggaataagcggatcaggctggagctgccgggcatccgttgagaagctagcaccaccggggacacaatttttagccagatgtctaggggggcttggtttgatcttccctttattttcattcttttaacttatatgtttgcaaaaaaaaaaagttttttaggttctttgagccattgccatgggttggcattggctgctgtcagattggattggtttggtttgtgtgagaggtggaagagatgaacaaagcagagggctgagctttcctatggagaggagagcttaggttaataagcccaatgccagtgcccaaatggggcacattccagtcaactttacttgaaagttgcactgtttgataagccattgtggatggcatgttgcaatgcaatttgcattcatatggtgagatgctgcttctgcagagaagttgcaaaacaagtggtaacaacactgaggttgagggttttaccattgtttatagaggagagagagagagagctgtttccttttttcacttgcgcaagtggatgtgtgagtgtttcactctgcacttgcttgggttacatcggtttgtaacaaccctgtgtacttgtgtaacccctcttgttcctgaggaatggatcagattgcatcatgtgtgtgacctccctgtaggtttcttgatcagttctgccgactgctgcaattttcagtgtcactcattcacttctgctgggccatggcagtggttcttcttgctctgcttttttctccaggaggatccaatgcaacctttttcctgttacattgcaaccagcttagcacatgcttgatgaatcttggccaaaccccactattgcacaggcagaacttgcacaatccacagtaatgtaagtaaaggaagagatggccggtgtgtaaagaaagccattgtcaaccatgattagtagcaagtacattgtggccctttggacattattgtgtatgatgagcaaagcatgcaacaacacactacgtgctgttgtgtgggaaggaagacaagtgctgctgcatatggatgggagtattaatgaacaagatagatacaggagattagcactttaggccaataattgccaaaagattagggtgatgtgacttctaacttatgtagttgtgtatttggttggtatggagctgcacaagtttgatatttgttacaccaagaggatgtggagcacactgaggcaacttgcaagttctgagcaaagtaaactatcaaaa

SEQ ID NO: 2946 - DNA, 1853 bp, Panicum virgatum
ttcggttgccatctcactctatcctcttccactccggcctcttccacgccgcctccgccgccgccacctcgccggcgaccaccgtagcatcagagattccagagctcgcgcctctcgcgcatggttcttggcttctcgcttgctcgaccagcactgtaactgactgaataagcgtggtgacgagatgatgccggtggaggcagcggcggcggaggactggtcggcgtgcgcgttctcgctcacctgcgaggaagacggcgccgacctcggcgacggctccgtcgacgacggcgagctcttctcgccctacaatgcccgcgacgaggaggaaaggagtacttggagcagctggtgttcaaggaggctagcttctgctgctcctccgactccgccgccgactgcgacggcgacggcgacggcgatgtggacggggacggggaccaccagctcgtcttctccgaggagtggttccggcaagctcgcctcgccgccgtcaagtggattcttgaaacgcgcgggtacttcgggttcggccaccggacggcgtacctcgccatcgcctacttcgatagcttcctccggcgatgcgtcgatagggaggccatgccgtgggcggcgcggctgctgtccgtggcgtgcgtgtccgtggccgccaaaatggaggagtgccaggtgccggcgctgtcggagttcgacgccggcgactacgacttctgctcggcgtccatccgccggatggagctgctcgtgctgtccacgctcgggtggcgcatgggcgccgtcacgcccttcgacttcctcccctgcttctcctcgcggctccacccgcacggcggcgccggcgccggcggccgcgtcgccctcaaggccatcggcttcatctttgccacggccgaagctggtagcgtgcttgatcacaggccgtccactgtggctgcagctgcaatcttggcagcaacccatggacctctactgaccaaagaggcactggattccaagatgagctatcttcctccatcttgtcttattgagaaggagcatgtacatgcttgctacagtatgatggttggagacatgaacaggaggggtaacaagagatcattgccatgttcaggctccaacgaggttgccactagtacatatgattctgttcttcttgatgatgttaccgacaacgccgcctttgcgacgggcgtggcggcgaggaataagcggatcgggctggagctgccgggcatccgttgagaagctagcaccaccggggacacaatttttagccagatgtctaggggggcttggtttgatcttccctttttttcattcttttaacttatatgtttgcaaaaaaaagaagttttttaggttctttgagccattgccatgggttggcattggctgctgtcagattggattggtttggtttgtgtgagaggtggaagagatgaacaaagcatagggctgagctttcctatggagaggagagcttaggttaataagcccaatgccagtgcccaaatggggcacattccattcaactttacttcaaagttgcactgtttgataagtcattgtggaatgtggatgccatgttgcaatgcaatttgcattgcatatggtgagatgctgctgctgctgttgcagagaagttgcaaaacaagtggtaataacactgaggttgagggttttaccattgtttataggagagagctgtttccttttttcacttgcgcaagtggatgtgtgagtgtttcactctgcacttgcttgggttacatcggtttgtaacaaccctgtgtacttgtgtaacccctcttgttcctgtggaatggaatcggattgcatcatgttgtgca

SEQ ID NO: 2947 - DNA, 1967 bp, Panicum virgatum
ggcttcggttgccatctcactctatcctcctccactccggcctcttccacgccgcctccgccgccgccacctcgccggcgaccaccgtagcgtcagagattccagagctcgcgcctctcgcgcatggttctcggcttctcgcttgctcgacccgcactgtaactgactgactaatcgtggtgacgagatgatgccggtggaggcggcggcggaggactggccggcgtgcgcgttctcgctcacctgcgaggaagacggcgccgacctcggcgacggctccgtcgacgacggcgagctcttctccccctacaatgcccgcgacgaggaggaagaggagtacttggagcagctggtgttcaaggaggccagcttctgctgctcctccgactccgcccccgactgcgacggcgacggcgatgtggacggggaccaccagctcgtcttctccgaggagtggttccggcaagctcgcctcgccgccgtcaagtggattcttgaaacgcgcggattcttcgggttcggccaccggacggcctacctcgccatcgcctacttcgatagcttcctcctccggcgacgcgtcgatagggaggcgatgccgtgggcggcgcggctgctgtccgtggcgtgcgtgtccgtggccgccaagatggaggagtgccgggtgccggcgctgtcggagttcgacgccggcgactacgacttctgctcggcgtcgatccgccggatggagctgctcgtgctgtccacgctcgggtggcgcatgggcgcagtcacgcccttcgacttcctcccctgcttctcctcgcggctccacccgcacggcggcgccggcgccggtggccgcgtcgccctcaaggccatcggtttcatctttgccacggccgaagctggtagcgtgcttgatcacaggccgtccactgtggctgcagctgcaatcttggcagcaacctatggacctctactgaccaaagaggcactggattccaagatgagctatcttcctccgtcttgtcttattgagaaggagcatgtacatgcttgctacagtatgatggttggagacatgaacaggaggggtaacaagagatcattgccatgttcaggctccaacgaggttgccagtagtacatatgattctgttcttgttgatgatgttaccgacaccgccgcctttgcgacggcggtagcagcgaggaataagcggattaggctggagctgccgggcatcagttgagaagctagcaccaccggggacacaatttttagccagatgtctaggggggcttggtttgatcttcccttttttttcattcttttaacttatatatgtttgccaaaaaaaagttttttaggttctttgagccattgccatgggttggcattggctgctgtcagattggattggtttggtttgtgtgagaggtggaagagatgaacaagaacaaagcatagggctgagctttcctatggagaggagagcttaggttaataagcccaatgccagtgcccaaatggggcacattccagtcaactttacttcaaagttgcactgtttggtcagtcattgtggaatgtggatgccatgttgcaatgcaatttgcattgcatatggcgagatgctgctgcagagaagttgcaaaacaagtggtaacaacactgaggttgagggttttgccattgtttataggggagagagagagagagctgtttcctttgttcacttgcgcaagtggatgtgtgagtgtttcactctgcacttgcttgggttacatcggtttgtaacaaccctgtgtacttgtgtaacccctcttgttcctgtggaatggaatcagattgcatcatgttgtgcatgcctctgcggctctgccagcctgagtgcgtgacctccctgtaggtttcttgatcagttctgccgactgctgcaattttcagtgccactcattcagttttggctgggccatgcc

SEQ ID NO: 2948 - DNA, 1886 bp, Saccharum officinarum
cccacagcagagcggcgcgcgcgatggcgggcggtggcgatctccagggcgcgaagaagcgcaagcgcgagcacgcggaagggaaggccaagcgtcggccgcaagttaagggaggcggggacggagggaagcggaagaagcacttggccgatggcggggccggagaggctgtggcgaggaagaagaccccggttacccacaaggagaagcgcctcgcggccaaggaaatgtcggaggccaggaagatgaagatgaaacggcattacagccttgagaaggaactaacgaaactgtgggaaaagatgagatgccacgatgtgagcaaagaggagaggtccaaggtagtaagtgaggctatcaagaaaatggatgggaaatatttggatattgccacatcacatgttactgcacgtgttcttcagacatgtgtaaagtggtgctcgcagtcagagagggatgctatttttgatattctacatccacatttgctcgatctttctcacaagaaatatgcggttttccttgtaaagaagcttgtagaactcgcctctaaaaaacagtttgccagtttcatctcttctcttcatgggcatgttgccaaacttcttcatcatactataggagctgcagtcgttgattatgcatttcagcggggaacacaacgtcagaaaagaacgttgttactggaactgtactccactgaacttcagctattccaggatctgactttgcaaagttcctgctgtttgatagatacaatttccaagcttgggttgcagatatcatctgtcctgcagtacatgactattgtgattcataaaatcttggagaaaggtactgttgagtattcaatagtgcacacggcaatattggagtactttacaattgcagataagacctcagccttggacgttatttctcaacttatcccccttcttactcaaggagcattaatcatagatggagatgaaccatcaaatgctccagagctaccaaagaaaacaaaagctaagaagaaaaggtcgaaagagccacttatcgttagaatcatgcagacaagggaaggattaaaactaggaattagttgccttaagcatggcagtgcaaaggaagaagatcattaaaagtttgaaggggcacattatgaagcttgctctaagtgattttggatgtcttttccttatctgcattatttccattgttgatgacacaaagcttgtttctaagattgtcattcaagagctggcaaaacatttaaagcaactcatttttgacaagaatgggagacgacctttgctgcaactacttcaccctctttgctcacgctatctttctccggatgatctggcttgtctgaactacaatgtgccttctcctagtccaacagagggtgacacatcagaaaatgaagtagatggtgggactgatgaaaatctaaaaggatgcaaattgtgtctgaaagcaagaaggatccattacaaaggcaacatgaactggtggtcaaaagtgaactggccgaggctctcatccaatcatgccttgaaaatgttggagaattacttcgaacaaattttggcaaagaaatgttatatgagatcgctgttggtggtaaagacaatgttttggagggcctcactgataggatccacatgttgcatgatgcaatagtgtctgatgcagcccaaccgaagactgaagatattgaacatgcattttgagaacttcttttccagccgtgtaattcagaagaatgataattgactgcccaaccgttgcagtcactcttttggagaaaagcttttggagggaagtgcaagatatgggcctgaaggacaccagttcgaaagtggttgcaaggtttcctggaatcgccaagttaaggaggt

SEQ ID NO: 2949 - DNA, 2272 bp, Zea mays
ctttcatcgtcctcctgcgtcgccagagcggagcaacgaggggcgcgcgcgatggcaggcggcggtctccagggagcgaagaagcgcaagcgcgagcacgcggaagggaaggcaaagcctcggaagcaagtcaagggaggcggggacggagcgaagcggaagagccactcggccgccggcggctacacggcccatggcggcgccggcgaagttgtggcgaggaagaagaccccggttacccccaaggagaagcgcctcgcggccaaggaaatgtcggaggccaggaagatgaagaggaggcagcattacagccttgagaaggaactaacgaaattgtgggaaaagatgagatgtcacgatgtgagcaaagaggagaggtccaaggcagtaagtcaggctatccataaaatggatgggaaatatttggacattgccacatcacatgttactgcacgtgttcttcaaacatgtgtaaagtggtgctcggagtcagagagggatgctatctttgatgttctacagccacatttgcttactctttcttgcaagaaatatgccgtttttcttgtaaagaagcttatagaactcgcctctaaaaaacagtttgccagtttcatatcttcccttcatggtcgtgttgccaaccttcttcatcatactattggagctgcagtcgttgattatgcatttcagcgaggaacacaacgtcagaaaaggcaattgttagttgaactgtactcccctgaacttcagctattcaaggatctgactgtgcaaagttcctcctgtttgatagatacaatttccaagcttgggttgcagatatcatctgtcctgcttcatatgactattgtgattgataaaatcttggagaaaggtactgttgagtacttaatagtgcacacggccatattggagtactttacaattgcagataagacctcagcctcggatgctatttgtcaacttatcccccttcttactcaaggggcattaatcatagatggagatgaacctacaaacgctccagaactaccaaagaaagcaaaagctaagaagaaaaggtcgaaagagccacttattgttcggatcatgcagacaagggaaggattaaaactaggaattagttgcgtcaagtatggcagtgcaaaggacaggaagaagattattaaaagtttgaagggccacattatgaagcttgctctaagtgattttggatgtctttttcttatctgcattatttctattgttgatgacacaaagcttgtttctaagattgtcattcaagagctggtaaaacatttaaagcagctcatttttgacaagaatgggagacggccattgctgcaactacttcaccctttttgctcacgctatctttctccgaatgatctagcttgtctgaactacaatgtgccttctcttagttcaacagaggttgagacatcagagagtgctataggagttataacagaaaataaattagatgatgtgattgctcaagatcccaatggcttagaaggcaagcaaattgtgtttgagagcaagaaggatccattacaaaggcgacatgaactgttgataaaaagtgagcttgccgaggctctcgttcagtcatgcattgaaaatgttggagaattacttcgaacaaattttggcaaagaagtattgtatgagatggctgttggtggtaaagacaacgttctggatggcctcaccgataggatccacatgttgcacgatgcaatagcgtctgatgcggcccaaccgaagactgaagatatggaacatgcatttgaaaacttcttttccagccgtgtaatcagaagaatggtaatcgattgcccagcgtttgcagtcactctctggagaaaggctcttcaggggaagtgcaagatatgggctgaaggacacagttcgaaggtggttgcgagtttcctggagtcgccaagtacggaggtcaaggatcttgcaaaacctgagttgcagccgctggttgatgctggcatccttaaagtgccagaccctaaggttgttcaaaaatgactcgtgcgcgggggcctttttgcgccagtaaatgactcgaggaccatcccttgtttaagggatacggataggttttttgaagctcgttctgccgataaaaattgttaagtcactcgttcgtgtgtacgccagtccgttgtacacataccctggatatatggtgaatcggatacgttattttgttttaaactcggaatgctcctttttatctataaatttttttagg

SEQ ID NO: 2950 - DNA, 2311 bp, Setaria italica
gtcctgcgtcgccaattagcaacgagcggcgcgcgcgatggccggcgccggcagcgatctccagagcccgaagaagcgcaagcgcgagcacgcggaggggaagatcaagccgcggccgcaggttaaggggggaggggacggagcgaagcggaagaagcacccgggcgccggcggttacgcggcccatggcggcgcaggcgaggctccggcgaagaagcggccggttacccccaaggagaagcgcctggctgcaaaggagatgtcggaggcgaggaagatgaagaggaagcggcattacagccttgagaaggaactagcgaaactatgggaaaagatgagatgccacgatgtgagcaaagaggagagatccaagctagtaagtcaggccatccggaaaatggatgggaaatacttggatattgctggatcccatgttactgcacgtgttctgcaaacatgtgtaaagtggtgctcacagtcagagagggatgctatttttgatgatctacagccacatttgctcactctttctcgcaagaaatatgctgttttccttgtaaagaagcttatagagcttgccactaaaaagcagtttgccagtttcatctcttctcttcatggccatgttgccaaacttcttcctcataccataggggctgcagtcgttgactatgcatttcagcgagcaacaccacctcagaaaagacagttgttattggaactgtactccactgaacttcagctattcaaggatctgactgtgcaaagttccttcagtttgttagagacaatttccaagcttggattgcagaaatcatctgtcctgcagtatatgactattgagattcagaaaatcttggagaaaggtactgttgagtattccatagtacacacggctatactggagtactttacaattgcagataagacctcagccatggacgtgattcatcaacttatcccccttctaactcaaggagcatcgatcatagatggagatgaaccatcaatcgctactgaactaccaaataaaacaaaagctaagaagaaaaggttgtcagagccgcttatcgttcggatcatgcagacaagggaaggattaaaactagcaatcagttgcctcaaacatggcagtgcaaaggacagaaagaagattattaaaagtttgaagggtcaaattatgaagcttgctctgaatgattttggatgccttttccttattagcattatttccattgttgacgacacaaagcttgtttctaagattgtgattcaagagctggcaaagcatttgaaagaactcatttttgacaagaatgggagacgaccgttgctgcagctacttcaccctctttgctcacgctatctgtctccagctgatctggcttgtctgagctataatgtgccttctcttagtgcaaaggagggtgaggcatcggagggtgctactgaagttatatcagaaaataaagtggatgctatgactgataaagagcccgatgatttggaaggcatgcagattgtgtctgagagcaagaaggatccatcacgaaggcggcatgaattgttgatcaaaagtgaccttgctgaggctcttgtccaatcttgcattgaaaatgttggagaattacttcgatcaaattttggcaaagaattattatatgaggttgctgttggtggaaaagacaatgttttggagggtgtcaccgataggatccacatgttgcatgatgcaattgcttcggatgcagcccagccaaagacggaagatattgaacatgcctttgagaacttcttttccagccgtgtaatcagaagaatgataatcgactgtccagcgtttgcagtcactctatggagaaaggctcttaaagggaagtgcaagatatgggctgaaggacacagttctaaggtggttgcagcgttcctggaatctccaagttctgaggtgaggaatcttgcaaaacctgagctgcaaccgctgattgatactggcattctgaaagtgccagatcataaaggagctgtggagaaatgacttcagcgcacggaactttttgcatcagaaatgactcacgggtcttcactcttgtgtaatcgataagttttggtcacctgaggaagttgtgccgataaattgttgtcattcgttagagtgtatgccagtattttgtatcctatttataggctagtaaatcagatccaatactttgctgtaaactcaaaccttctgtttatttgtatttttttcactcgacaggtagtatatgaatttattttttataagtaaggtatttggttttctgttaca

SEQ ID NO: 2951 - DNA, 2118 bp, Echinochloa colona
ggcggcggcagcgatctgaagaagcggaaacgggagcacgcagaggggaagggaaagccgcggccgcaagtcaaggggagtggggacggggagaagcggaagaagcactcggctgccggcggttacgcggcccatggcggcgccggcgaggctgcgccgaagaagaagctgccggttacccacaaggagaagcgcctggcggctaaggagatgtcagaggcgaggaagatgaagaggaagcggcattacagcctcgagaaggaactaacgaaactatgggaaaagatacgatgccacgatgtgagcaaagaggataggtccaagctagtaagtgaggctatccggaaaatggatgggaaatacttggatattgctggatcccatgttactgcacgtgttctgcaaacttgtgtaaagtggtgctcacagtcagagagggatgctatttttgatgagctacagccacatttgctcactctatctcgcaagaaatatgctgttttccttgtaaagaagcttatagaacttgccactaaaaaacagtttgccagtttcatctcttctcttcatggccatgttgccaaacttcttcctcatactataggagctgcagtcgttgactacgcatttcagcgggcaacaccacctcagaaaagacagttgttattggaactgtactccactgagcttcagctattcaaggatctaactgtgcaaagttccttcagtttgttagagacaatttccaagcttggattgcagaaatcatctgtcctacagtacatgactattgagattcaaaaaattttggagaaaggtactgttgagtattccatagtacacacggccatgttggagtactttacaattgcagataagacctcagcctcggatgtgattcgtcaacttatcccccttcttactcaaggagcatcaatcatagatggagatgaaccatcaatctctcctgaactcccaaagaaaacaaaagctaagaagaaaaggtcgaaagagccacttatcgctcggatcatgcagacaagggaaggattgaaactagcaattagttgcctcaagtatggcagtgcgaaggacaggaagaaaattattaaaagtttgaaggggcacattatgaagcttgctctgaatgattttggatgcctttttcttatctgcattatttccattgttgatgacacaaagcttgtttctaagattgtgattcaagagctggcaaagcatttgaaggaactcatctttgacaagaatgggagacgacctttgctgcaactacttcaccctctttgctcacgctatctgtccccaactgatctggcttgtctgagctacagcgtgccttctcttagttcaagggagggtgatgcagcagagagtgctactgaagctatatcagaaaataaagtggatgctgtgactgataaagagcccgatggttcggaaggcatgaagattgtgtctgagagcaagaaagatccatcacaaaggcgacatgaattgttgatcaaaagtgagcttgctgaggctcttgtccaatcttgcgttgaaaatgttggagaactacttcgaacaaattttggcaaagaattattatacgaggttgctgttggtggaaaagacaatgttttggagggtgtcactgataggatccacttgttgcataatgcaattgcttctgatgcagcagaaccaaaaatagaagatattgaacatgcctttgagaacttcttttccagccgtgtaatcagaagaatgataatcgattgtccagcattcgcagtcactctctggaagaaggctcttgaagggaagtgcaagatatgggctgaagggcacagttctaaggttgttgcagcgttcctggagtctccaagtgccaaagtgagggaccttgcaaaatctgagctgcaaccgctgattgattctggcattctgaaagtgccagaccataaagctgtggagaaatgacttgagcgcgcggacttttttgcatcagaaacgactcagggccatcattcttgtaatggatgagattttgccacctgtggacgttctgccgataaattgttgtcattcgttagagtgtatgccagtcttttg

SEQ ID NO: 2952 - DNA, 2636 bp, Panicum virgatum
ttccgccgcccccagccgatcccgcgcggagggccgggtgcgttggcgggcagaggcgcaggccccgcgctgtccgccgcgggaaaaccctcaatttccccgcccacgctgaattgacgcaaacgccctcgcgcgctttgactggtcagaccgcgccatctgggctcggcccgagcaaagcttctgaaatatcgtgagccggcctctctctgggttcgttgggacatatcatatgcgggcgggcactacgtgggcccaatagaagacgtgagcgaacaaccgaatgggcccaatactacagcccactaactgagcgcgtataaaccctaggcctatcgagtttggggaaaaaccttcctctcgccctccgtcaccaattcgcctcctcgtagcaacgagcggcgcgcgcgatggccgccggcggcagcgatctccagagcccgaagaagcgcaagcgggagcaggtggaggggaagaccaagccgcggccgcaagttaagggaggaggggacggagtgaagcggaagaagcactcgggtgctggtggctacgcggcccatggcggcggcgccggcgaggctgcggcgaagaagaagcggccagcgacccccaaggagaagcgcctggctgctaaggagatttcggaggcgaggaagatgaagaggaagcggcattacagccttgagaaggagctaacaaaactatgggaaaagatgagatgccacgatgtgagcaaagaggagaggtccaagctagtaagtgaggctatccgaaaaatggatgggaagtacttggatattgtcggatcccatgttactgcacgtgttctgcaaacatgtgtaaagtggtgctcacagtcagagagggatgctattttcgataatctacagccacatttgctcagtctctctcgcaagaaatatgctgttttccttgtcaagaagcttatagaactcgccactaaaaaacagtttgccagtttcatctcttctcttcatggccaggttgccaaacttcttcctcataccataggagctgcagtcgttgactatgcgtttcagcgggcaacacaacctcagaaaagacagttgttattggaactgtactccaccgagcttcagctattcaaggatctgactgtgcaaagttcgtgcagtttgttagagacaatctccaagcttggattgcagaaatcatctgtcctgcagtatatgactattgagattcagaaaatcttggagaagggtactgttgagtattccatagtacacacggcaatattggagtactttacaattgcagacaagacctcagctttggatgtgattcgccaacttatcccgcttcttactcaaggagcatcaatcatagatggagatgaaccatcacttgctactgaactaccaaagaaaacaaaagctaagatgaaaaggttgtcagagccacttatcgttcagatcatgcatacaaaggaaggattaaaactagctattagttgcctcaagtatggcagtgcaaaggacaggaagaagattattaaaagcttgaaggggcacattatgaagcttgctctaaatgattttggatgcctattccttatcagcattatttctattgttgatgacacaaagcttgtttctaagattgtgatccaagagctggcaaagaatttaaagcaactcatcttggacaaaaatgggagacgtccattactacaactacttcacccactttgctcacgctatctgtctccagctgatctggcttgtctgagctacaatgtgccttctcttagttcaagggagggtgaggcatcagacagtgctaccgaagttatatcagaaaataaagttgatgctgttactgataagattgtgtccgagagcaagaaggatccatcacaaaggcgacatgaattgttgatcaaaagtgagcttgctgaggctcttgtccaatcttgcattgaaaatgttggtgaattacttcgaacaaattttagcaaggaattattatatcaggttgctgttggtggaaaagacaatgttttggagggcgtaactgacatggtccacaagttgcatgatgcaatagcttctgatgcagcccaaccaaagacggaagatattgaacatgcctttgagaacttcttttccagccgtgtgatcagaagaatgataattgactgtccagcgtttgccgtcactctctggagtaaggctcttaaagggaaatgcaagacatgggctgaagggcacagttccaaggtggttgcagctttcctggaatctccaagttccgaggtgaaggatcttgcaaaagatgagctgcaatcactgattgatactggcattctgaaagtgcctgaccataaagctatggagaaatgacgggggcggaaaattttgcatcagaaatgactcgggggccatcattcttgtgtaccctataagttattgtgacccgaagacgtgcccataaactgttgtcattcgtcgagtgtatgccagtcttttgtaccctatataggcagtaaatcggatccagtactttgtgagcgcgaaaacagtccttgtatttgtattatttttcacttgacaggtaatatatgatttttatttcttaagtgcagtatttgt

SEQ ID NO: 2953 - DNA, 2734 bp, Setaria italica
gggagctcgcctgctagaccgacgtggtgagctgttcttccgcgctctctcccttctctctgcgtgtctgtgtgtctgtgcgcggggtatatgctggctggccagacgcggtggtgttcgccttccggctattaaggccgttcttgatgcgtaggtgagggaggaggagagctcggctcggctcgtcgctgcgctgcgtgccgggtgacggagagagagagagggtcgtggtggtgcttgtggctgtggctgtggccgtgtgccaatggcgccgtcgtggtgggggagggacgcgagggccaatggcggcggcggcggtggcgggacgcctgtggtggtgaagatggagaaccccaactggtccatctccgaggtctccgcgtcggaggtggcggcgccggactcgccggcgggcggcggcgggggcaaggccggccggggcaagaatgcgcgccagatcacatgggtgctgctcctcaaggcgcaccgcgccgcggggcggctcacgggagcggcctccgcggcgctcgccgtggcggcggccgcgcgacggagggtggcggcggggcggacggactcggacgtggcccccggggagaacacggcgctgcgcgcgcgcttctacggctgcatccgggtgttcctcgtgctctccctgctgctgctcgccgtcgaggtggcggcgtggctccagggctggcacctcgaggtggacgcggggctcctcgccgtcgacggcctcttcgccgccgcctacgcgggctggatgcgcgcccgcctcgactacctcgcgccgccgctgcagttcctcaccaacgcctgcgtcgtcctcttcatgatccagagcgtcgaccgccttgtactttgcctcggctgcttctggatcaggctcaagggcatcaagcccgtgccgctggccgccgacaaggaggacgtcgaggccggcgccgaggacttccccatggtgctcgtgcaaatgcccatgtgcaatgagagggaggtgtaccagcaatccattggtgcagtttgcagcctggactggccaaggtcaaacttcttggtccaggtgctggatgattctgatgatgctaccacttcagcacttatcaaggaggaagtggagaaatggcagcgggagggtgtgcgcataatataccggcaccgagtgatcagggatggctacaaggctggaaacctgaaatcagccatgaactgcagttatgtgaaagattatgagtttgttgtcatctttgatgccgatttccaaccacagccagatttcctgaagcgcactgtgccccatttcaagggaaaggacgatgtcgggttggttcaggcaagatggtcttttgtaaacaaggatgagaacttgctgaccagacttcagaacataaacctttgcttccactttgaggtggagcagcaggtgaatggggcatttctcaacttctttgggttcaatggcactgcgggagtatggagaattaaggcactcgaggattctggaggatggatggaaaggacaacagtggaggatatggacatagctgtccgagcacatctcaagggatggaagtttgtcttcctaaatgatgttgagtgtcaatgcgagttgccagaatcctatgaagcttacagaaagcagcaacaccggtggcactcaggtcccatgcaattgtttaggctttgctttgtggacataatcaaatccaagattggattctggaagaagttcaatctcatattccttttcttcctcctccggaagctcatcctacccttctattcgttcacccttttctgtgtcatccttcccatgacaatgtttgttcctgaagctgaactccccgcatgggtagtatgctacattccagcaacaatgtccatcctcaacatcctcccagccccaaaatccttccctttcattgttccataccttctgtttgagaacaccatgtcagtaaccaagttcaatgccatgatttctggcctgttccagcttgggagtgcctatgagtgggttgtcaccaagaaatcaggtcgttcttctgagggcgatcttgttgccctcgttgaaaaacactctaagcaacaaagagtgggttctgcgcccaatcttgacgcgctaacaaaggaggagtcaaatcctaaaaaggacttgaagaagaagaagcacaataggatctacaggaaggaacttgcactgtccttccttctgctaacagcagccgcccgcagcttgctgtctgcccagggcatccatttctacttcctcctgttccaaggggtctcattcttggtcgtcggtctcgacctaatcggcgagcaagtggagtgacagaaaataaagagtacaatgggttctttttttgtctgaagaaatctttcaagcatcgaagcggctctttgtaaagggaagagcgtcgcactcattgatgcttacacgaggaagctttggtccctgttccagggggtcgagattcaccagagatactgaaatgtggagctgtagatagttatagcttggatttagcctgtgagatgcttttattctttcaggtctcgattcttttgtaagaatattcctgtgcctagatgggttctttctttctttctttcttgacagactttaccttcaaatgaagataatacttgtggttaccatgtatttgatcaatcaatcaattaccatgattattgggatacatgtcctatacatagtcccatccttttt

SEQ ID NO: 2954 - DNA, 2685 bp, Panicum virgatum
cgcgacatatgttggctggccggccgcggtggtggtcgtcttccggctattaaggccgttcttgatgagttggtgagggaggaggaggaggagagctcgggtcgtcgctgcgtgcaggggttgtgtgaaggagagccggagagggggggggcgtggtggtgcttggccgggccaatggcgccgtcgtggtgggggaaggacgcgagggccaatggcggcggcggcgggacgccggtggtggtgaagatggagaaccccaactggtccatctccgaggtctccgcgtcggaggtggcgccgggctcgccggcgggcggcggcgggggcaaggccgggcggggcaagaacgcgcgccagatcacgtgggtgctgctcctcaaggcgcaccgcgccgcgggccgcctcacggggcggcctccgccgcgctcgccgtcgcggccgccgcgcgccggagggtggcggcggggcggaccgactccgacgccgcgccgggggagaacacggcgctgcgcacgcgcttctacggctgcatccgggtgttcctcgtgctgtccctgctgctgctcgccgtcgaggtggcggcgtacctccaggggtggcatctcgacgtggaagaggggctcctcgccgtcgacgggctcttcgccgccgcctacgcgggctggatgcgcacccgccttgactacctcgcgccgcccctgcagttcctcaccaacgcctgcgtcgtcctcttcttgatccagagcgtcgaccgccttgtcctttgcctaggctgcttctggatcaggctcaaggggatcaagcccgtgccgctggcggccggcaaggaggacgtcgaggccggcgccgaggacttccccatggtgctcgtgcagatgcccatgtgcaatgagagggaggtgtaccagcagtccatcggtgcagtttgcagcctggactggccaaggtcaaacttccttatccaagtgctagatgattccgatgatgctaccacttcagcccttatcaaggaggaagtggagaaatggcagcgggagggtgtgcgcataatataccggcaccgggtaatccgagatggctataaggctggaaacctgaaatcagccatgaactgcagttatgtgaaagattatgagtttgttgtcatctttgatgctgattttcaaccgcaagcggatttcctgaagcgcaccgttccccatttcaagggaaaggacgatgtcgggttggttcaggcaagatggtcttttgtaaacaaggatgagaacttgctgaccagacttcagaacataaatctttgcttccattttgaggtggagcagcaggtgaatggggcgtttctcaacttcttcgggtttaacggcactgcgggagtgtggagaattaaggcacttgaggactctggaggatggatggagaggacaacagtggaggatatggacatagctgtccgagcacatcttaagggatggaagtttgtctacctaaatgatgttgagtgtcaatgcgagttgccagaatcctatgaagcttacagaaagcagcaacaccggtggcactcaggtcccatgcaattgtttaggctgtgctttgtggacataatcaaatctaagattggattctggaagaagttcaatctcatattccttttcttcctcctccggaagctcatcctaccattctattccttcactcttttctgtgtcatccttcccatgacaatgtttgttcctgaagctgaactccccacatgggtagtatgctacattccagctacaatgtccatcctcaacatccttccagcccccaaatccttcccgttcattgttccgtaccttctgtttgagaacaccatgtcagtaaccaagttcagtgccatgatttctggcctgttccagctcgggagtgcctacgagtgggtcgtcaccaagaaatcaggccgttcttctgagggtgatcttgtttccctcgttgaaaagcactctaagcaacaaagagtaggttctgcgcccaatcttgacgcgctaacaaaggagtcaaatcctaaaaaggactcgaagaagaagaagcacaataggatctacaggaaggaactcgcactgtccttccttctgctaacagcagccgcccgcagcttgctgtctgcccagggaatccatttctacttcctcctgttccaaggggtctcattcttggtcgtcggcctcgacctgatcggcgagcaagtggagtgacagaaataaggagtataatgggttctttcctctctttttttgtctgaagaaatctttgcaagcatctaagcggctctttgtaaagggaagggcgtcgcactctctgatgcttacacgaggaagctctggtccctattccaggggtcaagattcaccagagatttacttgaaaaaaagattcgccagagatactgaaatgtggagctgtagataggtatagtttggatttagcctgtgagatgcttttattctttcaggtctcgattcttttgtaagaatatttctgtgcctagatgggttctttctttctttctttctttctttctttctttctttctttctttcttgacagactttaccttcaaatgaagataatacttgtggttaccacgtatttgatcaatcaattatcgtgattgttgatatacataatctgcatatatagttcagt

SEQ ID NO: 2955 - DNA, 2591 bp, Oryza sativa
gacgtggtgagctgttcttgtgcgctctgctgctgccgcgggtggccggctggcttattaaggttgaggagttcttgatgagtaggtgaggccggaggaggaggagcgattggttggttggttggttgattggagttgtgagaggttgtgttggcaatggcgccgtcgtggtgggggaggagtggaggaggaggagtcggcaatgggggtggcacgccggtggtggtgaagatggagaatccgaactggtcaatctcggaggtggaggcggcggaggtggcgccgggttcgccggcgggggcgggcaaggccgggcgcggcaagaacgcgcgccagatcacgtgggtgctgctgctcaaggcgcaccgcgccgcggggcggctcacgggcgccgcgtccgccgcgctcgccgtcgcgtccgcggcgaggcgcagggtggcgtccgggcggaccgacgccgacgccgcgccgggggagagcacggcgctgcgggcgcgctcctacggctgcatccgggtgtccctcgtcctgtctctgctgctgctcgccgtcgaggtcgccgcctacctccaggggtggcacctcgaggaggtggcgtcgctcctcgccgtcgacggcctcttcgccgcctcctacgccgggtggatgcgcctccgcctcgactacctcgcgccgccgctccagttcctcaccaacgcctgcgtcgccctcttcatggtccagagcatcgaccgcctcgtcctctgcctcggctgcttctggatcaggttcaagggcatcaagcccgtgccgcaggccgccgccgccggcaagccggacgtcgaggctggcgccggcgactaccccatggtgctcgtccagatgcccatgtgcaacgagagagaggtgtaccagcaatccattggggcagtttgcaacctggactggccaaagtcaaacttcttggtgcaggtgttggacgattctgatgatgctaccacttctgcgctgatcaaggaggaggtggagaaatggcagcgggagggcgtgcgcatcatataccggcaccgggtgatccgggatggctacaaggctggaaaccttaaatcagccatgaattgcagttatgtgaaggattatgagtttgttgtcatatttgatgccgatttccaaccacaagccgatttcctgaagcgaaccgtgccacatttcaaggggaaggatgacgttgggttggttcaggcaagatggtctttcgtaaacaaggatgagaacctgctgactagactacagaacgtaaatttgtgcttccactttgaggtggagcagcaggtgaatggtgcattcctcaacttctttggattcaatggaactgccggagtttggagaattaaggcgcttgaggattcggggggctggatggagagaacaacagtggaggacatggatattgctgtccgagcacatcttaagggatggaagtttgtcttcctgaatgatgttgagtgtcaatgtgagttgccagaatcatatgaagcgtacagaaagcagcaacacaggtggcactcaggtcccatgcaattgttcagactctgctttgtggacattataaaatctaagattgggttctggaagaagttcaacctcatattccttttcttcctcctccgcaagctcatcctacccttctattcattcacacttttctgtgtcatccttcccatgacaatgtttgttcctgaagctgagctccctgcctgggttgtatgctacattccagctacaatgtccatcctgaacatcctcccagccccaaaatctttcccattcattgtcccataccttcttttcgagaacactatgtccgtaaccaagttcaatgccatgatttctggattgttccagctcgggagtgcctatgagtgggttgtcaccaagaaatcaggtcgttcttcggagggcgatcttgttgggctagttgagaaacactccaagcagcaaagagtaggatctgctcccaatcttgacgcgctaacaaaggaggagtcgaatcctaaaaaggactccaagaagaagaagcacaataggatctacaggaaggaactggcactttccttcctcttgttaacggcagcagctcgcagtttgctatctgctcagggaatccatttctactttcttctgttccaaggggtctcattcttggttgttggtctcgacctaattggtgagcaagtggagtgatagaagatgaagagtttaatggggttcttttttgtttgaaagaaaacactttgcaagcatcaaagggctctttgtaaagggaagagtgatgcaaatgttcgatgcttacacatggaagctttgatccctattctaggggtcaagattcatcacatatactgaactgtggagatgtagatagatatagtttggattaagcctgtgggatgcttttattccttcaggcaattcttttgtaagaatcttttgtgcctagatgggttcttcttctctcttaacaaactttaccttcaaatgaagataatacatgtttctaccatgtactttgatcgattaccttgggtatccatatacatgtcagattgtcc

SEQ ID NO: 2956 - DNA, 2664 bp, Oryza sativa
ggaagctgagctctcccgtactactaagaccgacgtggtgagctgttcttgtgcgctctgctgctgccgcgggtggccggctggcttattaaggttgaggagttcttgatgagtaggtgaggccggaggaggaggagcgattggttggttggttggttgattggagttgtgagaggttgtgttggcaatggcgccgtcgtggtgggggaggagtggaggaggaggagtcggcaatgggggtggcacgccggtggtggtgaagatggagaatccgaactggtcaatctcggaggtggaggcggcggaggtggcgccgggttcgccggcgggggcgggcaaggccgggcgcggcaagaacgcgcgccagatcacgtgggtgctgctgctcaaggcgcaccgcgccgcggggcggctcacgggcgccgcgtccgccgcgctcgccgtcgcgtccgcggcgaggcgcagggtggcgtccgggcggaccgacgccgacgccgcgccgggggagagcacggcgctgcgggcgcgctcctacggctgcatccgggtgtccctcgtcctgtctctgctgctgctcgccgtcgaggtcgccgcctacctccaggggtggcacctcgaggaggtggcgtcgctcctcgccgtcgacggcctcttcgccgcctcctacgccgggtggatgcgcctccgcctcgactacctcgcgccgccgctccagttcctcaccaacgcctgcgtcgccctcttcatggtccagagcatcgaccgcctcgtcctctgcctcggctgcttctggatcaggttcaagggcatcaagcccgtgccgcaggccgccgccgccggcaagccggacgtcgaggctggcgccggcgactaccccatggtgctcgtccagatgcccatgtgcaacgagagagaggtgtaccagcaatccattggggcagtttgcaacctggactggccaaagtcaaacttcttggtgcaggtgttggacgattctgatgatgctaccacttctgcgctgatcaaggaggaggtggagaaatggcagcgggagggcgtgcgcatcatataccggcaccgggtgatccgggatggctacaaggctggaaaccttaaatcagccatgaattgcagttatgtgaaggattatgagtttgttgtcatatttgatgccgatttccaaccacaagccgatttcctgaagcgaaccgtgccacatttcaaggggaaggatgacgttgggttggttcaggcaagatggtctttcgtaaacaaggatgagaacctgctgactagactacagaacgtaaatttgtgcttccactttgaggtggagcagcaggtgaatggtgcattcctcaacttctttggattcaatggaactgccggagtttggagaattaaggcgcttgaggattcggggggctggatggagagaacaacagtggaggacatggatattgctgtccgagcacatcttaagggatggaagtttgtcttcctgaatgatgttgagtgtcaatgtgagttgccagaatcatatgaagcgtacagaaagcagcaacacaggtggcactcaggtcccatgcaattgttcagactctgctttgtggacattataaaatctaagattgggttctggaagaagttcaacctcatattccttttcttcctcctccgcaagctcatcctacccttctattcattcacacttttctgtgtcatccttcccatgacaatgtttgttcctgaagctgagctccctgcctgggttgtatgctacattccagctacaatgtccatcctgaacatcctcccagccccaaaatctttcccattcattgtcccataccttcttttcgagaacactatgtccgtaaccaagttcaatgccatgatttctggattgttccagctcgggagtgcctatgagtgggttgtcaccaagaaatcaggtcgttcttcggagggcgatcttgttgggctagttgagaaacactccaagcagcaaagagtaggatctgctcccaatcttgacgcgctaacaaaggaggagtcgaatcctaaaaaggactccaagaagaagaagcacaataggatctacaggaaggaactggcactttccttcctcttgttaacggcagcagctcgcagtttgctatctgctcagggaatccatttctactttcttctgttccaaggggtctcattcttggttgttggtctcgacctaattggtgagcaagtggagtgatagaagatgaagagtttaatggggttcttttttgtttgaaagaaaacactttgcaagcatcaaagggctctttgtaaagggaagagtgatgcaaatgttcgatgcttacacatggaagctttgatccctattctaggggtcaagattcatcacatatactgaactgtggagatgtagatagatatagtttggattaagcctgtgggatgcttttattccttcaggcaattcttttgtaagaatcttttgtgcctagatgggttcttcttctctcttaacaaactttaccttcaaatgaagataatacatgtttctaccatgtactttgatcgattaccttgggtatccatatacatgtcagattgtccttttttttcatccagtatatagaattaatcacttgttcagaa

SEQ ID NO: 2957 - DNA, 2748 bp, Zea mays
cgggacgggaggcacagccgcggataaataaagcgggggaggcgagctcccctgctagaccgacgacgtggtgagctgttcttccttccttccgcgcgcgcgcacaccctctctctctctctctctctctgctgtgcccgcggctattaagcccgttctggatgagtcggtgagggaggacgacgaggagagccggggtcatcggatcgctgccgagggttctccgtttgtgcgacagagaggtggtggtggtgacggtgtcagtgcgtgcgtgcgtgcgtgccaatggcgccgtcgtggtgggggcgggacgcgagggccaacggcgtcgttggcggcggcacgcccgtggtggtcaggatggagaaccccaactggtgcatctccgaggtcgccgccgcggcgtcggaggtggacgcgccgccgccggcggcggccgggggcggcaaggccgggcggcggggcaagaacgcgcgccagatcacgtgggtgctgctcctcagggcgcaccgcgccgcgggccgcctcacgggggcggcctccgccgcgctctccgtggccgccgccgcgcgccgcagggtggcggcgggccggaccgactccgacgccgacgccgacgccgccccgggcgagagcgcggcgctccgggcgcgctcctacggctgcatccgcctcttcctcgccctctcgctgctgctgctcgccgtcgaggtcgcggcctacctccggggctggcacctcgaggtggacgtgggcgccgggatcctcgccgtcgacggcctcttcgccgccgcctacgcggcctggatgcgcgcccgcctcgactacctcgcgccgccgctgcagttcctaaccaacgcctgcgtcctcctcttcctggtccagagcgtcgaccgcctcgtgctctgcctcggctgcttctggatcaagctcaagggcgtcaggcccgtgccgccgctgcccgccgacaaggaggacgtcgaggccggtcccgacggcgtccccatggtgctcgtgcagatgcccatgtgcaatgagagagaggtgtaccagcaatccatcggtgcggtttgcagcctggactggccaaggtcaaatttcctggtccaggtgttggatgactctgatgatgctaccacttcggcacttatcaaggaggaggtggagaaatggcagcgagagggtgtgcgcatagtataccggcaccgggtgatccgggatggctacaaggctggaaacctgaaatcagccatgaactgcagttacgtgaaagactatgagttcgttgtcatcttcgatgctgatttccaaccacaggcggacttcctgaagcgcaccgtgccccatttcaagggaaaggatgacgtcgggttggttcaggcgagatggtcgttcgtaaacaaggatgagaacttgctgaccaggcttcagaacataaatctttgcttccacttcgaggtggagcagcaggtgaacggggcgtttctcaacttcttcgggttcaatggcaccgcgggagtctggagaatcaaggcgcttgaggagtctggaggatggatggagaggacgacggtggaggacatggacatagctgttcgagcgcacctcaaagggtggaagtttctctttctaaacgatgtcgagtgtcagtgtgaattgccagaatcgtatgaagcgtacagaaagcagcagcaccggtggcactcaggtcccatgcaattgtttaggctctgctttgtggacataatcaaatctaagatcggtttctggaagaagttcaacctcatattcctcttcttcctgctccggaagctgatactacccttctactccttcaccctcttctgcgtgatcctccccatgacgatgttcgtccccgaagccgagctccccgcgtgggtggtgtgctacatcccggcgacgatgtccatcctcaacatcctcccgtccccgaaatcgttcccgttcatcgtcccgtacctgctgttcgagaacaccatgtcggtgaccaagttcaacgccatggtctccggcctgttccagctggggagcgcctacgagtgggtcgtcaccaagaagtcggggcgctcctccgagggcgacctcgtggccctcgtggagaagcactccaagcagcagagggtaggctcggcgcccaacctcgacgcgctgaccaaggagtcgaagggcaccgaggaggagaagaataagaagaagaggaagaagaagcacaacaggatctacaggaaggagctcgcgctgtccttcctcctgctgaccgcggccgcccgcagcttgctgtccgcccagggcgtccacttctacttcctcctgttccagggggtttcgttcttggtcgtcgggctcgacctgatcggcgagcaggtggattgatagcagttgaataatgggttatatatatatatatatatattttcgcttgaagaaatcctcgcaggcatcatcaaattcaaagggctctttgtgaagggaagagcgtcgccttcttggatgcgtaaaccttgggtccctgttcctgttccaggaggggtcggaatcggaagatactgaaacgtggagctgtgtagataggtatagcttggggtttagcctgcgagatgcttttgttcttccaggtttcgattcttttgtaagaatatttgtgcccctacatgcaagggctcttttgtttttttctttttttgacagactttaccttcaaatgaagataatacttgtgttccattc

SEQ ID NO: 2958 - DNA, 3138 bp, Panicum virgatum
ggtggtgaagatggacaacccccaactggtccatctccgaggtctccgcgtcggaggtggcgccgggctcgccggcgggcggcggcgggggcaaggccgggcggggcaagaacgcgcgccagatcacgtgggtgctgctcctcaaggcgcaccgcgccgcgggccggctcacgggggcggcctccgccgcgctcgccgtcgcggtcgccgcgcgccggagggtggcggcggggcggacggactccgacgccgcgcccggggagaacaccgcgctgcgcacgggcttctacggctgcatccgggtgttcctcgtgctgtccctgctgctgctcgccgtcgaggtggcggcgtacctccaggggtggcacctcgacgtgggcgaggggctcctcgccgtcgacgggctcttcgccgctgcctacgcgggctggatgcgcacccgcctcgactacctcgcgccgccgctgcagttcctcaccagcgcctgcgtcgtcctcttcttgatccagagcgtcgaccgccttgtcctttgcctgggctgcttctggatcaagctcaagggaatcaagcccgtgccgctggcggccggcaaggaggacttcgaagccggcgtcgaggacttccccatggtgctcgtgcagatgcccatgtgcaatgagagggaggtgtaccagcagtccatcggtgcagtttgcagcctggactggccaaggtcaaacttccttgtccaagtgctcgatgattctgatgatgctaccacttcagcacttatcaaggaggaagtggagaaatggcagcgggagggtgtgcgcataatataccggcaccgggtaatccgggatggctataaggctggaaacctaaaatcagccatgaactgcagttatgtgaaagattatgagtttgttgtcatctttgatgctgatttccaaccacaagcggacttcctgaagcacaccgtgccccatttcaagggaaaggatgatgtggggttggttcaggcaagatggtcttttgtaaacaaggatgagaacttgctgaccagacttcagagcataaatctttgcttccactttgaggtggagcagcaggtgaatggtgcgtttctcaactttttcgggtttaacggcactgcgggagtgtggagaattaaggcacttgaggattctggaggatggatggagaggacaacagtggaggatatggacatagctgtccgagcacatcttaagggatggaagtttgtctacctaaatgatgttgagtgtcaatgcgagttgccagaatcctatgaagcttacagaaagcagcaacaccggtggcactcaggtcccatgcaattgtttaggctgtgctttgtggacataatcaaatctaagattggattctggaagaagttcaatctcattttccttttcttcctcctccggaagctcatcctaccattctattcgttcactcttttctgtgtcatccttcccatgacaatgtttgttcctgaagctgaactccccgcatgggtagtatgctacattccagctacaatgtccatcctaaacatcctcccagcccccaaatccttcccgttcattgttccgtaccttctgtttgagaacaccatgtcagtaaccaagttcggtgccatgatttctggcctgttccagctcgggagtgcctacgagtgggttgtcaccaagaaatcaggtcgttcttctgagggtgacctcgttgccctcgttgagaagcactctaagcaacaaagagtaggttctgcacccaatcttgatgcgctaacaaaggaggagtcaaatcccaaaaaggacgcaaagaagaagcacaataggatctacaggaaggaactcgcactgtccttccttctgctaacagcagccgcccgcagcttgctgtccgcccagggcatccatttctacttcctcctgttccaaggggtctcattcttggtcgtcggtctcgacctgatcggcgagcaagtggagtgacagaaataaggagtataatgggttctttctctcttttttttttgtctgaagaaatctttgcaagcacctaagcggctctgtgtaaagggaagggcgtcgcactctctgatgcttacacgaggaagctctggtcccctattccaggggtcgagattcaccagagatttacttgagattcaccagagatttacttgaaaaaaagattcaccagagatttacttgaaaaaaagattcaccagagatactgaaatgtggagctgtagataggtatagtttggattagcctgtgagatgcttttattctttcaggtctcgattcttttgtaagaatatttctgtgcctagatgggttctttctttctttctttctttcttgacagactttaccttcaaatgaagataatacttgtggttaccatgtatttgatcaatcaatcaattaccatgattgttgagacacatgacctgcatatagttcagtcgtttttctaggaaatgtgatatagatagaattactcacccgttacatcaccatcatgtatcatgcttgcaagctgagaaggggtactggtatgggtcacaattggagcccgggggccgtgttccatctttgctacaagccgtccttgtcctcatcatgtgcatttggcagggatatgcttgtttgtgtgattcgtgtcccaatccctgaaaaggacagcgatccatgagtgtgtccctcctgcttgcagcaatccatgtggaagcaaagcaaattgggaaatgctagccactaggagtctaggagtaagctcgtttggcctgccgcctgatggcgcttgctctcctaaccttccaattggcggtctggcatccagaagtagaagtagttgctgtcaagtgaggaatgcacaccgatggattttgtgagtggtttctgaggaccagcagctctgttggtttttccttcggccttttcacaaggcctggccgtcgggttctggacatgtgactgggaggtcccgtctgttggaggaaaaacctcagctccgagttcggaccaactgaaagttcggccgcacttcctgacgagaattcagtttctaccagatctgatcacgggccacccgacccaacccgttcgaaaaaatctgacccg

SEQ ID NO: 2959 - DNA, 3215 bp, Brachypodium distachyon
acaaataaagaaagctggagctctccctcccatcctagagcgacgacgtggtgagctgctcttcttcttcccccacccccccttcttcgtggcctgcggcgggtgtggtgtttggtcaggactcgggaggtttattaagggcggtgccccgttcttgatgagtctctgaggaaggaagtttggccacgaagaggaggaggaggaggagtgatttgttgcctcgtttggtcgtatatctgtgggattccgtggtttgtttgtcagtccgaggcggcggcaaacaaaggggtgtcaatggcgccgtcgtggtgggggagggagcagcagccggcgagggccaatggcggcgggactcccgtggtggtgaagatggagaaccccaactggtcgatctcggaggtggagccggagcttgggcccgggtcccccgcggggctggccggcggcaaggccgggcgggggaagaacgcgcgccagatcacctgggtgctgctcctcaaggcgcaccgcgcggcggggcggctcacgggggccgccacggcggcgctggcggtggccgccgccgcgcgccggcgggtggcggcgggccggacggactccgacgcggcccccggggagaacacggccctcagggcccgcttctacggctgcatccgcgtcttcctcgcgctctccctgctgctgctggccgtcgaggtcgccgcctacctccagggctggcacctcgagatgcccgggctcgacgccatggacgggctcttcgccgccgcctacgccggctggatgcgcgttcgcctccggtacctcgcgccgccgctgcagttcctcaccaactcctgcgtcgtccttttcctcatccagagcgtcgaccgcctcgtcctctgcctcggctgcttctggatcaagctcaagggcatcaggcccgtgccccaggccagcgacaaggaggatgtcgaggccggcgccgaggacttccccatggttctagtccagatgcccatgtgcaacgagcgggaggtttaccagcaatccataggtgcaatttgcaacctggagtggccaaggtcaaacttcttggtgcaggtattggatgattctgatgatcctaccacttcggcgcttatcaaggaggaggtagagaaatggcagcgagagggcgtgcacattgtataccggcaccgggtgatccgggatggctacaaggctggaaacctcaaatcagcaatgaactgcagttatgtgaaagactacgaatatgttgtcatctttgatgctgatttccaaccacaagcggatttcctgaagcgagccatgccccatttcaagggaaaggatgatgttgggttggttcaggcaagatggtcttttgtaaacaacgatgagaacttgttgactagattacaaaacataaatctgtgcttccactttgaggtggagcagcaagtgaatggcgcattcctcaacttctttgggttcaatggaactgcgggagtgtggagaatcaaggcgcttgaggattccggtgggtggatggagaggacaacagtggaggacatggacattgctgtccgagcacatctcaagggatggaagtttctctacctgaatgacgttgagtgtcaatgtgagttgccagaatcatatgaagcatacagaaagcagcagcaccggtggcactcaggtcccatgcaactgtttagactctgcttcgtggacattataaaatctgagattggattctggaagaagtgcaacctcatatttctattcttcctcctccgcaagctcatcttacccttctattctttcacccttttctgtgtcatccttcccatgacaatgtttgttcctgaagctgaacttcctgcatgggttgtgtgctacattccagtaacaatgtccatccttagcgtcctcccatccccaaaatccttcccattcattgttccataccttctcttcgagaacacgatgtcagtaaccaagttcaatgccatgatttctggcttgttccagctcgggagtgcctatgagtgggtcgtcaccaagaaatcaggtcgttcttccgagggcgatcttgtcgccctcgtcgagaaacactccatgcagcagcaaagagtagggtccgcgcccaaccttgacgcgctagcaaaggaggaatcacttcccaaaaaggattccaagaagaagaagcacaataggatctacaggaaggaactggcactgtcattcctcctgttaacagcagcggctcgcagcgtgctgtctgcccagggcatccatttctacttcctcctgttccaaggggtctcattcttggtagtcggcctcgacctaatcggtgagcaagtggagtgatagcaaatgaagaagagtataactgggttcccttttttcattgaagatactttgcaagcatcaaatggccctttgtaaaaggagaagagcgcggcattgttttgatgcttacatgagcaacttctgatccctaccccaaggggcagagattattcacgagatacaactgaagtgtggatgatgtagatagatatagcttttggatcgaaaaaacctgtgagatgcttttattctttcaggtcactcaaattctttttgtaagaaaaatctttggcgcctagatgggggtccttcttccttcttgacagactttaccttcaaatgaagataatactgcttgttttcaccgtgtattatcacgataattaattatcgagatacctgttcaatggttcacccctgttgttttctttccctcttcgtatgaggagccttgtaatttctgaatgctgcagctaggaagagaaacttccattgctagcttcacaaatggagcctctgcctgttgaacttgaagggaccatccaatgcccaatcctgtgtttggctctgccatgtgccttgggcaatttggcagggccaggttgttcgtttccttgatccgtgtccctatcgccgaaaaggacgtctacccccaagtttgctccttccgttggagcattccatgtggaggcaaatagcagaaacccacagtacgggtcactagcaagcaaaaaagcttccttggcctgtgctgcatcttccttccaattggcgatctggcatcatcacaaactaaacccacctgtactcctcaagtaacaacaaaaataaacacctgccgaattggcccccttctctccagcttcttccggtgc

SEQ ID NO: 2960 - DNA, 2218 bp, Zea mays
gttcttccttccttccgcgcgcgcgcacaccctctctctctctctctctctctctctctctctctctgctgtgcccgcggctattaagcccgttctggatgagtcggtgagggaggacgacgaggagagccggggtcatcggatcgctgccgagggttctccgtttgtgcgacagagaggtggtggtggtgacggtgtcagtgcgtgcgtgcgtgcgtgccaatggcgccgtcgtggtgggggcgggacgcgagggccaacggcgtcgttggcggcggcacgcccgtggtggtcaggatggagaaccccaactggtgcatctccgaggtcgccgccgcggcgtcggaggtggacgcgccgccgccggcggcggccgggggcggcaaggccgggcggcggggcaagaacgcgcgccagatcacgtgggtgctgctcctcagggcgcaccgcgccgcgggccgcctcacggggggcggcctccgccgcgctctccgtggccgccgccgcgcgccgcagggtggcggcgggccggaccgactccgacgccgacgccgacgccgccccgggcgagagcgcggcgctccgggcgcgctcctacggctgcatccgcctcttcctcgccctctcgctgctgctgctcgccgtcgaggtcgcggcctacctccggggctggcacctcgaggtggacgtgggcgccgggatcctcgccgtcgacggcctcttcgccgccgcctacgcggcctggatgcgcgcccgcctcgactacctcgcgccgccgctgcagttcctaaccaacgcctgcgtcctcctcttcctggtccagagcgtcgaccgcctcgtgctctgcctcggctgcttctggatcaagctcaagggcgtcaggcccgtgccgccgctgcccgccgacaaggaggacgtcgaggccggtcccgacggcgtccccatggtgctcgtgcagatgcccatgtgcaatgagagagaggtgtaccagcaatccatcggtgcggtttgcagcctggactggccaaggtcaaatttcctggtccaggtgttggatgactctgatgatgctaccacttcggcacttatcaaggaggaggtggagaaatggcagcgagagggtgtgcgcatagtataccggcaccgggtgatccgggatggctacaaggctggaaacctgaaatcagccatgaactgcagttacgtgaaagactatgagttcgttgtcatcttcgatgctgatttccaaccacaggcggacttcctgaagcgcaccgtgccccatttcaagggaaaggatgacgtcgggttggttcaggcgagatggtcgttcgtaaacaaggatgagaacttgctgaccaggcttcagaacataaatctttgcttccacttcgaggtggagcagcaggtgaacggggcgtttctcaacttcttcgggttcaatggcaccgcgggagtctggagaatcaaggcgcttgaggagtctggaggatggatggagaggacgacggtggaggacatggacatagctgttcgagcgcacctcaaagggtggaagtttctctttctaaacgatgtcgagtgtcagtgtgaattgccagaatcgtatgaagcgtacagaaagcagcagcaccggtggcactcaggtcccatgcaattgtttaggctctgctttgtggatataatcaaatctaagatcggtttctggaagaagttcaacctcatattcctcttcttcctgctccggaagctgatactacccttctactccttcaccctcttctgcgtgatcctccccatgacgatgttcgtccccgaagccgagctccccgcgtgggtggtgtgctacatcccggcgacgatgtccatcctcaacatcctcccgtccccgaaatcgttcccgttcatcgtcccgtacctgctgttcgagaacaccatgtcggtgaccaagttcaacgccatggtctccggcctgttccagctggggagcgcctacgagtgggtcgtcaccaagaagtcggggcgctcctccgagggcgacctcgtggccctcgtggagaagcactccaagcagcagagggtaggctcggcgcccaacctcgacgcgctgaccaaggagtcgaagggcaccgaggaggagaagaataagaagaagaggaagaagaagcacaacaggatctacaggaaggagctcgcgctgtccttcctcctgctgacc

SEQ ID NO: 2961 - DNA, 3171 bp, Brachypodium distachyon
agccgagagagcccaagaagcgggagggagcaccgagctgccatttgccgatccccaaacacgcacgcctttaatcaattctgcttactactaaaacccgcgccggggaactcctccgtcctggccctcgaggaaaggaaggacggactacttgctctacagctggaagcagaagccaaagggaaacgagacgaggggaaggtggtggtggcgccgcggtggtaatcataggggtcgtgtataaaggctcggcttgtcccgagctcagggggagttggatcccctccgcggcgccgtggtgagctgttttctctgcgtgggatcctgctgccttcgtcctctttccacccctgccatttccacctattcggacctctgtcgtctttggcgtgtccacctctagctctagcatcatctaggtgctgtgtttgatgaggaggtgagcctaccaacaggcggcattttgtgtctgggcgggtgtggcaatggcgccgtggtgggggcaggaggcgcggggagggggcggcgggggaacgcctgtggtggtgaagatggagagcccggactggtccatctccgaggtggcggcgcctgggtcgcccgcggcgggggccaaggccggccgcggcaagaacgcgcgccagatcacgtgggtgatgctgctcaaggcgcaccgcgccgcggggaagctcacgggcgcggcctccgccgcgctctccgtggcggccgccgcgcggaggcgggtggcggccgggcggaccgactccgacgcggccacgacggcgggggagagccccgtgctgcgcaccaggttctacgcctgcctccgcgccttcctcctcttctccatgctcctcctcgccgtcgacgtcgccgctcacgcccagggatggcacctcgccgccgtccccgacctggaagccgtcgaggggctcttcgccgccgcctacgcgtcctggatgcgcgcccgcgtcgcgtacctcgcgccggctctgcagttcctcaccaacgcctgcgtcgtcctgttcctgatccagagcgccgaccgactcatcctttgcctcggctgcttatggatcaggctcaggggaatcaagcccgtccccaataccaccggcggcaaagcgtcggacgatatcgagaccggcgtcgaggagttccccatggtgctcgtgcagattccaatgtgcaacgagaaggaggtgtatcagcaatccattggagctgtctgcaatctggactggccaaggtcaaacttcttggtgcaggtgctggatgattctgatgatgctgcgacttcagctcttatcaaagaggaggtggagaaatggcaacttgagggtgtccgcatattgtaccgacatcgggtgatccgtgacggctacaaggctggaaacctcaagtcagccatgaactgcagctacgtcaaagattatgagtttgttgtcatctttgatgctgatttccaaccacaagaagacttcctgaagaaaactgtgccccatttcaagggcaatgaggatgtaggattagttcaggcaaggtggtcttttgtaaacaaggatgagaacttgttaactaggctgcaaaacataaatctgtgcttccactttgaggtggagcagcaggttaacagtgtatttctcaatttctttgggttcaacggaaccgcaggagtgtggagaatcaaggcacttgaggattctggaggatggatggagagaacaacagttgaagacatggatatagctgtccgagcacatctcaagggatggaagtttctgtatcttaatgatgttgagtgccagtgtgaattgccggagtcatatgaagcatacagaaaacagcagcatcgatggcattctggtcccatgcagttgtttagactctgctttgtggacattatcaaatcaaagattgggttttggaagaagttcaacctcatattccttttctttctcctccgcaaactcattttacccttctattcctttactcttttctgcgtcatccttcccatgacaatgtttgctcctgaagctgagctccctgcttgggtagtatgctacattccggcaacaatgtccttacttaacatcctccctgccccaaaatccttcccattcattgttccttaccttctgttcgagaacaccatgtcagtgaccaaattcaacgctatgatctctggcttgttccagctcgggagtgcctatgagtgggttgtcactaagaaatcaggccgttcttctgagggcgaccttgtcgcccttgtcgagaacgagaagcaatctaagcaacagagagtagggtctgcacccaatcttgactgcctagcaaaggaggaatcccgccctaaagaggattccaaaaagaagaaacacaataggttatataggaaggaactagcactctccttccttctcttgacagcagcagctcgcagcttgctatcggttcagggtatacatttctacttccttctgttccaaggggtctcgttcttggttgtcggacttgatctaatcggtgagcaagtcaaatgataggatactataatgttctttttatccatttgaagcacgtggattatgccaacaaagatcacttctagaattaagaggaaataatgatacacgatttgatttgatgggtacacaagaagctctgatcgatggtgcccaattgtaaggggttgcagttgatcagagacacttaaatgttgggggttgtagatatatggcttgggactcggccggtgagatagtcttcgaggtctcattcttttgtacggagtaagaatcttcaatggttaattagattgggttgatgtcttcttgttttctctcgacagtttaccttcaaatggagatactgttgccatctgtaatgtactttggctcgtcactactacaaattaatgcatagtgaaaacttgttctacgccagtagcactaacgccacaccatggtggcatggtgcctttgcattttgagcatcagaagatttgtggatgtgtctggtggattcaaaagtttgcatgaaatggaaacatgatctgcggactacgtgaggggctgcgataatgtggttgtaatatacacaggtacacatgaaagctgtatgactcagttgctacttttggccttgtaatccgcatgtttgatttgt

SEQ ID NO: 2962 - DNA, 2399 bp, Oryza sativa
aaaggccgtcgtcctgtacttgctctccagctggaggagaggaggaaaaggaaaggttggaattttaattttttaatttttttttttgggtgaggtggtggtaatcataggggagtgtataaagaccgggcttgtctggagctgaggagagttgggattggattggatcgcgacgacgtggtgagctgtttgtttcctcttctgctcgccgccgccgccgccgcagccgcgtgcgtgtgggggtgtttgatgaggaggtgaggtcgtggggggagacggaaggagaagaagcggcggcaatggcgaggtggtggggaggggaggggaggggagggagcgggacgccggtggtggtgaagatggagagcccggagtgggcgatatctgaggtggaggcgggggcggcggcgccggggtcgccggcggcgggggggaaggcggggagggggaagaacgcgcggcagatcacgtgggtgctgctgctcaaggcgcaccgggcggcggggaagctgacgggcgcggcgtccgcggcgctgtccgtggcggcggccgcgcggaggcgggtggcggcggggcggaccgactccgacgacgccgccgcggcgccgccgggggagagccccgcgctgcgcgcgaggttccacggcttcctccgcgccttcctcctcctgtccgtgctcctcctcgccgtcgacgtcgcggcgcacgcccagggctggcacgccgtcgtccccgacctgctcgccgtcgagggcctcttcgccgccgcgtacgcgtcctggctgcgcgtccgcctcgagtacctcgcgccggggctccagttcctcgccaacgcctgcgtcgtcctcttcttgatccagagcgccgaccgcctcatcctctgcctcggctgcttatggatcaagctcaagggaatcaagcctgtgcccaaggctagcggcggcggcggcggcggcaaagggtcggacgacgtcgaggccggcgccgacgagttccccatggtcctcgtgcagattccaatgtgcaacgagaaggaggtgtaccagcaatccattggtgctgtctgcaacctggattggccaaggtcaaacttcttagtacaagtactagatgactctgatgatgctgccacctctgcacttattaaggaggaagtggagaaatggcagcgagagggtgtccgcatattgtaccgacaccgggtgatccgtgatggctacaaggctggaaatctcaagtcagccatgaactgcagttatgttaaagattatgagtttgttgttatctttgatgctgatttccaaccacaagcagacttcctgaagcgaactgtgccccatttcaagggcaatgaagatgttggattggttcaagcaagatggtcttttgtaaacaaagacgagaacttgctgactagactgcaaaacattaatctgtgcttccactttgaggtggaacagcaggttaatggagtattcctcaatttctttgggttcaatggaaccgcaggagtatggagaattaaggcacttgaggactctggaggatggatggagaggacaacagtggaggatatggatattgctgtccgagcacatctcaaggggtggaagtttctgtacattaatgatgtcgagtgccagtgtgagctgccagagtcatatgaagcatacagaaagcagcaacatcgatggcattctggtcccatgcagttgtttcgactctgttttgtcgacatcatcaaatcaaagattggagtatggaagaagttcaacctcatcttccttttctttctccttcgcaaactcatattgcccttctattccttcacacttttctgcatcatccttcccatgacaatgtttgtccctgaagctgagctccctgcatgggtggtgtgctacattccagcaaccatgtccttgctgaatattctcccagcacccaaatccttcccatttattgttccctaccttctgtttgagaataccatgtcagtgacaaaattcaatgccatgatttctggcttgttccagctcgggagcgcctacgagtgggttgtgaccaagaaatcgggccgttcttctgagggcgatctcgtttctcttgttgagaagcagcctaagcaacagagagttgggtctgcacccaaccttgattccctagcgaaggagtcccatccgaaaaaggattcgaaaaagaaaaaacacaataggatataccagaaggagctggcactctccttccttctattaacagcagcagctcgaagcctgctctcggtgcaaggcatacatttctacttccttctgttccaaggggtctcattcttggttgtcggcctcgacttgatcggcgagcaagtcgagtgatagaatacatgtggtataatcggtttc

SEQ ID NO: 2963 - DNA, 2533 bp, Oryza sativa
cccgccaagaagccgaagcatatcgagtcgccaattggcccccgatcccgagagcgagggagggactgtgttcttggcttaatttaattggaatgctccggcggattagttgattaagcttcgagcagcagcgtaaaggccgtcgtcctgtacttgctctccagctggaggagaggaggaaaaggaaaggttggaattttaattttttaatttttttttttgggtgaggtggtggtaatcataggggagtgtataaagaccgggcttgtctggagctgaggagagttgggattggattggatcgcgacgacgtggtgagctgtttgtttcctcttctgctcgccgccgccgccgccgcagccgcgtgcgtgtgggggtgtttgatgaggaggtgaggtcgtggggggagacggaaggagaagaagcggcggcaatggcgaggtggtggggaggggaggggaggggagggagcgggacgccggtggtggtgaagatggagagcccggagtgggcgatatctgaggtggaggcgggggcggcggcgccggggtcgccggcggcgggggggaaggcggggagggggaagaacgcgcggcagatcacgtgggtgctgctgctcaaggcgcaccgggcggcggggaagctgacgggcgcggcgtccgcggcgctgtccgtggcggcggccgcgcggaggcgggtggcggcggggcggaccgactccgacgacgccgccgcggcgccgccgggggagagccccgcgctgcgcgcgaggttccacggcttcctccgcgccttcctcctcctgtccgtgctcctcctcgccgtcgacgtcgcggcgcacgcccagggctggcacgccgtcgtccccgacctgctcgccgtcgagggcctcttcgccgccgcgtacgcgtcctggctgcgcgtccgcctcgagtacctcgcgccggggctccagttcctcgccaacgcctgcgtcgtcctcttcttgatccagagcgccgaccgcctcatcctctgcctcggctgcttatggatcaagctcaagggaatcaagcctgtgcccaaggctagcggcggcggcggcggcggcaaagggtcggacgacgtcgaggccggcgccgacgagttccccatggtcctcgtgcagattccaatgtgcaacgagaaggaggtgtaccagcaatccattggtgctgtctgcaacctggattggccaaggtcaaacttcttagtacaagtactagatgactctgatgatgctgccacctctgcacttattaaggaggaagtggagaaatggcagcgagagggtgtccgcatattgtaccgacaccgggtgatccgtgatggctacaaggctggaaatctcaagtcagccatgaactgcagttatgttaaagattatgagtttgttgttatctttgatgctgatttccaaccacaagcagacttcctgaagcgaactgtgccccatttcaagggcaatgaagatgttggattggttcaagcaagatggtcttttgtaaacaaagacgagaacctgctgactagactgcaaaacattaatctgtgcttccactttgaggtggaacagcaggttaatggagtattcctcaatttctttgggttcaatggaaccgcaggagtatggagaattaaggcacttgaggactctggaggatggatggagaggacaacagtggaggatatggatattgctgtccgagcacatctcaaggggtggaagtttctgtacattaatgatgtcgagtgccagtgtgagctgccagagtcatatgaagcatacagaaagcagcaacatcgatggcattctggtcccatgcagttgtttcgactctgttttgtcgacatcatcaaatcaaagattggagtatggaagaagttcaacctcatcttccttttctttctccttcgcaaactcatattgcccttctattccttcacacttttctgcatcatccttcccatgacaatgtttgtccctgaagctgagctccctgcatgggtggtgtgctacattccagcaaccatgtccttgctgaatattctcccagcacccaaatccttcccatttattgttccctaccttctgtttgagaataccatgtcagtgacaaaattcaatgccatgatttctggcttgttccagctcgggagcgcctacgagtgggttgtgaccaagaaatcgggccgttcttctgagggcgatctcgtttctcttgttgagaagcagcctaagcaacagagagttgggtctgcacccaaccttgattccctagcgaaggagtcccatccgaaaaaggattcgaaaaagaaaaaacacaataggatataccagaaggagctggcactctccttccttctattaacagcagcagctcgaagcctgctctcggtgcaaggcatacatttctacttccttctgttccaaggggtctcattcttggttgtcggcctcgacttgatcggcgagcaagtcgagtgatagaatacatgtggtataatcggtttc

SEQ ID NO: 2964 - DNA, 3001 bp, Setaria italica
cccccatggctaatccctcctcctatggcggattagttaattgattgagctgattagcgagcggcgtcaaggccgccccgtgcttcttctccagctggaagcagaagcggaaggtgacagaaaaaaaaaaggaaaggaaaagacgggggttttaattgattattagggtttaggaggtggtggtcgcggtaatcataggggctcataaaggttgggcttgtccgagctctgctcagtgctcaggcgaattggatccccgccgcgacgtggtgagcactcagctagcccgttcttcctcgctcaggctcagctacctgctccccctcacctcgtgcgcgcgcgcccctcccctcttcgtggggtcgtgtccggccggccgcctcctacctcaccaccatttccctcctcgtccctgttcgtattaatctctgcgcccctcccttccttgtgtgtcggcgtcgtccacaggtggtctcgttgatgcgctgaggtgtcgcgccgacggggaggtgggagcccagaaagcggcggcgtctggggctgggtcgtgcagcgaggtgccaatggagcaatggttggggcgggaggcgcggggtggcggcgggagcgggacgtcggtggtggtgaagatggagagcccggactgggccgtcccgcggtcggaggcggcggcgggggcgggtgccgcgggcggcaaggcggggcgcggcaagaacgcgcgccagatcacgtgggtgctgctgctcaaggcgcaccgcgccgcggggaagctcacgggcgccgcctccgccgcgctgtccgtggccgccgccgcgcggaggcgggtagcggcggggcggaccgacgccgacgccggcgccgcgccgcccggggagagccccgccctgcgcaccaggttctacggcttcctccgcgccttcctcctcctgtccatgctcctcctcgccgtcgacgtcgccgcgcacctccagggctggcacctcgccgtcgacgtccccgacctgctcaccgtcgaggggctcttcgcctccgggtacgcatcctgggtgcgcatccgcctcgagtaccttgcgccggcgctgcagttcctggcgaacgcgtgcgtcgtgctctttttgatccagagcgccgaccgcctcatcttgtgcctcggatgcctctggattaagctaaggggcgtcaagcctgttgccaaggctggcggcaaaggttcggacgacgtcgagtccggcgccggggagtttcccatggtgctcgtgcagattccaatgtgcaacgagaaggaggtgtaccagcaatctattggtgctgtttgcagtctggactggccaaggtcaaacttcttggtgcaggtgctagacgattctgatgatgctgccacttcagctcttattaaggaggaggtggagaaatggcaacgtgaaggtgttcgcatactgtaccgacaccgggtgatccgtgatggctacaaggctggaaatctcaagtcagctatgaactgcagctatgtaaaggattatgagttcgttgttatctttgatgctgattttcaaccccaaccagacttcctgaagcgaactgtgccccatttcaagggaaatgaagatgttggattagttcaggcaaggtggtcttttgtgaacaaggacgagaacttgttaactagactgcaaaacataaacctgtgcttccacttcgaagtggagcagcaggttaatgggatcttcctcaatttctttgggttcaatggaaccgcaggagtgtggagaattaaggcacttgaggattctggtggatggatggagaggacaacagtggaggacatggatattgctgtccgagcacacctcaaaggctggaagtttctgttccttaacgatgttgagtgccagtgtgaattgccggagtcatatgaagcatatagaaaacagcaacatcgatggcattctggtcccatgcagttgttcagactctgctttgtggatattattaaatctaagattggtttttggaagaagttcaacctgatatttcttttctttctccttcgcaaacttattttacccttctactccttcactcttttctgcatcatccttcccatgacaatgtttattcctgaagctgagcttcctgcttgggttgtgtgctacattccggcaaccatgtccttgttgaacatcctcccagcccccaaatcctttccatttatcgttccctatcttctatttgagaataccatgtcggtaaccaaattcaatgccatgatttctggcctgttccagctcgggagcgcctatgagtgggttgtcaccaagaaatcaggccgttcttccgaaggcgatcttattgccctcgtcgagaagcaatctaagcagcaaagagtaggatctgcacccaaccttgactccctaacaaaggagtcgtcgaatctcaaaaaggacttcaggaagaagaaacacaataggatatacaggaaggagttagcactctccttccttctcttaactgccgcagctcggagcctgctttcggtccaaggcatacatttctatttccttctgttccaaggggtctcattcttggttgttggtctcgatctaatcggcgaacaagtcgagtgatagaagaagaatgatagattttatttttgctgggagcgggtcacgctcacgccaacaaagagtacttcaggtgaagggcagcatggtacgtgactggatgcatacacgactacacgaaaagatttggttcagattgtgaggggttatagttcgtcagggatactgaaatggtgaaacgtggaattgtataatgtagatatatggctcgggaccctggactgtgaaaggctttgggggtctaattcttttgtaagaatcttcagtggttagatgcgctattcttgcttacttgacagtttataaaaggagatactgttgggatccatgtaatttggtcaattgctacgaatgcatactgaattactgatactgtgata

SEQ ID NO: 2965 - DNA, 2847 bp, Sorghum bicolor
ccgcgacgtggtgagctccttctgctgctacctgctctccctactccctcttttcgtgcgtgcgtgcgcgcgcgcgcgcgcgctcccgctttcgtggggtcctgtcctgtgcggccggcctcctcctacctcaccagcatttccctcccttgtcccagctcgtattaatccttggccccctcctctctcttgtcttgtgagtgtgtctccgtcgctcacctcggccacaggtggtggtctcgttgatgaggtgaggccgtgaggggctgtgctcagtgggaggggggggagccaaagcccaaagccaagaagcggcggcgtctagtggcttgggttctaccgcgaggtgccaatggcgcagtggtggggacgggaggcgcggggcggcggcggcggcggcgggacgtcggtggtggttaagatggagagcccggactgggccgtcccggggtcggcggcggcggggggcaaggccggccgcggcaagaacgctcgccagatcacgtgggtgctgctgctcaaggcgcaccgcgccgcggagaagctcacgggcgccgcctccgccgcgctgtctgtcgccgccgccgcgcggaggcgggtggcggcggggcggaccgacgacgacgtcgacgccgacgaggccggcgccgccgcgacgcccggggagagccccgccctgcgcgccaggctctacggcttcctccgcgtcttcctcctcctgtccatgctcctcctcgccgtcgacgtcgccgcgcacctccagggctggcacctcgccgtcgacgtccccgacctgctcgccgtcgagggcctcttcgccgctgggtacgcgtcctgggtgcgcgtccgcctcgagtacctcgcgccggcgttgcagttcatggcgaacgcgtgcgtcgtgctcttcttgatccagagcgccgaccgccttatcctctgcctgggttgcctctggatcaagctcaagggcatcaagcctgttcccaaggctgctggcaaagggtcggacgacgacgtcgaggccgacacaaccggggagttccccatggtgctcgtgcagattccaatgtgcaacgagaaggaggtgtaccagcaatctattggtgctgtttgcggtctggactggccaaggcccaacttcttggtgcaggtgctagatgattctgatgatgctgccacttcagcacttattaaagaggaggtggagaagtggcaacgcgaaggcgttcgcatattgtaccgacaccgagtaattcgtgatggatacaaggctggaaatctcaagtcagccatgaactgcagctatgtaaaagattatgagtttgttgttatctttgacgctgattttcaaccccagccagacttcctgaagcgaactgtgccccatttcaagggcaatgaggatgttgggctagttcaggcaaggtggtcttttgtgaacaaggatgagaacttgttaactagactgcaaaacataaacctttgcttccactttgaggtggagcagcaggttaatgggatcttcctcaatttctttggattcaacggaacggcaggagtgtggagaataaaggcacttgaggattcaggtggatggatggagaggacaacagtggaggacatggatattgctgtccgagcacacctcaagggctggaagtttatgttccttaatgatgttgagtgccagtgtgaattgccagagtcgtatgaggcatatcggaaacagcaacaccgatggcactctggtcccatgcaattgtttagactctgctttgtggatattattaaatcaaagattggattttggaagaagttcaacctcatatttcttttctttctccttcgcaagcttattttgcccttctattccttcactcttttctgcatcatccttcccatgacaatgtttattcctgaagctgagctccctgcctgggttgtgtgctacattccggcaaccatgtccttgctgaacatcctcccagcccccaaatccttcccatttattgtcccctatctcctatttgagaataccatgtcagtaaccaaattcaacgccatggtttctggcttattccagctcgggagtgcctacgagtgggtcgtcaccaagaaatcaggccgttcttctgagggtgatctcattgccctcgtcgagaagcagtctaaacagcaaagggtagggtctgcacccaaccttgattcccttacaaaggagtcttccaatctcaaaaaggattccaaaaagaagaaacacaataggatatacaggaaggagctggcactctccttccttctcttgacagcagctgctcggagcctgctatcggtgcaaggaatacatttctacttccttctgttccaaggggtatcattcttggttgttggactcgatttaatcggtgagcaagttgagtgacgggaatacaagggagagtaatgggggtatttattttgctgcgagtgtgggcaacgcgaccaaagagcacttcaggtaaaggcaagcacggtacatgattcaacgcatacacgactacacgagaagattttgattccggattaagaggggttatagttggtcagggatacttgaaacggtgaaatgtggattgtagatatatggcttgggactgtggactgtaaaaggcttgggtgtctaattcttttgtaagaaaatcttcagtgattagatgggttattttgcttacttgacggtttaccttcaaagggggatactgttggggtccatgtaatttgggcaattgctacgaacgcatactgaattactgagactgtgatacttgttcgtttcttgaactctcacttgtggatagaggattgcaa

SEQ ID NO: 2966 - DNA, 2071 bp, Panicum virgatum
tggcggtgggacgtcggtggtggtgaagatggagagcccggactgggccgtcccgcagtcggaggcgggggccgcgagcggcaaggcggggcgcgggaagaacgcgcgccagatcacgtgggtgctgctgctcaaggcgcaccgcgccgcggggaagctcacgggcgccgcgtccgccgcgctgtccgtggccgccgccgcgcggagtcgtgtggcggctgggcggaccgacgccgacgccggcgctgcgccgcccggggagagccccgccctgcgcaccaggttctacggcttcctccgcgccttcctcctcctgtccttgctcctactcgccgtggacgtcgccgcgcacctccagggctggcacatcgccgtcgacgtccccgacctgctggccgtcgaggggctcttggccgccgggtacgcgtcctgggtgcgcatccgcctcgagtacctcgcgcctgcgctgcagttcctggcgaacgcgtgcgtcgtgctctttttgatccagagcgccgaccgtcttatcctgtgcctcggctgcctctggattaagctaaggggcatcaagcctgtgcccaaggccggcggcaaaggttcggacgacgtcgaggccggcgccggggagttccccatggtgctcgtgcagattccaatgtgcaacgagaaggaggtgtaccagcaatctattggtgctgtttgcagtttggactggccaaggtcaaacttcttggtgcaggtgctagatgattctgatgatgctgccacttcagctcttattaaggaggaggtggagaagtggcaacgtgaaggccttcgcatattgtaccgacaccgggtgatccgtgatggctacaaggctggaaatctcaagtcagccatgaactgcagctatgtaaaagattatgagtttgttgttatctttgatgctgattttcaaccccaaccagacttcctgaagcgaactgtgccccatttcaagggaaatgaggatgttggattagttcaggcaaggtggtcttttgtgaacaaagacgaaaacttgttaactagactgcaaaacattaacctgcgcttccactttgaggtggagcagcaggttaatgggatcttcctcaatttctttgggttcaacggaaccgcaggagtgtggagaattaaggcacttgaggattctggtggatggatggagaggacaacagtggaggacatggatattgctgtccgagcacacctcaaaggctggaagtttctgttccttaacgatgttgagtgccagtgtgaattgccggagtcatatgaagcatatagaaagcagcaacatcgatggcattctggtcccatgcagttgttcagactctgctttgtagatattattaaatcaaagattggtttttggaagaaattcaacctgatatttcttttctttctccttcgcaaacttattttacccttctactccttcactcttttctgcatcatccttcccatgacaatgtttattcctgaagctgagcttccagcttgggttgtgtgctacattccagcaaccatgtccttgttgaacatcctcccagcccccaaatcctttccatttattgttccctatcttctatttgagaataccatgtcagtaaccaaattcaacgccatgatttctggtttgttccaactcgggagcgcctatgagtgggttgtcaccaagaaatcaggccgttcttctgagggcgatcttgttgccctcgtcgagaagcaatctaagcaacaaagagttggatctgcacccaaccttgattccctaacaaaggagtcagcacatccaaaaaaggactccgtgaagaagaaacacaataggatatacaggaaggagctagcactctccttccttctcttaacagctgcagctcggagcctgctttcggtccaaggcatacatttctacttccttctgttccaaggggtctcattcttggttgttggtctggatctaattggcgagcaaatcgagtgatgaaggcaagtgatggaatttatttttgtgggagcgggccatgccagcaaaagagcgctt

SEQ ID NO: 2967 - DNA, 2718 bp, Zea mays
gctcccagctcgcattaatctttggcccctcttctccttgtgtgagcgtgtctccgtcgttcgcctcggcgctcacgggtggtctcgttgatgagctgagggaggggctgtgctccgggggagggggaagccaaagccaagaagcggcgccgcctaggcttgggttccgcggcgaggtgccaatgccgcagtggtggggccgggaggcgcggggtggcggcggcggcggcggcacgtcggtggtggtgaagatggagagcccggactgggccgtccgggagccagaggcggcgagggggaaggccggccgcggcaagaacgctcgccagatcacgtgggtgcttctgctcaaggcgcaccgcgccgcggggaagctcacgggcgccgcctccgccgcgctgtccgtcgccgcggccgcgcggaggcgggtggcggcggggcggaccgacgccgacgccgacgccggcgccggcgccggcgccgcgccgcacggggagagccccgcactgcgcaccaggctctacggcttcctccgcgcctctctcgtcctctccatgctcctcctcgccgccgacgtcgccgcgcacctccagggctggcacctcctcgccgtcgacgtccccgacctgctcgccgtcgagggtctcttcgccgccgggtacgcgtcctgggtgcgcgtccgcctccagtacctcgcgccggcgctgcagttcctggcgaacgcgtgcgtcctgctcttcttggtccagagcgccgaccgccttatcctctgcctcggctgcctctggatcaagctcaggggcatcaagccagttcccaatgctgctggcaaagggccagacgacgtcgaggccggcaccggggagttccccatggtgctcgtgcagattccgatgtgcaacgagaaggaggtgtaccagcaatctattggtgctgtttgcggtctggactggccacggcccaacttcttggtgcaggtgctagacgactctgatgatgctgccacttcagcgcttattaaagaggaggtggagaggtggcaacgtgaaggcgttcgcatattgtaccgacaccgggtaattcgtgatggctacaaggctggaaatctcaagtcagccatgaactgcagctatgtgaaagattatgagtttgttgttatctttgacgctgattttcaaccccagccagacttcctgaagcgaactgtgccccatttcaagggaaatgaggatgttgggctagttcaggcaaggtggtcttttgtgaacaaggatgagaacttgttaactaggctgcaaaacataaacctgtgcttccactttgaggtggagcagcaggttaatgggatcttcctcaatttctttggattcaacggaacggctggagtgtggagaataaaggcacttgaggattcaggtgggtggatggagaggacaacagtggaggacatggatattgctgtccgagcacacctcaagggctggaagtttctgttccttaacgatgttgagtgccagtgtgaattgccagagtcatatgaggcatatcgaaaacagcaacaccgatggcattctggtccaatgcagttatttagactatgctttgtggatattatcaaatcgaagattggattttggaagaagttcaacctcatattccttttctttctccttcgcaagcttattttgcccttctattccttcacccttttctgtatcattcttcccatgacaatgttcattcctgaagccgagctccctgcctgggtcgtgtgctacattccggcaaccatgtccttgctgaacatcctcccagcccccaaatcgttcccgttcattgtcccctatctcctgtttgagaataccatgtcagtaaccaaattcaacgccatggtttctggcctgttccagctcgggagcgcctacgagtgggttgtcaccaagaaatcaggccgttcttccgagggcgacctcatcgcccttgtcgagaagcagcctaaacagcaaagggtagggtctgcacccaaccttgagtcacttacaaaggagtcttccagtctcaaaagggactccaaaaggaagaaacacaataggatatacaggaaggagctggcactctccttccttctcctaacagccgctgctcggagcctgctatcggtgcaagggatacatttctacttccttctgttccaaggggtgtcgttcttggttgttgggctcgatctaatcggtgagcaagtcgagtgatgcggtacaagggagagtaattgggtatctattttgctgcgagtggggggcaatgcgaccaaaagaggcacttcaggtaaaggcaagcgtggtacatgatccaaagaagatttgattccggattaagaagggttatatagtttcatcggggatacttgaaacggtgaaaatgtggaattgtggattgtagatataatatggcttgggactgtgggctgtaaaaggcttgggggttctaattcttttgtaagaaaaatcatcagtggttagatgggttattttgcttacttgacagtttaccttcaaagggggatactgttgggatccatgtgatttgggcaattgctacgaatggatactgaattactgagaccgatttgttcttttcttgaactctcacttgtggataaaaggattgcatgagtgcaccagcagtaaacttcgaatgcctacggtttgtgaatgctag

SEQ ID NO: 2968 - DNA, 2495 bp, Panicum virgatum
ggcggcgggcggcaaggcggggcgcgggaagaacgcgcgccagatcacgtgggtgctgctgctcaaggcgcaccgcgccgcggggaagctcacgggcgccgcgtccgccgcgctgtccgtggccgccgccgcgcggaggcgtgtggcggctgggcggaccgacgccgacgccggcgccgcgcctcccggggagagccccgccctgcgcaccaggttctacggcttcctccgcgccttcctcctcctgtccatgctcctactcgccgtcgacgtcgccgcgcacctccagggctggcacctcgctgtcgacgtccccgacctgctggccttcgaggggctcttcgccgccgggtacgcatcctgggtgcgcatccgcctcgagtacctcgcgccggcgctgcagttcctggcgaacgcgtgcgtcgtgctctttttgatccagagcgccgaccgtcttctcctgtgcctcggctgcctctggattaagctaaggggcatcaagcctgtgcccaagcccggcggcaaaggttcggacgacgtcgaggccggcgccggggagttccccatggtgctcgtgcagattccaatgtgcaacgagaaggaggtgtaccagcaatctattggtgctgtttgcagtctggactggccaaggtcaaacttcttggtgcaggtgctagacgattctgatgatgctgccacttcagctcttattaaggaggaggtggagaagtggcaacgtgaaggcgttcgcatattgtaccgacaccgtgtgatccgtgatggctacaaggctggaaatctcaagtcagccatgaactgcagctatgtaaaagattatgagtttgttgttatctttgatgctgattttcaaccccaaccagacttcctgaagcgaactgtgccccatttcaagggaaacgaggatgttggattagttcaggctaggtggtcttttgtcaacaaggatgaaaacttgttaactagactgcaaaacattaacctgtgcttccactttgaggtggagcagcaggttaatgggatcttcctcaatttctttgggttcaacggaaccgcaggagtgtggagaattaaggcacttgaggactctggtggatggatggagaggacaacagtggaggacatggatattgctgtccgagcacacctcaaaggctggaagtttctgttccttaatgatgttgagtgccagtgtgaattgccggagtcatatgaagcatatagaaagcagcaacatcgatggcattctggtcccatgcagttgttcagactctgttttgtggatattattaaatcaaagattggtttttggaagaaattcaacctgatatttcttttctttctccttcgcaaacttattttacccttctactccttcactcttttctgcatcatccttcccgtgacaatgtttattccagaagctgagcttcctgcttggattgtgtgctacattccagcaaccatgtccttgttgaacatcctcccagcccccaaatcctttccatttattgttccctatcttctatttgagaataccatgtcagtgaccaaattcaacgccatgatttctggtttgttccaacttgggagcgcctatgagtgggttgtcaccaagaaatcaggccgttcttctgagggtgatcttgttgcccttgttgagaagcaatctaagcaacaaagagtgggatctgcacccaaccttgattccctaacaaaggagtcagcacatataaaaaagggactccatgaagaagaaacacaataggatatacaggaaggagctagcactctccttccttctcttaacagctgcagctcggagcctgctttcggtccaaggcatacatttctacttccttctgttccaaggggtctcattcttggttgttggtctggatttaatcggcgagcaaatcgagtgatagaaggctgagtgtcggaatttatttttgtgggagcgggccatgccagcaaaagagcgcttcaggtgaagagcagcatggcacattactggatgcatacacgactacacgaggatacctgatttcgattatgaggggttatagttcgtcagggatactgaaatggtggaacctggaattgtagaatgtagatatatggctcggggctctggattgtgaaaggcttggggttctaattcttttgtaagaatcttcagtggttaggtgggttattcttggttgacagattaccatcaaaggaggatactgttgggatccatgtaatttgggcaattgctacgagtgcatactgaattactgatactgtgatacttgttcgtttcctgtactactctcacttgtggacagaaaattgtccaatgaacccagcgaacggaaggagttgtgcgctggtgcatcagaaataaacttatttatgaatttgtaaaaaattgtgaatgcaagggggcaaatatggtttatgggaaccttaacctatttgatcgataactg

SEQ ID NO: 2969 - DNA, 2927 bp, Zea mays
cagcatttccctccctagtcccagctcgtattaatctttggccccccttctctttgtgcgagtgtgcctcgtcattcacctcggccacaggcggtctcattgatgaggtgaggagctgtgctcagggggagcctaaaagcggcggcgtctacgcttgccgcgaggtgccaatggtgcagtggtggggccgtgaggcgccgggtggccgggggacgtcggtggtggtgaagatggagagcccggactggaccatcccggcggagtcggaggtggcggcggggggcaaggccggccgcggcaagaacgcccgccagatcacgtgggtgctactgctcaaggcgcaccgcaccgcggggaagctcacgggcgccgcctccgccgtgctttccatcgccggcgccgcgtggaggcgggtggcggcggggcggaccgacgaagacgaagacgaagacgccggcgccgcgccgcccggggagagccccgcgctgcgcagcaggttctacggcttcctccgcgcctccctcgtcctgtccgtgctcctcctcgccgccgacgtcgccgcacacctccagggctggcacctcgccgtcgacgtccccgacctgctcgccgtcgagggcctcttcgccgccgggtacgcgtcctgggcgcgcgtccgtctcgagtacctcgcgccggcgctgcagttcctggcgaacgcgtgcgtcgtgctcttcttggtccagagcgccgaccgccttatcctctgcctgggttgcctctggatcaagcacaggggcatcaggcctgtccccaaggctggtggcaaagggtcagacgacgtcgaggccggcaccgggaacttccccatggtgctcgtgcagattccaatgcgcaacgagaaggaggtgtaccagcaatctattggtgctgtttgcggtctggactggccaaggccaaacttcttggtgcaggtgctagacgattctgatgacgctgccacttcaacacttattaaagaggaggtggagaagtggcaacgggaaggcgttcgcatattgtaccgacaccggttaattcgtgatggctacaaggctggaaatctcaagtcagccatgaactgcagctatgtaaaggattatgagtttgttgttatctttgatgctgattttcaaccccagccagacttcctgaagcgaactgtgccccatttcaagggcaatgaggacgttgggttagttcaggcaaggtggtcttttgtgaacaaggatgagaacttgctaactaggctgcaaaacataaacctttgcttccactttgaggtggagcagcaggttaatgggatcttcctcaatttctttggattcaatggaacggcaggagtgtggagaataaaggcactcgaggattcaggtggatggatggagaggacaacagtggaggacatggatattgctgtccgagcacacctcaagggttggaagtttctgttccttaacgatgttgagtgccagtgtgaattgccggagtcatatgaggcatatcgaaagcagcaacaccgatggcattctggtcccatgcagttatttagactctgctttgtggatattatcaagtcgaagatcggattctggaagaagttcaacctcatatttcttttctttctcctccgcaagctcattctgcccttctattccttcacccttttctgcatcatccttcccatgacgatgtttattcccgaagccgagctccctgcctgggtcgtgtgctacatcccggcgaccatgtccctgctgaacatcctcccagccccgaaatcgttcccgtttatcgtgccctatctcctgttcgagaacaccatgtcggtaaccaagttcaacgccatggtctccggcctgttccagctcgggagcgcccacgagtgggtcgtcaccaagaaatcaggccgttcttccgagggcgatctcgtcgtcgagaagcagcctagacagcaaagggcagggtccgcatccaaccttggttcccttgcaaaggagccttcctccagtctcagaaaggactcccaaaggaagaaacacaataggatatacaggaaggagctggcgctctccttccttctcttaacagcagctgctcggagcctgatatcggtgcaaggaatacacttctacttccttctgttccaaggggtatcgtttttggtcgttgggctcgatctgatcggcgagcaagttgagtgacgggaatacaagggagagtaatggcggtatttgtttttgctgcgagcggtggcaatgcgaacagggagcacttcaggtaaaggcaggcacggtatatgattcaacgcaaacacgagaagatttggttccggattaagaggggttatagatggttagggatacttgaaacggtgtactgtggattgtagatatatggcttgagactgtggactggggtctgattcttttgtaagaaaatctttcagtggggtcattttgctttcttgacagtttaccttcaaagggggatactgtttgggatccatgtaatttggccagttagtacgaatgcatactgaatgatacttgttcgtttcttgaattctaacatgtggataaaggattgcgctaaggggaacccagaaaaagggaagaagatgttctgcatgagtgcatcagtagaatgcctacgggctctgtttgtgaatgcaagagcgcaaatcacatgcggctcacgaacggtaatcaggggaactggggaaggggtttaggaacaacccatctccattcaccaacggcgcctccaactccgagcgccgcctctgcctcgaaaactcttactcgcggagctgcagccaggggggcgaccggtgtgtgaaccgctgccgctatggctgctgcttccgttccgccaacatcttcatccggcggctgggacttcacctg

SEQ ID NO: 2970 - DNA, 3265 bp, Setaria italica
gcatcctcgccttgcctcctccccaaatttgaaacctccgaggcggacgcgacgcgagacgaaggcgtcggtcgagtgggcggcgcctcccccgctccgtcggctctcgcgggcgcggttggagcggccgaggacgcgcgcgcgggcgcgggattggatgcggcgcggctcggttgccggagggtgctcgctgctcgcgtcggtcacggagtaatcatggcaagtgacaaagcaaaagtcgcaaagaagggtggagaggatcctggacttccgccagcttctcgtgaaggggaaaacagccatgagccgcagaggcaacgatcactgaatgggaggaccactggtccaacccggcgttctaccaaaggaaattggacacccgaagaggattctatattgtcccgtgcggttcagacataccaagggaaaaactggaaaaagatagcggaatgttttccagacagaaccgacgtacagtgtttgcacaggtggcaaaaggttctaaatcctgaattggtcaaagggccatggtcgaaagaagaagatgaaatcatagttcagatggtaaacaaatatgggccaaagaaatggtcgaccattgctcaagctttgcctggacgcataggaaagcaatgccgggaacggtggcacaatcatcttaacccagccataaacaaggaggcatggacgcaagaagaggagattactctcattcatgctcatcggatgtatggaaataaatgggctgaactgacaaaatttctacctggaaggacggataacgcaattaaaaatcactggaacagttcggtaaagaaaaaagttgattcatacatatcttctggcttgctttctcaagtcccgtgcctccctctgatcgaatgcccttcacaatgcaactctttatctactatgaacctacaaaataatggagatagtggttgcaatgctcagaacactaatttggccttgagctgtgatttacaagaaaatatggatgccaacaagagcgaagcacaagactctcactcttctatgtgtcaggggacatgctatacttccacagaggctgtaggatccgctttgcctgatgggcatcaccatctttcttcgtctttttctcaaagattggacctgcagatggatgtacatgaagggtcaggtaattctatgtttgtggatgaacaaacgctttgtagcacatcaaatcaagaaaactctatggtaccatttggtgttgcacaggaaatgcctgtctctgtgctatcaagtgtttctgatgctgagcagaaactgcatttaatctctgatgctgacagtctgaaatctgaactttggaaagacgtgtccttgcaaactctaatttcaggagatacagttgatgctgcttcttcaggactaaatcaactgccagatacttctaaaacggacaccaactttttggcacagccatacccattacatacatcaaatccatccagtgtgatggaaactgtgtatgaacggagtacgttggtgacagtgtcttcctcttttctgtgtttagatagtttacctggtgtacctggaaatagatctgagccaatggacatgctggattctgaagcagagatgatcacatgctcaaacaattctttttgtgatgctgagcaatcagctaaaccaggcagcagtgatgacagacctggggatttcacaatgattgagaacactacaaactgcaggagccaacagtccacagatgccgaagaagctgtggccagtacagcaaaagaacagttaccaaaagacattgagactgtgcccgatgaaaagaagggtgagggagctctattctacgaacctcctcggttcccaggtgtggatgtcccatttatcagttgcgatcttgtaacttctgctgatctgcaagaatttagtccccttgggattcggcagtggatgcggtcaaccatgaatgtccccactcctttaagattatggggatccccaacacatgatgaaagcccagatgcgctaaagactgctgccgaaagcttcccatgcacaccatcaataatgaagaaaagacacagaggtctattatctcctactccagataaaagaattgagaagaaatctgggattgcaaaggagatgacagacatctcctatatgattacagccacatgttccgtgaatacaaccaaagatgaagcaactgttactgaatcgcttgtgtgtgctgagcaatcttcttttaaacatctagataagaaacttgagttctctgatggtaacaaggaaaattccgatggagcacctgaacaggccagagatgcacagaatgcaggaaacaaacaacttgtggatgaaggagggcaacgatgttcctcaccaaatgtcgccaatcctaatgctgatctgccagacaattcacaacctgtaggtattctggttgagcatgagcataactgcaatgacctcattgccactgatcatggtgcaaagcctgaatctttgtcattctgtaaggaagcagttaattcaaaatcaaagcctgcggatctagttgttgagaaatcatcaccatgcatcaacgcggattatgaatatgtgaacttattggctgataccccaggtgtcaaaagaggactggaatctccttcagcatggaagtctccttggtatatagatatgcacatgagctttcagggttttgtcagcccggcagacagaacttatgacgcgctagggttagtgaagcagataagtaagcacagtgctgctgctgcagtggaggcctgtgaggtgctagcaagcggcagcagaccctctgatgcggaaaacaaggaaaatacagatgacaaggagccagggacaagaaaatcacagaccaaaatcatggccgaggcgcgagtcctggatttcgacgaatattccacacctgcaagaacagcagataagagacttagcagctgtctcggaagatctgttagctcacccattctttcctcccccaacctgagaagttttcgataggtagacttgtgagagatacaccagatatgttccaataatacattagctgtatgtacatgcatgttcctagagctcattgttctcattcgttactgtgtattgccaccgttatttaagcgtacagtgtcagcccagaaactagcttccaaaaggcggcagtatcagtggactgttaaaaccttgtatcattcaattgtaatttactattggttaatagtagtagtttacatcggagacgtttctt

SEQ ID NO: 2971 - DNA, 3685 bp, Panicum virgatum
acttggacggaatcattatgcatccttcagttttttcggtctaccaactcctgtcaaactattttatcttacatgtgagccatcaggaggtattttgtgaggagatgagtaagttaattttggtggaaattgtatcgaattctttttattttttatagtatagataaatcccgtctcttgctctctgtcccgtttccagattccaaaaaccaaaataaccggtaacgcccgttaaattgacgcttgccagttgccacgcgcccaccccacccgtcccagccggtatcccacccgttggcattcaaatattgccgacgcggcacgcgagtcagcggcacggacggccacgatgcggccccttccgccggtaactatctcccgccgtccatctgccaccccatcccctgcttccccgacactgacttgagacccacccaacatgtcaagcggccgtagggtttgatttcgaagcatcctccccaaatttgaaacctccgaggcggacgtgagacgaaggcgtcggcatctccccctctccgtcggcgctctcgcggcggggttggagcggccgagttgccgcgcgcgggcgcgggattggatgcggcgcggctcgatcagtcgccggaggtgctcgctgctcgcgtcggtcacggaggcacggtgactcgtaatcatggcaagtgacaaagcaaaagttgcaaagaagggtggagaggatcctggacttccgccagcttctcgcgaaggggaaaacagccatgagccacagaggcaacggtcactcaacgggaggaccactggtccgactcggcgttccaccaaaggaaattggacacctgaagaggatgctatattgtcccgtgcagttcagacataccaaggaaaaaactggaaaaaaatagcggaatgttttccagacagaaccgatgtacaatgtttgcacaggtggcaaaaggttctaaatcctgaattggtcaaagggccatggtcgaaagaagaagatgaaatcatagttcagatggtaaacaaatatgggccaaagaaatggtcgaccattgctcaagctttgcctgggcgcataggaaagcaatgccgggaacggtggcacaatcatcttaacccagccataaacaaggaggcatggacgcaggaggaggagattactcttattcacgctcatcgaatgtatggaaataaatgggctgaattgacgaagtttttacctggaaggacggataatgcgataaaaaatcactggaacagttcagtgaagaaaaaagttgattcgtacatatcttctggcttgctttcacaagtcccgtgcctccctgtgattgaatgccctgcacaatgcaactctttatctgctatgaacctgcagaacattggagatagtggttgcaatgctcataacactaatgtagccttgagctgtgaattacaagtaaatgtagatgacaacaagggagaagcacacgactctcactcttccatgtgtcaaggggcatgctatacttccgtagaggctgtaggatctgctttgcctgatgggcatcaccatctttcttcgtcattttctcaaagaatggacctgcagatggatgtaaatgaagggtcaggtaattctgtgtttgcagatgaccaaactctttgtagcacatcaaatcaagaaaagtccatggtaccatatggtgttgcggaggaaatgcctgtttctgtgctatcaactgtttctgatgctgagcagaaactacatttaaactctgatgctgatagtctgaaatctgaactttggagagatgtgtccttgcaaacattaatttcaggagacacaattgatggtgattcttcttcaggactaaatcaactgccagatacttctgaaatggacaccaaccttttggcacagccgtacccattacactcatcaaatccgtccagtgtgatggaaactgtgtacgaacaaaattcactgccgacagtatctccctcttttatatgtttagatagtttatctgatgcacccaaaaatagatctgagccagtagaaatgccagattctgaagcagatatgatcacatgctccaacagttctttttgtgatgttgagcaatctgctaaacctgggagcagcgatgacagacctggggctttcacaatatctgagagcattacaaactgcaggagccaacagtcgacagatgccgaagaacctgtggccagtacagcgaaagaacagttaccgaaagacatggatattgtgccagatgaaaagaagggtgggggagccctattttatgaacctcctcggttcccaggtttggatgtcccatttatcagttgcgatcttgtaacttctgctgatatgcaagaatttagtccccttgggattcggcagtggatgaggtcaaccatgaatgtccccactcctttaagattatggggatccccaacacatgatgaaagcccaggtgtgctaaagagtgctgccgaaagcttcccatgcacaccatcaataatgaagaaaagacagagaggtctattatctcctactccagataaaagaattgagaagaaatctgggatagcaaaggagatgacagacatctcctacatgatcgcagccacatgttccatgaatgcaaccaaagatgaagcaacttctcctgaatcagttgcgtgtgctgaacaacattcttcttttaaacatctagatgagaaacttgagttctctgatggtaacagggaaaatttcaatggagcacctgaacaggtcagagatgcacaaaatggaggaaacaaacaaggagggcaaaaatgttcctcattaaatgtcgccaatcctaacactgatctgccagacaatttacaacctgtcggtattcttgttgagcacaactgcaatgacatcattgctgctgatcctgaatctttgtcatcctgcaaggaagcagttagttcaaaaccaaagcctgcagcactagttgttgagaaatcatcaccatgcatcaatgcggattatgaatatgtgaacttattggctgataccccaggtgtgaaaagaggactggaatctccttctgcatggaagtctccttggtatatagatatgcacatgcactttcagggttttgtcagtccagcagacagaacttatgatgcattaggattagtgaaacagataagtaagcgaagtgctgctgctgcagtggaggcctgtgaggtgctagcaagcggcagcagaatctctgacaaagaaaacaaggagaatagagatgacaaggagccagggacaagacaatcacagaccaaaatcatggccgaggcacgagtcctggattttgacgaatattccacacctgcaaaggcagcagataagagacttggcagctgtctcggaaaatccgttagctcaccgattctttcctccccaaacatgagatgttttcgataggtagacttgtgagagatacaccagatatgtccaaataatatatagccgtatgtacatgcatgttcctagagcccattgttctcattcgttactgtgtattgtcagttgttaccgttatttcagcgtacagtctcagcctagaaactagcttcccaaaggcggcagtaccagtggactgttaacttatgtatcattcaattttaatttactattggttaatagtggtaattt

SEQ ID NO: 2972 - DNA, 3027 bp, Panicum virgatum
gtaatcatggcaagtgacaaagcaaaagtcgcaaagaagggtggagaggatcctggacctccgccagcttctcgcgaaggggaaaacagccatgagccacagaggcaacggtcactcaatgggaggaccactggtccgactcggcgttccaccaaaggaaattggaaacctgaagaggatgctatattgtcccgcgcagttcagacataccaaggaaaaaactggaaaaaaatagcggaatgttttccagacagaaccgatgtacaatgtttgcacaggtggcaaaaggttctaaatcctgaattggtcaaggggccatggtcgaaagaagaagatgaaatcatagttcagatggtaaacaaatatgggccaaagaaatggtcgaccattgctcaagctttgcctgggcgcataggaaagcaatgccgggaacggtggcacaatcatcttaacccagccataaacaaggaggcatggacgcaggaagaggagattactctcattcacgctcatcgaatgtatggaaataaatgggctgaactgacgaagtttttacctggaaggacggataatgcgataaaaaatcactggaacagttcagtaaagaaaaaggttgattcttacatatcttctggcttgctttcacaagtcccgtgcctccccgtgatcgaatgccctgcacaatgcaactctttatctgctttgaacctacagaacaatggagatagtggttgcaatgctcataacactaatgtagccttgagctgtgaattacaagtaaatgtagatgccaacaagggagaagcacacgactctcactcttccatgtgtcaggtggcatgctatacttcaatagaggctgtaggatctgctttgcctgatgggcatcaccatctttcttcgtcattttctcaaagaatggacctgcagatggatgtaaatgaagggtcaggtaattctgtgtttgcagatgaccaaactctttgcagcacatcaaatcaagaaaagtccatggtaccatatggtgttgcgcaggaaatgcctttctctgtgctatccagtgtttctgacgctgagcagaaactacatttaatctctgatgctgatagtctgaaatctgaactttggaaagatgtgtccttgcaaacattaatttcaggagatacaattgatggtgattcttcatcaggactaaatcaaccgccagatacttctgaaacggacaccaactttttggcacagccgtacacattacacacatcaaatccgtccagtatgatggaaactgtgtacgaacagagtacactggcgacaatatctccctcttttataagtttagatggtttatctgatgcacccgaaaatagatctgagccaatagaaatgcgagattctgaggcagagataatcacatgctcaaacaattctttttgtgatgctgagcaatctgttaaacctgggagcagtgatgacagacctggggctttcacaatgaccgagagcattacaaactgcaagagccaacagtcgacagatgctgaagaacctgtggccagtacagtgaaagaacagttaccgaaagacatggatattgggccagatgaaaagaagggtgagggagctctgttttatgaacctcctcggttcccaggtttggatgtcccatttatcagttgcgatcttgtaacatctgctgatatgcaagaatttagtccccttggtattcggcagtggatgaggtcaaccatgaatgtccccactcctttaagattatggggatccccgacacatgatgaaagcccaggtgtgctaaagagtgctgccgaaagcttcccatgcacaccatcaataatgaagaaaagacagagaggtctattatctcctactccagataaaagaattgagaagaaatctgggattgcaaaggagatgacagacatctcctatatgattgcagccacatgttccatgaatgcaaccaaagatgaagcaactgctcctgaatcagttgcgtgtgctgaacaacatctagatgagaaacttaagttctctgatggtaacagggaaaatttcaatggagcacctgaacaggcaagagatgcacaaaatggaggaaacaaacaaggagggcaacattgttcctcattaaatgttgccaatcctaatactgatctgccagacaatttacaacctgtcggtgttcttgttgagcacaactgcaatgacatcattgccgctgatcatggtgcaaagcctgaatctttgtcatcctgcaaggaagcagttagttcaaaaccaaagcctgcagaactagttgttgagaaatcatcaccatgcatcaatgcgaattatgaatatgtgaacttattggctgataccccaggtgtcaaaaaaggactggaatctccttctgcatggaagtctccctggtatatagatatgcacatgcactttcagggttttgtcagcccagcagacagaacttatgacgcattaggattagtgaagcagataagtaagcaaagtgctgctgctgcagtggaggcctgtgaggtgctagcaagcggcagcagaatctttgataaagaaaacaaggagaatagagatgataaggagccagggacaagaaaatcacagaccaaaatcatggccgaggcacgagtcctggatttcgacgaatattccacacctgcaaaggcagcagataagagacttggcagctgtctcggaagatctgttagctcaccgattctttcctccccaaacctgagaagttttcgataggtagacttgtgagagatacaccagatatgtcccaataatacataaccgtatgtacatgcatgttcctagagctcattgttctcatttgttactgtgtattgtcagttgttaccgttatttcagcgtacagtctcagcccagaaactagcttcccaaaggcggcagtatcagtggactgttaacttatgtatcattcaaatttaatttactattggttagtagtggtagtttacattggaggcg

SEQ ID NO: 2973 - DNA, 3061 bp, Zea mays
ccatcccctctcaatcgcctccgcggctccgcctccccctcccccaaatttgaaacctccgaggcggacgcgaggcgaagccgtgcgtcggtcatcgagacggccggctgggcgaccgcgccgccgcctctctcctctcgttgcgtgccgcgggggttgcccgcacttgggcgcgcgctcgggcgcggggttggatgcagctccgccgacgtaggtgctcgtcgatcgcgtcggccacaccgggacggtggtaatcatgccgagtgataaagcaaaagctccaaagaagaagggcgaagaggatcctggaatcccgccagctccctgtgaaggagaaattagccatgagccacatagacaacggtcactcaatgggtggcaaaaggttctaaaccctgaattggtcaaagggccatggtccaaagaagaagacgaaatcatagttcagatggtaaacaaatacgggccaaagaaatggtcggccatcgctcaagctttgcctggacgcataggaaagcaatgccgggagcggtggcacaatcatcttaacccagccataaacaaggaggcatggacgcaagaagaggagattactcttattcatgctcataggatgtatggaaataaatgggccgaacttacgaaatttttacctggaaggacggacaatgcaattaaaaatcactggaacagttcagtgaagaaaaaggtcgattcgtacatatcttctggtttactttcacaagtcccatgcctctctctgattgaatgtcctgcacaatgtgactctttatcggctatggaccaacaaaacaacggaggtactgattgcaatgaccagaacactagcgtggtcttaagctctgatttacaagtaaatgtggatgccaacaagaaagaagcacatgactctcactcgtccttgtgtcaaggggtatgctatccttccacagagactgtaggatctgttttgcctgatgacctggagatggatatggatgaaggatcaggaaactctatttttgcagacgatcaaactctttgtagcacatcaaatcaagaacaatctatggtgccatttgttgttgcacaggaaatgcctgtctctgtgctatcaagtgtttctagcgctgagcagaaacggcacttaatctctgatgccaaaagcttgaaatccgaactttggaaagatgtttgtttgcaaactcttattacaggagatacagatgaccctgatgcttcttcaagattaaataacccagattcttctaaaatggacaccaattttttgaaagaggcctacccattacacacaccaaatccatccagtgtgattgaaactgtatatgaaccgatggcgttggtgacaatctctcccccttttatatgttcagatggtttgtctttcgcacccgaaaatagatctaagccaggagaaatgtcagactgtgaagcagagatggtcacatgctcaaacaatttttttggtaatgccgagcaatctgctaaacttgccagcagtgatgacaggccagaggctttcacaatgactgagagcactacaaactgtgggggtgaacaattgacagatgccaaagaacctgtggccagtacagcaaaagaacggttatcgaaagacatcgagactatgccagataaaaagaagggtgagggggctctattctatgaacctcctcgattccctggtttggatgtcccgtttatcagttgcgatcttgtaacttctgctgatctgcaagaatttagtccccttggaattaggcagtggatgcggtcgaccatgaatgtcccaactcctttaagattatggggctctccaacacatgatgaaagcccagatgcactaaaaactgctgctgaaagcttcccatgcacaagttcaataatgaaaaaaagacagagaagtctattgtcccctactccagatgaaagaattgagaagaaatctgggattgcaaagggggtgacggacatctcctatatgataacggccacatgttccatgaatgcaaccaatgatgaagacattgttactgaatcagctgtgtgtgctaagcaaccttctttgaaacatctagacaagaagcttgagttctctgacattaacaaggaaaactctgatggagcatctgaacaggccaaagatgcacaaaacacacaactcgtggatgagcaacattcctcaccaaatgttgtgaatcctaacactgatctacaagacaatatacaacctgtacagattcttgtagagcaaagcagcaataaccttatttcctctgatcatggtgcaaagccatcctgtaaggaagtgattagttcaaaatcaaagcctacaaaactacttgttgaaaaatcatcaccatgtatcaacgtggattacgaatatgtgaatttattggctgataccccaggtatcaaaagaggactcgaatctccatctgcatggaagtctccttggtatatcgatatgcacatgcactttcagggttttgtcagcccagcagacagaacttatgacgcgttaggattagtgaatcgtttaagcaagcacagtgctgctgctgcagtggaggcctgtgagatgctagcaagtggcaacacgacttctgataaggaaaacaaggataatacggatggcaaggaactagtgacaagaaaatcacagattaagatcatggccgaggcgcgagtcctggatttcgacgaatctcccgcacctgcaagaacagcagataagaaacttggcagctgtcaccggagatctgttagctcacccattcttccttcccccaaccttagaagtttccgataggtacaccatatatggcatcatcgtacattacccacctgcatgtattggtgaactctattgttattatgtctccttagagcgcgttgttgaaactattggagcgtttcctttctttcgttactctattgttattactattattatgtctctcagcccggaaacaggcatcagtaccagtgaactgttgaaactaccctaatcattcaaattaaattattatattgcccg

SEQ ID NO: 2974 - DNA, 1690 bp, Zea mays
ctcgttcccctccaccactccgtctccttcctattgctgagtgcggcacccttgcctataataaaccccgccgcacgcccgcaccggagaagaaagctcccaagtcccaatccacgttcctcgccccctgccgctccggagagtcatggccaccgccgtttccacccccgcggacctgtcgcccacgcctgccccgagacggcggggccggccgccgaagaaccccgccccagccgaggccccaggcagcccggcggaccaagcggaggtgattggggactacgagcgcgagagggacgcgaggatccgggagaacatggagcggatgcagaagctcggcatcctcgacctcgcgcacaccctcagccactgcgccgccgcctcgggtctgggtaccggcagcgggcggtggcgccggaagcccgtggagccggggtctgctggtggggccagggtgaagcccgcgtcgccggcgccctcgcggagatcgctcaggttgaaggacgtggaaccggttacctatcgtgaaattgagccaaagaaagagaaacgctctgaaggtggcaaaactgttttaatggaggtgggagccaaggaagaaatatacactgaagagcatgacaagcttttgggtacatgcaacactccttggactctctttgttgatggttatggcaaagatggaaaacgcatttatgatcaagtgaggggtcaaacctgtcatcagtgccgtcagaagactcttggtcatcatacaagctgctgtaaatgccagattgtccaaggacagttctgtggagactgtttgtacatgaggtatggtgaaaatgtgttagaggttaagaagaatcctaactggatatgtccagtttgccgtggcatctgtaattgcagtctatgcagaactaagaaaggatggttccctactgggtctgcgtataggaaggcgatcggacttgggtacaaatctgtggcacactttctaattgcaacacatcgagcatcatcagtcaattcaagctcagtcgacaataacaagctgccgtctgctaaatctgaaacctcgtgcatttctgaccatgccaatgagagcccagaggatggagaaacgaccagcaaagctaagcagaacaaagcaactcgccgccgagtgaggaagagttctgatggcgacaacgatagcagaagtgggtccgtggtgacatctgactgccaggatgatcaagccaacaaggatgctgggtgtgtgactccgtcgtctaagccagcgtcaacgaagaggaagtacgttgaacgaagccctgactgcatcgcaagcaggctgcggtctcggctcaatatgccatgagcccatgaagatgtgatcaggatcatgtatctcttttactgcctgaccgcaggctctgtcccttcttgcgatgatgttgtggctctttcatctacaagcagttcatggtttgccagtaacgatgttctgcgcgagtaagaaggtgattgttatagtctcttgcgcagctgtgttaagagcttgaaactagactcagtcatgtgtagtatttgtaccattagtgccaactgtggtctctggcattagtgcctactgtggtttgtgagctatgagttgacgcgatagcctgtagctttaatgtacaattcatgatatgcaagtgaatatgttcattttcagctg

SEQ ID NO: 2975 - DNA, 1950 bp, Solanum phureja
tctctttttcactttcactctcactttcactaacaatggagggccgccattctcatccatctactccaatccccgacgactttgttcagaagcggggcaagaaacggggtagttataactgtgggagatgtggccttccgaaaaaaggacatgtttgtgatttgactaaggagattagtgaagttcctactcctacatctagtgatgctaagtcatttgttttgccttctccgctttctgttgttcgtactaagcctactccacctctacctccgccacgtcaggcggttcctcagctccggcgagcactttcatttgatgacattggtgttactgatgaatcgcctggatctgatgatgatgagggtgtggatgagggggagtttttggattttgagagtgagttggatttaggtggatctgggaagttgccggcgaattgtttgtgggaagtgtttaagagattgccaccgtcgtcgttgctttcttcggcgaaggtgtgtaagggttggagggatgtttctaggaggatttggaagtcggctgaggagcttagacttgaggttcctgtgaaggctcagattgggcttgttggatcggtgttgcagaagtgtcctggacttgttaagctttctcttagaatgaaaagtgatgtggatgccacaatgctggcctgcattgcattttcctgccctaatctggattcactggagatcctcacttctgaaacctcagtcaatcggatcactggggatgaattaggtcgttttgttgctgataaaaggtgtcttgccaatcttaagatggaaggctgctcaaatctcgggggctttactctttcttcaaccagcctttccactctttgcctttcggaactcttttgtcactctaagatggtcttcaactgccccaatttgaaggagatctccctgattttttctcgtcaagagaatgaaaacactgatcttacagctatggtgaatggtcttggaaggagctgtccaagactacagaacattcatgttgcctcagttcggctgacacatgctgttgtgcttgctctaacagcagcaaatttaaggggattaagaatgctttcacttgtactaggatcagaaattactgatgcatctgttgctgctattgcttcgagctactcgaggctcgaattacttgatttgagtgggtctagtattagtgacagtggcattgggatgatatgcaatgtatttccggagacattgttgaaacttctccttgctctttgtccaaacatcacatcaagtggcatacaatttgctgcagctcagttgcctaatctagagctaatggattgtggaatgagcatatgcgatccagatctagacagtccagcagcacaggaaaatgatactgtcgagttacaaagaacaccaagtagtaaattacaccttatttatcagaaactgattattaagcacagccacttgaagaaattcagcttatggggttgctctggcttagatgcattatatcttaattgcccagagcttagtgatttgaacctgaactcttgtatgaatttgaatccaggaagattgctacttcagtgccccaatctggaaagtgtacatgcatcaggttgccaagacacattggttgaaactcttcagaatcaggtttgtggtgattttatggctgaagacgatcattatccttgtaaacgtcttcctgatggctcaaaaaggatcagagttcctcattcatacagtccccagccatttgatgatggaaagagaaagagaaggctttcaaagcaacattgtgcagtgcttgtttattagtcagaaactcatcttgtactggctttgttgttactctaggccatcttatttatctattctttgtactatagcaatctgaggtcaaggcctaatcatgtaatcttcattgatagaactaaactcaata

SEQ ID NO: 2976 - DNA, 2116 bp, Capsicum annuum
caaaatgtgccaaaattccgcgccttccgacccacaccctccgccctttatttcttcgccattctgaccgcactttcatctcctcttctttcctctttttgacttttacctctcaattcactcggaaatcccaaatgaagggccgcctttcccacccatctactcctatccccaacgacttcgttcgtaagaccggcaaaaaacgtggcggctacaactgtggccgatgtggtcttccaaaaaaaggccatgtttgtgattttactaaggatagtattaatgaagttcctacgccgacatctggtgatgctaaatcctttgtttcaccttctatgagttctgttattcgtcctcagccccctcctccaccaccgccacgtcaggcagttcctcagctccggcgagcactttcatttgatgacattggtgttacggatgaatcacctggatctgatgatgatgatgatgagagggaggaacttttggatcttgagagtgaattagatataagtgggtctgggaagttgccggcgaattgtttatgggaagtgcttaagagattgcctccatcgtcgttgctttcttcggcgaaggtgtgtaaaggttggagggatgtttctagaaggatttggaggtcggctgaggagctcagacttggggtacctgtgaatgctcaaattggacttgttggatcagtgttgaagaagtgtcctggacttgttaagctttctcttagaatgaaaagtgatgtggatgcaacaatgctggcatgcattgcattttcctgtcctaatttggattcactggagatcctcacttctgacacctccgtcaatcgaatcacaggggatgaattaggtcgttttgttgctgaaaaaaggtgtcttaccaaccttaagatggaaggctgctcaaatcttgggggatttactctttcttcaaccagcctttccgctctctgcctttcggatctcttttgccactctaagatggtcttcaactgcccaaatttgaaggagatttccctggaattttctcgccaagagaatgacaatactgatcttactgctatggtggatggtctcggaaagagctgcccaagactacagaacattcatgttgcttcagttcggcttacacatgctgttgttcttgctctaacagcagcaaatttaaggggattaagaatgctttcccttgtattaggctcagaaataactgatgcgtctgttgctgctatatcttcaagctactcgtggcttgagttacttgatttgagtgggtctagtatcactgacagcggcatcggaatgatatgcaatgtatttccagagacattgtctaaccttctccttgcgctttgtccaaatatcacctcaagtggtatacaatttgctgcagctcagttgcccaatctagaactaatggactgtggaatgagcatatgcaatccagatctagacagtcctacaagtcagaaaaatgataatgtcgagttacaaagaacaccaagtagtaaattacaccttatatatcagaaactgattattaagcacagccgcttgaagaaactcagtttatggggttgctctagcttagattcattatatctaaattgcccagagcttaatgatttgaacctgaactcttgtatcaatttgaatccagaaagattgctacttcagtgtcccaatctggaaagtgtacatgcatcaggttgtgaagacacattggttgaaactcttaagaatcaggttagtgatgattttacggctgaagattattttccttgcaaacgtcttcctgatggctcaaaaaggattagagttcctctcttgtacagcccccaggtaataccgagaagcttgcatcactacaagccgttcgatgatgcaaagagaaagagaaggatttcaaagcaacgcagtgcagtgcttgtttattagtcagatacttgtcttgtactggctttgttgttacttccggccatatgaacttgtgtctattctttgtcatacagtgatccgaggctaaagcctaatcatgttatccttatttataggattattctcaatgtcaatacagggattatatgccctttatcaataaaaagtgc

SEQ ID NO: 2977 - DNA, 2022 bp, Nicotiana benthamiana
cacacacacacactaatctccttgattctttcctcttcccttcactttcacacagtcaaatcatttcattttcattttcactctcaaatccaaaaatggaaatcccccatccgcacccctccacccccatctccgacgccttcgtccacaagcgcggcaagaaacgcggccgatgtgggcagcccaaaaaaggccacgtttaccatatccctaaggaccttaatgatactaatcctactgaagttcctactcccctgcccagtgaatctaaatcctttgttctcccttctccgctctctgttattcgtcctcagcaactttcgctcccgccacatcagccacttccccagctccggcgagcgctttctttcgatgacgtcgatgtcagcgatgatgagtcgcctggatctgatgatgatgacgtggaatatttggatctggagaatgagttggatttagttgggtccgggaagttaccagcgagtgctttgtgggaagtgcttaagagattgcctccatcagctctgctttctgcggcgaaggtgtgtaagtgttggagggatgtttctagaaggatctggaagtcggctgaggagcttcgacttggagttcctgtgaaagctcagattgggcttgttggatcggtgttgcagaagtgtcctggacttgttaagctttcacttagaatggaaagtgatgtggatgcaacaatgctggcctgcattgcattttcctgccctaatctggattcaatggagatccttacttcaggcagctcaattaatcggatcacaggggatgaattaggccgttttgttgctgacagaaggtgccttaccaatctcaagatggaaggcggccctttactctttcttcaaccagcatttccactctttgcctttcggatctcttttgccactctaagatggtcttcaactgccccaatttaaaggagatttccctgaattttgctcgccaagagaaggatagcactgatcttactgctatggtagatggtgttggaaggagctgcccaagactacagaacattcatgtcgcttctgttcggcttacacatgctgttgtgcttgctctaacagcagcaaatttaaggggattacgaatgctttcccttgtactagggtccgaaataactgatgcatctgtcgctgctattgcttcaagctactcgatgcttgagttacttgatttgagtgggtcgagtattagtgacagtggcattgggatgatatgcaatgtatttccagagacattgtctaaacttctcctttctctttgtccaaatatcacttcaagtggaattcaatttgctgcagctcagttgcctaatctagagataatggattgtggaatgaccatttgcgatccagatttagacagtccaactactcaggaaagtgataatggcaagttacaaagaacaccgattagtaaaatacaccttatatatcagaaactgattatcaaacacagccgcttaaagaaactcagcttatggggttgctctggcttagatgcattatatctaaattgcccagagcttaatgatttgaacctgaactcttgtacaaacatgaatccagaaagattgctacttcaatgccccaatctggaaagtgtgcatgcatcatgctgtcaagacacattggttgaaactcttcagaatcaggtttgtggtgattttgtggatggagacaatcattttccatccaaatgtcttcctgatggctcaaaaaggataagagttcctcacttattcagcccccagccatttgataatgagaagagaaagagaaggatttcaaagcaacggtgctcggtgcttgtttattagtcaaatactagtcttgtactggctttgttgcactctaggccaattgtccattatttgttatatagtgatctgaggctaaggcctgatcatgtaattgattaaactatacccaatgtcaatacatggattgtattccctcttatcaataagaagtacttggctccggg

SEQ ID NO: 2978 - DNA, 958 bp, Arabidopsis lyrata
aatttggaagaaaagcagaagtgtgagaagacgatctagattctggatacagctggaagagaattataagaaaaacaaaatcttcgaacgaagatcgaattgcttcgagtctctgaggaaagaagaaattatgggacgtgtggattatctagcgatgaagaccgacgacgtcgatacggtggcggcgttagtcaattccgacatggaagagctcaaggtcgctgcaaagaaactctttagcgatgtttcgaagcttggtggattaggcttcggtgtttcttttctcaaattcatcgcttctttcgctgccatctacttgttaatattggatcgtaccaattggaaaaccaagatgcttacatcactcttaataccatacatcttccttagccttcctagtgtcatttttaactttctcagtggagaagttgggaaatggattgctttcgttgcagttgtactcagacttttcttccctaagcatttcccagattggcttgagatgccgggttctctaatccttctactggtagttgctccacacttcctagctcaccatatacgtggaacctggattggcactgtaatcagccttttcattggctgttaccttcttcaagaacatatccgagcatcgggtgggttcaggaattcattcacacagccccgtggagtgtcaaacactttagggatcatccttcttttggtctaccctgtttgggctctaatcgtccgtgtcatgtaatccacattcctattccattctccaagttgtttctagctcggctgcttcaataaactgcgtgaaacatcgagagctgagcaagaatctgtggtgttcctttcttctgattatgttgcatacccaaatactacctcatgctcaatcaatgttctatatataaaagaatctcatttttcaaatatttgtttgtcctactgtatgaaaaaagttctg

SEQ ID NO: 2979 - DNA, 988 bp, Raphanus sativus
ggaccataatcggtaaacaaagagaactatttatgagaaaagaataaaaagcaagttgaaaagcatagaagcccatcatactgaattaccgacagtgacagataggctggaggaaactctttctcgaagaataaaatataaaaacctcgaaattattgtcttcataatacgaaagatcaattattcagctgaggaaagaataaagtaatggggcgtgtggattacctagcgatgaagtccgacgacgtcgacacggttgctttggtcaactccgacgtggaggagctcaagatcgctgccaagaagctcttcagcgatgtctcgaagcttggtggatcagcctttggtgtttctttcgtcaaatggatggcttgcttcgctgccatttacttgttgatattggatcgtacaaattggagaagcaagatgcttacatcactcttgataccatacatcttccttagccttcctggtgtgattttcaacttcctcagtggagacgttgggaaatggattgcgttcgttgcagttgtgctcagacttttcttccctaagcatttcccagattggctagagatgcctggttctctgatccttctgctagtagtgtctccacattttctagctcaccatatacgtggaacctggattggctctgtcatcggtcttttcataggctgttaccttcttcaagaacatatccgagtctcaggtgggttcaggaattcgttcacgcagccccgtggagtatccaacactctagggatcatccttattctggtctaccctgtttgggctctaatcgttcgtgtcacaaaatagacattccctgttccatttccctcaagttgtatatgtcttgtctaataaaattccctagtgctctgcttctcttacatacccttatactactgtctcaagctcaatcaatgttccatattataaaaaaaaagaatctcattttttcaactatttgtttgtacttatc

SEQ ID NO: 2980 - DNA, 1104 bp, Eutrema halophilum
gggaaatctgagaatcgtgagaagacgacctggataagctgaacctagctggaggaatataataattttgaaagagatattaaataagtaaataaaaaagcttcaaaattattgtctttgaaaacgaagatcgattatcgttttgattcggctggagaaagaagaagaagaacagaaaaacaatggggcgtgtggattatctggcgatgaagaccgacgttgatacggttgctctggtcaattccgacttggaggagctcaagatcgctgcgaagaaactcgtcagcgatgtttcgaagcttggtggattagcctttggtgtttctttcgtcaaatggatcgcttctttcgctgccatttacttgttaatattggatcgtaccaattggagaaccaagatgcttacagcactcttgataccatacatcttccttagccttcctggtgtgatttttaactttctcagtggagacgttgggaaatggatagctttcgttgcagttgtactcagactcttcttccccaagcatttccctgattggcttgagatgccaggttctctgatccttctgctggtagtttctccacacttcctagtgcatcatatacgcggaacctggattggctcggtcatcagcctttttataggatgttaccttcttcaagaacatatccgtgtaacgggtgggttcaggagttcattcacgcagccccgtggaatatcaaacactttagggatcatccttcttttggtctaccctgtctgggctctgatcgttcgtgtctcataaaacccacattcctctcaatttcatctccaagttgtgttcttgctcggctggtccaataaaaacttcgtgaaagatcgagcaagaacctatctttctgcttctgttacatacccaaatactactgcctcaacgcaaagctcaatcaatgttccatatatataaaaaaaaagaatctcgtttttttcaactatttgtttgtctattgtaagaagaacttgtaagttctgaaaagttgtttcgatgtaaattgcttatgaattttgtttcgtatatgccgtcgtggaatgtttgtcgttttggtatagcaaaaagt

SEQ ID NO: 2981 - DNA, 1065 bp, Eutrema parvulum
aaagccgagaagcgtgagaagacgatctaatagctgaacctagctggaggaatatttttaaagcgaaataaaaattatatagaaaagctcaaaattattgacttcaaacgaagatcgattatcgttttgattcggctggagaaagaagaagaagaacagaaaaacaatggggcgtgtggattatctggcgatgaagaccgacgttgatacggttgctctggtcaattccgacttggaggagctcaagatcgctgcgaagaaactcgtcagcgatgtttcgaagcttggtggattagcctttggtgtttctttcgtcaaatggatcgcttctttcgctgccatttacttgttaatattggatcgtaccaattggagaaccaagatgcttacagcactcttgataccatacatcttccttagccttcctggtgtgatttttaactttctcagtggagacgttgggaaatggatagctttcgttgcagttgtactcagactcttcttccccaagcatttccctgattggcttgagatgccaggttctctgatccttctgctggtagtttctccacacttcctagtgcatcatatacgcggaacctggattggctcggtcatcagcctttttataggatgttaccttcttcaagaacatatccgtgtaacgggtgggttcaggagttcattcacgcagccccgtggaatatcaaacactttagggatcatccttcttttggtctaccctgtctgggctctgatcgttcgtgtctcataaaacccacattcctctcaatttcatctccaagttgtgttcttgctcggctggtccaataaaaacttcgtgaaagatcgagcaagaacctatctttctgcttctgttacatacccaaatactactgcctcaacgcaaagctcaatcaatgttccatagaaaaaagaacctcattctttcaactatttgttcgtctattgtaagacgaacttccaagttctgaaatttgttgtgtaaaaattgcttatggatccgtatggtatatgcacttatggaatgtttgtcgttttggt

SEQ ID NO: 2982 - DNA, 679 bp, Brassica oleracea
taggaagatcgagtatcgtctaggaaggatggggcgtgtggattatctggcgatgaagacagacgtggataaggttgctttagtcaattccgacgtggaggagctcaagatcgctgccaagaaactcctcaccgatgtttcgaaacttggtggtttagcctttggtgtttccttcgtcaaatggatcgcttctttctccgccatttacttgttgatattggatcgtaccaattggagaaccaagatgcttacttcactcttgattccatacatcttcctcacccttcctggtgtcatttttaatttcctcagtggagacgttgggaaatggatagctttcgttgcagttgtactcagacttttcttccctaagcatttcccagattggcttgagatgcctggttctctgatccttctgctggtagtttctccacacttccttgttcaccatatacgcggaggctggattggctctgtcatcagccttttcattggttgttaccttcttcaagaacatatcagagtgtcaggtgggttcaggaactcgttcacgcagccccgtggagtttcaaacactttggggatcatccttcttcttgtctaccctgtttgggctcttatcatccgtgtctcataatcaccaccattcaacttcccatctccaagctgtgtccaataa
